United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 6

SEQ ID NO: 16526 - DNA, 1198 bp, Artificial Sequence
  chemically treated genomic DNA (Homo sapiens) CpG-island No: 16526
ccaaaatcatcatataaaactaaaaaactccccttaacaacaaccgcccaaaaaactacccaacaaaaacccgcaacgacgacccgaacgaaacgaaaccgaaaacgaaaaaatcccgaccgacaacaaacaacccgcctcgacccccgtaccgaatcaccgaaacacccgtaattcaccttccattttatcaaaaacctcctaataaaaaaaaatacccctaaaatccgccgctatcatccccgaaaaacgcgcgaaaccgaaaacgacgacgataacgatacgcgaaaaatatacgaccgaaccgacgacaaccgcgacactaataacgacgtccgccgcgcctcgaaatcccactcgctaaaataactaatccgcgcgcgaccgacgcgaacgacgacgacaacgacaaacaaaacgacccgaaccccgccgccgccgcccgcccgtcgacccccaccccgccccgccccgccccgcccgaaccgcccgaaaactcgaaaacccgaaccgaacctccccgccccccgacgcgaaacgcactcctcgaaataacaaaaacgcccgtacaaccataacgctcgaccgctccaaaacccgcaacgacgcccccgaccctccgaaccgcccgccccgaaccgcgaacgccgaaaccgaaaccgaaacccgccgaacgccccgccgaccgctccgcccgcctcccctaccctcgccgaaaaccaacgccgcgccaaccatattaacgacgacgacgacgccgaacgaacgaaaaacgaaaaaaaaacgaccgacccgcgcccccccgaaccaccgaacgtccgcgacgaccatattaacgcaaaaccaacgacgtaacctacgaaaccgcgcgacgccgaaccaaacccgaaaacgaaatttacccgtacgacgacccccgacgaacaccaaccgcgcaacccccgacgaacaccgaccgcccgttccccaacgaaatccgtcgcgaaccgaaaaactcccgacccccttcccgctaccgccgcccaacgcccacaacccgcaaccgcccctctactcgcccaaccgccgcaaccgcaactacccaaacatctaacctcgaaaaccctaaattcccgactacgacccctaaaaccgccacgaacgaacgtccgccgaaaaaaccgacccccgaaaacgaaaaactcgaaaaacgcgttaa

SEQ ID NO: 16527 - DNA, 1198 bp, Artificial Sequence
  chemically treated genomic DNA (Homo sapiens) CpG-island No: 16527
ttaaggttattatgtaaaattaaagagttttttttggtagtagtcgtttaggaggttgtttaatagagattcgtagcggcggttcgggcggggcgggatcgggagcgggggagtttcggtcggtagtaggtagttcgtttcggttttcgtgtcgggttatcgggatattcgtaatttattttttattttgttaaaagttttttgatgaaagaaagtgtttttgaaattcgtcgttgttattttcgggggacgcgcggggtcgggggcggcggcggtggcggtgcgcggggggtgtgcggtcgggtcggcggtagtcgcggtattggtggcggcgttcgtcgcgtttcggagttttattcgttaaaatggttgattcgcgcgcggtcggcgcgggcggcggcgatagcggtaaataaagcggttcgggtttcgtcgtcgtcgttcgttcgtcggtttttatttcgtttcgtttcgtttcgttcgggtcgttcgggggttcgggggttcgggtcggattttttcgtttttcggcgcggggcgtatttttcgggataataaaggcgttcgtgtagttatgacgttcggtcgttttagggttcgtagcggcgttttcggtttttcgagtcgttcgtttcgggtcgcgggcgtcggggtcgaggtcggagttcgtcgggcgtttcgtcgatcgtttcgttcgttttttttgttttcgtcggaggttagcgtcgcgttagttatgttagcggcggcggcggcgtcgggcgggcgggaggcgagaggggggcggtcggttcgcgttttttcgggttatcgggcgttcgcgacggttatgttaacgtagagttagcggcgtagtttgcgggatcgcgcggcgtcgggttaagttcgggagcgaagtttgttcgtgcggcggttttcggcgggtattagtcgcgtagttttcggcgggtatcggtcgttcgttttttagcggagttcgtcgcgggtcggggaattttcggtttttttttcgttgtcgtcgtttagcgtttatagttcgtagtcgtttttttgttcgtttagtcgtcgtagtcgtagttgtttaaatatttggtttcgggggttttgggttttcggttgcggtttttggggtcgttacgggcgggcgttcgtcgagggggtcgattttcgaaagcggggagttcggggaacgcgttgg

SEQ ID NO: 16528 - DNA, 1198 bp, Artificial Sequence
  chemically treated genomic DNA (Homo sapiens) CpG-island No: 16528
ccaacgcgttccccgaactccccgctttcgaaaatcgaccccctcgacgaacgcccgcccgtaacgaccccaaaaaccgcaaccgaaaacccaaaacccccgaaaccaaatatttaaacaactacgactacgacgactaaacgaacaaaaaaacgactacgaactataaacgctaaacgacgacaacgaaaaaaaaaccgaaaattccccgacccgcgacgaactccgctaaaaaacgaacgaccgatacccgccgaaaactacgcgactaatacccgccgaaaaccgccgcacgaacaaacttcgctcccgaacttaacccgacgccgcgcgatcccgcaaactacgccgctaactctacgttaacataaccgtcgcgaacgcccgataacccgaaaaaacgcgaaccgaccgcccccctctcgcctcccgcccgcccgacgccgccgccgccgctaacataactaacgcgacgctaacctccgacgaaaacaaaaaaaacgaacgaaacgatcgacgaaacgcccgacgaactccgacctcgaccccgacgcccgcgacccgaaacgaacgactcgaaaaaccgaaaacgccgctacgaaccctaaaacgaccgaacgtcataactacacgaacgcctttattatcccgaaaaatacgccccgcgccgaaaaacgaaaaaatccgacccgaacccccgaacccccgaacgacccgaacgaaacgaaacgaaacgaaataaaaaccgacgaacgaacgacgacgacgaaacccgaaccgctttatttaccgctatcgccgccgcccgcgccgaccgcgcgcgaatcaaccattttaacgaataaaactccgaaacgcgacgaacgccgccaccaataccgcgactaccgccgacccgaccgcacaccccccgcgcaccgccaccgccgccgcccccgaccccgcgcgtcccccgaaaataacaacgacgaatttcaaaaacactttctttcatcaaaaaacttttaacaaaataaaaaataaattacgaatatcccgataacccgacacgaaaaccgaaacgaactacctactaccgaccgaaactcccccgctcccgatcccgccccgcccgaaccgccgctacgaatctctattaaacaacctcctaaacgactactaccaaaaaaaactctttaattttacataataaccttaa

SEQ ID NO: 16529 - DNA, 662 bp, Artificial Sequence
  chemically treated genomic DNA (Homo sapiens) CpG-island No: 16529
ggggcggtcgggtgtttatttttagagtttgtttagcgttttgttgagtttagcgttgtgtaggtgcgggtattggttcgcgagttttttgcgcgttgtttgagtttatattatgaaggcgtttatgggtcgtttgacgtgcggtttgtttttgttggcgtcgttgacgcgtacgggtatgggtattagcgtttagtcgtagtcgttgagtatttggttgacggtttcgcggatgtatacggggaatttgttatcgttcgtttcgtcgttttgttgtttttttttgattttgtttagttcgtttggtttcgggttggttcgtaggttcgattcgtcgtcgtcgtcgtcgggttttagcgagggcgcgtttttcggggataggtagcggggttttttcgagtttacggggtttagttttattttcgataggttttgttttttcgttatgtcgttttcggtcgtcgtcgtcgtcgtttcggtcgtttttttcgggttagtcgtcggggttttcgtaaagagtttaacgtttatttggatggaaggagggcgcgatggagcggtcgcgcgcgtagtttcgagggcggttcgagataggacgtgggtatagtttcgaggtggcggttttttttgttttagttaaatttatttggtttttggggttt

SEQ ID NO: 16530 - DNA, 662 bp, Artificial Sequence
  chemically treated genomic DNA (Homo sapiens) CpG-island No: 16530
aaaccccaaaaaccaaataaatttaactaaaacaaaaaaaaccgccacctcgaaactatacccacgtcctatctcgaaccgccctcgaaactacgcgcgcgaccgctccatcgcgccctccttccatccaaataaacgttaaactctttacgaaaaccccgacgactaacccgaaaaaaacgaccgaaacgacgacgacgacgaccgaaaacgacataacgaaaaaacaaaacctatcgaaaataaaactaaaccccgtaaactcgaaaaaaccccgctacctatccccgaaaaacgcgccctcgctaaaacccgacgacgacgacgacgaatcgaacctacgaaccaacccgaaaccaaacgaactaaacaaaatcaaaaaaaaacaacaaaacgacgaaacgaacgataacaaattccccgtatacatccgcgaaaccgtcaaccaaatactcaacgactacgactaaacgctaatacccatacccgtacgcgtcaacgacgccaacaaaaacaaaccgcacgtcaaacgacccataaacgccttcataatataaactcaaacaacgcgcaaaaaactcgcgaaccaatacccgcacctacacaacgctaaactcaacaaaacgctaaacaaactctaaaaataaacacccgaccgcccc

SEQ ID NO: 16531 - DNA, 662 bp, Artificial Sequence
  chemically treated genomic DNA (Homo sapiens) CpG-island No: 16531
gggttttaggggttagatgggtttagttggagtaggaagggtcgttatttcggggttgtgtttacgttttgtttcgggtcgttttcggggttgcgcgcgcggtcgttttatcgcgttttttttttatttaggtgggcgttggattttttgcgaggatttcggcggttggttcgggggaggcggtcgaggcggcggcggcggcggtcgggggcgatatggcggaggagtaggatttatcggaggtggagttgagtttcgtgggttcggaggagtttcgttgtttgttttcggggagcgcgttttcgttagggttcgacggcggcggcggcggatcgggtttgcgagttagttcggggttaggcgagttgggtaaggttaagaaggagtagtaggacggcgaggcggacgatgataagtttttcgtgtgtattcgcgaggtcgttagttaggtgtttagcggttacgattggacgttggtgtttatgttcgtgcgcgttaacggcgttagtaaaagtaagtcgtacgttaagcggtttatgaacgtttttatggtgtgggtttaggtagcgcgtaggaagttcgcggattagtattcgtatttgtataacgttgagtttagtaagacgttgggtaagttttggaggtgagtattcgatcgtttt

SEQ ID NO: 16532 - DNA, 662 bp, Artificial Sequence
  chemically treated genomic DNA (Homo sapiens) CpG-island No: 16532
aaaacgatcgaatactcacctccaaaacttacccaacgtcttactaaactcaacgttatacaaatacgaatactaatccgcgaacttcctacgcgctacctaaacccacaccataaaaacgttcataaaccgcttaacgtacgacttacttttactaacgccgttaacgcgcacgaacataaacaccaacgtccaatcgtaaccgctaaacacctaactaacgacctcgcgaatacacacgaaaaacttatcatcgtccgcctcgccgtcctactactccttcttaaccttacccaactcgcctaaccccgaactaactcgcaaacccgatccgccgccgccgccgtcgaaccctaacgaaaacgcgctccccgaaaacaaacaacgaaactcctccgaacccacgaaactcaactccacctccgataaatcctactcctccgccatatcgcccccgaccgccgccgccgccgcctcgaccgcctcccccgaaccaaccgccgaaatcctcgcaaaaaatccaacgcccacctaaataaaaaaaaaacgcgataaaacgaccgcgcgcgcaaccccgaaaacgacccgaaacaaaacgtaaacacaaccccgaaataacgacccttcctactccaactaaacccatctaacccctaaaaccc

SEQ ID NO: 16533 - DNA, 850 bp, Artificial Sequence
  chemically treated genomic DNA (Homo sapiens) CpG-island No: 16533
tgtcgcgttttatttcgacgcgggttttgtcgttggttagttggtttatttgtcggcgtagttttcgtatttttttttcgtagaggttttttaggcgcgatttgttttggtttttgagttgttcgagttcggttagtaggattttattttgttgttttaggaagcgtattttgtcgatgtagttggcgaagcggttatttagtttttgtagttttattttttcgttggtgcgggtgtttttgaattcggtgttgatggcgtcggttagcgagaagtttatcgagttttgtaggagtcgtatttcgggtacgttgtttcgtaggcgtacggtagaggagcgcgtggtatatacgtcgttcggggacgaggcgtagaggttgcggttggtgttggggcgtagcgcgttgtttaggttgtaggtgcgggtggacgtagttacgtagtttcggttggagttcggtcggttcgcggtgttcgggtcgtcgaatattttgcggtaggaggacgaggatacggatttggtggatatggttgcggagggtggcgatggtttgggcggcggcggtggcgcggattggttttcggagaagaggcgaacgagggcgcggtgggtgtgggtggtgggagcgcggttgcgtttttggcgcggggatttcggagcgagagtggtagaggattggatttcgtcgagggcgttgtttttataatttcgttaggaaagagggtttttttttattgttattttagtcgcggagcgcgttagttaatagggatttagcgagaagcggggagggtgggcgggtggggtgggggcgttttcgagtttttttgtttcggggtttgggattgg

SEQ ID NO: 16534 - DNA, 850 bp, Artificial Sequence
  chemically treated genomic DNA (Homo sapiens) CpG-island No: 16534
ccaatcccaaaccccgaaacaaaaaaactcgaaaacgcccccaccccacccgcccaccctccccgcttctcgctaaatccctattaactaacgcgctccgcgactaaaataacaataaaaaaaaaccctctttcctaacgaaattataaaaacaacgccctcgacgaaatccaatcctctaccactctcgctccgaaatccccgcgccaaaaacgcaaccgcgctcccaccacccacacccaccgcgccctcgttcgcctcttctccgaaaaccaatccgcgccaccgccgccgcccaaaccatcgccaccctccgcaaccatatccaccaaatccgtatcctcgtcctcctaccgcaaaatattcgacgacccgaacaccgcgaaccgaccgaactccaaccgaaactacgtaactacgtccacccgcacctacaacctaaacaacgcgctacgccccaacaccaaccgcaacctctacgcctcgtccccgaacgacgtatataccacgcgctcctctaccgtacgcctacgaaacaacgtacccgaaatacgactcctacaaaactcgataaacttctcgctaaccgacgccatcaacaccgaattcaaaaacacccgcaccaacgaaaaaataaaactacaaaaactaaataaccgcttcgccaactacatcgacaaaatacgcttcctaaaacaacaaaataaaatcctactaaccgaactcgaacaactcaaaaaccaaaacaaatcgcgcctaaaaaacctctacgaaaaaaaaatacgaaaactacgccgacaaataaaccaactaaccaacgacaaaacccgcgtcgaaataaaacgcgaca

SEQ ID NO: 16535 - DNA, 850 bp, Artificial Sequence
  chemically treated genomic DNA (Homo sapiens) CpG-island No: 16535
ttagttttaggtttcggagtaggaaggttcgagggcgtttttattttattcgtttatttttttcgtttttcgttaggtttttattggttggcgcgtttcgcggttgggatggtagtgggaggggatttttttttttaacggggttataaaaatagcgttttcggcggggtttagttttttgttattttcgtttcgaggttttcgcgttagagacgtagtcgcgtttttattatttatatttatcgcgttttcgttcgtttttttttcgggagttagttcgcgttatcgtcgtcgtttaggttatcgttatttttcgtagttatgtttattaggttcgtgttttcgtttttttatcgtaggatgttcggcggttcgggtatcgcgagtcggtcgagttttagtcggagttacgtgattacgtttattcgtatttatagtttgggtagcgcgttgcgttttagtattagtcgtagtttttacgtttcgttttcgggcggcgtgtatgttacgcgtttttttgtcgtgcgtttgcggagtagcgtgttcggggtgcggtttttgtaggattcggtggatttttcgttggtcgacgttattaatatcgagtttaagaatattcgtattaacgagaaggtggagttgtaggagttgaatgatcgtttcgttaattatatcgataaggtgcgttttttggagtagtagaataagattttgttggtcgagttcgagtagtttaagggttaaggtaagtcgcgtttgggggatttttacgaggaggagatgcgggagttgcgtcggtaggtggattagttaattaacgataaagttcgcgtcgaggtggagcgcgata

SEQ ID NO: 16536 - DNA, 850 bp, Artificial Sequence
  chemically treated genomic DNA (Homo sapiens) CpG-island No: 16536
tatcgcgctccacctcgacgcgaactttatcgttaattaactaatccacctaccgacgcaactcccgcatctcctcctcgtaaaaatcccccaaacgcgacttaccttaacccttaaactactcgaactcgaccaacaaaatcttattctactactccaaaaaacgcaccttatcgatataattaacgaaacgatcattcaactcctacaactccaccttctcgttaatacgaatattcttaaactcgatattaataacgtcgaccaacgaaaaatccaccgaatcctacaaaaaccgcaccccgaacacgctactccgcaaacgcacgacaaaaaaacgcgtaacatacacgccgcccgaaaacgaaacgtaaaaactacgactaatactaaaacgcaacgcgctacccaaactataaatacgaataaacgtaatcacgtaactccgactaaaactcgaccgactcgcgatacccgaaccgccgaacatcctacgataaaaaaacgaaaacacgaacctaataaacataactacgaaaaataacgataacctaaacgacgacgataacgcgaactaactcccgaaaaaaaaacgaacgaaaacgcgataaatataaataataaaaacgcgactacgtctctaacgcgaaaacctcgaaacgaaaataacaaaaaactaaaccccgccgaaaacgctatttttataaccccgttaaaaaaaaaaatcccctcccactaccatcccaaccgcgaaacgcgccaaccaataaaaacctaacgaaaaacgaaaaaaataaacgaataaaataaaaacgccctcgaaccttcctactccgaaacctaaaactaa

SEQ ID NO: 16537 - DNA, 609 bp, Artificial Sequence
  chemically treated genomic DNA (Homo sapiens) CpG-island No: 16537
taaaggggcgtgggaggaggtgcgcggcggtttcggggttgcggttaggcggggagattcgcgggtaaaggagcgggaagaggaaagagtaaggaattttttagatttgaagtcgcggagaaagaaataaagagcgtttgagattggaacgcggggtgggggcgcgtatagcgtaggaacgtagggtttaggtttcgtcgtagtttcgcgcgtcgttcgtttggaaaggggggttgtttcggttcgcgtttttgtttatcgatttgttttggcggagagatgttggggggaggggaggttttgtcgagggatttaacgggtttagtttagtttcggacggcgggagttgcgagacggcggtggtagaggaaagttcgagggagaggggtggggtcgtttagttatcggcggtgatttatcgcgttttgttgtttcgtcgattgagggtttttagcggtttaggggaaatcgttagattagattgatttaagttttagcgggtttcgcgcgcgttgttagtttttagtgttattaatttatagttgggttatcgttttgttgtgtgcggtcgggttttgtgggggataagagcgtttttaagtttttaat

SEQ ID NO: 16538 - DNA, 609 bp, Artificial Sequence
  chemically treated genomic DNA (Homo sapiens) CpG-island No: 16538
attaaaaacttaaaaacgctcttatcccccacaaaacccgaccgcacacaacaaaacgataacccaactataaattaataacactaaaaactaacaacgcgcgcgaaacccgctaaaacttaaatcaatctaatctaacgatttcccctaaaccgctaaaaaccctcaatcgacgaaacaacaaaacgcgataaatcaccgccgataactaaacgaccccacccctctccctcgaactttcctctaccaccgccgtctcgcaactcccgccgtccgaaactaaactaaacccgttaaatccctcgacaaaacctcccctccccccaacatctctccgccaaaacaaatcgataaacaaaaacgcgaaccgaaacaacccccctttccaaacgaacgacgcgcgaaactacgacgaaacctaaaccctacgttcctacgctatacgcgcccccaccccgcgttccaatctcaaacgctctttatttctttctccgcgacttcaaatctaaaaaattccttactctttcctcttcccgctcctttacccgcgaatctccccgcctaaccgcaaccccgaaaccgccgcgcacctcctcccacgccccttta

SEQ ID NO: 16539 - DNA, 609 bp, Artificial Sequence
  chemically treated genomic DNA (Homo sapiens) CpG-island No: 16539
attaaaaatttaggggcgtttttgttttttatagggttcgatcgtatatagtaaggcgatggtttagttgtaagttggtagtattgagaattagtagcgcgcgcggagttcgttgagatttgaattaatttggtttaacggttttttttaaatcgttaggagtttttaatcggcgggatagtagggcgcggtgagttatcgtcggtgattaagcgattttatttttttttttcgggtttttttttgttatcgtcgtttcgtaattttcgtcgttcgaagttggattgagttcgttaggtttttcgatagaattttttttttttttaatattttttcgttaaggtaagtcgatggatagaggcgcgggtcggagtagtttttttttttaagcgggcggcgcgcgaggttgcggcgaggtttgagttttgcgtttttgcgttgtgcgcgtttttatttcgcgttttaattttaggcgttttttgttttttttttcgcgattttagatttgagggattttttattttttttttttttcgtttttttgttcgcgggttttttcgtttgatcgtagtttcgagatcgtcgcgtatttttttttacgtttttttg

SEQ ID NO: 16540 - DNA, 609 bp, Artificial Sequence
  chemically treated genomic DNA (Homo sapiens) CpG-island No: 16540
caaaaaaacgtaaaaaaaaatacgcgacgatctcgaaactacgatcaaacgaaaaaacccgcgaacaaaaaaacgaaaaaaaaaaaaaataaaaaatccctcaaatctaaaatcgcgaaaaaaaaaacaaaaaacgcctaaaattaaaacgcgaaataaaaacgcgcacaacgcaaaaacgcaaaactcaaacctcgccgcaacctcgcgcgccgcccgcttaaaaaaaaaaactactccgacccgcgcctctatccatcgacttaccttaacgaaaaaatattaaaaaaaaaaaaaattctatcgaaaaacctaacgaactcaatccaacttcgaacgacgaaaattacgaaacgacgataacaaaaaaaaacccgaaaaaaaaaaataaaatcgcttaatcaccgacgataactcaccgcgccctactatcccgccgattaaaaactcctaacgatttaaaaaaaaccgttaaaccaaattaattcaaatctcaacgaactccgcgcgcgctactaattctcaatactaccaacttacaactaaaccatcgccttactatatacgatcgaaccctataaaaaacaaaaacgcccctaaatttttaat

SEQ ID NO: 16541 - DNA, 527 bp, Artificial Sequence
  chemically treated genomic DNA (Homo sapiens) CpG-island No: 16541
cgacgtggggaaataagttttagttttcgaagcgcgattaaaaggagaaattaagtttttatcgttagggcgggggagggaagttgggtgtcggtaggcgtttcgttggagacgagatttttttcggttttagaagcgtttcgttagggttagagagggcgagcgtggcgggagggaagtttttgttttttagcggttaggcgattcgaagtcgagcgtcgtgttatacgtatttcgtttcgttttgtttgcggtattttcgtgtaatttttatgaaaatgttttttcgtttttgacgtttcgcggtgtaatttttattttttaacgaggagggggtcgtcgtaggattgggaatttagtggtcggcgttttagtattttcggacgcgtttcgtgttttttttagtatttttttgagggatcgtttattgcgattttacgtagtgtcggttatttcgttttagtcgtagggagtattaaataaaagaatttttgtaaatttttttttttggatattcgcgggttttt

SEQ ID NO: 16542 - DNA, 527 bp, Artificial Sequence
  chemically treated genomic DNA (Homo sapiens) CpG-island No: 16542
aaaaacccgcgaatatccaaaaaaaaaaatttacaaaaattcttttatttaatactccctacgactaaaacgaaataaccgacactacgtaaaatcgcaataaacgatccctcaaaaaaatactaaaaaaaacacgaaacgcgtccgaaaatactaaaacgccgaccactaaattcccaatcctacgacgaccccctcctcgttaaaaaataaaaattacaccgcgaaacgtcaaaaacgaaaaaacattttcataaaaattacacgaaaataccgcaaacaaaacgaaacgaaatacgtataacacgacgctcgacttcgaatcgcctaaccgctaaaaaacaaaaacttccctcccgccacgctcgccctctctaaccctaacgaaacgcttctaaaaccgaaaaaaatctcgtctccaacgaaacgcctaccgacacccaacttccctcccccgccctaacgataaaaacttaatttctccttttaatcgcgcttcgaaaactaaaacttatttccccacgtcg

SEQ ID NO: 16543 - DNA, 527 bp, Artificial Sequence
  chemically treated genomic DNA (Homo sapiens) CpG-island No: 16543
agagattcgcgagtgtttagagagaaaagtttgtaaaagtttttttgtttgatgttttttgcggttagggcgaggtaatcgatattacgtggaatcgtagtaggcgattttttaaggggatattgggggaggtacggaacgcgttcgaaaatgttgggacgtcggttattggatttttagttttgcggcgatttttttttcgttgaggggtggaggttgtatcgcggggcgttagggacgggaggatatttttataggagttatacgggagtgtcgtaagtagggcgaggcggggtacgtgtgatacggcgttcggtttcgggtcgtttggtcgttgggggatagaggtttttttttcgttacgttcgttttttttggttttggcggggcgtttttggggtcgggaggagtttcgtttttagcggagcgtttgtcggtatttagtttttttttttcgttttggcggtgggaatttgatttttttttttggtcgcgtttcgggggttggagtttgtttttttacgtcg

SEQ ID NO: 16544 - DNA, 527 bp, Artificial Sequence
  chemically treated genomic DNA (Homo sapiens) CpG-island No: 16544
cgacgtaaaaaaacaaactccaacccccgaaacgcgaccaaaaaaaaaaatcaaattcccaccgccaaaacgaaaaaaaaaaactaaataccgacaaacgctccgctaaaaacgaaactcctcccgaccccaaaaacgccccgccaaaaccaaaaaaaacgaacgtaacgaaaaaaaaacctctatcccccaacgaccaaacgacccgaaaccgaacgccgtatcacacgtaccccgcctcgccctacttacgacactcccgtataactcctataaaaatatcctcccgtccctaacgccccgcgatacaacctccacccctcaacgaaaaaaaaatcgccgcaaaactaaaaatccaataaccgacgtcccaacattttcgaacgcgttccgtacctcccccaatatccccttaaaaaatcgcctactacgattccacgtaatatcgattacctcgccctaaccgcaaaaaacatcaaacaaaaaaacttttacaaacttttctctctaaacactcgcgaatctct

SEQ ID NO: 16545 - DNA, 881 bp, Artificial Sequence
  chemically treated genomic DNA (Homo sapiens) CpG-island No: 16545
  misc_feature (1)..(1): n is either a, c, g or t
  misc_feature (7)..(7): n is either a, c, g or t
  misc_feature (22)..(22): n is either a, c, g or t
  misc_feature (45)..(52): n is either a, c, g or t
  misc_feature (54)..(54): n is either a, c, g or t
  misc_feature (68)..(68): n is either a, c, g or t
  misc_feature (70)..(71): n is either a, c, g or t
  misc_feature (74)..(74): n is either a, c, g or t
  misc_feature (103)..(103): n is either a, c, g or t
  misc_feature (174)..(175): n is either a, c, g or t
  misc_feature (209)..(209): n is either a, c, g or t
  misc_feature (216)..(216): n is either a, c, g or t
  misc_feature (230)..(230): n is either a, c, g or t
  misc_feature (232)..(233): n is either a, c, g or t
  misc_feature (265)..(265): n is either a, c, g or t
  misc_feature (340)..(340): n is either a, c, g or t
  misc_feature (372)..(372): n is either a, c, g or t
  misc_feature (376)..(376): n is either a, c, g or t
  misc_feature (383)..(383): n is either a, c, g or t
  misc_feature (394)..(394): n is either a, c, g or t
  misc_feature (456)..(456): n is either a, c, g or t
  misc_feature (484)..(484): n is either a, c, g or t
  misc_feature (491)..(491): n is either a, c, g or t
  misc_feature (530)..(530): n is either a, c, g or t
  misc_feature (532)..(532): n is either a, c, g or t
  misc_feature (536)..(536): n is either a, c, g or t
  misc_feature (545)..(545): n is either a, c, g or t
  misc_feature (547)..(547): n is either a, c, g or t
  misc_feature (550)..(550): n is either a, c, g or t
  misc_feature (582)..(583): n is either a, c, g or t
  misc_feature (590)..(590): n is either a, c, g or t
  misc_feature (606)..(606): n is either a, c, g or t
  misc_feature (625)..(625): n is either a, c, g or t
  misc_feature (628)..(628): n is either a, c, g or t
  misc_feature (634)..(634): n is either a, c, g or t
  misc_feature (649)..(649): n is either a, c, g or t
  misc_feature (655)..(656): n is either a, c, g or t
  misc_feature (668)..(669): n is either a, c, g or t
  misc_feature (672)..(672): n is either a, c, g or t
  misc_feature (677)..(677): n is either a, c, g or t
  misc_feature (683)..(683): n is either a, c, g or t
  misc_feature (686)..(686): n is either a, c, g or t
  misc_feature (688)..(689): n is either a, c, g or t
  misc_feature (708)..(708): n is either a, c, g or t
  misc_feature (714)..(714): n is either a, c, g or t
  misc_feature (732)..(732): n is either a, c, g or t
  misc_feature (739)..(740): n is either a, c, g or t
  misc_feature (757)..(757): n is either a, c, g or t
  misc_feature (772)..(772): n is either a, c, g or t
  misc_feature (785)..(785): n is either a, c, g or t
  misc_feature (788)..(788): n is either a, c, g or t
  misc_feature (801)..(802): n is either a, c, g or t
  misc_feature (807)..(807): n is either a, c, g or t
  misc_feature (838)..(838): n is either a, c, g or t
ngtcgtngtttttcgttttcgngggggggggggcgtttcgttttnnnnnnnngnggttcgtcggcggngnnggngggaaaaaaaaaaaaaagcgcggcgggtngcggcggttcgcgggcggcggggggcgcggcgcgtcgcgtcggtcgcgtcgtcggcgcggcgtcgcgtttnngggcggcgtcggcggtcgcgggcgcgggggcggncggcgtncgcgcggggcgcgngnngggggggcgcgcgcggcggcgggggcgttcgngtcgtttttcgggcgcgcgggtcgcgggcgcgcggcgcggggcggggcggggggcgcgcgcgcggcggggcgttngcgcggggcgcggcggttcggttcgtcgcggncggncgcggtngcgcgtcgttncgcggcgggcggtcgcggcggcgttcggtcggcgggggcgtcggcgggggggtcgcggcggnggcgcgggcgcgcgcgcggcgtcgtcgncgcgggngcgcggcggttcgcgcgcgcgcggcggtcgcggtcggtntncggnggcgcgggngncgncgcgcgcgcgcgcgcgtcgtcgggggggggtnncggcggncgcgtttcggggtcgncggcggcgcggcgcgcgtnttngcgttncgcggcgcggcggtntcgcgnncgtcgcgcgttnnttncgttntcgcgnggngnncgcgtcgcgggcgggcggngcgcgnggacggcgcgggcggcgngcgcggnngcgggcggcgggcgcgncgcgcgggcgtcggngtcgcgggcgcgnggngggcgcgcgcgtnncgcgngggggggcgcgcgggcgcgggggcgggcgtnggcgcgcgggaaaaaaaacgaatatataaaaaataaaaagaga

SEQ ID NO: 16546 - DNA, 881 bp, Artificial Sequence
  chemically treated genomic DNA (Homo sapiens) CpG-island No: 16546
  misc_feature (44)..(44): n is either a, c, g or t
  misc_feature (75)..(75): n is either a, c, g or t
  misc_feature (80)..(81): n is either a, c, g or t
  misc_feature (94)..(94): n is either a, c, g or t
  misc_feature (97)..(97): n is either a, c, g or t
  misc_feature (110)..(110): n is either a, c, g or t
  misc_feature (125)..(125): n is either a, c, g or t
  misc_feature (142)..(143): n is either a, c, g or t
  misc_feature (150)..(150): n is either a, c, g or t
  misc_feature (168)..(168): n is either a, c, g or t
  misc_feature (174)..(174): n is either a, c, g or t
  misc_feature (193)..(194): n is either a, c, g or t
  misc_feature (196)..(196): n is either a, c, g or t
  misc_feature (199)..(199): n is either a, c, g or t
  misc_feature (205)..(205): n is either a, c, g or t
  misc_feature (210)..(210): n is either a, c, g or t
  misc_feature (213)..(214): n is either a, c, g or t
  misc_feature (226)..(227): n is either a, c, g or t
  misc_feature (233)..(233): n is either a, c, g or t
  misc_feature (248)..(248): n is either a, c, g or t
  misc_feature (254)..(254): n is either a, c, g or t
  misc_feature (257)..(257): n is either a, c, g or t
  misc_feature (276)..(276): n is either a, c, g or t
  misc_feature (292)..(292): n is either a, c, g or t
  misc_feature (299)..(300): n is either a, c, g or t
  misc_feature (332)..(332): n is either a, c, g or t
  misc_feature (335)..(335): n is either a, c, g or t
  misc_feature (337)..(337): n is either a, c, g or t
  misc_feature (346)..(346): n is either a, c, g or t
  misc_feature (350)..(350): n is either a, c, g or t
  misc_feature (352)..(352): n is either a, c, g or t
  misc_feature (391)..(391): n is either a, c, g or t
  misc_feature (398)..(398): n is either a, c, g or t
  misc_feature (426)..(426): n is either a, c, g or t
  misc_feature (488)..(488): n is either a, c, g or t
  misc_feature (499)..(499): n is either a, c, g or t
  misc_feature (506)..(506): n is either a, c, g or t
  misc_feature (510)..(510): n is either a, c, g or t
  misc_feature (542)..(542): n is either a, c, g or t
  misc_feature (617)..(617): n is either a, c, g or t
  misc_feature (649)..(650): n is either a, c, g or t
  misc_feature (652)..(652): n is either a, c, g or t
  misc_feature (666)..(666): n is either a, c, g or t
  misc_feature (673)..(673): n is either a, c, g or t
  misc_feature (707)..(708): n is either a, c, g or t
  misc_feature (779)..(779): n is either a, c, g or t
  misc_feature (808)..(808): n is either a, c, g or t
  misc_feature (811)..(812): n is either a, c, g or t
  misc_feature (814)..(814): n is either a, c, g or t
  misc_feature (828)..(828): n is either a, c, g or t
  misc_feature (830)..(837): n is either a, c, g or t
  misc_feature (860)..(860): n is either a, c, g or t
  misc_feature (875)..(875): n is either a, c, g or t
  misc_feature (881)..(881): n is either a, c, g or t
tctctttttattttttatatattcgttttttttcccgcgcgccnacgcccgcccccgcgcccgcgcgcccccccncgcgnnacgcgcgcgcccnccncgcgcccgcgacnccgacgcccgcgcgncgcgcccgccgcccgcnnccgcgcncgccgcccgcgccgtccncgcgcnccgcccgcccgcgacgcgnncnccncgcganaacgnaannaacgcgcgacgnncgcganaccgccgcgccgcgnaacgcnaanacgcgcgccgcgccgccgncgaccccgaaacgcgnccgccgnnacccccccccgacgacgcgcgcgcgcgcgcgncgncncccgcgccnccgnanaccgaccgcgaccgccgcgcgcgcgcgaaccgccgcgcncccgcgncgacgacgccgcgcgcgcgcccgcgccnccgccgcgacccccccgccgacgcccccgccgaccgaacgccgccgcgaccgcccgccgcgnaacgacgcgcnaccgcgnccgnccgcgacgaaccgaaccgccgcgccccgcgcnaacgccccgccgcgcgcgcgccccccgccccgccccgcgccgcgcgcccgcgacccgcgcgcccgaaaaacgacncgaacgcccccgccgccgcgcgcgcccccccnncncgcgccccgcgcgnacgccgnccgcccccgcgcccgcgaccgccgacgccgcccnnaaacgcgacgccgcgccgacgacgcgaccgacgcgacgcgccgcgccccccgccgcccgcgaaccgccgcnacccgccgcgcttttttttttttttcccnccnncnccgccgacgaaccncnnnnnnnnaaaacgaaacgcccccccccccncgaaaacgaaaaacnacgacn

SEQ ID NO: 16547 - DNA, 881 bp, Artificial Sequence
  chemically treated genomic DNA (Homo sapiens) CpG-island No: 16547
  misc_feature (44)..(44): n is either a, c, g or t
  misc_feature (75)..(75): n is either a, c, g or t
  misc_feature (80)..(81): n is either a, c, g or t
  misc_feature (94)..(94): n is either a, c, g or t
  misc_feature (97)..(97): n is either a, c, g or t
  misc_feature (110)..(110): n is either a, c, g or t
  misc_feature (125)..(125): n is either a, c, g or t
  misc_feature (142)..(143): n is either a, c, g or t
  misc_feature (150)..(150): n is either a, c, g or t
  misc_feature (168)..(168): n is either a, c, g or t
  misc_feature (174)..(174): n is either a, c, g or t
  misc_feature (193)..(194): n is either a, c, g or t
  misc_feature (196)..(196): n is either a, c, g or t
  misc_feature (199)..(199): n is either a, c, g or t
  misc_feature (205)..(205): n is either a, c, g or t
  misc_feature (210)..(210): n is either a, c, g or t
  misc_feature (213)..(214): n is either a, c, g or t
  misc_feature (226)..(227): n is either a, c, g or t
  misc_feature (233)..(233): n is either a, c, g or t
  misc_feature (248)..(248): n is either a, c, g or t
  misc_feature (254)..(254): n is either a, c, g or t
  misc_feature (257)..(257): n is either a, c, g or t
  misc_feature (276)..(276): n is either a, c, g or t
  misc_feature (292)..(292): n is either a, c, g or t
  misc_feature (299)..(300): n is either a, c, g or t
  misc_feature (332)..(332): n is either a, c, g or t
  misc_feature (335)..(335): n is either a, c, g or t
  misc_feature (337)..(337): n is either a, c, g or t
  misc_feature (346)..(346): n is either a, c, g or t
  misc_feature (350)..(350): n is either a, c, g or t
  misc_feature (352)..(352): n is either a, c, g or t
  misc_feature (391)..(391): n is either a, c, g or t
  misc_feature (398)..(398): n is either a, c, g or t
  misc_feature (426)..(426): n is either a, c, g or t
  misc_feature (488)..(488): n is either a, c, g or t
  misc_feature (499)..(499): n is either a, c, g or t
  misc_feature (506)..(506): n is either a, c, g or t
  misc_feature (510)..(510): n is either a, c, g or t
  misc_feature (542)..(542): n is either a, c, g or t
  misc_feature (617)..(617): n is either a, c, g or t
  misc_feature (649)..(650): n is either a, c, g or t
  misc_feature (652)..(652): n is either a, c, g or t
  misc_feature (666)..(666): n is either a, c, g or t
  misc_feature (673)..(673): n is either a, c, g or t
  misc_feature (707)..(708): n is either a, c, g or t
  misc_feature (779)..(779): n is either a, c, g or t
  misc_feature (808)..(808): n is either a, c, g or t
  misc_feature (811)..(812): n is either a, c, g or t
  misc_feature (814)..(814): n is either a, c, g or t
  misc_feature (828)..(828): n is either a, c, g or t
  misc_feature (830)..(837): n is either a, c, g or t
  misc_feature (860)..(860): n is either a, c, g or t
  misc_feature (875)..(875): n is either a, c, g or t
  misc_feature (881)..(881): n is either a, c, g or t
tttttttttgttttttgtgtgttcgttttttttttcgcgcgttngcgttcgttttcgcgttcgcgcgtttttttncgcgnngcgcgcgcgtttnttncgcgttcgcggtntcggcgttcgcgcgncgcgttcgtcgttcgtnntcgcgtncgtcgttcgcgtcgtttncgcgtntcgttcgttcgcggcgcgnntnttncgcggnggcgnggnnggcgcgcggcgnncgcggngtcgtcgcgtcgcgnggcgtnggngcgcgcgtcgcgtcgtcgncggtttcggggcgcgntcgtcgnngttttttttcggcggcgcgcgcgcgcgcgcgncgntnttcgcgttntcgngngtcggtcgcggtcgtcgcgcgcgcgcgggtcgtcgcgtnttcgcgncggcggcgtcgcgcgcgcgttcgcgttntcgtcgcggttttttcgtcggcgttttcgtcggtcgggcgtcgtcgcggtcgttcgtcgcgnggcggcgcgtngtcgcgntcgntcgcggcgggtcgggtcgtcgcgtttcgcgtnggcgtttcgtcgcgcgcgcgtttttcgtttcgtttcgcgtcgcgcgttcgcggttcgcgcgttcggggggcggtncgggcgttttcgtcgtcgcgcgcgtttttttnntncgcgtttcgcgcgngcgtcgntcgttttcgcgttcgcggtcgtcggcgtcgtttnngggcgcggcgtcgcgtcggcggcgcggtcggcgcggcgcgtcgcgtttttcgtcgttcgcgggtcgtcgtngttcgtcgcgttttttttttttttttttnttnntntcgtcggcgggttntnnnnnnnnggggcggggcgtttttttttttncgggggcggggggtngcggtn

SEQ ID NO: 16548 - DNA, 881 bp, Artificial Sequence
  chemically treated genomic DNA (Homo sapiens) CpG-island No: 16548
  misc_feature (1)..(1): n is either a, c, g or t
  misc_feature (7)..(7): n is either a, c, g or t
  misc_feature (22)..(22): n is either a, c, g or t
  misc_feature (45)..(52): n is either a, c, g or t
  misc_feature (54)..(54): n is either a, c, g or t
  misc_feature (68)..(68): n is either a, c, g or t
  misc_feature (70)..(71): n is either a, c, g or t
  misc_feature (74)..(74): n is either a, c, g or t
  misc_feature (103)..(103): n is either a, c, g or t
  misc_feature (174)..(175): n is either a, c, g or t
  misc_feature (209)..(209): n is either a, c, g or t
  misc_feature (216)..(216): n is either a, c, g or t
  misc_feature (230)..(230): n is either a, c, g or t
  misc_feature (232)..(233): n is either a, c, g or t
  misc_feature (265)..(265): n is either a, c, g or t
  misc_feature (340)..(340): n is either a, c, g or t
  misc_feature (372)..(372): n is either a, c, g or t
  misc_feature (376)..(376): n is either a, c, g or t
  misc_feature (383)..(383): n is either a, c, g or t
  misc_feature (394)..(394): n is either a, c, g or t
  misc_feature (456)..(456): n is either a, c, g or t
  misc_feature (484)..(484): n is either a, c, g or t
  misc_feature (491)..(491): n is either a, c, g or t
  misc_feature (530)..(530): n is either a, c, g or t
  misc_feature (532)..(532): n is either a, c, g or t
  misc_feature (536)..(536): n is either a, c, g or t
  misc_feature (545)..(545): n is either a, c, g or t
  misc_feature (547)..(547): n is either a, c, g or t
  misc_feature (550)..(550): n is either a, c, g or t
  misc_feature (582)..(583): n is either a, c, g or t
  misc_feature (590)..(590): n is either a, c, g or t
  misc_feature (606)..(606): n is either a, c, g or t
  misc_feature (625)..(625): n is either a, c, g or t
  misc_feature (628)..(628): n is either a, c, g or t
  misc_feature (634)..(634): n is either a, c, g or t
  misc_feature (649)..(649): n is either a, c, g or t
  misc_feature (655)..(656): n is either a, c, g or t
  misc_feature (668)..(669): n is either a, c, g or t
  misc_feature (672)..(672): n is either a, c, g or t
  misc_feature (677)..(677): n is either a, c, g or t
  misc_feature (683)..(683): n is either a, c, g or t
  misc_feature (686)..(686): n is either a, c, g or t
  misc_feature (688)..(689): n is either a, c, g or t
  misc_feature (708)..(708): n is either a, c, g or t
  misc_feature (714)..(714): n is either a, c, g or t
  misc_feature (732)..(732): n is either a, c, g or t
  misc_feature (739)..(740): n is either a, c, g or t
  misc_feature (757)..(757): n is either a, c, g or t
  misc_feature (772)..(772): n is either a, c, g or t
  misc_feature (785)..(785): n is either a, c, g or t
  misc_feature (788)..(788): n is either a, c, g or t
  misc_feature (801)..(802): n is either a, c, g or t
  misc_feature (807)..(807): n is either a, c, g or t
  misc_feature (838)..(838): n is either a, c, g or t
naccgcnaccccccgcccccgnaaaaaaaaaaacgccccgccccnnnnnnnnanaacccgccgacganannaanaaaaaaaaaaaaaaaaaacgcgacgaacnacgacgacccgcgaacgacgaaaaacgcgacgcgccgcgccgaccgcgccgccgacgcgacgccgcgcccnnaaacgacgccgacgaccgcgaacgcgaaaacgancgacgcncgcgcgaaacgcgnannaaaaaaacgcgcgcgacgacgaaaacgcccgnaccgccccccgaacgcgcgaaccgcgaacgcgcgacgcgaaacgaaacgaaaaacgcgcgcgcgacgaaacgccnacgcgaaacgcgacgacccgacccgccgcgancgancgcgacnacgcgccgccncgcgacgaacgaccgcgacgacgcccgaccgacgaaaacgccgacgaaaaaaccgcgacganaacgcgaacgcgcgcgcgacgccgccgncgcgaanacgcgacgacccgcgcgcgcgcgacgaccgcgaccgacncncganaacgcgaanancgncgcgcgcgcgcgcgcgccgccgaaaaaaaacnncgacgancgcgccccgaaaccgncgacgacgcgacgcgcgcnccnacgccncgcgacgcgacgacnccgcgnncgccgcgcgccnnccncgccnccgcgnaananncgcgccgcgaacgaacganacgcgnaaacgacgcgaacgacgnacgcgannacgaacgacgaacgcgncgcgcgaacgccganaccgcgaacgcgnaanaaacgcgcgcgcnncgcgnaaaaaaacgcgcgaacgcgaaaacgaacgcnaacgcgcgaaaaaaaaaacgaacacacaaaaaacaaaaaaaaa

SEQ ID NO: 16549 - DNA, 849 bp, Artificial Sequence
  chemically treated genomic DNA (Homo sapiens) CpG-island No: 16549
  misc_feature (130)..(130): n is either a, c, g or t
  misc_feature (191)..(192): n is either a, c, g or t
  misc_feature (215)..(216): n is either a, c, g or t
  misc_feature (239)..(239): n is either a, c, g or t
  misc_feature (303)..(303): n is either a, c, g or t
  misc_feature (306)..(306): n is either a, c, g or t
  misc_feature (361)..(361): n is either a, c, g or t
  misc_feature (363)..(363): n is either a, c, g or t
  misc_feature (365)..(365): n is either a, c, g or t
  misc_feature (416)..(416): n is either a, c, g or t
  misc_feature (424)..(424): n is either a, c, g or t
  misc_feature (433)..(434): n is either a, c, g or t
  misc_feature (446)..(446): n is either a, c, g or t
  misc_feature (448)..(449): n is either a, c, g or t
  misc_feature (517)..(517): n is either a, c, g or t
  misc_feature (565)..(565): n is either a, c, g or t
  misc_feature (578)..(578): n is either a, c, g or t
  misc_feature (648)..(648): n is either a, c, g or t
  misc_feature (788)..(788): n is either a, c, g or t
  misc_feature (794)..(794): n is either a, c, g or t
  misc_feature (814)..(814): n is either a, c, g or t
ggcggtcgttcgtttttttttttttttttatataaaaaaaaaaagaaaaattttttttttttttttcgttcgggggtcgcgtttttttcggcgtttttcgtttcgcgcggttgttttgtttttttcgcgngttcgcgtcgtcgcgttttcgttcgttttttttcgtttttcgggggggcgcgttttttttnnttttcgtttttttttttttcgtnnggggggcgtaataggcggcgcgngtcgttcggttcgtttcggtcgtttttttttttcgggttcgcggcgttcgttcgcgttcgtcgncgntttcgtttttcgttcgcgtcgtttttttttttttttcgtttcgtcgttttcgttngngngttttcgttcgcgtttttttttttcgcgtttcggttcggtttcgcggcgtncgcgcgtncgtcgtcgnngtttcgtttttngnncgttttttttgcgttttttttcgcgttcgtcgcgttttttttttttttcgttcgtttcgtcgtttcgntttttttcgttgtcgcgcgtttgttttttttttcgttttgtttttcgnttttcgtttcgtntttgtcggcgtgcgggcggttcggtgcgttttcgtttcgtcgttcgcgttcgtttttcggtttttttttncgcggcgtgtgtttttttttttttttcgttcgcgtgtcgttttttttcgtttttcgtttggtttcgcgtcgttttgttttcgttcgtttttttttttttcgttttttttttttcgtcggcgtttatatgtgtttttttgncgtttnttttgttcgtttttcggttncgtcgtcgtttttttcgtttattattttttttttt

SEQ ID NO: 16550 - DNA, 849 bp, Artificial Sequence
  chemically treated genomic DNA (Homo sapiens) CpG-island No: 16550
  misc_feature (36)..(36): n is either a, c, g or t
  misc_feature (56)..(56): n is either a, c, g or t
  misc_feature (62)..(62): n is either a, c, g or t
  misc_feature (202)..(202): n is either a, c, g or t
  misc_feature (272)..(272): n is either a, c, g or t
  misc_feature (285)..(285): n is either a, c, g or t
  misc_feature (333)..(333): n is either a, c, g or t
  misc_feature (401)..(402): n is either a, c, g or t
  misc_feature (404)..(404): n is either a, c, g or t
  misc_feature (416)..(417): n is either a, c, g or t
  misc_feature (426)..(426): n is either a, c, g or t
  misc_feature (434)..(434): n is either a, c, g or t
  misc_feature (485)..(485): n is either a, c, g or t
  misc_feature (487)..(487): n is either a, c, g or t
  misc_feature (489)..(489): n is either a, c, g or t
  misc_feature (544)..(544): n is either a, c, g or t
  misc_feature (547)..(547): n is either a, c, g or t
  misc_feature (611)..(611): n is either a, c, g or t
  misc_feature (634)..(635): n is either a, c, g or t
  misc_feature (658)..(659): n is either a, c, g or t
  misc_feature (720)..(720): n is either a, c, g or t
aaaaaaaaaaataataaacgaaaaaaacgacgacgnaaccgaaaaacgaacaaaanaaacgncaaaaaaacacatataaacgccgacgaaaaaaaaaaaacgaaaaaaaaaaaaacgaacgaaaacaaaacgacgcgaaaccaaacgaaaaacgaaaaaaaacgacacgcgaacgaaaaaaaaaaaaaaacacacgccgcgnaaaaaaaaaccgaaaaacgaacgcgaacgacgaaacgaaaacgcaccgaaccgcccgcacgccgacaaanacgaaacgaaaancgaaaaacaaaacgaaaaaaaaaacaaacgcgcgacaacgaaaaaaancgaaacgacgaaacgaacgaaaaaaaaaaaaaacgcgacgaacgcgaaaaaaaacgcaaaaaaaacgnncnaaaaacgaaacnncgacgacgnacgcgcgnacgccgcgaaaccgaaccgaaacgcgaaaaaaaaaaacgcgaacgaaaacncncnaacgaaaacgacgaaacgaaaaaaaaaaaaaaacgacgcgaacgaaaaacgaaancgncgacgaacgcgaacgaacgccgcgaacccgaaaaaaaaaaacgaccgaaacgaaccgaacgacncgcgccgcctattacgccccccnnacgaaaaaaaaaaaaacgaaaannaaaaaaaacgcgcccccccgaaaaacgaaaaaaaacgaacgaaaacgcgacgacgcgaacncgcgaaaaaaacaaaacaaccgcgcgaaacgaaaaacgccgaaaaaaacgcgacccccgaacgaaaaaaaaaaaaaaaatttttctttttttttttatataaaaaaaaaaaaaaaaacgaacgaccgcc

SEQ ID NO: 16551 - DNA, 849 bp, Artificial Sequence
  chemically treated genomic DNA (Homo sapiens) CpG-island No: 16551
  misc_feature (36)..(36): n is either a, c, g or t
  misc_feature (56)..(56): n is either a, c, g or t
  misc_feature (62)..(62): n is either a, c, g or t
  misc_feature (202)..(202): n is either a, c, g or t
  misc_feature (272)..(272): n is either a, c, g or t
  misc_feature (285)..(285): n is either a, c, g or t
  misc_feature (333)..(333): n is either a, c, g or t
  misc_feature (401)..(402): n is either a, c, g or t
  misc_feature (404)..(404): n is either a, c, g or t
  misc_feature (416)..(417): n is either a, c, g or t
  misc_feature (426)..(426): n is either a, c, g or t
  misc_feature (434)..(434): n is either a, c, g or t
  misc_feature (485)..(485): n is either a, c, g or t
  misc_feature (487)..(487): n is either a, c, g or t
  misc_feature (489)..(489): n is either a, c, g or t
  misc_feature (544)..(544): n is either a, c, g or t
  misc_feature (547)..(547): n is either a, c, g or t
  misc_feature (611)..(611): n is either a, c, g or t
  misc_feature (634)..(635): n is either a, c, g or t
  misc_feature (658)..(659): n is either a, c, g or t
  misc_feature (720)..(720): n is either a, c, g or t
gggggggggggtggtgggcggggggagcggcgacgnggtcggggggcgagtagagnagacgntaaaagagtatatgtggacgtcggcggagagaaaaaggcgggggaaaaaggggcgggcggggatagggcggcgcggggttaggcggggggcgggagaagacgatacgcgggcggggggaagggagggatatacgtcgcgnggggaggaatcggggggcgggcgcgggcgacggggcgggggcgtatcggatcgttcgtacgtcgataaangcgaggcggaagncggggggtagagcgagaggaggggtaggcgcgcggtagcggggagggncggggcggcggggcgaacggaagaagaggggggcgcggcgggcgcgggggggagcgtaggagagacgnntngggggcggggtnncggcggcgngcgcgcgngcgtcgcggggtcgggtcggggcgcggggagggggggcgcgggcgggggtntntnggcgggggcggcggggcggggggggggggggggcggcgcgggcggggggcggggncgncggcgggcgcgggcgggcgtcgcgggttcggggggggggggcggtcggggcgggtcgggcggtncgcgtcgtttgttgcgttttttnngcggggggggggggggcgggggnnggggggggcgcgttttttcggggggcgggggggggcgggcgggggcgcggcggcgcgggtncgcgaaaaaaataaaatagtcgcgcggggcggggggcgtcggggggggcgcggttttcgggcggggggaaaaaaaaaaatttttttttttttttttgtgtgggggggggggggggggcgggcggtcgtt

SEQ ID NO: 16552 - DNA, 849 bp, Artificial Sequence
  chemically treated genomic DNA (Homo sapiens) CpG-island No: 16552
  misc_feature (130)..(130): n is either a, c, g or t
  misc_feature (191)..(192): n is either a, c, g or t
  misc_feature (215)..(216): n is either a, c, g or t
  misc_feature (239)..(239): n is either a, c, g or t
  misc_feature (303)..(303): n is either a, c, g or t
  misc_feature (306)..(306): n is either a, c, g or t
  misc_feature (361)..(361): n is either a, c, g or t
  misc_feature (363)..(363): n is either a, c, g or t
  misc_feature (365)..(365): n is either a, c, g or t
  misc_feature (416)..(416): n is either a, c, g or t
  misc_feature (424)..(424): n is either a, c, g or t
  misc_feature (433)..(434): n is either a, c, g or t
  misc_feature (446)..(446): n is either a, c, g or t
  misc_feature (448)..(449): n is either a, c, g or t
  misc_feature (517)..(517): n is either a, c, g or t
  misc_feature (565)..(565): n is either a, c, g or t
  misc_feature (578)..(578): n is either a, c, g or t
  misc_feature (648)..(648): n is either a, c, g or t
  misc_feature (788)..(788): n is either a, c, g or t
  misc_feature (794)..(794): n is either a, c, g or t
  misc_feature (814)..(814): n is either a, c, g or t
aacgaccgcccgcccccccccccccccccacacaaaaaaaaaaaaaaaaatttttttttttccccccgcccgaaaaccgcgccccccccgacgccccccgccccgcgcgactattttatttttttcgcgnacccgcgccgccgcgcccccgcccgcccccccccgccccccgaaaaaacgcgccccccccnncccccgccccccccccccccgcnnaaaaaacgcaacaaacgacgcgnaccgcccgacccgccccgaccgccccccccccccgaacccgcgacgcccgcccgcgcccgccgncgnccccgccccccgcccgcgccgccccccccccccccccgccccgccgcccccgccnananacccccgcccgcgccccccctccccgcgccccgacccgaccccgcgacgcncgcgcgcncgccgccgnnaccccgcccccnanncgtctctcctacgctcccccccgcgcccgccgcgcccccctcttcttccgttcgccccgccgccccgnccctccccgctaccgcgcgcctacccctcctctcgctctaccccccgncttccgcctcgcntttatcgacgtacgaacgatccgatacgcccccgccccgtcgcccgcgcccgccccccgattcctccccncgcgacgtatatccctcccttccccccgcccgcgtatcgtcttctcccgccccccgcctaaccccgcgccgccctatccccgcccgcccctttttcccccgcctttttctctccgccgacgtccacatatactcttttancgtctnctctactcgccccccgaccncgtcgccgctccccccgcccaccaccccccccccc

SEQ ID NO: 16553 - DNA, 558 bp, Artificial Sequence
  chemically treated genomic DNA (Homo sapiens) CpG-island No: 16553
  misc_feature (12)..(12): n is either a, c, g or t
  misc_feature (23)..(23): n is either a, c, g or t
  misc_feature (26)..(26): n is either a, c, g or t
  misc_feature (94)..(95): n is either a, c, g or t
  misc_feature (97)..(98): n is either a, c, g or t
  misc_feature (229)..(229): n is either a, c, g or t
  misc_feature (232)..(232): n is either a, c, g or t
  misc_feature (277)..(277): n is either a, c, g or t
  misc_feature (292)..(293): n is either a, c, g or t
  misc_feature (313)..(313): n is either a, c, g or t
  misc_feature (315)..(315): n is either a, c, g or t
  misc_feature (319)..(320): n is either a, c, g or t
  misc_feature (373)..(373): n is either a, c, g or t
  misc_feature (410)..(410): n is either a, c, g or t
  misc_feature (433)..(433): n is either a, c, g or t
  misc_feature (449)..(449): n is either a, c, g or t
  misc_feature (461)..(461): n is either a, c, g or t
  misc_feature (487)..(487): n is either a, c, g or t
  misc_feature (518)..(518): n is either a, c, g or t
tcgcggttcggncgcgttcggtncgntcggttcgttttcgcgcgcgggtcggtttcggttttcgcggcgcgtcgtcgttcgcgtcgggttcgtnngnngtcgtttcgtttcggcgttcgcggtcgcgttttcgcggtcgcgggttcgcgttcggggtcgcggcgggggtcgcggcggtcggggtcggttcgtcgcgcggcgcgtcgcgtttcggttttcgcgtcgtttncgngcgcgtcgcgcgcggtttttcgtcggcgcgttcgcgtcggtcgtncggcgtcgcgttcgnntttcgttcgcgcgcggcgtngntttnntcggcgggcgggtcgcggcgcgtcggcgcgggcgtttcgcgttcgttcgggtngcgggggcgtcggtttcgtttttttcggcgtcgtttncggtcggcgcgcgtcgcgggggngtcgggcgcgggcggnggcgcggggcgncgtttttcgcggcgggcgtcgtcgtncgtttcgcgtttcgcgcggcggcgcgcgcgnggggggtagtcgtagaataaggaaagaagaagagagaaga

SEQ ID NO: 16554 - DNA, 558 bp, Artificial Sequence
  chemically treated genomic DNA (Homo sapiens) CpG-island No: 16554
  misc_feature (41)..(41): n is either a, c, g or t
  misc_feature (72)..(72): n is either a, c, g or t
  misc_feature (98)..(98): n is either a, c, g or t
  misc_feature (110)..(110): n is either a, c, g or t
  misc_feature (126)..(126): n is either a, c, g or t
  misc_feature (149)..(149): n is either a, c, g or t
  misc_feature (186)..(186): n is either a, c, g or t
  misc_feature (239)..(240): n is either a, c, g or t
  misc_feature (244)..(244): n is either a, c, g or t
  misc_feature (246)..(246): n is either a, c, g or t
  misc_feature (266)..(267): n is either a, c, g or t
  misc_feature (282)..(282): n is either a, c, g or t
  misc_feature (327)..(327): n is either a, c, g or t
  misc_feature (330)..(330): n is either a, c, g or t
  misc_feature (461)..(462): n is either a, c, g or t
  misc_feature (464)..(465): n is either a, c, g or t
  misc_feature (533)..(533): n is either a, c, g or t
  misc_feature (536)..(536): n is either a, c, g or t
  misc_feature (547)..(547): n is either a, c, g or t
tcttctctcttcttctttccttattctacgactaccccccncgcgcgcgccgccgcgcgaaacgcgaaacgnacgacgacgcccgccgcgaaaaacgncgccccgcgccnccgcccgcgcccgacncccccgcgacgcgcgccgaccgnaaacgacgccgaaaaaaacgaaaccgacgcccccgcnacccgaacgaacgcgaaacgcccgcgccgacgcgccgcgacccgcccgccgannaaancnacgccgcgcgcgaacgaaanncgaacgcgacgccgnacgaccgacgcgaacgcgccgacgaaaaaccgcgcgcgacgcgcncgnaaacgacgcgaaaaccgaaacgcgacgcgccgcgcgacgaaccgaccccgaccgccgcgacccccgccgcgaccccgaacgcgaacccgcgaccgcgaaaacgcgaccgcgaacgccgaaacgaaacgacnncnnacgaacccgacgcgaacgacgacgcgccgcgaaaaccgaaaccgacccgcgcgcgaaaacgaaccgancgnaccgaacgcgnccgaaccgcga

SEQ ID NO: 16555 - DNA, 558 bp, Artificial Sequence
  chemically treated genomic DNA (Homo sapiens) CpG-island No: 16555
  misc_feature (41)..(41): n is either a, c, g or t
  misc_feature (72)..(72): n is either a, c, g or t
  misc_feature (98)..(98): n is either a, c, g or t
  misc_feature (110)..(110): n is either a, c, g or t
  misc_feature (126)..(126): n is either a, c, g or t
  misc_feature (149)..(149): n is either a, c, g or t
  misc_feature (186)..(186): n is either a, c, g or t
  misc_feature (239)..(240): n is either a, c, g or t
  misc_feature (244)..(244): n is either a, c, g or t
  misc_feature (246)..(246): n is either a, c, g or t
  misc_feature (266)..(267): n is either a, c, g or t
  misc_feature (282)..(282): n is either a, c, g or t
  misc_feature (327)..(327): n is either a, c, g or t
  misc_feature (330)..(330): n is either a, c, g or t
  misc_feature (461)..(462): n is either a, c, g or t
  misc_feature (464)..(465): n is either a, c, g or t
  misc_feature (533)..(533): n is either a, c, g or t
  misc_feature (536)..(536): n is either a, c, g or t
  misc_feature (547)..(547): n is either a, c, g or t
ttttttttttttttttttttttgttttgcggttgttttttncgcgcgcgtcgtcgcgcggggcgcggggcgngcggcggcgttcgtcgcggggggcgncgtttcgcgttntcgttcgcgttcggtnttttcgcggcgcgcgtcggtcgngggcggcgtcggggggggcggggtcggcgttttcgtngttcgggcgggcgcggggcgttcgcgtcggcgcgtcgcggttcgttcgtcggnngggntngcgtcgcgcgcgggcggggnncgggcgcggcgtcgngcggtcggcgcgggcgcgtcggcggggggtcgcgcgcggcgcgtncgngggcggcgcgggggtcggggcgcggcgcgtcgcgcggcgggtcggtttcggtcgtcgcggttttcgtcgcggtttcgggcgcgggttcgcggtcgcgggggcgcggtcgcgggcgtcggggcggggcggtnntnngcgggttcggcgcgggcggcggcgcgtcgcgggggtcggggtcggttcgcgcgcgggggcgggtcggncgngtcgggcgcgntcgggtcgcgg

SEQ ID NO: 16556 - DNA, 558 bp, Artificial Sequence
  chemically treated genomic DNA (Homo sapiens) CpG-island No: 16556
  misc_feature (12)..(12): n is either a, c, g or t
  misc_feature (23)..(23): n is either a, c, g or t
  misc_feature (26)..(26): n is either a, c, g or t
  misc_feature (94)..(95): n is either a, c, g or t
  misc_feature (97)..(98): n is either a, c, g or t
  misc_feature (229)..(229): n is either a, c, g or t
  misc_feature (232)..(232): n is either a, c, g or t
  misc_feature (277)..(277): n is either a, c, g or t
  misc_feature (292)..(293): n is either a, c, g or t
  misc_feature (313)..(313): n is either a, c, g or t
  misc_feature (315)..(315): n is either a, c, g or t
  misc_feature (319)..(320): n is either a, c, g or t
  misc_feature (373)..(373): n is either a, c, g or t
  misc_feature (410)..(410): n is either a, c, g or t
  misc_feature (433)..(433): n is either a, c, g or t
  misc_feature (449)..(449): n is either a, c, g or t
  misc_feature (461)..(461): n is either a, c, g or t
  misc_feature (487)..(487): n is either a, c, g or t
  misc_feature (518)..(518): n is either a, c, g or t
ccgcgacccgancgcgcccgacncgnccgacccgcccccgcgcgcgaaccgaccccgacccccgcgacgcgccgccgcccgcgccgaacccgcnnannaccgccccgccccgacgcccgcgaccgcgcccccgcgaccgcgaacccgcgcccgaaaccgcgacgaaaaccgcgacgaccgaaaccgacccgccgcgcgacgcgccgcgccccgacccccgcgccgcccncgnacgcgccgcgcgcgaccccccgccgacgcgcccgcgccgaccgcncgacgccgcgcccgnnccccgcccgcgcgcgacgcnancccnnccgacgaacgaaccgcgacgcgccgacgcgaacgccccgcgcccgcccgaacnacgaaaacgccgaccccgccccccccgacgccgcccncgaccgacgcgcgccgcgaaaanaccgaacgcgaacganaacgcgaaacgncgccccccgcgacgaacgccgccgcncgccccgcgccccgcgcgacgacgcgcgcgnaaaaaacaaccgcaaaacaaaaaaaaaaaaaaaaaaaaaa

SEQ ID NO: 16557 - DNA, 567 bp, Artificial Sequence
  chemically treated genomic DNA (Homo sapiens) CpG-island No: 16557
cggcgttagagtcgggggcgggcgggggttattcgagggtcgtttttcgatgattcgcgttcgttcgtttttagtacggggtcgcgtttcgcggtggttcgcgagttgtttttggttgcgttggaggaattgagttaagagtagttgaagcgttttcgttataagttgcgcgacgtgggttcggacggacgtagtatttcgtgggggcggttggagcgcgcggacgtcgtggatttcgcggagtagttggtttagttttacggttcggagtttgttttggaggtggttcgtaagatttttaagagggcggacgcgcgcgacgtggcggcgtagttttaggagcggcggttgtagcgtgagttttgcgcgggaggttttttttgtttgggtagaggttgggttgttttttttttcgtttttcggagaagtttcggcgcggttttcggttttcgcgcgttttatttataaattcgcgggttttaggggtaggattttgcgtgttttttagggtgattcggattttcgtggcgtttttttttgtttttattttcggcggaattttatttt

SEQ ID NO: 16558 - DNA, 567 bp, Artificial Sequence
  chemically treated genomic DNA (Homo sapiens) CpG-island No: 16558
aaaataaaattccgccgaaaataaaaacaaaaaaaaacgccacgaaaatccgaatcaccctaaaaaacacgcaaaatcctacccctaaaacccgcgaatttataaataaaacgcgcgaaaaccgaaaaccgcgccgaaacttctccgaaaaacgaaaaaaaaaacaacccaacctctacccaaacaaaaaaaacctcccgcgcaaaactcacgctacaaccgccgctcctaaaactacgccgccacgtcgcgcgcgtccgccctcttaaaaatcttacgaaccacctccaaaacaaactccgaaccgtaaaactaaaccaactactccgcgaaatccacgacgtccgcgcgctccaaccgcccccacgaaatactacgtccgtccgaacccacgtcgcgcaacttataacgaaaacgcttcaactactcttaactcaattcctccaacgcaaccaaaaacaactcgcgaaccaccgcgaaacgcgaccccgtactaaaaacgaacgaacgcgaatcatcgaaaaacgaccctcgaataacccccgcccgcccccgactctaacgccg

SEQ ID NO: 16559 - DNA, 567 bp, Artificial Sequence
  chemically treated genomic DNA (Homo sapiens) CpG-island No: 16559
ggggtgaggtttcgtcgagggtgggaataggggaaggcgttacgggggttcgagttattttgaggagtacgtagggttttatttttggggttcgcgaatttgtggataaaacgcgcgggggtcggggatcgcgtcggggttttttcgggaagcgggaaggagggtagtttagtttttgtttagataggagggatttttcgcgtagaatttacgttgtagtcgtcgtttttggagttgcgtcgttacgtcgcgcgcgttcgtttttttgagggttttgcgggttatttttagggtaggtttcgggtcgtagaattgggttagttgtttcgcgaggtttacggcgttcgcgcgttttagtcgtttttacgggatgttgcgttcgttcgggtttacgtcgcgtagtttgtggcggaagcgttttagttgtttttggtttagtttttttagcgtagttaggagtagttcgcgggttatcgcgaggcgcggtttcgtgttggaggcgggcgggcgcgggttatcggggagcggttttcgggtgattttcgttcgttttcgattttggcgtcg

SEQ ID NO: 16560 - DNA, 567 bp, Artificial Sequence
  chemically treated genomic DNA (Homo sapiens) CpG-island No: 16560
cgacgccaaaatcgaaaacgaacgaaaatcacccgaaaaccgctccccgataacccgcgcccgcccgcctccaacacgaaaccgcgcctcgcgataacccgcgaactactcctaactacgctaaaaaaactaaaccaaaaacaactaaaacgcttccgccacaaactacgcgacgtaaacccgaacgaacgcaacatcccgtaaaaacgactaaaacgcgcgaacgccgtaaacctcgcgaaacaactaacccaattctacgacccgaaacctaccctaaaaataacccgcaaaaccctcaaaaaaacgaacgcgcgcgacgtaacgacgcaactccaaaaacgacgactacaacgtaaattctacgcgaaaaatccctcctatctaaacaaaaactaaactaccctccttcccgcttcccgaaaaaaccccgacgcgatccccgacccccgcgcgttttatccacaaattcgcgaaccccaaaaataaaaccctacgtactcctcaaaataactcgaacccccgtaacgccttcccctattcccaccctcgacgaaacctcacccc

SEQ ID NO: 16561 - DNA, 704 bp, Artificial Sequence
  chemically treated genomic DNA (Homo sapiens) CpG-island No: 16561
tcgatcgcggcgcgtcggtgtcgtagatgttggtttagtcgtagcggttgttttttattttggacggcgcggacgagttgtcggcgttggggggtttcgaggtcgcgttttgtatagattttttcgaggcggcgagcggcgcgcgggtgttaggcgggttgttgagtaaggcgttgttgtttacggtttttttgttggtgattacgcgcgtcgtcgttttcgggaggttgtagggtcgtttgtgtttttcgtagtgcgtcgaggtgcgcggttttttcgataaggataagaagaagtatttttataagttttttcgggatgagaggagggtcgagcgcgtttatcgtttcgtgaaggagaacgagacgttgttcgcgttgtgtttcgtgtttttcgtgtgttggatcgtgtgtatcgtgttgcgttagtagttggagttcggtcgggatttgtcgcgtacgtttaagattattacgttagtgtatttgttttttattattagcgttttgagttcggtttcggtagtcgacgggtttcggttgtagggcgatttgcgtaatttgtgtcgtttggttcgcgagggcgttttcggacgtagggcgtagtttgtcgagaaggaattggagtaattggagtttcgtggttttaaagtgtagacgttgttttttagtaaaaaggagttgtcgggcgtgttggagatagag

SEQ ID NO: 16562 - DNA, 704 bp, Artificial Sequence
  chemically treated genomic DNA (Homo sapiens) CpG-island No: 16562
ctctatctccaacacgcccgacaactcctttttactaaaaaacaacgtctacactttaaaaccacgaaactccaattactccaattccttctcgacaaactacgccctacgtccgaaaacgccctcgcgaaccaaacgacacaaattacgcaaatcgccctacaaccgaaacccgtcgactaccgaaaccgaactcaaaacgctaataataaaaaacaaatacactaacgtaataatcttaaacgtacgcgacaaatcccgaccgaactccaactactaacgcaacacgatacacacgatccaacacacgaaaaacacgaaacacaacgcgaacaacgtctcgttctccttcacgaaacgataaacgcgctcgaccctcctctcatcccgaaaaaacttataaaaatacttcttcttatccttatcgaaaaaaccgcgcacctcgacgcactacgaaaaacacaaacgaccctacaacctcccgaaaacgacgacgcgcgtaatcaccaacaaaaaaaccgtaaacaacaacgccttactcaacaacccgcctaacacccgcgcgccgctcgccgcctcgaaaaaatctatacaaaacgcgacctcgaaaccccccaacgccgacaactcgtccgcgccgtccaaaataaaaaacaaccgctacgactaaaccaacatctacgacaccgacgcgccgcgatcga

SEQ ID NO: 16563 - DNA, 704 bp, Artificial Sequence
  chemically treated genomic DNA (Homo sapiens) CpG-island No: 16563
ttttgtttttagtacgttcggtagtttttttttgttgagaaatagcgtttgtattttggagttacgaagttttagttgttttagttttttttcggtaaattgcgttttgcgttcgaggacgttttcgcgggttaggcggtatagattgcgtaggtcgttttgtaatcggggttcgtcggttatcggagtcgagtttagaacgttggtgatgaaaagtaggtatattgacgtggtggttttggacgtgcgcgataggtttcgatcgagttttagttgttggcgtagtacggtgtatacgatttagtatacgaagggtacgaagtatagcgcgaatagcgtttcgtttttttttacgaagcggtaggcgcgttcggttttttttttatttcggaagaatttgtagaaatatttttttttgtttttgtcggagaagtcgcgtatttcggcgtattgcggggaatataggcggttttgtagtttttcgggggcggcggcgcgcgtggttattagtaggagggtcgtgggtagtagcgttttgtttagtagttcgtttagtattcgcgcgtcgttcgtcgtttcgaaggggtttgtgtagggcgcggtttcggggttttttagcgtcggtagttcgttcgcgtcgtttaggatgaagagtagtcgttgcggttgggttagtatttgcggtatcggcgcgtcgcggtcgg

SEQ ID NO: 16564 - DNA, 704 bp, Artificial Sequence
  chemically treated genomic DNA (Homo sapiens) CpG-island No: 16564
ccgaccgcgacgcgccgataccgcaaatactaacccaaccgcaacgactactcttcatcctaaacgacgcgaacgaactaccgacgctaaaaaaccccgaaaccgcgccctacacaaaccccttcgaaacgacgaacgacgcgcgaatactaaacgaactactaaacaaaacgctactacccacgaccctcctactaataaccacgcgcgccgccgcccccgaaaaactacaaaaccgcctatattccccgcaatacgccgaaatacgcgacttctccgacaaaaacaaaaaaaaatatttctacaaattcttccgaaataaaaaaaaaaccgaacgcgcctaccgcttcgtaaaaaaaaacgaaacgctattcgcgctatacttcgtacccttcgtatactaaatcgtatacaccgtactacgccaacaactaaaactcgatcgaaacctatcgcgcacgtccaaaaccaccacgtcaatatacctacttttcatcaccaacgttctaaactcgactccgataaccgacgaaccccgattacaaaacgacctacgcaatctataccgcctaacccgcgaaaacgtcctcgaacgcaaaacgcaatttaccgaaaaaaaactaaaacaactaaaacttcgtaactccaaaatacaaacgctatttctcaacaaaaaaaaactaccgaacgtactaaaaacaaaa

SEQ ID NO: 16565 - DNA, 875 bp, Artificial Sequence
  chemically treated genomic DNA (Homo sapiens) CpG-island No: 16565
taagtttcgtcgagcgcggcgggtttgtgttttcgtttcgtttttagtttttcgtttttttttgattcgatttcgagtttttttttcggacggtgtcgagaattcgggcgtcggttggggttggagtttcgttggtttcggagcgttttcgagttttcgggcgatagcgaggcgaggatttaggtggaggcggtcgggggcgcgggcggagggaggaggcgcgggagggaattttcggttcgcgggttttatttatagtcgtttcgggacgtagttcggggtttaggttcgagttttgtttatttagggcgtttcgtgtagggaacgttaggttttcggacgcgatttacgcggtcgttgttagcggggatcgaggggagtcggggtcgcggtcgcgagtttacgtttcgttttcgggttcggtttagcgatcgttttcgtcgtttagggatcgttttcgttttttagcgatcgttcgggttttcggggcggggatcgcggatttttttggtggcgcggtagtcgggcggttttttttttttttcggttttggcgtggagtagagggatataggtttttacgttggcgttcggcgatcgggtggggttgcggtgagttttataggttttcgtttcgtagttttcggtcgtttcggttcgtttttttagttttcggtcgttttatttttttttttttattcgcgtttgttttagtcgtttatattttcgagatttttattcgttcggcgtttcggtagtttcggatttttttttttatttcgtttagcgttttttttattttttatatacgttcgtttttacgtgttattaatagacgtaggtttcgattatagagggtgggggtaagatcggggt

SEQ ID NO: 16566 - DNA, 875 bp, Artificial Sequence
  chemically treated genomic DNA (Homo sapiens) CpG-island No: 16566
accccgatcttacccccaccctctataatcgaaacctacgtctattaataacacgtaaaaacgaacgtatataaaaaataaaaaaaacgctaaacgaaataaaaaaaaaaatccgaaactaccgaaacgccgaacgaataaaaatctcgaaaatataaacgactaaaacaaacgcgaataaaaaaaaaaaaataaaacgaccgaaaactaaaaaaacgaaccgaaacgaccgaaaactacgaaacgaaaacctataaaactcaccgcaaccccacccgatcgccgaacgccaacgtaaaaacctatatccctctactccacgccaaaaccgaaaaaaaaaaaaaaccgcccgactaccgcgccaccaaaaaaatccgcgatccccgccccgaaaacccgaacgatcgctaaaaaacgaaaacgatccctaaacgacgaaaacgatcgctaaaccgaacccgaaaacgaaacgtaaactcgcgaccgcgaccccgactcccctcgatccccgctaacaacgaccgcgtaaatcgcgtccgaaaacctaacgttccctacacgaaacgccctaaataaacaaaactcgaacctaaaccccgaactacgtcccgaaacgactataaataaaacccgcgaaccgaaaattccctcccgcgcctcctccctccgcccgcgcccccgaccgcctccacctaaatcctcgcctcgctatcgcccgaaaactcgaaaacgctccgaaaccaacgaaactccaaccccaaccgacgcccgaattctcgacaccgtccgaaaaaaaaactcgaaatcgaatcaaaaaaaaacgaaaaactaaaaacgaaacgaaaacacaaacccgccgcgctcgacgaaactta

SEQ ID NO: 16567 - DNA, 875 bp, Artificial Sequence
  chemically treated genomic DNA (Homo sapiens) CpG-island No: 16567
atttcggttttgtttttattttttgtggtcgggatttgcgtttgttggtggtacgtgggggcgggcgtgtgtggagggtggggggagcgttgggcgggatgggggagggagttcggggttgtcggggcgtcgggcgggtgggggtttcgggggtgtaggcggttggggtaggcgcgggtgggggagggaggatggggcgatcgggggttggggggacgggtcggggcggtcgggagttgcggggcgggggtttatgggatttatcgtagttttattcggtcgtcgggcgttagcgtgggaatttgtgtttttttgttttacgttagggtcgggaggaaggaggagtcgttcggttgtcgcgttattaggaaggttcgcggttttcgtttcgagggttcgggcggtcgttgggaggcgggggcggtttttgggcggcgggggcggtcgttgggtcgggttcgggggcgggacgtggattcgcggtcgcggtttcggtttttttcggttttcgttggtagcggtcgcgtgggtcgcgttcgggggtttggcgttttttgtacgaagcgttttgagtgagtaaagttcgagtttggatttcgagttgcgtttcggggcggttgtgggtggggttcgcgggtcgggggttttttttcgcgtttttttttttcgttcgcgttttcggtcgtttttatttgggttttcgtttcgttgtcgttcgagggttcgggggcgtttcgaggttagcgagattttagttttagtcggcgttcgggttttcgatatcgttcggagaaagaattcggggtcgggttagaaggaagcgagaggttggaagcgaagcgaaggtatagattcgtcgcgttcggcggagtttg

SEQ ID NO: 16568 - DNA, 875 bp, Artificial Sequence
  chemically treated genomic DNA (Homo sapiens) CpG-island No: 16568
caaactccgccgaacgcgacgaatctataccttcgcttcgcttccaacctctcgcttccttctaacccgaccccgaattctttctccgaacgatatcgaaaacccgaacgccgactaaaactaaaatctcgctaacctcgaaacgcccccgaaccctcgaacgacaacgaaacgaaaacccaaataaaaacgaccgaaaacgcgaacgaaaaaaaaaaacgcgaaaaaaaacccccgacccgcgaaccccacccacaaccgccccgaaacgcaactcgaaatccaaactcgaactttactcactcaaaacgcttcgtacaaaaaacgccaaacccccgaacgcgacccacgcgaccgctaccaacgaaaaccgaaaaaaaccgaaaccgcgaccgcgaatccacgtcccgcccccgaacccgacccaacgaccgcccccgccgcccaaaaaccgcccccgcctcccaacgaccgcccgaaccctcgaaacgaaaaccgcgaaccttcctaataacgcgacaaccgaacgactcctccttcctcccgaccctaacgtaaaacaaaaaaacacaaattcccacgctaacgcccgacgaccgaataaaactacgataaatcccataaacccccgccccgcaactcccgaccgccccgacccgtccccccaacccccgatcgccccatcctccctcccccacccgcgcctaccccaaccgcctacacccccgaaacccccacccgcccgacgccccgacaaccccgaactccctcccccatcccgcccaacgctccccccaccctccacacacgcccgcccccacgtaccaccaacaaacgcaaatcccgaccacaaaaaataaaaacaaaaccgaaat

SEQ ID NO: 16569 - DNA, 991 bp, Artificial Sequence
  chemically treated genomic DNA (Homo sapiens) CpG-island No: 16569
ttttttttcgttttttttttttttttttattcggtcgttttttttttttttttttttttttttttttttttcgtttttgaagagcgcgtcgcgtgggggacggttcggttattttttttagagattgacgagtgcggtgtcgttttagtttagagttttcggagtcgttcggttagcgttcggtttttttgatcgtttttggtcggcgttttcgttttcgttcggcgcgtatcgagtagtcgcgggcgtcgagtagttatcgtttcgattaagcgtcggttttgttcgtagcggtagggtaagagttgggttcgtagagagcgttcggcgcgcggttttagttttatggagggttattcggggtttgggcgggggtcgcggggggtattgatacgtagatttcggggcgttgtcgggggtgtaggtgggggtggcggttgttgcgaggattttaggggcgcgcgtttgagtttcgcgtcggttcgtttttcggttatggagtggttttcggggttggcggggtcggtcggggggtttttgcgtgttagggtcgttgttttcggggtcgtttagcggcgggcgcggttagggcgcgttggtttgtttcgttcgtttttgtttttaaaaggaaacgtaggtttggtagggggttttgtttagtggatgtttcggcgaatatgatttcgcgaacgggagtgggggtataggagagcgtgttcgaggtggtttggcgtttcggttttgagggtgattttttggagcggcgtcgggttcggaggatttggggcgtttaagatatttgaaggttgcggtatcgcgggaatttgcggggcgcggggtgttatggttatttgttcgtcgcgtttagggttcgggttggggatttttcggtcgtgcgaggagagcgtggggaatttgtcggaaatgagatttggttgcgttgggttgtttttattttttcgtttttatagtatttgaatgaagaggtaat

SEQ ID NO: 16570 - DNA, 991 bp, Artificial Sequence
  chemically treated genomic DNA (Homo sapiens) CpG-island No: 16570
attacctcttcattcaaatactataaaaacgaaaaaataaaaacaacccaacgcaaccaaatctcatttccgacaaattccccacgctctcctcgcacgaccgaaaaatccccaacccgaaccctaaacgcgacgaacaaataaccataacaccccgcgccccgcaaattcccgcgataccgcaaccttcaaatatcttaaacgccccaaatcctccgaacccgacgccgctccaaaaaatcaccctcaaaaccgaaacgccaaaccacctcgaacacgctctcctatacccccactcccgttcgcgaaatcatattcgccgaaacatccactaaacaaaaccccctaccaaacctacgtttccttttaaaaacaaaaacgaacgaaacaaaccaacgcgccctaaccgcgcccgccgctaaacgaccccgaaaacaacgaccctaacacgcaaaaaccccccgaccgaccccgccaaccccgaaaaccactccataaccgaaaaacgaaccgacgcgaaactcaaacgcgcgcccctaaaatcctcgcaacaaccgccacccccacctacacccccgacaacgccccgaaatctacgtatcaataccccccgcgacccccgcccaaaccccgaataaccctccataaaactaaaaccgcgcgccgaacgctctctacgaacccaactcttaccctaccgctacgaacaaaaccgacgcttaatcgaaacgataactactcgacgcccgcgactactcgatacgcgccgaacgaaaacgaaaacgccgaccaaaaacgatcaaaaaaaccgaacgctaaccgaacgactccgaaaactctaaactaaaacgacaccgcactcgtcaatctctaaaaaaaataaccgaaccgtcccccacgcgacgcgctcttcaaaaacgaaaaaaaaaaaaaaaaaaaaaaaaaaaaaaaaaacgaccgaataaaaaaaaaaaaaaaaaacgaaaaaaaa

SEQ ID NO: 16571 - DNA, 991 bp, Artificial Sequence
  chemically treated genomic DNA (Homo sapiens) CpG-island No: 16571
gttatttttttatttaaatgttgtaggaacgagaaaataaaggtagtttagcgtaattagattttattttcgataggttttttacgtttttttcgtacgatcgaggggtttttagttcgggttttggacgcggcgagtaggtgattatggtatttcgcgtttcgtaggttttcgcggtgtcgtagtttttaggtgttttgggcgttttagatttttcgggttcggcgtcgttttaggaagttatttttaaagtcggggcgttaggttatttcggatacgtttttttgtgtttttattttcgttcgcgaaattatgttcgtcgggatatttattgggtaggattttttattaggtttgcgtttttttttaaaaataaaagcgagcgaaataagttagcgcgttttggtcgcgttcgtcgttaggcgatttcgaagatagcggttttagtacgtaggaatttttcggtcgatttcgttagtttcggaggttattttataatcggaaaacgagtcggcgcggaatttagacgcgcgtttttagagttttcgtagtagtcgttatttttatttgtattttcggtagcgtttcgagatttgcgtgttagtgtttttcgcgattttcgtttaggtttcgggtgattttttatgggattggagtcgcgcgtcgggcgttttttgcgggtttagtttttattttgtcgttgcgggtagggtcggcgtttggtcgggacggtggttgttcggcgttcgcggttgttcggtgcgcgtcgggcgagggcgagggcgtcggttagagacgattagggaggtcggacgttggtcgggcggtttcgggagttttgagttggagcgatatcgtattcgttagtttttggaggaagtaatcgggtcgttttttacgcggcgcgttttttaggagcgggaggaggagggaggagggaggaggaaggagggacggtcgagtggaggggaggggaggaaacgagggagga

SEQ ID NO: 16572 - DNA, 991 bp, Artificial Sequence
  chemically treated genomic DNA (Homo sapiens) CpG-island No: 16572
tcctccctcgtttcctcccctcccctccactcgaccgtccctccttcctcctccctcctccctcctcctcccgctcctaaaaaacgcgccgcgtaaaaaacgacccgattacttcctccaaaaactaacgaatacgatatcgctccaactcaaaactcccgaaaccgcccgaccaacgtccgacctccctaatcgtctctaaccgacgccctcgccctcgcccgacgcgcaccgaacaaccgcgaacgccgaacaaccaccgtcccgaccaaacgccgaccctacccgcaacgacaaaataaaaactaaacccgcaaaaaacgcccgacgcgcgactccaatcccataaaaaatcacccgaaacctaaacgaaaatcgcgaaaaacactaacacgcaaatctcgaaacgctaccgaaaatacaaataaaaataacgactactacgaaaactctaaaaacgcgcgtctaaattccgcgccgactcgttttccgattataaaataacctccgaaactaacgaaatcgaccgaaaaattcctacgtactaaaaccgctatcttcgaaatcgcctaacgacgaacgcgaccaaaacgcgctaacttatttcgctcgcttttatttttaaaaaaaaacgcaaacctaataaaaaatcctacccaataaatatcccgacgaacataatttcgcgaacgaaaataaaaacacaaaaaaacgtatccgaaataacctaacgccccgactttaaaaataacttcctaaaacgacgccgaacccgaaaaatctaaaacgcccaaaacacctaaaaactacgacaccgcgaaaacctacgaaacgcgaaataccataatcacctactcgccgcgtccaaaacccgaactaaaaacccctcgatcgtacgaaaaaaacgtaaaaaacctatcgaaaataaaatctaattacgctaaactacctttattttctcgttcctacaacatttaaataaaaaaataac

SEQ ID NO: 16573 - DNA, 657 bp, Artificial Sequence
  chemically treated genomic DNA (Homo sapiens) CpG-island No: 16573
cgtttttcgcggggtatcgtaggttttttaggagagtgtgggttttatacgtcgagttttgaacgggtagtttgattcgtcgtggttgggattttaatttcgaaagtaacgttggagagcgcgtttttcgtatattttaagggttttgaagtgtttcgtattagacggttgcgtagtcgtttttttcgtaggagcgttgtttagtttagaatagcggcgggtcgaaggagcgtttattcgtagttttcgttttgtagtttttttattttgcgagtcgtcgttaacgcggttaaatttttagttcggggatagagtttttttcgttattatttcggcgttttttatagatatagttttaattagttcgtgcggcgacgacggttttattttagttattgttatagtacgtgattttcggtttcggtttcgttttcgttcgcgagggtcggtcgggttcgttgtttttgcgatcgcgggggtttttgggaaagcgagtttttcgtcgtggtcgaaggcggtcgttatggcgtcggtagtgttagcgggcgttttgcgattcggttcgggtttcgttattatttattgtgttttttaagttatttcggtattttaatttcgttttgttttttttagacgatttttaatatttgggaaagt

SEQ ID NO: 16574 - DNA, 657 bp, Artificial Sequence
  chemically treated genomic DNA (Homo sapiens) CpG-island No: 16574
actttcccaaatattaaaaatcgtctaaaaaaaacaaaacgaaattaaaataccgaaataacttaaaaaacacaataaataataacgaaacccgaaccgaatcgcaaaacgcccgctaacactaccgacgccataacgaccgccttcgaccacgacgaaaaactcgctttcccaaaaacccccgcgatcgcaaaaacaacgaacccgaccgaccctcgcgaacgaaaacgaaaccgaaaccgaaaatcacgtactataacaataactaaaataaaaccgtcgtcgccgcacgaactaattaaaactatatctataaaaaacgccgaaataataacgaaaaaaactctatccccgaactaaaaatttaaccgcgttaacgacgactcgcaaaataaaaaaactacaaaacgaaaactacgaataaacgctccttcgacccgccgctattctaaactaaacaacgctcctacgaaaaaaacgactacgcaaccgtctaatacgaaacacttcaaaacccttaaaatatacgaaaaacgcgctctccaacgttactttcgaaattaaaatcccaaccacgacgaatcaaactacccgttcaaaactcgacgtataaaacccacactctcctaaaaaacctacgataccccgcgaaaaacg

SEQ ID NO: 16575 - DNA, 657 bp, Artificial Sequence
  chemically treated genomic DNA (Homo sapiens) CpG-island No: 16575
atttttttaggtattaaaaatcgtttagagagagtagggcgaaattagagtgtcgaagtggtttgagaagtatagtgaatggtggcgaagttcgagtcgggtcgtaagacgttcgttggtattgtcggcgttatggcggtcgttttcggttacggcggaggattcgtttttttaggggttttcgcggtcgtaggggtaacgagttcggtcggttttcgcgagcggaggcggggtcggggtcggaagttacgtgttgtgatagtagttggggtgaggtcgtcgtcgtcgtacgggttggttggggttgtgtttgtgggaggcgtcggggtgatggcgaaaaagattttgttttcggattgggagtttgatcgcgttgacgacggttcgtagagtaagggagttgtagggcgagggttgcgggtggacgttttttcggttcgtcgttgttttgggttgggtagcgtttttgcgagagggacggttgcgtagtcgtttggtgcgggatattttagagtttttggggtgtgcgagggacgcgttttttagcgttattttcggggttggggttttagttacggcgggttaggttgttcgtttagggttcggcgtgtgaggtttatatttttttaaggagtttgcggtgtttcgcggggagcg

SEQ ID NO: 16576 - DNA, 657 bp, Artificial Sequence
  chemically treated genomic DNA (Homo sapiens) CpG-island No: 16576
cgctccccgcgaaacaccgcaaactccttaaaaaaatataaacctcacacgccgaaccctaaacgaacaacctaacccgccgtaactaaaaccccaaccccgaaaataacgctaaaaaacgcgtccctcgcacaccccaaaaactctaaaatatcccgcaccaaacgactacgcaaccgtccctctcgcaaaaacgctacccaacccaaaacaacgacgaaccgaaaaaacgtccacccgcaaccctcgccctacaactcccttactctacgaaccgtcgtcaacgcgatcaaactcccaatccgaaaacaaaatctttttcgccatcaccccgacgcctcccacaaacacaaccccaaccaacccgtacgacgacgacgacctcaccccaactactatcacaacacgtaacttccgaccccgaccccgcctccgctcgcgaaaaccgaccgaactcgttacccctacgaccgcgaaaacccctaaaaaaacgaatcctccgccgtaaccgaaaacgaccgccataacgccgacaataccaacgaacgtcttacgacccgactcgaacttcgccaccattcactatacttctcaaaccacttcgacactctaatttcgccctactctctctaaacgatttttaatacctaaaaaaat

SEQ ID NO: 16577 - DNA, 1039 bp, Artificial Sequence
  chemically treated genomic DNA (Homo sapiens) CpG-island No: 16577
aaggagtgttatagcgttaaattttgttggtttcgcgttaggtcgagttttatttttttagttcgcggttaatatttttatttcgttttatagttcgtcgcgttcgcggggcgatattttttattttattatttcggaggtggtgcggtcgagtttcggatttaattggcggaagcggggtcggttgtgtgcgcgcgtataaatgttcggatgcgtcgcgacgattcgcgcgtttttttcgggcggtagggggcgcgtatcgaggtatcgcggcgagtttggttgtttttggggtttgtgtggttttgtgtgtcggaaagatggagtaagaagtcgagttcgaggggcggtcgcgatttttttgatcgagattttgttgttttcgtagttaggagtatcgttttttttcggattagtgcgtacgagcgtttagtgttttggttcggagagtggaatgattttcgaggtttaaggcgtcgtgttttcgcgcgtttcgtgaaggaaattggggagttttgagggattttcgattttaagcgcgaaaatttcggatggggaggagtaggtattggttcggtagcgagcggttatttttgggtttgggttttgacggggtttttttatcgttgggcgtttagtttttggttcgttcgtagtttttgtgcggttcgtggttgggggttcggggttcggggcgtcggggtatggggtacgtggtttttgcggaggttttgttggattgggggttaggtagtcgtcgttagggaggagggcgggatttcggacggtttttttcgtcggtgggggtgggggtggttcggaggttttcgcgggagtttagggtaaaggttacgggggtcgggggttgcggggtcgtttcggcgcgggaggttcggatgatcgtaggtgtttgtcgggttattagtgtgaacgttgcgcgtagtttgggcgggattgggtcggtttagtgggtaggttgatttagtttttttttttgagttggttaagtttagatacgtttcgaaattgtagtaaaagg

SEQ ID NO: 16578 - DNA, 1039 bp, Artificial Sequence
  chemically treated genomic DNA (Homo sapiens) CpG-island No: 16578
ccttttactacaatttcgaaacgtatctaaacttaaccaactcaaaaaaaaaaactaaatcaacctacccactaaaccgacccaatcccgcccaaactacgcgcaacgttcacactaataacccgacaaacacctacgatcatccgaacctcccgcgccgaaacgaccccgcaacccccgacccccgtaacctttaccctaaactcccgcgaaaacctccgaaccacccccacccccaccgacgaaaaaaaccgtccgaaatcccgccctcctccctaacgacgactacctaacccccaatccaacaaaacctccgcaaaaaccacgtaccccataccccgacgccccgaaccccgaacccccaaccacgaaccgcacaaaaactacgaacgaaccaaaaactaaacgcccaacgataaaaaaaccccgtcaaaacccaaacccaaaaataaccgctcgctaccgaaccaatacctactcctccccatccgaaattttcgcgcttaaaatcgaaaatccctcaaaactccccaatttccttcacgaaacgcgcgaaaacacgacgccttaaacctcgaaaatcattccactctccgaaccaaaacactaaacgctcgtacgcactaatccgaaaaaaaacgatactcctaactacgaaaacaacaaaatctcgatcaaaaaaatcgcgaccgcccctcgaactcgacttcttactccatctttccgacacacaaaaccacacaaaccccaaaaacaaccaaactcgccgcgatacctcgatacgcgccccctaccgcccgaaaaaaacgcgcgaatcgtcgcgacgcatccgaacatttatacgcgcgcacacaaccgaccccgcttccgccaattaaatccgaaactcgaccgcaccacctccgaaataataaaataaaaaatatcgccccgcgaacgcgacgaactataaaacgaaataaaaatattaaccgcgaactaaaaaaataaaactcgacctaacgcgaaaccaacaaaatttaacgctataacactcctt

SEQ ID NO: 16579 - DNA, 1039 bp, Artificial Sequence
  chemically treated genomic DNA (Homo sapiens) CpG-island No: 16579
ttttttattgtagtttcggaacgtgtttgaatttgattagtttaagaggaaaagttgagttaatttgtttattgaatcggtttaatttcgtttagattacgcgtagcgtttatattagtgattcgataggtatttgcgattattcggatttttcgcgtcgaagcggtttcgtagttttcggttttcgtgatttttattttgaattttcgcggagattttcgaattatttttatttttatcggcggggagagtcgttcgaaatttcgtttttttttttggcggcgattgtttagtttttagtttaataaaattttcgtaaaggttacgtgttttatgtttcggcgtttcgagtttcgagtttttagttacgaatcgtataaaggttgcgaacgggttagaggttgggcgtttagcgatagaggggtttcgttaaagtttagatttaaaagtgatcgttcgttgtcgggttagtatttgtttttttttattcggggttttcgcgtttggagtcgggggttttttaagattttttagttttttttacggggcgcgcggaagtacgacgttttgggtttcggggattattttatttttcgggttagggtattgggcgttcgtacgtattaattcggggagggacggtgtttttggttgcgaaagtagtaggatttcggttagaggggtcgcggtcgtttttcgggttcggttttttgttttattttttcgatatatagggttatataggttttagaagtagttaagttcgtcgcggtgtttcggtgcgcgttttttatcgttcgaggggagcgcgcgggtcgtcgcggcgtattcgggtatttgtgcgcgcgtatataatcggtttcgttttcgttaattgggttcggggttcggtcgtattattttcgggatgatggagtggggggtgtcgtttcgcgggcgcggcgggttgtgaggcggggtgggggtgttggtcgcgagttgagagggtggggttcggtttggcgcggagttagtaaggtttggcgttgtgatatttttt

SEQ ID NO: 16580 - DNA, 1039 bp, Artificial Sequence
  chemically treated genomic DNA (Homo sapiens) CpG-island No: 16580
aaaaaatatcacaacgccaaaccttactaactccgcgccaaaccgaaccccaccctctcaactcgcgaccaacacccccaccccgcctcacaacccgccgcgcccgcgaaacgacaccccccactccatcatcccgaaaataatacgaccgaaccccgaacccaattaacgaaaacgaaaccgattatatacgcgcgcacaaatacccgaatacgccgcgacgacccgcgcgctcccctcgaacgataaaaaacgcgcaccgaaacaccgcgacgaacttaactacttctaaaacctatataaccctatatatcgaaaaaataaaacaaaaaaccgaacccgaaaaacgaccgcgacccctctaaccgaaatcctactactttcgcaaccaaaaacaccgtccctccccgaattaatacgtacgaacgcccaataccctaacccgaaaaataaaataatccccgaaacccaaaacgtcgtacttccgcgcgccccgtaaaaaaaactaaaaaatcttaaaaaacccccgactccaaacgcgaaaaccccgaataaaaaaaaacaaatactaacccgacaacgaacgatcacttttaaatctaaactttaacgaaacccctctatcgctaaacgcccaacctctaacccgttcgcaacctttatacgattcgtaactaaaaactcgaaactcgaaacgccgaaacataaaacacgtaacctttacgaaaattttattaaactaaaaactaaacaatcgccgccaaaaaaaaaaacgaaatttcgaacgactctccccgccgataaaaataaaaataattcgaaaatctccgcgaaaattcaaaataaaaatcacgaaaaccgaaaactacgaaaccgcttcgacgcgaaaaatccgaataatcgcaaatacctatcgaatcactaatataaacgctacgcgtaatctaaacgaaattaaaccgattcaataaacaaattaactcaacttttcctcttaaactaatcaaattcaaacacgttccgaaactacaataaaaaa

SEQ ID NO: 16581 - DNA, 931 bp, Artificial Sequence
  chemically treated genomic DNA (Homo sapiens) CpG-island No: 16581
cgggtggtcgcgtcgaggtacgggggacggtttaagcgcgggtgaagtggggattagaggagggtttcgtttttattgttttcgagggaggtttcggttatttatatttttcgtgtttcgttcgtttatcgtcggtaatggcgttcgggtcgatattttgtgcgggtagcggggtttggtcggggtttcgtcggtcgggttgtggtgcgggtttcggggggcgataggaaaggggtgcggacgcgagtataaggtcggggcgagcggttttcgtaggtcgcggggcggtgtaataagcggtttcggcgggggaaagagggaagaggacgcggaggaagaggagggggagtcgtttttcgcggcggcgtcgtcggggtatgcggatagtaacgagggagggtttcgggcgaggcggttgttcggcgttggcggggcggcgaggttggtaggatgaggcgtggaaggggagtcgggaggcggtggcgagtttcgttaggtttttcggattatgggtgaaggtgaagtcggtgttttaaattattgtttggttcgttttggcgagcgtttgggcgttaggaatcgcggttttgatagcgttattcgcgtcgcgtttcgtttttcgttttaggtgtacggcgtcgttcgatttagtcgtatttacgcgttcggggtttagcggcggcggcgttcgatttttcggcgcgaatgtttcggttcggttcgcgcggttatagttatcgtcgtcgtcgcgttttagttaggaggagcggttcgagtcggttgcgcgcggagtagcgggcgcggtacgtagcgtttagaggtatttggcggtcgtcgtcgggtgggcgggcgttagtcgagggggtttttttatttatttttttattagggatgcggggtcgttttttttttttttttttttttttttttt

SEQ ID NO: 16582 - DNA, 931 bp, Artificial Sequence
  chemically treated genomic DNA (Homo sapiens) CpG-island No: 16582
aaaaaaaaaaaaaaaaaaaaaaaaaaaaacgaccccgcatccctaataaaaaaataaataaaaaaaccccctcgactaacgcccgcccacccgacgacgaccgccaaatacctctaaacgctacgtaccgcgcccgctactccgcgcgcaaccgactcgaaccgctcctcctaactaaaacgcgacgacgacgataactataaccgcgcgaaccgaaccgaaacattcgcgccgaaaaatcgaacgccgccgccgctaaaccccgaacgcgtaaatacgactaaatcgaacgacgccgtacacctaaaacgaaaaacgaaacgcgacgcgaataacgctatcaaaaccgcgattcctaacgcccaaacgctcgccaaaacgaaccaaacaataatttaaaacaccgacttcaccttcacccataatccgaaaaacctaacgaaactcgccaccgcctcccgactccccttccacgcctcatcctaccaacctcgccgccccgccaacgccgaacaaccgcctcgcccgaaaccctccctcgttactatccgcataccccgacgacgccgccgcgaaaaacgactccccctcctcttcctccgcgtcctcttccctctttcccccgccgaaaccgcttattacaccgccccgcgacctacgaaaaccgctcgccccgaccttatactcgcgtccgcacccctttcctatcgccccccgaaacccgcaccacaacccgaccgacgaaaccccgaccaaaccccgctacccgcacaaaatatcgacccgaacgccattaccgacgataaacgaacgaaacacgaaaaatataaataaccgaaacctccctcgaaaacaataaaaacgaaaccctcctctaatccccacttcacccgcgcttaaaccgtcccccgtacctcgacgcgaccacccg

SEQ ID NO: 16583 - DNA, 931 bp, Artificial Sequence
  chemically treated genomic DNA (Homo sapiens) CpG-island No: 16583
gaaaaaggaggaggaggaggaggaggaggcggtttcgtatttttaatgagggaatgaatggagaggttttttcggttggcgttcgtttattcggcggcggtcgttaagtgtttttgggcgttgcgtgtcgcgttcgttgtttcgcgcgtagtcggttcgggtcgttttttttgattgaggcgcggcggcggcggtggttgtgatcgcgcggatcgagtcgagatattcgcgtcgggggatcgggcgtcgtcgtcgttgggtttcgggcgcgtggatgcggttgggtcgggcggcgtcgtatatttgaggcggagaacggggcgcggcgcgggtgacgttgttagggtcgcggtttttgacgtttaggcgttcgttaggacgagttaggtagtgatttgaggtatcggttttatttttatttatggttcggagagtttagcggggttcgttatcgtttttcggttttttttttacgttttattttgttagtttcgtcgtttcgttagcgtcgggtaatcgtttcgttcgaagttttttttcgttattgttcgtatatttcggcggcgtcgtcgcgggaagcggttttttttttttttttttcgcgtttttttttttttttttttcgtcggggtcgtttgttgtatcgtttcgcggtttgcgggagtcgttcgtttcggttttgtgttcgcgttcgtattttttttttgtcgtttttcggggttcgtattatagttcggtcggcgagatttcggttagatttcgttgttcgtataaaatgtcggttcggacgttattgtcgacggtgaacgagcgggatacggaaaatgtgagtaatcggagtttttttcgggagtagtgggggcgagatttttttttgatttttattttattcgcgtttgggtcgtttttcgtgtttcggcgcggttattcg

SEQ ID NO: 16584 - DNA, 931 bp, Artificial Sequence
  chemically treated genomic DNA (Homo sapiens) CpG-island No: 16584
cgaataaccgcgccgaaacacgaaaaacgacccaaacgcgaataaaataaaaatcaaaaaaaaatctcgcccccactactcccgaaaaaaactccgattactcacattttccgtatcccgctcgttcaccgtcgacaataacgtccgaaccgacattttatacgaacaacgaaatctaaccgaaatctcgccgaccgaactataatacgaaccccgaaaaacgacaaaaaaaaaatacgaacgcgaacacaaaaccgaaacgaacgactcccgcaaaccgcgaaacgatacaacaaacgaccccgacgaaaaaaaaaaaaaaaaaaacgcgaaaaaaaaaaaaaaaaaaccgcttcccgcgacgacgccgccgaaatatacgaacaataacgaaaaaaaacttcgaacgaaacgattacccgacgctaacgaaacgacgaaactaacaaaataaaacgtaaaaaaaaaaccgaaaaacgataacgaaccccgctaaactctccgaaccataaataaaaataaaaccgatacctcaaatcactacctaactcgtcctaacgaacgcctaaacgtcaaaaaccgcgaccctaacaacgtcacccgcgccgcgccccgttctccgcctcaaatatacgacgccgcccgacccaaccgcatccacgcgcccgaaacccaacgacgacgacgcccgatcccccgacgcgaatatctcgactcgatccgcgcgatcacaaccaccgccgccgccgcgcctcaatcaaaaaaaacgacccgaaccgactacgcgcgaaacaacgaacgcgacacgcaacgcccaaaaacacttaacgaccgccgccgaataaacgaacgccaaccgaaaaaacctctccattcattccctcattaaaaatacgaaaccgcctcctcctcctcctcctcctcctttttc

SEQ ID NO: 16585 - DNA, 760 bp, Artificial Sequence
  chemically treated genomic DNA (Homo sapiens) CpG-island No: 16585
gggaagcgttcggggttttcgggatttattttttagaggcgggtgtaggtgttcggtttttcgcggttttcgattttcgggcggcgcggagcggcgggagttaattagatgggttggcggtcggtttgggaatggggcggtcgcgtaggaacggtttttagtttttagcgtttcggtgtagtttttattcgggttcgcgttcgttgcgttcgggtttttagtagtcgttggatgcgttgtcgattcgttcggttcggcggagttgggttttggtattaattttcgcgttttaattagttttcgattcggcgttcggagagagtagggaggaggagatcgcgggagtagaaggagggagggggcggtgggggaggagttgtaagtaaagggagagaaggaggggagcgggagcgaaaaagaggagggggttggagtagatttgtcgcggcgggcgttgtattcgttagtttcgaggcgcgcggaggagcgcgagggggcgttttgtatttcgcggttgttcggtcgattttcgtttcgggtttgtcgagtgtggtgattagttcggtgggtcgaagtttttttttcggtcggtatttcggcggtaagatttaggatttcgagtatttgtcgtcgtttgttatatttcgttttgtcgttttcggttattttatttcgaatgtgatattttcgagggttatcggcgcggtttgtttattttaatatttagggtttgaggaagtttttttaaattttatttcgg

SEQ ID NO: 16586 - DNA, 760 bp, Artificial Sequence
  chemically treated genomic DNA (Homo sapiens) CpG-island No: 16586
ccgaaataaaatttaaaaaaacttcctcaaaccctaaatattaaaataaacaaaccgcgccgataaccctcgaaaatatcacattcgaaataaaataaccgaaaacgacaaaacgaaatataacaaacgacgacaaatactcgaaatcctaaatcttaccgccgaaataccgaccgaaaaaaaaacttcgacccaccgaactaatcaccacactcgacaaacccgaaacgaaaatcgaccgaacaaccgcgaaatacaaaacgccccctcgcgctcctccgcgcgcctcgaaactaacgaatacaacgcccgccgcgacaaatctactccaaccccctcctctttttcgctcccgctcccctccttctctccctttacttacaactcctcccccaccgccccctccctccttctactcccgcgatctcctcctccctactctctccgaacgccgaatcgaaaactaattaaaacgcgaaaattaataccaaaacccaactccgccgaaccgaacgaatcgacaacgcatccaacgactactaaaaacccgaacgcaacgaacgcgaacccgaataaaaactacaccgaaacgctaaaaactaaaaaccgttcctacgcgaccgccccattcccaaaccgaccgccaacccatctaattaactcccgccgctccgcgccgcccgaaaatcgaaaaccgcgaaaaaccgaacacctacacccgcctctaaaaaataaatcccgaaaaccccgaacgcttccc

SEQ ID NO: 16587 - DNA, 760 bp, Artificial Sequence
  chemically treated genomic DNA (Homo sapiens) CpG-island No: 16587
tcggagtggggtttgggggagtttttttaggttttgagtgttggggtgggtaggtcgcgtcgatggttttcggggatgttatattcgagatggggtgatcgagaacggtaaggcgggatgtggtaaacggcggtaagtgttcggagttttaggttttgtcgtcggaatgtcggtcggggaaggggtttcggtttatcgggttggttattatattcggtaggttcggggcgggagtcggtcgagtagtcgcgggatgtagggcgttttttcgcgttttttcgcgcgtttcgaggttggcgggtgtagcgttcgtcgcggtaggtttgttttagtttttttttttttttcgttttcgtttttttttttttttttttttgtttgtaattttttttttatcgttttttttttttttttgttttcgcggtttttttttttttgtttttttcgagcgtcgggtcgggagttagttggagcgcgggggttggtgttagagtttagtttcgtcgagtcgggcgggtcggtagcgtatttagcggttgttgggagttcgagcgtagcgggcgcgggttcgggtggggattgtatcggagcgttgagagttggaggtcgtttttgcgcggtcgttttatttttagatcggtcgttagtttatttggttagttttcgtcgtttcgcgtcgttcgggagtcgggagtcgcggggaatcgggtatttgtattcgtttttgggaggtgagtttcgggagtttcgggcgtttttt

SEQ ID NO: 16588 - DNA, 760 bp, Artificial Sequence
  chemically treated genomic DNA (Homo sapiens) CpG-island No: 16588
aaaaaacgcccgaaactcccgaaactcacctcccaaaaacgaatacaaatacccgattccccgcgactcccgactcccgaacgacgcgaaacgacgaaaactaaccaaataaactaacgaccgatctaaaaataaaacgaccgcgcaaaaacgacctccaactctcaacgctccgatacaatccccacccgaacccgcgcccgctacgctcgaactcccaacaaccgctaaatacgctaccgacccgcccgactcgacgaaactaaactctaacaccaacccccgcgctccaactaactcccgacccgacgctcgaaaaaaacaaaaaaaaaaaaaccgcgaaaacaaaaaaaaaaaaaaaacgataaaaaaaaaattacaaacaaaaaaaaaaaaaaaaaaaaacgaaaacgaaaaaaaaaaaaaaactaaaacaaacctaccgcgacgaacgctacacccgccaacctcgaaacgcgcgaaaaaacgcgaaaaaacgccctacatcccgcgactactcgaccgactcccgccccgaacctaccgaatataataaccaacccgataaaccgaaaccccttccccgaccgacattccgacgacaaaacctaaaactccgaacacttaccgccgtttaccacatcccgccttaccgttctcgatcaccccatctcgaatataacatccccgaaaaccatcgacgcgacctacccaccccaacactcaaaacctaaaaaaactcccccaaaccccactccga

SEQ ID NO: 16589 - DNA, 857 bp, Artificial Sequence
  chemically treated genomic DNA (Homo sapiens) CpG-island No: 16589
cgcgcggagagcggcgggattcggagcggcgtttttcggggttatttttttaggacgtttcgtagagttgggagcgttgttttatttcgttcgggtcgtttttggggatttcgttcggggtttcgcggtttttttgtttcgcgtcgcgtttattcgtttttaggatttacggtacgttttcgcgtcgttattttgttattttttgtcgtcggttttgtagtttcggtcgtcgtttcggggttgtttagattttatagtcgttcgggggtaggagtcgttaaggagggggtcgggtataatgcgtcgtcgttttcgtagtcgtcgtttcgttttttttgtgtcggcgcgaggttgtttgaggcggttacgggcgaagggcggttcgttgcgtttcgcgaatttcgcgggtcgtcgtcgtcgttagagttttttagaggtaacggtaacggttatcgttacggtcgagtcgttttagtcgggattgcggcgcgcgggggcggcgtttgtacgtcgttcggttgggggcgtagcgggttcggtttcgtttttgattcgtttttgttttcggtttcggtttcgttttaattcgcgcgttttcgtcgattttcggtcgcgcgttcgcgcgcgcgggtgttttaaggagtcggaggaacgcggtcgcgcgacgggtttcggacgtcgagggtggtgtttttttcgagttttcggtggtgaggtcgtttttagaaggttatggaagcgtaggggagagcgagacggtcgagtttaggtaaattttcgagaaaggtcgagtgcgcgacggttttgcggggaggatcgcgttttttcgaatgcggtggttttattagattatgata

SEQ ID NO: 16590 - DNA, 857 bp, Artificial Sequence
  chemically treated genomic DNA (Homo sapiens) CpG-island No: 16590
tatcataatctaataaaaccaccgcattcgaaaaaacgcgatcctccccgcaaaaccgtcgcgcactcgacctttctcgaaaatttacctaaactcgaccgtctcgctctcccctacgcttccataaccttctaaaaacgacctcaccaccgaaaactcgaaaaaaacaccaccctcgacgtccgaaacccgtcgcgcgaccgcgttcctccgactccttaaaacacccgcgcgcgcgaacgcgcgaccgaaaatcgacgaaaacgcgcgaattaaaacgaaaccgaaaccgaaaacaaaaacgaatcaaaaacgaaaccgaacccgctacgcccccaaccgaacgacgtacaaacgccgcccccgcgcgccgcaatcccgactaaaacgactcgaccgtaacgataaccgttaccgttacctctaaaaaactctaacgacgacgacgacccgcgaaattcgcgaaacgcaacgaaccgcccttcgcccgtaaccgcctcaaacaacctcgcgccgacacaaaaaaaacgaaacgacgactacgaaaacgacgacgcattatacccgaccccctccttaacgactcctacccccgaacgactataaaatctaaacaaccccgaaacgacgaccgaaactacaaaaccgacgacaaaaaataacaaaataacgacgcgaaaacgtaccgtaaatcctaaaaacgaataaacgcgacgcgaaacaaaaaaaccgcgaaaccccgaacgaaatccccaaaaacgacccgaacgaaataaaacaacgctcccaactctacgaaacgtcctaaaaaaataaccccgaaaaacgccgctccgaatcccgccgctctccgcgcg

SEQ ID NO: 16591 - DNA, 857 bp, Artificial Sequence
  chemically treated genomic DNA (Homo sapiens) CpG-island No: 16591
tattataatttaatgagattatcgtattcggggaggcgcggtttttttcgtagagtcgtcgcgtattcggtttttttcgaggatttgtttgggttcggtcgtttcgtttttttttgcgtttttatgattttttgagagcggttttattatcggaggttcggaggaagtattattttcggcgttcggggttcgtcgcgcggtcgcgttttttcgattttttggagtattcgcgcgcgcgggcgcgcggtcggggatcggcgggggcgcgcgggttggggcggggtcggggtcgggggtaggggcgggttaggggcggggtcgggttcgttgcgtttttagtcgagcggcgtgtaggcgtcgttttcgcgcgtcgtagtttcggttggagcgattcggtcgtggcggtggtcgttatcgttgtttttgggaggttttggcggcggcggcggttcgcggggttcgcggagcgtagcgggtcgtttttcgttcgtggtcgttttaagtagtttcgcgtcgatataggggaggcgagacggcggttgcggaggcggcggcgtattgtgttcggttttttttttggcggtttttgttttcgggcggttgtgggatttgggtagtttcggggcggcggtcgaggttatagagtcggcggtaggggatggtaagatagcggcgcgggagcgtatcgtgagttttgggggcgggtgggcgcggcgcggagtaggggagtcgcggagtttcgagcggggtttttaggggcggttcgggcggggtggggtagcgtttttagttttgcggagcgttttaggggagtgatttcggagagcgtcgtttcgggtttcgtcgtttttcgcgcg

SEQ ID NO: 16592 - DNA, 857 bp, Artificial Sequence
  chemically treated genomic DNA (Homo sapiens) CpG-island No: 16592
cgcgcgaaaaacgacgaaacccgaaacgacgctctccgaaatcactcccctaaaacgctccgcaaaactaaaaacgctaccccaccccgcccgaaccgcccctaaaaaccccgctcgaaactccgcgactcccctactccgcgccgcgcccacccgcccccaaaactcacgatacgctcccgcgccgctatcttaccatcccctaccgccgactctataacctcgaccgccgccccgaaactacccaaatcccacaaccgcccgaaaacaaaaaccgccaaaaaaaaaaccgaacacaatacgccgccgcctccgcaaccgccgtctcgcctcccctatatcgacgcgaaactacttaaaacgaccacgaacgaaaaacgacccgctacgctccgcgaaccccgcgaaccgccgccgccgccaaaacctcccaaaaacaacgataacgaccaccgccacgaccgaatcgctccaaccgaaactacgacgcgcgaaaacgacgcctacacgccgctcgactaaaaacgcaacgaacccgaccccgcccctaacccgcccctacccccgaccccgaccccgccccaacccgcgcgcccccgccgatccccgaccgcgcgcccgcgcgcgcgaatactccaaaaaatcgaaaaaacgcgaccgcgcgacgaaccccgaacgccgaaaataatacttcctccgaacctccgataataaaaccgctctcaaaaaatcataaaaacgcaaaaaaaaacgaaacgaccgaacccaaacaaatcctcgaaaaaaaccgaatacgcgacgactctacgaaaaaaaccgcgcctccccgaatacgataatctcattaaattataata

SEQ ID NO: 16593 - DNA, 527 bp, Artificial Sequence
  chemically treated genomic DNA (Homo sapiens) CpG-island No: 16593
aggaaggtcggatttttacgcgaggtttgttgggaagtgtagttcgttagtggaaggaagttatatggaagaggggcggtagttggttgtgggtattgggttagaggtattacgtgggggtattttcgttttagtttttggataagacgtaggcgtaaatttacggttgttgcgggggatttttgtggtttttttcggtcggtggaattaattcgtgtaatagagaagcggggcgaattgaggcgagtgaagtggattttgagggttatcgttatcgttattgttgcggtaggggcgtggagggtagagggtcgcggaggtcgtagttgtaaatatggtttagagtagagacggcggaaattcgttcgtcgagtttagcgagtttgataattttttttaggtgatttgcgttagtcggttttttttgggcggttaggttgatttttttcggttttgtagggtcgggttaatttgtatttttatttgtgatatttgattttgggaagagtcgttacgtggggtgatag

SEQ ID NO: 16594 - DNA, 527 bp, Artificial Sequence
  chemically treated genomic DNA (Homo sapiens) CpG-island No: 16594
ctatcaccccacgtaacgactcttcccaaaatcaaatatcacaaataaaaatacaaattaacccgaccctacaaaaccgaaaaaaatcaacctaaccgcccaaaaaaaaccgactaacgcaaatcacctaaaaaaaattatcaaactcgctaaactcgacgaacgaatttccgccgtctctactctaaaccatatttacaactacgacctccgcgaccctctaccctccacgcccctaccgcaacaataacgataacgataaccctcaaaatccacttcactcgcctcaattcgccccgcttctctattacacgaattaattccaccgaccgaaaaaaaccacaaaaatcccccgcaacaaccgtaaatttacgcctacgtcttatccaaaaactaaaacgaaaatacccccacgtaatacctctaacccaatacccacaaccaactaccgcccctcttccatataacttccttccactaacgaactacacttcccaacaaacctcgcgtaaaaatccgaccttcct

SEQ ID NO: 16595 - DNA, 527 bp, Artificial Sequence
  chemically treated genomic DNA (Homo sapiens) CpG-island No: 16595
ttgttattttacgtggcggttttttttaggattaaatgttataaatggggatataagttagttcgattttatagaatcgggaagaattaatttgatcgtttaaaagaggtcgattggcgtaagttatttgaaaggggttgttaagttcgttgggttcggcgaacgggttttcgtcgtttttgttttgagttatgtttgtaattgcggttttcgcggttttttgttttttacgtttttgtcgtagtagtggcggtagcggtagtttttagagtttattttattcgttttagttcgtttcgtttttttgttgtacggattggttttatcgatcggaaagggttataaggatttttcgtagtagtcgtgggtttgcgtttgcgttttgtttaaaagttaagacgaaagtgtttttacgtgatatttttaatttagtgtttataattaattatcgttttttttttatgtgatttttttttattaacgaattatattttttagtaggtttcgcgtaggaattcggttttttt

SEQ ID NO: 16596 - DNA, 527 bp, Artificial Sequence
  chemically treated genomic DNA (Homo sapiens) CpG-island No: 16596
aaaaaaaccgaattcctacgcgaaacctactaaaaaatataattcgttaataaaaaaaaatcacataaaaaaaaaacgataattaattataaacactaaattaaaaatatcacgtaaaaacactttcgtcttaacttttaaacaaaacgcaaacgcaaacccacgactactacgaaaaatccttataaccctttccgatcgataaaaccaatccgtacaacaaaaaaacgaaacgaactaaaacgaataaaataaactctaaaaactaccgctaccgccactactacgacaaaaacgtaaaaaacaaaaaaccgcgaaaaccgcaattacaaacataactcaaaacaaaaacgacgaaaacccgttcgccgaacccaacgaacttaacaacccctttcaaataacttacgccaatcgacctcttttaaacgatcaaattaattcttcccgattctataaaatcgaactaacttatatccccatttataacatttaatcctaaaaaaaaccgccacgtaaaataacaa

SEQ ID NO: 16597 - DNA, 751 bp, Artificial Sequence
  chemically treated genomic DNA (Homo sapiens) CpG-island No: 16597
ggagagggttgaggtcgcgggtcgttcgttttagtttttcggaagttcgggtttttgaagtatagatagttaagagcggttcgagttaagttttaggaataggggtttcgggaagagatttcgatcgggtcgtatagcggggaggtttggttcgagagtttttatttggtcggttgcgattttatattggaatttcggaaacgcgttttggtcgttttagtttaagtgggttttggggcggttttttgttttttattttcgaacgttagtttttttcgggcgattcgaaggttacgaggcgggtcgtatagtttcgcgtcgtcgggggcgtttcgggagtatcggggattgcgcgcggcgtttagggagggcggttgttgttttttggcgttcgttagagttcgcggcgcgtttcgatagtttcgcgtagttcgggttcgttcgggaaaggtttttacgttagttaatttcggtttttttttgcgttcgggttcgcggtaacgttcggggatagtttttgcgcggtagcggttatagtattttagttttgggggagggaggagcgggcgttaggggtttcgtgaggtcggcgagggattttcgcgtcggggagtttaattgaggggtttcgcggggattataaagtagttcgcggtggaacggggtcgggattcggggattgggttgtagtttcggggtggatgagaggtttcgggaggtgtagggttcggtagggagggcgtggagggat

SEQ ID NO: 16598 - DNA, 751 bp, Artificial Sequence
  chemically treated genomic DNA (Homo sapiens) CpG-island No: 16598
atccctccacgccctccctaccgaaccctacacctcccgaaacctctcatccaccccgaaactacaacccaatccccgaatcccgaccccgttccaccgcgaactactttataatccccgcgaaacccctcaattaaactccccgacgcgaaaatccctcgccgacctcacgaaacccctaacgcccgctcctccctcccccaaaactaaaatactataaccgctaccgcgcaaaaactatccccgaacgttaccgcgaacccgaacgcaaaaaaaaaccgaaattaactaacgtaaaaacctttcccgaacgaacccgaactacgcgaaactatcgaaacgcgccgcgaactctaacgaacgccaaaaaacaacaaccgccctccctaaacgccgcgcgcaatccccgatactcccgaaacgcccccgacgacgcgaaactatacgacccgcctcgtaaccttcgaatcgcccgaaaaaaactaacgttcgaaaataaaaaacaaaaaaccgccccaaaacccacttaaactaaaacgaccaaaacgcgtttccgaaattccaatataaaatcgcaaccgaccaaataaaaactctcgaaccaaacctccccgctatacgacccgatcgaaatctcttcccgaaacccctattcctaaaacttaactcgaaccgctcttaactatctatacttcaaaaacccgaacttccgaaaaactaaaacgaacgacccgcgacctcaaccctctcc

SEQ ID NO: 16599 - DNA, 751 bp, Artificial Sequence
  chemically treated genomic DNA (Homo sapiens) CpG-island No: 16599
gtttttttacgttttttttgtcgggttttgtatttttcggggttttttatttatttcggggttgtaatttagttttcggatttcggtttcgttttatcgcgggttgttttgtggttttcgcggagttttttaattaagtttttcggcgcgggggtttttcgtcgattttacggggtttttgacgttcgttttttttttttttagggttagggtgttgtggtcgttgtcgcgtagggattgttttcgggcgttgtcgcgggttcggacgtaggagggggtcggggttgattggcgtggaggtttttttcgggcgggttcggattgcgcggagttgtcgggacgcgtcgcgggttttggcggacgttagggggtagtagtcgttttttttggacgtcgcgcgtagttttcggtgttttcggaacgttttcgacggcgcggggttgtgcggttcgtttcgtggttttcgggtcgttcgggaagaattagcgttcgaggataaaagataggaagtcgttttagagtttatttgagttggaacggttaaggcgcgttttcgaggttttaatatagagtcgtagtcggttaggtggggattttcggattaggttttttcgttgtgcggttcggtcggggttttttttcgaagtttttgtttttggggtttgattcgggtcgtttttggttatttgtgttttaggagttcgggttttcggggggttaaggcgggcggttcgcggttttaatttttttt

SEQ ID NO: 16600 - DNA, 751 bp, Artificial Sequence
  chemically treated genomic DNA (Homo sapiens) CpG-island No: 16600
aaaaaaaattaaaaccgcgaaccgcccgccttaaccccccgaaaacccgaactcctaaaacacaaataaccaaaaacgacccgaatcaaaccccaaaaacaaaaacttcgaaaaaaaaccccgaccgaaccgcacaacgaaaaaacctaatccgaaaatccccacctaaccgactacgactctatattaaaacctcgaaaacgcgccttaaccgttccaactcaaataaactctaaaacgacttcctatcttttatcctcgaacgctaattcttcccgaacgacccgaaaaccacgaaacgaaccgcacaaccccgcgccgtcgaaaacgttccgaaaacaccgaaaactacgcgcgacgtccaaaaaaaacgactactaccccctaacgtccgccaaaacccgcgacgcgtcccgacaactccgcgcaatccgaacccgcccgaaaaaaacctccacgccaatcaaccccgaccccctcctacgtccgaacccgcgacaacgcccgaaaacaatccctacgcgacaacgaccacaacaccctaaccctaaaaaaaaaaaaaacgaacgtcaaaaaccccgtaaaatcgacgaaaaacccccgcgccgaaaaacttaattaaaaaactccgcgaaaaccacaaaacaacccgcgataaaacgaaaccgaaatccgaaaactaaattacaaccccgaaataaataaaaaaccccgaaaaatacaaaacccgacaaaaaaaacgtaaaaaaac

SEQ ID NO: 16601 - DNA, 1244 bp, Artificial Sequence
  chemically treated genomic DNA (Homo sapiens) CpG-island No: 16601
gcggggtcggagttggtagcgtacgtcggatcgggggcggggtttttcgagtttcgcgaaaatgttcgtagtatcgcggggatcggcgtagggggaagcggtcgttcgtacgcgaagtcggggtgggtttcgtatttggggtcgttcgagcgtacgggggcggggagaggagcgggggtcgttttcggggagtcggaggggagacgcggggttcgggtaggttgttcggttgttgcgggtgtcggcgttataaggttcgggagtaagtcgcgtggttgtttttaattttttttttagtcgcgcgtttttggggttttttttgattaggaaatttttcgttggtcgttgacgtacgtagtaagtgagacgcgcggagggatcgagtcgcggttcgggcgtagcggtaaaaaatatttattatagaaatcgatttaagggaagacgttgagagtaaacggtacgcgcggacgtcgttcggttttatgtaaggaattagcgtcgtttcgtcgtagttgatagtcggacggtgtaggagcgcggagtggttttttcgggtttcgcggttaaatcgtattttcgttttggaagcggaggtttggttttgggcggtcgcgtaggatttggggtcgttcgcgggttgtagtttcggttcgggagtttcgtggcggttattgcgtttgtttgtagcggttcgcggggtcgggttttttcgggtgcggcgcgtcggtcgggtttttttcgggtcggcggggtttgttttttttttttaggttttcggatcgtggttattcgcggagtcgtataagtttgcgtgtggttgcggaaaggggttcgtacgcgggcggggtttcgggttagtatgtaggtttggatgcggggcgcgggggtggttttcgatttttcgttcgggttgcgtatagtagcgcgcggcgcggcggcgggggcgcgcgggttaattttaggagtcggcggcggcgagtcgcgttttggttgatatcggaaaggtttgtgattggtcgtcggtcgtttttatgtaaacgagttgagggaatggaattttttcggtcgggtttatagtaaaagtacgtttatttttaggtatttttatttatagagttagcgggcgcgggcgggacgggcgtttcgcggtcggatttagttagggtattacgttgttcggttttgcgtcgttaggtattttttttcggggtttttagggacgttagaaggaagttaatttttgt

SEQ ID NO: 16602 - DNA, 1244 bp, Artificial Sequence
  chemically treated genomic DNA (Homo sapiens) CpG-island No: 16602
acaaaaattaacttccttctaacgtccctaaaaaccccgaaaaaaaatacctaacgacgcaaaaccgaacaacgtaataccctaactaaatccgaccgcgaaacgcccgtcccgcccgcgcccgctaactctataaataaaaatacctaaaaataaacgtacttttactataaacccgaccgaaaaaattccattccctcaactcgtttacataaaaacgaccgacgaccaatcacaaacctttccgatatcaaccaaaacgcgactcgccgccgccgactcctaaaattaacccgcgcgcccccgccgccgcgccgcgcgctactatacgcaacccgaacgaaaaatcgaaaaccacccccgcgccccgcatccaaacctacatactaacccgaaaccccgcccgcgtacgaacccctttccgcaaccacacgcaaacttatacgactccgcgaataaccacgatccgaaaacctaaaaaaaaaaaacaaaccccgccgacccgaaaaaaacccgaccgacgcgccgcacccgaaaaaacccgaccccgcgaaccgctacaaacaaacgcaataaccgccacgaaactcccgaaccgaaactacaacccgcgaacgaccccaaatcctacgcgaccgcccaaaaccaaacctccgcttccaaaacgaaaatacgatttaaccgcgaaacccgaaaaaaccactccgcgctcctacaccgtccgactatcaactacgacgaaacgacgctaattccttacataaaaccgaacgacgtccgcgcgtaccgtttactctcaacgtcttcccttaaatcgatttctataataaatattttttaccgctacgcccgaaccgcgactcgatccctccgcgcgtctcacttactacgtacgtcaacgaccaacgaaaaatttcctaatcaaaaaaaaccccaaaaacgcgcgactaaaaaaaaaattaaaaacaaccacgcgacttactcccgaaccttataacgccgacacccgcaacaaccgaacaacctacccgaaccccgcgtctcccctccgactccccgaaaacgacccccgctcctctccccgcccccgtacgctcgaacgaccccaaatacgaaacccaccccgacttcgcgtacgaacgaccgcttccccctacgccgatccccgcgatactacgaacattttcgcgaaactcgaaaaaccccgcccccgatccgacgtacgctaccaactccgaccccgc

SEQ ID NO: 16603 - DNA, 1244 bp, Artificial Sequence
  chemically treated genomic DNA (Homo sapiens) CpG-island No: 16603
gtagaggttgatttttttttggcgtttttaggagtttcggaaagaagtgtttggcggcgtagggtcgggtagcgtggtgttttggttgggttcggtcgcggggcgttcgtttcgttcgcgttcgttggttttatgaatgagagtgtttggaaatgaacgtgtttttattgtaagttcggtcggaggaattttatttttttagttcgtttgtataggggcggtcggcggttaattataggttttttcggtattagttagggcgcggttcgtcgtcgtcggtttttggaattggttcgcgcgttttcgtcgtcgcgtcgcgcgttattgtacgtagttcgggcggggagtcggaggttattttcgcgtttcgtatttaagtttgtatgttggttcggggtttcgttcgcgtgcggattttttttcgtagttatacgtaggtttgtgcggtttcgcgagtggttacggttcggagatttggaaaaagaaagtaggtttcgtcggttcgaggaggattcggtcggcgcgtcgtattcggagaggttcggtttcgcgagtcgttgtaggtaggcgtagtggtcgttacgaggttttcgaatcggggttgtagttcgcggacggttttagattttgcgcggtcgtttagggttaggttttcgtttttagggcgggggtgcgatttggtcgcggggttcgggggagttatttcgcgtttttgtatcgttcggttgttagttgcggcgaagcggcgttgattttttgtatgaggtcggacggcgttcgcgcgtgtcgtttgtttttagcgtttttttttgggtcggtttttgtaatgggtgttttttatcgttgcgttcgggtcgcggttcgattttttcgcgcgttttatttgttgcgtgcgttagcggttagcgaggagttttttagttaggaaagattttaagaacgcgcggttggaaggaaagttgaaagtagttacgcggtttgttttcgggttttgtagcgtcggtattcgtagtagtcggatagtttgttcgggtttcgcgtttttttttcggtttttcggaagcggttttcgttttttttttcgttttcgtgcgttcgagcggttttaggtgcggaatttatttcggtttcgcgtgcgggcggtcgtttttttttgcgtcggttttcgcggtgttgcgggtattttcgcggagttcggagggtttcgttttcggttcggcgtgcgttgttaatttcgatttcgt

SEQ ID NO: 16604 - DNA, 1244 bp, Artificial Sequence
  chemically treated genomic DNA (Homo sapiens) CpG-island No: 16604
acgaaatcgaaattaacaacgcacgccgaaccgaaaacgaaaccctccgaactccgcgaaaatacccgcaacaccgcgaaaaccgacgcaaaaaaaaacgaccgcccgcacgcgaaaccgaaataaattccgcacctaaaaccgctcgaacgcacgaaaacgaaaaaaaaaacgaaaaccgcttccgaaaaaccgaaaaaaaaacgcgaaacccgaacaaactatccgactactacgaataccgacgctacaaaacccgaaaacaaaccgcgtaactactttcaactttccttccaaccgcgcgttcttaaaatctttcctaactaaaaaactcctcgctaaccgctaacgcacgcaacaaataaaacgcgcgaaaaaatcgaaccgcgacccgaacgcaacgataaaaaacacccattacaaaaaccgacccaaaaaaaaacgctaaaaacaaacgacacgcgcgaacgccgtccgacctcatacaaaaaatcaacgccgcttcgccgcaactaacaaccgaacgatacaaaaacgcgaaataactcccccgaaccccgcgaccaaatcgcacccccgccctaaaaacgaaaacctaaccctaaacgaccgcgcaaaatctaaaaccgtccgcgaactacaaccccgattcgaaaacctcgtaacgaccactacgcctacctacaacgactcgcgaaaccgaacctctccgaatacgacgcgccgaccgaatcctcctcgaaccgacgaaacctactttctttttccaaatctccgaaccgtaaccactcgcgaaaccgcacaaacctacgtataactacgaaaaaaaatccgcacgcgaacgaaaccccgaaccaacatacaaacttaaatacgaaacgcgaaaataacctccgactccccgcccgaactacgtacaataacgcgcgacgcgacgacgaaaacgcgcgaaccaattccaaaaaccgacgacgacgaaccgcgccctaactaataccgaaaaaacctataattaaccgccgaccgcccctatacaaacgaactaaaaaaataaaattcctccgaccgaacttacaataaaaacacgttcatttccaaacactctcattcataaaaccaacgaacgcgaacgaaacgaacgccccgcgaccgaacccaaccaaaacaccacgctacccgaccctacgccgccaaacacttctttccgaaactcctaaaaacgccaaaaaaaaatcaacctctac

SEQ ID NO: 16605 - DNA, 1207 bp, Artificial Sequence
  chemically treated genomic DNA (Homo sapiens) CpG-island No: 16605
gttaacgttaatttcgattttttcgtgaaacgcgtagttcgcgtaggcgttcgtagtttttagttttcgggacggtttcgaacgagtttatcgttgacgcgtttaggaagaaacgatttcgtttttagtaaatttcggacggtggggcgcggggaagggcgtaggtagttttttaattcgagtttcgtaattcggcgggatcggagtttagcgttttacgtttttcgggaggaagtttcggatttcgggcgatttcgttttttttttcggatttcgttcgcgttttagtattcgggaggaaggcgaagatcggcgggaggagcgtttttttcggaaggggagaatcgggttcgaggcgtcgtggggcgggggtcgcgggcgtatttacgggggcgagtagttagtaggttagtagcgcgggaggtagtagcgttcgtatttcgagtttagcgtgtcgggggtcgtttagcgttcgtcgttttcgttttaggttttcgcggtttcgtcgtttttagtatgggtcgggagcgagtgcgcggagatttcgggtttcgtagttgtagtcgagcgttcgagcgcgggggtcgtttttttcgtttcggtagttggagcgcgtttaatgtacgttcgttttttacgcgtttcgtcgtttcgtttttcgtttttgttttcgtttcgcgttgttttaattttcgttttttttttttttcgagaattttcgtttcgcgtttttttttatcgttttttattttttttttcgttgcgtttcgcgtttttttttcgtttttgggttttttgttttcgtcgcgcgcgttttttttggttttttcgatttttttagttttttttttcgtttttttttttttttttttggtttacgtttttttttcggtcgcgttttttcgatttgtgggcggaggggttgggaagcggggtgtttagtgcgcgttcggtttcgagtagagagaattgggggagagcggtcggcgcggggtcgggagaggaggatcgggttaggtgtgcgttcggaaggggcggatgtttttgcggtcgtttgtatttgtttttttaaataattgcggaagtttaagaaagcggttagagattcgttcggggtgggcgcgtcgtttttgtagttagtggggttaggttggggtatttgaaaatggagaaaattagagtgttttttggtggggattttcgtagt

SEQ ID NO: 16606 - DNA, 1207 bp, Artificial Sequence
  chemically treated genomic DNA (Homo sapiens) CpG-island No: 16606
actacgaaaatccccaccaaaaaacactctaattttctccattttcaaataccccaacctaaccccactaactacaaaaacgacgcgcccaccccgaacgaatctctaaccgctttcttaaacttccgcaattatttaaaaaaacaaatacaaacgaccgcaaaaacatccgccccttccgaacgcacacctaacccgatcctcctctcccgaccccgcgccgaccgctctcccccaattctctctactcgaaaccgaacgcgcactaaacaccccgcttcccaacccctccgcccacaaatcgaaaaaacgcgaccgaaaaaaaaacgtaaaccaaaaaaaaaaaaaaaaaaacgaaaaaaaaaactaaaaaaatcgaaaaaaccaaaaaaaacgcgcgcgacgaaaacaaaaaacccaaaaacgaaaaaaaaacgcgaaacgcaacgaaaaaaaaaataaaaaacgataaaaaaaaacgcgaaacgaaaattctcgaaaaaaaaaaaaaacgaaaattaaaacaacgcgaaacgaaaacaaaaacgaaaaacgaaacgacgaaacgcgtaaaaaacgaacgtacattaaacgcgctccaactaccgaaacgaaaaaaacgacccccgcgctcgaacgctcgactacaactacgaaacccgaaatctccgcgcactcgctcccgacccatactaaaaacgacgaaaccgcgaaaacctaaaacgaaaacgacgaacgctaaacgacccccgacacgctaaactcgaaatacgaacgctactacctcccgcgctactaacctactaactactcgcccccgtaaatacgcccgcgacccccgccccacgacgcctcgaacccgattctccccttccgaaaaaaacgctcctcccgccgatcttcgccttcctcccgaatactaaaacgcgaacgaaatccgaaaaaaaaaacgaaatcgcccgaaatccgaaacttcctcccgaaaaacgtaaaacgctaaactccgatcccgccgaattacgaaactcgaattaaaaaactacctacgcccttccccgcgccccaccgtccgaaatttactaaaaacgaaatcgtttcttcctaaacgcgtcaacgataaactcgttcgaaaccgtcccgaaaactaaaaactacgaacgcctacgcgaactacgcgtttcacgaaaaaatcgaaattaacgttaac

SEQ ID NO: 16607 - DNA, 1207 bp, Artificial Sequence
  chemically treated genomic DNA (Homo sapiens) CpG-island No: 16607
gttgcggggatttttattaaaaagtattttgattttttttatttttagatgttttaatttagttttattggttataaagacggcgcgtttatttcggacgggtttttggtcgtttttttgggttttcgtagttgtttagaaaggtaggtataggcggtcgtaaaggtattcgtttttttcgagcgtatatttggttcggtttttttttttcggtttcgcgtcggtcgtttttttttagttttttttattcggagtcgggcgcgtattgagtatttcgttttttagttttttcgtttatagatcggggaggcgcggtcgggaggggggcgtgggttagggaagaggggaggagaacggagagagaggttgggggggtcgaggagattagagggagcgcgcgcggcggggatagagagtttaggggcgaggagagggcgcggggcgtagcggaaggggaagtggggggcggtgaggaggggcgcggagcgggggttttcgggggaggagggagacgaggattggggtagcgcggggcggggataggggcggggggcggagcggcggggcgcgtgggggacgggcgtgtattgagcgcgttttagttgtcgggacggagggggcggttttcgcgttcgggcgttcggttatagttgcggggttcgaggttttcgcgtattcgttttcggtttatgttggaggcggcggaatcgcggggatttaggacggaggcggcgggcgttgggcggttttcggtacgttgagttcgggatgcggacgttgttgtttttcgcgttgttgatttgttggttgttcgttttcgtgagtgcgttcgcgattttcgttttacggcgtttcggattcggtttttttttttcgagaagagcgtttttttcgtcggttttcgtttttttttcgggtgttggagcgcgggcggggttcgggagagggagcggggtcgttcggggttcggagttttttttcggagagcgtgaagcgttgagtttcggtttcgtcgggttgcgggattcgggttgggaggttgtttgcgttttttttcgcgttttatcgttcggggtttgttggaaacgggatcgtttttttttggacgcgttaacgatgagttcgttcggggtcgtttcgggagttgggagttgcgggcgtttgcgcgggttgcgcgttttacggggagatcggggttggcgttggt

SEQ ID NO: 16608 - DNA, 1207 bp, Artificial Sequence
  chemically treated genomic DNA (Homo sapiens) CpG-island No: 16608
accaacgccaaccccgatctccccgtaaaacgcgcaacccgcgcaaacgcccgcaactcccaactcccgaaacgaccccgaacgaactcatcgttaacgcgtccaaaaaaaaacgatcccgtttccaacaaaccccgaacgataaaacgcgaaaaaaaacgcaaacaacctcccaacccgaatcccgcaacccgacgaaaccgaaactcaacgcttcacgctctccgaaaaaaaactccgaaccccgaacgaccccgctccctctcccgaaccccgcccgcgctccaacacccgaaaaaaaaacgaaaaccgacgaaaaaaacgctcttctcgaaaaaaaaaaaccgaatccgaaacgccgtaaaacgaaaatcgcgaacgcactcacgaaaacgaacaaccaacaaatcaacaacgcgaaaaacaacaacgtccgcatcccgaactcaacgtaccgaaaaccgcccaacgcccgccgcctccgtcctaaatccccgcgattccgccgcctccaacataaaccgaaaacgaatacgcgaaaacctcgaaccccgcaactataaccgaacgcccgaacgcgaaaaccgccccctccgtcccgacaactaaaacgcgctcaatacacgcccgtcccccacgcgccccgccgctccgccccccgcccctatccccgccccgcgctaccccaatcctcgtctccctcctcccccgaaaacccccgctccgcgcccctcctcaccgccccccacttccccttccgctacgccccgcgccctctcctcgcccctaaactctctatccccgccgcgcgcgctccctctaatctcctcgacccccccaacctctctctccgttctcctcccctcttccctaacccacgcccccctcccgaccgcgcctccccgatctataaacgaaaaaactaaaaaacgaaatactcaatacgcgcccgactccgaataaaaaaaactaaaaaaaaacgaccgacgcgaaaccgaaaaaaaaaaaccgaaccaaatatacgctcgaaaaaaacgaatacctttacgaccgcctatacctacctttctaaacaactacgaaaacccaaaaaaacgaccaaaaacccgtccgaaataaacgcgccgtctttataaccaataaaactaaattaaaacatctaaaaataaaaaaaatcaaaatactttttaataaaaatccccgcaac

SEQ ID NO: 16609 - DNA, 1025 bp, Artificial Sequence
  chemically treated genomic DNA (Homo sapiens) CpG-island No: 16609
tcgtcggggttgttagagcggtattttttttttggttttcgtagtttttgggggtcggagtgattcgagcggattcggtagtaagagaggcgcgcgtcgtattttttcggtatcggcgttttttttttatatttatattttcgcgtttttcgtagtttagttcgggggatgtaggcgtcggcgggtttcgggcgcggcgggcgagcggcgtttatttttgtgatagttatgtagaaatttcgcggcggagcgggggcgcgggcgcggcgtgcgggggcggcggcggcggttcggggcggcggcggaagggggttcggtagttttcggttcgtttttcgcgtttcgtcggcggttcggtcgagtttgggggttgcgtttcgggcgggtagcgcgtagggatcgttcgtcggcgttcgttcgtcgttcgtcgttgatgttagtttcgaatgtgtatttataatagatgagtttttttcgtcgtaggaaggcgaggtaggaagaaagggagagagggagagggttcgggttggggggcggggggaggaagaggggtcgggaattcgttataaaggaggaggcggagggaggaggaggaggaagcgtagttcgttagcggtcgtgtttcgagtttttcgttcgatcgtcggtcgtcgggtatcgttgttttcggagttcggacgggcgttcgggttcgcggttttaattttttcgggtttgcggacgttacgcggttgggcgaggttggttttcggtatttgtcggttgggagaacgggcggcgtttcgggttttcgggtgtttcgttggttcggggacgttggtgaagttataggttggacggtcgaggcgttgcgcgggtaaagaaggcggtcgggttcgttttttggaggttcgtaaagtcggttcgtgggtcgtgagtgtggcgcggcgggttgggaggggcgtggtagtcgtaagttcgggagttttgttcgtatttttatttcgcgttggttcggggtatagggtggttagacggatttgtgt

SEQ ID NO: 16610 - DNA, 1025 bp, Artificial Sequence
  chemically treated genomic DNA (Homo sapiens) CpG-island No: 16610
acacaaatccgtctaaccaccctataccccgaaccaacgcgaaataaaaatacgaacaaaactcccgaacttacgactaccacgcccctcccaacccgccgcgccacactcacgacccacgaaccgactttacgaacctccaaaaaacgaacccgaccgccttctttacccgcgcaacgcctcgaccgtccaacctataacttcaccaacgtccccgaaccaacgaaacacccgaaaacccgaaacgccgcccgttctcccaaccgacaaataccgaaaaccaacctcgcccaaccgcgtaacgtccgcaaacccgaaaaaattaaaaccgcgaacccgaacgcccgtccgaactccgaaaacaacgatacccgacgaccgacgatcgaacgaaaaactcgaaacacgaccgctaacgaactacgcttcctcctcctcctccctccgcctcctcctttataacgaattcccgacccctcttcctccccccgccccccaacccgaaccctctccctctctccctttcttcctacctcgccttcctacgacgaaaaaaactcatctattataaatacacattcgaaactaacatcaacgacgaacgacgaacgaacgccgacgaacgatccctacgcgctacccgcccgaaacgcaacccccaaactcgaccgaaccgccgacgaaacgcgaaaaacgaaccgaaaactaccgaacccccttccgccgccgccccgaaccgccgccgccgcccccgcacgccgcgcccgcgcccccgctccgccgcgaaatttctacataactatcacaaaaataaacgccgctcgcccgccgcgcccgaaacccgccgacgcctacatcccccgaactaaactacgaaaaacgcgaaaatataaatataaaaaaaaaacgccgataccgaaaaaatacgacgcgcgcctctcttactaccgaatccgctcgaatcactccgacccccaaaaactacgaaaaccaaaaaaaaaataccgctctaacaaccccgacga

SEQ ID NO: 16611 - DNA, 1025 bp, Artificial Sequence
  chemically treated genomic DNA (Homo sapiens) CpG-island No: 16611
atataaattcgtttggttattttgtgtttcgggttagcgcgaggtgggggtgcgggtagggttttcgggtttgcggttgttacgttttttttagttcgtcgcgttatatttacggtttacgggtcgattttgcgagtttttagggggcgaattcgatcgttttttttgttcgcgtagcgtttcggtcgtttagtttgtgattttattagcgttttcgggttagcgggatattcgagagttcggggcgtcgttcgtttttttagtcggtaggtgtcgggagttagtttcgtttagtcgcgtggcgttcgtaggttcgaaggggttaaggtcgcggattcgggcgttcgttcggatttcgggagtagcggtgttcggcggtcggcgatcgagcgggaggttcggggtacggtcgttggcgggttgcgttttttttttttttttttttcgtttttttttttgtagcgagttttcggttttttttttttttttcgttttttagttcgggttttttttttttttttttttttttttgtttcgtttttttgcggcgaaggaggtttatttattataaatgtatattcggggttgatattagcgacgagcggcgggcgagcgtcgacgagcggtttttgcgcgttgttcgttcggagcgtagtttttaggttcggtcgagtcgtcggcggggcgcggggagcgagtcgggagttgtcggattttttttcgtcgtcgtttcgggtcgtcgtcgtcgttttcgtacgtcgcgttcgcgttttcgtttcgtcgcggagtttttgtatgattgttataaaggtaagcgtcgttcgttcgtcgcgttcgggattcgtcggcgtttgtatttttcgggttaggttgcggggggcgcgggggtgtgggtgtggggagggggcgtcggtgtcgggaaggtgcggcgcgcgttttttttgttgtcggattcgttcgagttatttcggtttttaaggattgcggaggttagggggaggatgtcgttttggtagtttcggcgg

SEQ ID NO: 16612 - DNA, 1025 bp, Artificial Sequence
  chemically treated genomic DNA (Homo sapiens) CpG-island No: 16612
ccgccgaaactaccaaaacgacatcctccccctaacctccgcaatccttaaaaaccgaaataactcgaacgaatccgacaacaaaaaaaacgcgcgccgcaccttcccgacaccgacgccccctccccacacccacacccccgcgccccccgcaacctaacccgaaaaatacaaacgccgacgaatcccgaacgcgacgaacgaacgacgcttacctttataacaatcatacaaaaactccgcgacgaaacgaaaacgcgaacgcgacgtacgaaaacgacgacgacgacccgaaacgacgacgaaaaaaaatccgacaactcccgactcgctccccgcgccccgccgacgactcgaccgaacctaaaaactacgctccgaacgaacaacgcgcaaaaaccgctcgtcgacgctcgcccgccgctcgtcgctaatatcaaccccgaatatacatttataataaataaacctccttcgccgcaaaaaaacgaaacaaaaaaaaaaaaaaaaaaaaaaaaaacccgaactaaaaaacgaaaaaaaaaaaaaaaaccgaaaactcgctacaaaaaaaaaaacgaaaaaaaaaaaaaaaaaaaacgcaacccgccaacgaccgtaccccgaacctcccgctcgatcgccgaccgccgaacaccgctactcccgaaatccgaacgaacgcccgaatccgcgaccttaaccccttcgaacctacgaacgccacgcgactaaacgaaactaactcccgacacctaccgactaaaaaaacgaacgacgccccgaactctcgaatatcccgctaacccgaaaacgctaataaaatcacaaactaaacgaccgaaacgctacgcgaacaaaaaaaacgatcgaattcgccccctaaaaactcgcaaaatcgacccgtaaaccgtaaatataacgcgacgaactaaaaaaaacgtaacaaccgcaaacccgaaaaccctacccgcacccccacctcgcgctaacccgaaacacaaaataaccaaacgaatttatat

SEQ ID NO: 16613 - DNA, 602 bp, Artificial Sequence
  chemically treated genomic DNA (Homo sapiens) CpG-island No: 16613
cgtataatcgttattttggggttacggtaatttttgcgttcgtttttggttttcgttgtttttgggatttttatgggcgggggatacgcgttagcgttataaagcgtcgcgatcgcgcgggagatcgagaggaggcgtggaaacgggaggaggaggaggtggtagtggaggagagttaggtacggtggggggaggggagggaggggtacgcgtacgcgcgtcgggtcgttagtcgttgagagtcgtttagtattcggcgtgcgttttttttttttttttttttttttttttttttttttgtttttcggtttcgttgttttcgcggcgcgaggcgttttcgttttttttttttttcgtcgtcgttttttttttcgcgtagttttcgtcgttatcgtcgcgagattttcgtacgtcgttttttttttatttttttttgtttcgcgcgttttcggttttgcggttttcgaagagaacgagagggcgagcgagcgcggcgttttcgggtcggttcggttttttttttttattatcgtcggtttttcgtcgttttttttcgtttttattttttttttttttttttaagttgaggtttttttcggggg

SEQ ID NO: 16614 - DNA, 602 bp, Artificial Sequence
  chemically treated genomic DNA (Homo sapiens) CpG-island No: 16614
cccccgaaaaaaacctcaacttaaaaaaaaaaaaaaaaaataaaaacgaaaaaaaacgacgaaaaaccgacgataataaaaaaaaaaaaccgaaccgacccgaaaacgccgcgctcgctcgccctctcgttctcttcgaaaaccgcaaaaccgaaaacgcgcgaaacaaaaaaaaataaaaaaaaaacgacgtacgaaaatctcgcgacgataacgacgaaaactacgcgaaaaaaaaaacgacgacgaaaaaaaaaaaaaacgaaaacgcctcgcgccgcgaaaacaacgaaaccgaaaaacaaaaaaaaaaaaaaaaaaaaaaaaaaaaaaaaaaaacgcacgccgaatactaaacgactctcaacgactaacgacccgacgcgcgtacgcgtacccctccctcccctccccccaccgtacctaactctcctccactaccacctcctcctcctcccgtttccacgcctcctctcgatctcccgcgcgatcgcgacgctttataacgctaacgcgtatcccccgcccataaaaatcccaaaaacaacgaaaaccaaaaacgaacgcaaaaattaccgtaaccccaaaataacgattatacg

SEQ ID NO: 16615 - DNA, 602 bp, Artificial Sequence
  chemically treated genomic DNA (Homo sapiens) CpG-island No: 16615
ttttcggagggggttttaatttggggggggggagaggaggtggaagcggaggaaggcggcggagggtcggcgatggtgaagggagggggtcgggtcggttcgggaacgtcgcgttcgttcgttttttcgtttttttcgggggtcgtagggtcggaggcgcgcggggtaggagagggtggggggagagcggcgtgcgggggtttcgcggcggtggcggcgggggttgcgcggggggaggggcgacggcggaggaggaggagagcgagagcgtttcgcgtcgcgggagtaacggagtcgagaagtagggagggagggagggagggagagagggaggaggggcgtacgtcgggtgttgggcggtttttagcggttggcggttcgacgcgcgtgcgcgtgttttttttttttttttttttatcgtgtttggtttttttttattattattttttttttttttcgtttttacgttttttttcggtttttcgcgcggtcgcggcgttttgtgacgttggcgcgtgtttttcgtttataaagattttagaagtagcggggattaagggcgggcgtagggattgtcgtggttttagagtgacggttgtgcg

SEQ ID NO: 16616 - DNA, 602 bp, Artificial Sequence
  chemically treated genomic DNA (Homo sapiens) CpG-island No: 16616
cgcacaaccgtcactctaaaaccacgacaatccctacgcccgcccttaatccccgctacttctaaaatctttataaacgaaaaacacgcgccaacgtcacaaaacgccgcgaccgcgcgaaaaaccgaaaaaaaacgtaaaaacgaaaaaaaaaaaaaataataataaaaaaaaaccaaacacgataaaaaaaaaaaaaaaaaaaacacgcgcacgcgcgtcgaaccgccaaccgctaaaaaccgcccaacacccgacgtacgcccctcctccctctctccctccctccctccctccctacttctcgactccgttactcccgcgacgcgaaacgctctcgctctcctcctcctccgccgtcgcccctccccccgcgcaacccccgccgccaccgccgcgaaacccccgcacgccgctctccccccaccctctcctaccccgcgcgcctccgaccctacgacccccgaaaaaaacgaaaaaacgaacgaacgcgacgttcccgaaccgacccgaccccctcccttcaccatcgccgaccctccgccgccttcctccgcttccacctcctctccccccccccaaattaaaaccccctccgaaaa

SEQ ID NO: 16617 - DNA, 1084 bp, Artificial Sequence
  chemically treated genomic DNA (Homo sapiens) CpG-island No: 16617
agggggcgtggtggcgttttcgagatttatgagaattaggcgtcgatttttttcgttgcgatatttaggttttttttaggtttttattgtttttgttgcggagagtttggttatagcggcggttttcgcgaagtattcgttagcgaggggcgtttcgagggcgttcgcgttttatatattcgttacgtaggatattttttcggttttacgtttcgcgttttcggggttattattatcgcgggttcgaggggtggtttttacgaggaggagtgggagtttcgcgtttggtttggggtcggttcggcgatatggggattttcgtttagatggggcgattcggagtcggtttttaattttttttttcgggttttaggatcgggtagtttcggtatcgtagttgcggggagttagtaagtatcggttatcggcgtcgttcgggtttcgcggatggtcgggggcggggtttgagcggcgtaagtgggggcgggagggggcggggttaggacgcgcgagggggggcggggtcggggttcgcggcgggggcgggggcggggcggggtcgggaggcgcgcgtttcgcgggcggaggggcgcgtcgcgttggggttgggtttggagcgcgcggagttcggttgtagagagtcgcgcggggacgcgtcgggatcgttaggagcgtaggagttttcgaggcggtgaacgagggagggagtttagttcgcgcgggttatgagttatcgggttcggggagttcggtcgcggttcgggtagcgtttagtcggcgttttagttcgttcggtcgtagttgcgcgtttgtaggtatggtttttttatatttaatttttcgttttttggtttttttttcgggatttttgtttgttttcggggacgtgcgttgtgtgcgtatcgttgttcgaaggagagcggtcgtacgcgttttggttcgcgcgtgtcgtttttgtgtgcgcgggtgggagggaggagggcgcgcgagggaggggaggcgttttcggttgggatttgtttttcgatttttatttcgggcggggcggggagtttttggaggggtcgagtcgtttttggagtat

SEQ ID NO: 16618 - DNA, 1084 bp, Artificial Sequence
  chemically treated genomic DNA (Homo sapiens) CpG-island No: 16618
atactccaaaaacgactcgacccctccaaaaactccccgccccgcccgaaataaaaatcgaaaaacaaatcccaaccgaaaacgcctcccctccctcgcgcgccctcctccctcccacccgcgcacacaaaaacgacacgcgcgaaccaaaacgcgtacgaccgctctccttcgaacaacgatacgcacacaacgcacgtccccgaaaacaaacaaaaatcccgaaaaaaaaaccaaaaaacgaaaaattaaatataaaaaaaccatacctacaaacgcgcaactacgaccgaacgaactaaaacgccgactaaacgctacccgaaccgcgaccgaactccccgaacccgataactcataacccgcgcgaactaaactccctccctcgttcaccgcctcgaaaactcctacgctcctaacgatcccgacgcgtccccgcgcgactctctacaaccgaactccgcgcgctccaaacccaaccccaacgcgacgcgcccctccgcccgcgaaacgcgcgcctcccgaccccgccccgcccccgcccccgccgcgaaccccgaccccgccccccctcgcgcgtcctaaccccgccccctcccgcccccacttacgccgctcaaaccccgcccccgaccatccgcgaaacccgaacgacgccgataaccgatacttactaactccccgcaactacgataccgaaactacccgatcctaaaacccgaaaaaaaaaattaaaaaccgactccgaatcgccccatctaaacgaaaatccccatatcgccgaaccgaccccaaaccaaacgcgaaactcccactcctcctcgtaaaaaccacccctcgaacccgcgataataataaccccgaaaacgcgaaacgtaaaaccgaaaaaatatcctacgtaacgaatatataaaacgcgaacgccctcgaaacgcccctcgctaacgaatacttcgcgaaaaccgccgctataaccaaactctccgcaacaaaaacaataaaaacctaaaaaaaacctaaatatcgcaacgaaaaaaatcgacgcctaattctcataaatctcgaaaacgccaccacgccccct

SEQ ID NO: 16619 - DNA, 1084 bp, Artificial Sequence
  chemically treated genomic DNA (Homo sapiens) CpG-island No: 16619
atgttttagaggcggttcggtttttttagaggtttttcgtttcgttcgggatggggatcggggagtagattttagtcgggggcgttttttttttttcgcgcgttttttttttttttattcgcgtatataaagacgatacgcgcggattaaggcgcgtgcggtcgttttttttcgggtagcggtgcgtatatagcgtacgttttcggggatagataggggtttcgggggaaggattagggagcgaggaattgggtataaggaggttatatttataggcgcgtagttgcggtcgagcgggttggggcgtcggttgagcgttgttcggatcgcggtcgggtttttcgggttcggtggtttatggttcgcgcggattgggttttttttttcgtttatcgtttcgaaggtttttgcgtttttggcggtttcggcgcgttttcgcgcggttttttgtagtcgagtttcgcgcgttttaagtttagttttagcgcggcgcgttttttcgttcgcgaggcgcgcgtttttcggtttcgtttcgttttcgttttcgtcgcgagtttcggtttcgttttttttcgcgcgttttggtttcgttttttttcgtttttatttgcgtcgtttaggtttcgttttcggttattcgcggagttcgagcggcgtcggtggtcggtgtttgttggtttttcgtagttgcggtgtcgagattgttcggttttggggttcggagagaggggttaggagtcggtttcgagtcgttttatttgggcgggggtttttatgtcgtcgagtcggttttaggttaggcgcgggatttttattttttttcgtggaggttatttttcgagttcgcggtggtggtggtttcgggagcgcggagcgtggggtcgggggaatgttttgcgtggcgggtgtatgggacgcggacgttttcgaagcgtttttcgttgacgggtgtttcgcgggagtcgtcgttgtggttagatttttcgtagtagggataatgggagtttggaggaggtttggatgtcgtaacggaggaagtcgacgtttggtttttataaatttcgagggcgttattacgtttttt

SEQ ID NO: 16620 - DNA, 1084 bp, Artificial Sequence
  chemically treated genomic DNA (Homo sapiens) CpG-island No: 16620
aaaaaacgtaataacgccctcgaaatttataaaaaccaaacgtcgacttcctccgttacgacatccaaacctcctccaaactcccattatccctactacgaaaaatctaaccacaacgacgactcccgcgaaacacccgtcaacgaaaaacgcttcgaaaacgtccgcgtcccatacacccgccacgcaaaacattcccccgaccccacgctccgcgctcccgaaaccaccaccaccgcgaactcgaaaaataacctccacgaaaaaaaataaaaatcccgcgcctaacctaaaaccgactcgacgacataaaaacccccgcccaaataaaacgactcgaaaccgactcctaacccctctctccgaaccccaaaaccgaacaatctcgacaccgcaactacgaaaaaccaacaaacaccgaccaccgacgccgctcgaactccgcgaataaccgaaaacgaaacctaaacgacgcaaataaaaacgaaaaaaaacgaaaccaaaacgcgcgaaaaaaaacgaaaccgaaactcgcgacgaaaacgaaaacgaaacgaaaccgaaaaacgcgcgcctcgcgaacgaaaaaacgcgccgcgctaaaactaaacttaaaacgcgcgaaactcgactacaaaaaaccgcgcgaaaacgcgccgaaaccgccaaaaacgcaaaaaccttcgaaacgataaacgaaaaaaaaaacccaatccgcgcgaaccataaaccaccgaacccgaaaaacccgaccgcgatccgaacaacgctcaaccgacgccccaacccgctcgaccgcaactacgcgcctataaatataacctccttatacccaattcctcgctccctaatccttcccccgaaacccctatctatccccgaaaacgtacgctatatacgcaccgctacccgaaaaaaaacgaccgcacgcgccttaatccgcgcgtatcgtctttatatacgcgaataaaaaaaaaaaaaacgcgcgaaaaaaaaaaaacgcccccgactaaaatctactccccgatccccatcccgaacgaaacgaaaaacctctaaaaaaaccgaaccgcctctaaaacat

SEQ ID NO: 16621 - DNA, 787 bp, Artificial Sequence
  chemically treated genomic DNA (Homo sapiens) CpG-island No: 16621
aggtggttgcgatgggacggaagttatgaatggtgtcggttttggtttcgtcgtagtcgtttcggttttagtttcggtttcggtttcggattggcggtagttttgcgagttgtatgcgtaggcggtcgtcgtggattttgcgtataagttttgtcgttttttgcgggataatttagtttacgatacgttcgacgtcggcgtttttttttttcgttatttcgtcgttaattttttggacgttttcggcgaggaggtgcgtcgcgtgttggtggttgggtcgacgattcggggcgcggtcgtgagcgtagaggttatggagtcggagttcgcggatatttttgtatttaaggcggcgtttacggttattcgcggagttcggaggacgtgtttacgtacgcggttattaaggttcgcgttcgtaagggtttttcgttgcgtaatatgagtttgtgcgtggtggacggcgtgcgcgatatgtggtatcggcgcgtttcgttcgagttcgacgcggtagttgtttcgcgtatcgtcgagtttcgcgataagtggacgcggcgtttgaggttgtcgcggacgttggttgttaaggtggagttggtggatatttaacgcgagggggcgttgcgttttatggtggtcgacgacgcggtcgcgggtttcgggggttcggtttagtggtagaagtgtcgtttgtttttgcgtagggttgtggtcgaggaacgttttcgtttggagtttttcgtgtcgtttaaagtgagttattttataattttatttagtttggggg

SEQ ID NO: 16622 - DNA, 787 bp, Artificial Sequence
  chemically treated genomic DNA (Homo sapiens) CpG-island No: 16622
cccccaaactaaataaaattataaaataactcactttaaacgacacgaaaaactccaaacgaaaacgttcctcgaccacaaccctacgcaaaaacaaacgacacttctaccactaaaccgaacccccgaaacccgcgaccgcgtcgtcgaccaccataaaacgcaacgccccctcgcgttaaatatccaccaactccaccttaacaaccaacgtccgcgacaacctcaaacgccgcgtccacttatcgcgaaactcgacgatacgcgaaacaactaccgcgtcgaactcgaacgaaacgcgccgataccacatatcgcgcacgccgtccaccacgcacaaactcatattacgcaacgaaaaacccttacgaacgcgaaccttaataaccgcgtacgtaaacacgtcctccgaactccgcgaataaccgtaaacgccgccttaaatacaaaaatatccgcgaactccgactccataacctctacgctcacgaccgcgccccgaatcgtcgacccaaccaccaacacgcgacgcacctcctcgccgaaaacgtccaaaaaattaacgacgaaataacgaaaaaaaaaaacgccgacgtcgaacgtatcgtaaactaaattatcccgcaaaaaacgacaaaacttatacgcaaaatccacgacgaccgcctacgcatacaactcgcaaaactaccgccaatccgaaaccgaaaccgaaactaaaaccgaaacgactacgacgaaaccaaaaccgacaccattcataacttccgtcccatcgcaaccacct

SEQ ID NO: 16623 - DNA, 787 bp, Artificial Sequence
  chemically treated genomic DNA (Homo sapiens) CpG-island No: 16623
tttttaggttaggtgggattatggggtaatttattttgggcggtacgaagaattttaggcggaagcgtttttcggttatagttttgcgtaggagtaggcggtatttttgttattgagtcgagttttcggagttcgcggtcgcgtcgtcggttattatgaagcgtagcgttttttcgcgttgaatgtttattagttttattttggtagttagcgttcgcgatagttttaggcgtcgcgtttatttgtcgcggggttcggcggtgcgcggggtagttgtcgcgtcgggttcgggcgaggcgcgtcggtgttatatgtcgcgtacgtcgtttattacgtataggtttatgttgcgtagcgagaagtttttgcgaacgcgggttttggtggtcgcgtgcgtggatacgtttttcgagtttcgcgagtggtcgtaggcgtcgttttgagtgtagaggtgttcgcgagtttcggttttatggtttttgcgtttacggtcgcgtttcgagtcgtcggtttagttattagtacgcggcgtattttttcgtcgaagacgtttaggaagttggcggcgaagtggcgggagaaggaggcgtcggcgtcgggcgtgtcgtaagttgggttgtttcgtaggaaacggtagaatttgtgcgtaaagtttacggcggtcgtttgcgtatgtagttcgtaaaattgtcgttagttcgggatcgggatcgggattgggatcggggcggttgcggcggggttagggtcggtattatttatggttttcgttttatcgtagttattt

SEQ ID NO: 16624 - DNA, 787 bp, Artificial Sequence
  chemically treated genomic DNA (Homo sapiens) CpG-island No: 16624
aaataactacgataaaacgaaaaccataaataataccgaccctaaccccgccgcaaccgccccgatcccaatcccgatcccgatcccgaactaacgacaattttacgaactacatacgcaaacgaccgccgtaaactttacgcacaaattctaccgtttcctacgaaacaacccaacttacgacacgcccgacgccgacgcctccttctcccgccacttcgccgccaacttcctaaacgtcttcgacgaaaaaatacgccgcgtactaataactaaaccgacgactcgaaacgcgaccgtaaacgcaaaaaccataaaaccgaaactcgcgaacacctctacactcaaaacgacgcctacgaccactcgcgaaactcgaaaaacgtatccacgcacgcgaccaccaaaacccgcgttcgcaaaaacttctcgctacgcaacataaacctatacgtaataaacgacgtacgcgacatataacaccgacgcgcctcgcccgaacccgacgcgacaactaccccgcgcaccgccgaaccccgcgacaaataaacgcgacgcctaaaactatcgcgaacgctaactaccaaaataaaactaataaacattcaacgcgaaaaaacgctacgcttcataataaccgacgacgcgaccgcgaactccgaaaactcgactcaataacaaaaataccgcctactcctacgcaaaactataaccgaaaaacgcttccgcctaaaattcttcgtaccgcccaaaataaattaccccataatcccacctaacctaaaaa

SEQ ID NO: 16625 - DNA, 517 bp, Artificial Sequence
  chemically treated genomic DNA (Homo sapiens) CpG-island No: 16625
gtgtttcgggaggcggattttcggtgtatttttgcgcgtgtgtatttttttttgcgtgcgtgttcgcgcgtgcgtgtttgtatatgcgcgttattttcgtattgttttggttttttgcgtttttttaggttatcgtttgttttcgtttttaggttttggtttttagtggacgagaattatcgagtttgcggggttggacgttgattgttcgggttagtatttaggcgggcgggagttgtgcggtttagggtttacgcgggtcgggtagaggttcgagtcgggattttcgagcgtgaatttcggagtcggcggcgttggggttagaggggtcgggcgggaggtggtggcggaggcgaaggggcgacgggatttgggtttggttcgtgtgtgttttcggcggtttggcgtcggtcgtcgttgtacggtgagttttagggaggcggatttgggtttcgagaaggattttcgtttggatttgtttcgtaggttcggttcgggtttttcgggagtagaatag

SEQ ID NO: 16626 - DNA, 517 bp, Artificial Sequence
  chemically treated genomic DNA (Homo sapiens) CpG-island No: 16626
ctattctactcccgaaaaacccgaaccgaacctacgaaacaaatccaaacgaaaatccttctcgaaacccaaatccgcctccctaaaactcaccgtacaacgacgaccgacgccaaaccgccgaaaacacacacgaaccaaacccaaatcccgtcgccccttcgcctccgccaccacctcccgcccgacccctctaaccccaacgccgccgactccgaaattcacgctcgaaaatcccgactcgaacctctacccgacccgcgtaaaccctaaaccgcacaactcccgcccgcctaaatactaacccgaacaatcaacgtccaaccccgcaaactcgataattctcgtccactaaaaaccaaaacctaaaaacgaaaacaaacgataacctaaaaaaacgcaaaaaaccaaaacaatacgaaaataacgcgcatatacaaacacgcacgcgcgaacacgcacgcaaaaaaaaatacacacgcgcaaaaatacaccgaaaatccgcctcccgaaacac

SEQ ID NO: 16627 - DNA, 517 bp, Artificial Sequence
  chemically treated genomic DNA (Homo sapiens) CpG-island No: 16627
ttgttttgttttcgagaggttcgggtcgggtttacggggtaaatttaggcgggggtttttttcggggtttagattcgtttttttggggtttatcgtatagcgacggtcggcgttaggtcgtcgaggatatatacgggttaggtttaggtttcgtcgttttttcgttttcgttattatttttcgttcggtttttttggttttagcgtcgtcggtttcggggtttacgttcgggggtttcggttcgagtttttattcggttcgcgtgaattttgggtcgtatagttttcgttcgtttaggtgttggttcgggtagttagcgtttagtttcgtagattcggtgattttcgtttattagaggttaaagtttgggaacgagagtaagcgatgatttgaagaggcgtaggaagttagggtagtgcggaggtggcgcgtatgtgtaagtacgtacgcgcgaatacgtacgtagggagaggtgtatacgcgtaggagtgtatcggaagttcgtttttcgggatat

SEQ ID NO: 16628 - DNA, 517 bp, Artificial Sequence
  chemically treated genomic DNA (Homo sapiens) CpG-island No: 16628
atatcccgaaaaacgaacttccgatacactcctacgcgtatacacctctccctacgtacgtattcgcgcgtacgtacttacacatacgcgccacctccgcactaccctaacttcctacgcctcttcaaatcatcgcttactctcgttcccaaactttaacctctaataaacgaaaatcaccgaatctacgaaactaaacgctaactacccgaaccaacacctaaacgaacgaaaactatacgacccaaaattcacgcgaaccgaataaaaactcgaaccgaaacccccgaacgtaaaccccgaaaccgacgacgctaaaaccaaaaaaaccgaacgaaaaataataacgaaaacgaaaaaacgacgaaacctaaacctaacccgtatatatcctcgacgacctaacgccgaccgtcgctatacgataaaccccaaaaaaacgaatctaaaccccgaaaaaaacccccgcctaaatttaccccgtaaacccgacccgaacctctcgaaaacaaaacaa

SEQ ID NO: 16629 - DNA, 793 bp, Artificial Sequence
  chemically treated genomic DNA (Homo sapiens) CpG-island No: 16629
tcgcgtttataggttgtgatgatgtttcgcgtacggagtagttgtaggtgcgtgaggatgtgtacgaggtcggttatacgggcgttgcggttgatttagggttataggacgttggtcgtgcgttgttcggagcgttcgtatagtcgtagttcggtttggtcgcgtacgattagggcggttgcggggcggggggcgttaggcgtcggcgttaggagttcgcgcgtttttcgtttttcggtagttcgtcgttatttatcgaattggtattagtcggcgggttttagggcgtttattattttgtagaagcggtatatgatttagggcggtatttcgtataagaagtgttgggcgtcgggggttgcgggttttttcgggttcggtttttcggttatggttgtcgtcgtcgggtcgggatttgtcggggttttttagggtcgcggcgggcgcgggtttgggtcggtcgggttcgcggatattgatttatttttttttcgagtcggtttcgtgcgacgttcggcggggcggaaggggcggtgttcgggttcgtcgttattttgcgcgtcgcggtcgcgcgttgggttatacgggggcgtttcgcgtcggggagggttcgggtttcggcgggtttcgcgagcggcgatcggtttttcgggttcgttcgggcggggttttggaggacgaacggcggttttcggcgttggggatagagggtagggcggaggttcgggttgttcggaaaggggtcggggtcgggtttttcgaaagtttttgggcggttttgtcggaattttgt

SEQ ID NO: 16630 - DNA, 793 bp, Artificial Sequence
  chemically treated genomic DNA (Homo sapiens) CpG-island No: 16630
acaaaattccgacaaaaccgcccaaaaactttcgaaaaacccgaccccgacccctttccgaacaacccgaacctccgccctaccctctatccccaacgccgaaaaccgccgttcgtcctccaaaaccccgcccgaacgaacccgaaaaaccgatcgccgctcgcgaaacccgccgaaacccgaaccctccccgacgcgaaacgcccccgtataacccaacgcgcgaccgcgacgcgcaaaataacgacgaacccgaacaccgccccttccgccccgccgaacgtcgcacgaaaccgactcgaaaaaaaaataaatcaatatccgcgaacccgaccgacccaaacccgcgcccgccgcgaccctaaaaaaccccgacaaatcccgacccgacgacgacaaccataaccgaaaaaccgaacccgaaaaaacccgcaacccccgacgcccaacacttcttatacgaaataccgccctaaatcatataccgcttctacaaaataataaacgccctaaaacccgccgactaataccaattcgataaataacgacgaactaccgaaaaacgaaaaacgcgcgaactcctaacgccgacgcctaacgccccccgccccgcaaccgccctaatcgtacgcgaccaaaccgaactacgactatacgaacgctccgaacaacgcacgaccaacgtcctataaccctaaatcaaccgcaacgcccgtataaccgacctcgtacacatcctcacgcacctacaactactccgtacgcgaaacatcatcacaacctataaacgcga

SEQ ID NO: 16631 - DNA, 793 bp, Artificial Sequence
  chemically treated genomic DNA (Homo sapiens) CpG-island No: 16631
gtagggtttcggtagggtcgtttaggagttttcggaaggttcggtttcggttttttttcgagtagttcgggttttcgttttgttttttgtttttaacgtcgggagtcgtcgttcgttttttagagtttcgttcgggcgagttcgggaggtcgatcgtcgttcgcggaattcgtcgggattcgggtttttttcggcgcggggcgttttcgtgtgatttagcgcgcggtcgcggcgcgtaagatggcggcgggttcgggtatcgtttttttcgtttcgtcgggcgtcgtacgaggtcggttcgaaggggaagtgagttagtgttcgcggattcggtcggtttaggttcgcgttcgtcgcggttttgagaggtttcggtaggtttcggttcggcggcggtagttatggtcggggggtcgggttcgggggagttcgtagttttcggcgtttagtattttttgtacgaggtgtcgttttgggttatgtgtcgtttttataaagtgatggacgttttggagttcgtcgattggtgttagttcggtgggtggcggcgggttgtcggggggcgggaggcgcgcgggtttttggcgtcgacgtttgacgtttttcgtttcgtagtcgttttgatcgtgcgcgattagatcgagttgcggttgtgcgagcgtttcgggtagcgtacggttagcgttttgtggttttggattaatcgtaacgttcgtgtggtcgatttcgtgtatatttttacgtatttgtagttgtttcgtgcgcgggatattattatagtttgtgagcgcgg

SEQ ID NO: 16632 - DNA, 793 bp, Artificial Sequence
  chemically treated genomic DNA (Homo sapiens) CpG-island No: 16632
ccgcgctcacaaactataataatatcccgcgcacgaaacaactacaaatacgtaaaaatatacacgaaatcgaccacacgaacgttacgattaatccaaaaccacaaaacgctaaccgtacgctacccgaaacgctcgcacaaccgcaactcgatctaatcgcgcacgatcaaaacgactacgaaacgaaaaacgtcaaacgtcgacgccaaaaacccgcgcgcctcccgccccccgacaacccgccgccacccaccgaactaacaccaatcgacgaactccaaaacgtccatcactttataaaaacgacacataacccaaaacgacacctcgtacaaaaaatactaaacgccgaaaactacgaactcccccgaacccgaccccccgaccataactaccgccgccgaaccgaaacctaccgaaacctctcaaaaccgcgacgaacgcgaacctaaaccgaccgaatccgcgaacactaactcacttccccttcgaaccgacctcgtacgacgcccgacgaaacgaaaaaaacgatacccgaacccgccgccatcttacgcgccgcgaccgcgcgctaaatcacacgaaaacgccccgcgccgaaaaaaacccgaatcccgacgaattccgcgaacgacgatcgacctcccgaactcgcccgaacgaaactctaaaaaacgaacgacgactcccgacgttaaaaacaaaaaacaaaacgaaaacccgaactactcgaaaaaaaaccgaaaccgaaccttccgaaaactcctaaacgaccctaccgaaaccctac

SEQ ID NO: 16633 - DNA, 1003 bp, Artificial Sequence
  chemically treated genomic DNA (Homo sapiens) CpG-island No: 16633
gaagtgcgtacgcgcgtcggtgggggggtcgagtaacgggagagggggcgcgcgagggagggagggggagagcgcgatttagggagaggtcggggtcgcgggcgcgcgacggcgtcgcggtttaaagtttcgagaagggtaggagcgcgcgtagtttcgataggcgaatttcggcgataggggcgttcgcggggtcgggggtcgggatgcgcgtcgagggcgggaggaagaggggcgttaggcgaaggcggttttagggaggtcgcgtcgaggacggttattcgcgagtacgggtgacgggtcgaggggagagtcgttatcggcggcggcgggagggggagggtagagaggagggacgttattcgttagtcgtgtcgttcgatttcgcgggtttttttcgcgttacgtttcgtttttgattttcgtttttcggtaagggttttcgttcgcggttacggcggttttatttatagtttttttttttcgttttttttttttttttcgttcggcgcggcggcggcggcggcggttatttttcggacggtttttattatagtttttttttcgagaggagggagcgcgcgcgtcgtcgacgtcgggatttcgtacggtcgacgtcgcgtttcgtttttttggtcggttcgcgcgttgttgtatttgcgcgttcgcgtttcgttttcggcgtcgttgcgagttcgttcgttattggttgtgatggtcgggttgggacggggaggacgggggaggggggaggttttagcggcgatgtcgttaattggcgagattttttgtttatttcggttagggaaaagggggcggatttttttagttgttgattggttgttttcggtcgtcgtttggggaaaagaggcggtttgggcgcggagggattggtttagtgggcggaatttgaatgttaaggattaatggatttttgcggatgttggggtaagtgaaggtttaggtttgggacgtttgtttgcgttgttttgaggggcgattg

SEQ ID NO: 16634 - DNA, 1003 bp, Artificial Sequence
  chemically treated genomic DNA (Homo sapiens) CpG-island No: 16634
caatcgcccctcaaaacaacgcaaacaaacgtcccaaacctaaaccttcacttaccccaacatccgcaaaaatccattaatccttaacattcaaattccgcccactaaaccaatccctccgcgcccaaaccgcctcttttccccaaacgacgaccgaaaacaaccaatcaacaactaaaaaaatccgcccccttttccctaaccgaaataaacaaaaaatctcgccaattaacgacatcgccgctaaaacctcccccctcccccgtcctccccgtcccaacccgaccatcacaaccaataacgaacgaactcgcaacgacgccgaaaacgaaacgcgaacgcgcaaatacaacaacgcgcgaaccgaccaaaaaaacgaaacgcgacgtcgaccgtacgaaatcccgacgtcgacgacgcgcgcgctccctcctctcgaaaaaaaaactataataaaaaccgtccgaaaaataaccgccgccgccgccgccgcgccgaacgaaaaaaaaaaaaaaaacgaaaaaaaaaaactataaataaaaccgccgtaaccgcgaacgaaaacccttaccgaaaaacgaaaatcaaaaacgaaacgtaacgcgaaaaaaacccgcgaaatcgaacgacacgactaacgaataacgtccctcctctctaccctccccctcccgccgccgccgataacgactctcccctcgacccgtcacccgtactcgcgaataaccgtcctcgacgcgacctccctaaaaccgccttcgcctaacgcccctcttcctcccgccctcgacgcgcatcccgacccccgaccccgcgaacgcccctatcgccgaaattcgcctatcgaaactacgcgcgctcctacccttctcgaaactttaaaccgcgacgccgtcgcgcgcccgcgaccccgacctctccctaaatcgcgctctccccctccctccctcgcgcgccccctctcccgttactcgacccccccaccgacgcgcgtacgcacttc

SEQ ID NO: 16635 - DNA, 1003 bp, Artificial Sequence
  chemically treated genomic DNA (Homo sapiens) CpG-island No: 16635
taatcgttttttagagtagcgtaaataggcgttttaagtttaggtttttatttgttttagtattcgtaagggtttattaatttttaatatttaaatttcgtttattaaattagttttttcgcgtttaagtcgttttttttttttaaacgacggtcgaaagtagttaattaatagttggaggggttcgtttttttttttttggtcgaaatggataggaaatttcgttaattgacggtatcgtcgttgagattttttttttttttcgtttttttcgttttagttcggttattatagttaatgacgggcgggttcgtagcggcgtcgagggcggggcgcgggcgcgtaggtgtagtagcgcgcgggtcggttaagagggcggggcgcgacgtcggtcgtgcggggtttcggcgtcggcggcgcgcgcgtttttttttttcggagagagggttgtggtaaaagtcgttcggaaaatggtcgtcgtcgtcgtcgtcgcgtcgagcggaggaggaggaggaggcgaggaggagagattgtgagtgggatcgtcgtggtcgcgggcggggatttttgtcggggggcgggggttaggggcgggacgtggcgcgggaggggttcgcggggtcggacgatacggttggcggatggcgttttttttttttattttttttttttcgtcgtcgtcggtggcgatttttttttcggttcgttattcgtgttcgcgggtgatcgttttcggcgcggtttttttggagtcgttttcgtttgacgtttttttttttttcgttttcgacgcgtatttcggttttcggtttcgcgggcgtttttgtcgtcggggttcgtttgtcggggttgcgcgcgtttttgtttttttcggggttttgggtcgcggcgtcgtcgcgcgttcgcggtttcggtttttttttggatcgcgttttttttttttttttttcgcgcgttttttttttcgttattcggtttttttatcggcgcgcgtgcgtatttt

SEQ ID NO: 16636 - DNA, 1003 bp, Artificial Sequence
  chemically treated genomic DNA (Homo sapiens) CpG-island No: 16636
aaaatacgcacgcgcgccgataaaaaaaccgaataacgaaaaaaaaaacgcgcgaaaaaaaaaaaaaaaaaacgcgatccaaaaaaaaaccgaaaccgcgaacgcgcgacgacgccgcgacccaaaaccccgaaaaaaacaaaaacgcgcgcaaccccgacaaacgaaccccgacgacaaaaacgcccgcgaaaccgaaaaccgaaatacgcgtcgaaaacgaaaaaaaaaaaaacgtcaaacgaaaacgactccaaaaaaaccgcgccgaaaacgatcacccgcgaacacgaataacgaaccgaaaaaaaaatcgccaccgacgacgacgaaaaaaaaaaaataaaaaaaaaaaacgccatccgccaaccgtatcgtccgaccccgcgaacccctcccgcgccacgtcccgcccctaacccccgccccccgacaaaaatccccgcccgcgaccacgacgatcccactcacaatctctcctcctcgcctcctcctcctcctccgctcgacgcgacgacgacgacgacgaccattttccgaacgacttttaccacaaccctctctccgaaaaaaaaaaacgcgcgcgccgccgacgccgaaaccccgcacgaccgacgtcgcgccccgccctcttaaccgacccgcgcgctactacacctacgcgcccgcgccccgccctcgacgccgctacgaacccgcccgtcattaactataataaccgaactaaaacgaaaaaaacgaaaaaaaaaaaaaatctcaacgacgataccgtcaattaacgaaatttcctatccatttcgaccaaaaaaaaaaaaacgaacccctccaactattaattaactactttcgaccgtcgtttaaaaaaaaaaaacgacttaaacgcgaaaaaactaatttaataaacgaaatttaaatattaaaaattaataaacccttacgaatactaaaacaaataaaaacctaaacttaaaacgcctatttacgctactctaaaaaacgatta

SEQ ID NO: 16637 - DNA, 647 bp, Artificial Sequence
  chemically treated genomic DNA (Homo sapiens) CpG-island No: 16637
gaaacggcggcgcgagaaataaagattagaaggcgttaagcggagtttagcgcgttttttcggggcggggttcggtagttaaaaggttagggggaggttcgcgtagtcggtcggtttcggggcgggattttgtatatttggaagcggcgggtggcgttttttttgtcgtttttatttattcggttcgggtgtatttgtagggatattttgtggtagtttcgtcggatttcgtcgtcggaggtttcgcgtcgtacgtttagtattcggtaaaggtcggcggtgtcgaatattttttcgtaaaggtttagtagttttatgtcgggcggagatacgatttcggaggaagtagtcgtttttagttgcgtcgggtataatttaggattgtttttttttcgcgtttaaaaagtttagggcgtttgcgttataagtattgaaggggcgtggttacgtcgcgtattcgcgttttacggcggtcgtaaaatgaggtgtggcgagttaggcgcgggttcgggtaagtaacgtcggtatgtggagttatagttttcggtcgcgcgtaggagttaggtttttagggaagtgatgttgttcgggttttttttttttttgttttggaaatttggcgttcgttttattttttagtgtttaag

SEQ ID NO: 16638 - DNA, 647 bp, Artificial Sequence
  chemically treated genomic DNA (Homo sapiens) CpG-island No: 16638
cttaaacactaaaaaataaaacgaacgccaaatttccaaaacaaaaaaaaaaaaaacccgaacaacatcacttccctaaaaacctaactcctacgcgcgaccgaaaactataactccacataccgacgttacttacccgaacccgcgcctaactcgccacacctcattttacgaccgccgtaaaacgcgaatacgcgacgtaaccacgccccttcaatacttataacgcaaacgccctaaactttttaaacgcgaaaaaaaaacaatcctaaattatacccgacgcaactaaaaacgactacttcctccgaaatcgtatctccgcccgacataaaactactaaacctttacgaaaaaatattcgacaccgccgacctttaccgaatactaaacgtacgacgcgaaacctccgacgacgaaatccgacgaaactaccacaaaatatccctacaaatacacccgaaccgaataaataaaaacgacaaaaaaaacgccacccgccgcttccaaatatacaaaatcccgccccgaaaccgaccgactacgcgaacctccccctaaccttttaactaccgaaccccgccccgaaaaaacgcgctaaactccgcttaacgccttctaatctttatttctcgcgccgccgtttc

SEQ ID NO: 16639 - DNA, 647 bp, Artificial Sequence
  chemically treated genomic DNA (Homo sapiens) CpG-island No: 16639
tttggatattaaaaggtaagacggacgttagatttttagagtaaggggaggagagattcgagtaatattatttttttgaagatttagtttttgcgcgcggtcggggattgtgattttatatgtcggcgttatttattcgggttcgcgtttgattcgttatattttattttgcggtcgtcgtaaagcgcggatgcgcggcgtggttacgtttttttagtgtttgtgacgtaggcgttttgggttttttgggcgcgaaaaagaagtagttttgggttgtattcggcgtagttgggagcggttgtttttttcggggtcgtattttcgttcggtatggggttgttggatttttgcgaggaagtgttcggtatcgtcgatttttatcgggtgttgggcgtgcgacgcgaggttttcgacggcgaggttcgacgaggttattataaggtgtttttgtaggtatattcggatcgggtgggtgagggcgataaggaggacgttattcgtcgtttttaggtatgtagggtttcgtttcgaagtcgatcggttgcgcgggtttttttttagttttttggttatcgggtttcgtttcgggggagcgcgttgagtttcgtttggcgttttttgatttttatttttcgcgtcgtcgtttt

SEQ ID NO: 16640 - DNA, 647 bp, Artificial Sequence
  chemically treated genomic DNA (Homo sapiens) CpG-island No: 16640
aaaacgacgacgcgaaaaataaaaatcaaaaaacgccaaacgaaactcaacgcgctcccccgaaacgaaacccgataaccaaaaaactaaaaaaaaacccgcgcaaccgatcgacttcgaaacgaaaccctacatacctaaaaacgacgaataacgtcctccttatcgccctcacccacccgatccgaatatacctacaaaaacaccttataataacctcgtcgaacctcgccgtcgaaaacctcgcgtcgcacgcccaacacccgataaaaatcgacgataccgaacacttcctcgcaaaaatccaacaaccccataccgaacgaaaatacgaccccgaaaaaaacaaccgctcccaactacgccgaatacaacccaaaactacttctttttcgcgcccaaaaaacccaaaacgcctacgtcacaaacactaaaaaaacgtaaccacgccgcgcatccgcgctttacgacgaccgcaaaataaaatataacgaatcaaacgcgaacccgaataaataacgccgacatataaaatcacaatccccgaccgcgcgcaaaaactaaatcttcaaaaaaataatattactcgaatctctcctccccttactctaaaaatctaacgtccgtcttaccttttaatatccaaa

SEQ ID NO: 16641 - DNA, 1048 bp, Artificial Sequence
  chemically treated genomic DNA (Homo sapiens) CpG-island No: 16641
tgtttttcgatttagtcgtcgcgttatattggaagttgttttttcgggttgttcgatttttagcgcgtttcgggaacgtgtgtaatcggtttttcggcgtttaaggttgtaggcggttcggttttttacgtttttatttttcgcgtagttttcgtttttttttttttttttcggaattcgcgttttgtttcgggttttcgggttttttttttttttttttttttcgagtaatgtttttttcggagggcggggtatgtagttatttaggttgcggggtcggcgggcgggtaggaggcggcggttcgggtttcgggatggagttgtagcgtttaggcgttagaggcggaggttcgaggtcgttatatagattgcggggttggcgggcgcggttcggcgttttgtatagcggtcggtagggtgtaggcggtcgggcggcgtagagttggttaggtaggtttcggggtttcgtgttttttttttcgttttttcgtttttttgtgttgtcgtttttttttttcgttgttttattttacggggcgaatatggcgtatagttgtcggtggcgttttttcgttcgattcgggattatcgggggcggcggcggcggggggcgtcggggtttagggggcgtttcgcggtaacgcgtttcggttttgttgttttttttcgggttttcggtcggcggtggcggtttcggggcgtttttttttttttcggttgtggcggtcgcggcggcggcggcgggaagtagcggggttggggttttagggggagcggtcgtcgttttagtagttttttcgtcgttcgtttcgttttcgttttcgttatcgtttttagtttttttagggtcggttttgtttcgggtgggttcgggtttcgacgcggcgttgtaggtttcggtcgttatcggtattaatttgcgtcggtttcgggtcgtgtttggggagagcggcgggggaggcggtagcggagaggtaagggggcgaggaatttttaagttcggggtttcgattttttgcggagatttttttttttttttattcgggat

SEQ ID NO: 16642 - DNA, 1048 bp, Artificial Sequence
  chemically treated genomic DNA (Homo sapiens) CpG-island No: 16642
atcccgaataaaaaaaaaaaaaaatctccgcaaaaaatcgaaaccccgaacttaaaaattcctcgcccccttacctctccgctaccgcctcccccgccgctctccccaaacacgacccgaaaccgacgcaaattaataccgataacgaccgaaacctacaacgccgcgtcgaaacccgaacccacccgaaacaaaaccgaccctaaaaaaactaaaaacgataacgaaaacgaaaacgaaacgaacgacgaaaaaactactaaaacgacgaccgctccccctaaaaccccaaccccgctacttcccgccgccgccgccgcgaccgccacaaccgaaaaaaaaaaaaacgccccgaaaccgccaccgccgaccgaaaacccgaaaaaaaacaacaaaaccgaaacgcgttaccgcgaaacgccccctaaaccccgacgccccccgccgccgccgcccccgataatcccgaatcgaacgaaaaaacgccaccgacaactatacgccatattcgccccgtaaaataaaacaacgaaaaaaaaaaacgacaacacaaaaaaacgaaaaaacgaaaaaaaaaacacgaaaccccgaaacctacctaaccaactctacgccgcccgaccgcctacaccctaccgaccgctatacaaaacgccgaaccgcgcccgccaaccccgcaatctatataacgacctcgaacctccgcctctaacgcctaaacgctacaactccatcccgaaacccgaaccgccgcctcctacccgcccgccgaccccgcaacctaaataactacataccccgccctccgaaaaaaacattactcgaaaaaaaaaaaaaaaaaaaaaacccgaaaacccgaaacaaaacgcgaattccgaaaaaaaaaaaaaaaaacgaaaactacgcgaaaaataaaaacgtaaaaaaccgaaccgcctacaaccttaaacgccgaaaaaccgattacacacgttcccgaaacgcgctaaaaatcgaacaacccgaaaaaacaacttccaatataacgcgacgactaaatcgaaaaaca

SEQ ID NO: 16643 - DNA, 1048 bp, Artificial Sequence
  chemically treated genomic DNA (Homo sapiens) CpG-island No: 16643
atttcggatgggggaggggaggggttttcgtagagggtcgagatttcggatttgggggtttttcgtttttttattttttcgttgtcgtttttttcgtcgttttttttaaatacggttcggaatcggcgtaggttggtgtcgatggcggtcgagatttgtagcgtcgcgtcgaagttcgggtttattcggagtagggtcggttttgaagaggttgaggacgatgacgaagacgaagacgaggcggacgacgaggaggttgttgaggcggcggtcgttttttttggaattttagtttcgttgtttttcgtcgtcgtcgtcgcggtcgttatagtcgggggggaggggggcgtttcggggtcgttatcgtcgatcgggggttcggggggaagtagtagggtcgggacgcgttgtcgcggggcgttttttaggtttcggcgtttttcgtcgtcgtcgttttcggtggtttcgggtcgggcggggaagcgttatcgatagttgtgcgttatgttcgtttcgtgaagtgaagtagcgagagggagaggcgataatataggggggcggggaggcggaggggggggtacggggtttcggaatttgtttaattagttttgcgtcgttcggtcgtttgtattttgtcggtcgttatgtagagcgtcgggtcgcgttcgttagtttcgtaatttgtatagcggtttcgggttttcgtttttgacgtttgggcgttgtaattttatttcgaggttcgggtcgtcgttttttgttcgttcgtcggtttcgtaatttggataattgtatgtttcgtttttcgggagaggtattgttcgggaaaaggaggggggaaggaagttcgggagttcggagtagagcgcgggtttcggagagagggggagggggcgaggattacgcggaggatggaggcgtagggagtcgggtcgtttgtagttttgagcgtcgagaggtcgattatatacgttttcgggacgcgttgggaatcgaatagttcgggagagtagtttttagtataacgcggcggttgggtcggggagta

SEQ ID NO: 16644 - DNA, 1048 bp, Artificial Sequence
  chemically treated genomic DNA (Homo sapiens) CpG-island No: 16644
tactccccgacccaaccgccgcgttatactaaaaactactctcccgaactattcgattcccaacgcgtcccgaaaacgtatataatcgacctctcgacgctcaaaactacaaacgacccgactccctacgcctccatcctccgcgtaatcctcgccccctccccctctctccgaaacccgcgctctactccgaactcccgaacttccttcccccctccttttcccgaacaatacctctcccgaaaaacgaaacatacaattatccaaattacgaaaccgacgaacgaacaaaaaacgacgacccgaacctcgaaataaaattacaacgcccaaacgtcaaaaacgaaaacccgaaaccgctatacaaattacgaaactaacgaacgcgacccgacgctctacataacgaccgacaaaatacaaacgaccgaacgacgcaaaactaattaaacaaattccgaaaccccgtacccccccctccgcctccccgcccccctatattatcgcctctccctctcgctacttcacttcacgaaacgaacataacgcacaactatcgataacgcttccccgcccgacccgaaaccaccgaaaacgacgacgacgaaaaacgccgaaacctaaaaaacgccccgcgacaacgcgtcccgaccctactacttccccccgaacccccgatcgacgataacgaccccgaaacgcccccctcccccccgactataacgaccgcgacgacgacgacgaaaaacaacgaaactaaaattccaaaaaaaacgaccgccgcctcaacaacctcctcgtcgtccgcctcgtcttcgtcttcgtcatcgtcctcaacctcttcaaaaccgaccctactccgaataaacccgaacttcgacgcgacgctacaaatctcgaccgccatcgacaccaacctacgccgattccgaaccgtatttaaaaaaaacgacgaaaaaaacgacaacgaaaaaataaaaaaacgaaaaacccccaaatccgaaatctcgaccctctacgaaaacccctcccctcccccatccgaaat

SEQ ID NO: 16645 - DNA, 1240 bp, Artificial Sequence
  chemically treated genomic DNA (Homo sapiens) CpG-island No: 16645
ttcgttcgcggtatcgacgtttttttcggttttcgggagggatttttgcggggtcgttagttttagcgttttcgcggatagtacgcgttttttttatcgagtttgcgaggaaggcgtttcgttttttattttttcgggagcgagttttagttttcgggacgtagtttatacgcgttagtttagtacgaatcggtttcgggtagggtcgtatttattttcgggattagttcgcgtttcgtatttcgtttttcggcgttcgttttggataggtgttttttgttttttcgggattttcgtatcgggatatcgcgcgtttttcgtttttttcgcgggcgtaggagtttgaggcggcggttcggggacgcggttaatttgggagagagcgggggcgggggtcggttggggaaggggtcgttcggaggcggaggggtcgtcgcgggagtttggaagttcgcggggtcgggtcggggcggcggggcgggtcggaggcgttggtcggggcgacggttatttatttttttgttcgggatttattgcggtttttttaggtcgaacgggttttcgaaggcgcggtgttcgggtattatgcgtaggtcgttcggggagcgtattagttttttggcgtcgcggcgcgcggatatttcggaggatatgacgtcgttttagtttttcggttagcggtttcgtattcggtttttcgtttagttcggggtatcgttcgtttcgtttcggttcgcgcgcggttgatagcgtcggcgtttaatcgttaagttcgttacggagcgcggattaatcggagtttgaatttcgttttatcgttgttttttttaattcgtgtaagggtatcgtttttgtaattttgaggtcgattattaatcggcggcgagggttggttcgggtacgtttcgttttttttagggagattgagattttggattggttagttagttagttacgttagcgtcgtttcgtttttgattggtgtagtttatttagggtgttaggcgtttattggaggagaaggtcgagaggagtaggacggcgggaagaggagtgcggaattcgcgggaggtgaggttcgtcgagtcgggttgcgagtcgggttgcgagtcgggcggtagcggggtcggaggtcgtgggcggtagcgggcgtgaggggtgaggtagggttaaggggcgggggcggtcgcgggtttttattgttcgagtttgtgggagtaggcgggtttggggttgtagt

SEQ ID NO: 16646 - DNA, 1240 bp, Artificial Sequence
  chemically treated genomic DNA (Homo sapiens) CpG-island No: 16646
actacaaccccaaacccgcctactcccacaaactcgaacaataaaaacccgcgaccgcccccgccccttaaccctacctcacccctcacgcccgctaccgcccacgacctccgaccccgctaccgcccgactcgcaacccgactcgcaacccgactcgacgaacctcacctcccgcgaattccgcactcctcttcccgccgtcctactcctctcgaccttctcctccaataaacgcctaacaccctaaataaactacaccaatcaaaaacgaaacgacgctaacgtaactaactaactaaccaatccaaaatctcaatctccctaaaaaaaacgaaacgtacccgaaccaaccctcgccgccgattaataatcgacctcaaaattacaaaaacgatacccttacacgaattaaaaaaaacaacgataaaacgaaattcaaactccgattaatccgcgctccgtaacgaacttaacgattaaacgccgacgctatcaaccgcgcgcgaaccgaaacgaaacgaacgataccccgaactaaacgaaaaaccgaatacgaaaccgctaaccgaaaaactaaaacgacgtcatatcctccgaaatatccgcgcgccgcgacgccaaaaaactaatacgctccccgaacgacctacgcataatacccgaacaccgcgccttcgaaaacccgttcgacctaaaaaaaccgcaataaatcccgaacaaaaaaataaataaccgtcgccccgaccaacgcctccgacccgccccgccgccccgacccgaccccgcgaacttccaaactcccgcgacgacccctccgcctccgaacgaccccttccccaaccgacccccgcccccgctctctcccaaattaaccgcgtccccgaaccgccgcctcaaactcctacgcccgcgaaaaaaacgaaaaacgcgcgatatcccgatacgaaaatcccgaaaaaacaaaaaacacctatccaaaacgaacgccgaaaaacgaaatacgaaacgcgaactaatcccgaaaataaatacgaccctacccgaaaccgattcgtactaaactaacgcgtataaactacgtcccgaaaactaaaactcgctcccgaaaaaataaaaaacgaaacgccttcctcgcaaactcgataaaaaaaacgcgtactatccgcgaaaacgctaaaactaacgaccccgcaaaaatccctcccgaaaaccgaaaaaaacgtcgataccgcgaacgaa

SEQ ID NO: 16647 - DNA, 1240 bp, Artificial Sequence
  chemically treated genomic DNA (Homo sapiens) CpG-island No: 16647
gttgtagttttaggttcgtttgtttttataggttcgggtaatggagattcgcggtcgttttcgttttttgattttgttttattttttacgttcgttgtcgtttacgattttcgatttcgttgtcgttcggttcgtagttcggttcgtagttcggttcggcgggttttatttttcgcgggtttcgtattttttttttcgtcgttttgtttttttcggtttttttttttaataggcgtttagtattttgagtgggttatattaattagagacgaagcggcgttaacgtgattgattaattaattaatttaaagttttaatttttttgagaggggcggagcgtattcgggttagttttcgtcgtcgattggtgatcgattttagggttgtaggggcggtgtttttatacggattggagagggtagcgatggggcggagtttaagtttcgattagttcgcgtttcgtggcgggtttggcgattggacgtcggcgttgttagtcgcgcgcggatcggggcggggcgggcggtgtttcgggttgggcgaggggtcgggtgcggggtcgttggtcgagaggttgaggcggcgttatgtttttcgaggtgttcgcgcgtcgcgacgttaagaagttggtgcgtttttcgagcggtttgcgtatggtgttcgaatatcgcgttttcggaagttcgttcggtttggaggagtcgtagtgggtttcggataaggaggtgggtggtcgtcgtttcggttagcgttttcgattcgtttcgtcgtttcggttcggtttcgcgggtttttaggttttcgcgacgattttttcgttttcgggcggttttttttttagtcggttttcgttttcgtttttttttaggttggtcgcgttttcgggtcgtcgttttaggtttttacgttcgcggggagggcgggaggcgcgcggtgtttcggtgcgggggtttcgggagggtaggaggtatttgtttagggcgggcgtcgggaggcggggtgcggggcgcgggttggtttcgggggtgggtgcggttttgttcgaggtcggttcgtgttgggttagcgcgtgtggattgcgtttcgagagttggggttcgttttcgagaaagtggaaggcggagcgtttttttcgtaggttcggtggggagggcgcgtgttgttcgcggaagcgttggagttggcggtttcgtaggggtttttttcgggaatcgggggaggcgtcggtgtcgcgggcggg

SEQ ID NO: 16648 - DNA, 1240 bp, Artificial Sequence
  chemically treated genomic DNA (Homo sapiens) CpG-island No: 16648
cccgcccgcgacaccgacgcctcccccgattcccgaaaaaaacccctacgaaaccgccaactccaacgcttccgcgaacaacacgcgccctccccaccgaacctacgaaaaaaacgctccgccttccactttctcgaaaacgaaccccaactctcgaaacgcaatccacacgcgctaacccaacacgaaccgacctcgaacaaaaccgcacccacccccgaaaccaacccgcgccccgcaccccgcctcccgacgcccgccctaaacaaatacctcctaccctcccgaaacccccgcaccgaaacaccgcgcgcctcccgccctccccgcgaacgtaaaaacctaaaacgacgacccgaaaacgcgaccaacctaaaaaaaaacgaaaacgaaaaccgactaaaaaaaaaaccgcccgaaaacgaaaaaatcgtcgcgaaaacctaaaaacccgcgaaaccgaaccgaaacgacgaaacgaatcgaaaacgctaaccgaaacgacgaccacccacctccttatccgaaacccactacgactcctccaaaccgaacgaacttccgaaaacgcgatattcgaacaccatacgcaaaccgctcgaaaaacgcaccaacttcttaacgtcgcgacgcgcgaacacctcgaaaaacataacgccgcctcaacctctcgaccaacgaccccgcacccgacccctcgcccaacccgaaacaccgcccgccccgccccgatccgcgcgcgactaacaacgccgacgtccaatcgccaaacccgccacgaaacgcgaactaatcgaaacttaaactccgccccatcgctaccctctccaatccgtataaaaacaccgcccctacaaccctaaaatcgatcaccaatcgacgacgaaaactaacccgaatacgctccgcccctctcaaaaaaattaaaactttaaattaattaattaatcaatcacgttaacgccgcttcgtctctaattaatataacccactcaaaatactaaacgcctattaaaaaaaaaaaccgaaaaaaacaaaacgacgaaaaaaaaaatacgaaacccgcgaaaaataaaacccgccgaaccgaactacgaaccgaactacgaaccgaacgacaacgaaatcgaaaatcgtaaacgacaacgaacgtaaaaaataaaacaaaatcaaaaaacgaaaacgaccgcgaatctccattacccgaacctataaaaacaaacgaacctaaaactacaac

SEQ ID NO: 16649 - DNA, 510 bp, Artificial Sequence
  chemically treated genomic DNA (Homo sapiens) CpG-island No: 16649
gacggacgtttgtgttttatgtttttagggttgtcgttttattacggttttttcggaaaacgggggcgttgagaagtttaatttttagttatatatgtcgttatcgtttatagggttttcgacggcgatgttggtgatagcgttttttgcgtgggcgttatttttttcgtgtttttcgcgtttgtagttaggtacgacggtgtgggtgtgttcgttcggggtagaggagttgtagggttcgcggtaggcggcgttgtgtaagtagcgacgtcgcggttcgaggaagtggaggcggtgaacgcgcgtgggcgcgtttttcgggatacggcgttggttttgcggcgttatttgttgggtattttttaatcgatggtgacgtcgtcgttgtcgttcggcgatcggtataaggagtttgcggtggtggcgggcgttgggtttacgtttttgaggcgttttaagttttttaagtttgttttgttggatcgcgtaggttattttgttcgttggttt

SEQ ID NO: 16650 - DNA, 510 bp, Artificial Sequence
  chemically treated genomic DNA (Homo sapiens) CpG-island No: 16650
aaaccaacgaacaaaataacctacgcgatccaacaaaacaaacttaaaaaacttaaaacgcctcaaaaacgtaaacccaacgcccgccaccaccgcaaactccttataccgatcgccgaacgacaacgacgacgtcaccatcgattaaaaaatacccaacaaataacgccgcaaaaccaacgccgtatcccgaaaaacgcgcccacgcgcgttcaccgcctccacttcctcgaaccgcgacgtcgctacttacacaacgccgcctaccgcgaaccctacaactcctctaccccgaacgaacacacccacaccgtcgtacctaactacaaacgcgaaaaacacgaaaaaaataacgcccacgcaaaaaacgctatcaccaacatcgccgtcgaaaaccctataaacgataacgacatatataactaaaaattaaacttctcaacgcccccgttttccgaaaaaaccgtaataaaacgacaaccctaaaaacataaaacacaaacgtccgtc

SEQ ID NO: 16651 - DNA, 510 bp, Artificial Sequence
  chemically treated genomic DNA (Homo sapiens) CpG-island No: 16651
gggttagcgggtagggtggtttacgcggtttagtagaataggtttagggggtttgaggcgttttaagagcgtgggtttagcgttcgttattatcgtaaattttttgtgtcggtcgtcgggcggtagcgacggcgttattatcgattagggagtgtttagtaggtagcgtcgtagagttagcgtcgtgtttcgggaggcgcgtttacgcgcgtttatcgtttttattttttcgggtcgcgacgtcgttgtttgtatagcgtcgtttgtcgcgagttttgtagtttttttgtttcgggcgggtatatttatatcgtcgtgtttggttgtaggcgcggggagtacggggagagtggcgtttacgtagggagcgttgttattagtatcgtcgtcgggggttttgtgggcggtggcgatatatatagttggaagttgggttttttagcgttttcgtttttcgagaaagtcgtgatgaagcggtagttttggaaatataaaatatagacgttcgtt

SEQ ID NO: 16652 - DNA, 510 bp, Artificial Sequence
  chemically treated genomic DNA (Homo sapiens) CpG-island No: 16652
aacgaacgtctatattttatatttccaaaactaccgcttcatcacgactttctcgaaaaacgaaaacgctaaaaaacccaacttccaactatatatatcgccaccgcccacaaaacccccgacgacgatactaataacaacgctccctacgtaaacgccactctccccgtactccccgcgcctacaaccaaacacgacgatataaatatacccgcccgaaacaaaaaaactacaaaactcgcgacaaacgacgctatacaaacaacgacgtcgcgacccgaaaaaataaaaacgataaacgcgcgtaaacgcgcctcccgaaacacgacgctaactctacgacgctacctactaaacactccctaatcgataataacgccgtcgctaccgcccgacgaccgacacaaaaaatttacgataataacgaacgctaaacccacgctcttaaaacgcctcaaaccccctaaacctattctactaaaccgcgtaaaccaccctacccgctaaccc

SEQ ID NO: 16653 - DNA, 695 bp, Artificial Sequence
  chemically treated genomic DNA (Homo sapiens) CpG-island No: 16653
cgtgggaggtcgcgattagcgatttcgtttattttttttagtcggttgttacgtaattgtaacgatagttagttagacgcggtagcgtcggatggcgggaggcgggagttggaggttaagggaagcgttgggcggaagtggttgtggttttgttttttggtttttgttggttgtgtggcggtttcgcggttcgtaggtcgttcgttgagcgtttttgtttagtcgcggttatgagtcggtatagtcggttgtagaggtaggttttgagtttgtatcgcgatttgttgcgcgtcgggcgtgggaagtcgggcgtcgaggcgcgagtgcgggtagagtttcggtagtatgcgggtttgtcgcggttcgacgtgttgcgtatcgagtatttgtatcgtcgcgggcggcgttagttgtagttgttacgttcgggttacgttatcgttatgggcgttttcgtacgttcgcgggtttcgatcggggagtttggcggcgtgggttgttagtttgacgacggcgatagtttaaggaatttttacgatagtacgggggtatcggagattcgtttcgacggacggtgataggcgaagagtcgaattcgttcgatggcgtggtggagttaggaggttcgtttgattgtatggggggattggggaattcgtttaaggtgagaggttttaagagattagtttgacgaa

SEQ ID NO: 16654 - DNA, 695 bp, Artificial Sequence
  chemically treated genomic DNA (Homo sapiens) CpG-island No: 16654
ttcgtcaaactaatctcttaaaacctctcaccttaaacgaattccccaatccccccatacaatcaaacgaacctcctaactccaccacgccatcgaacgaattcgactcttcgcctatcaccgtccgtcgaaacgaatctccgatacccccgtactatcgtaaaaattccttaaactatcgccgtcgtcaaactaacaacccacgccgccaaactccccgatcgaaacccgcgaacgtacgaaaacgcccataacgataacgtaacccgaacgtaacaactacaactaacgccgcccgcgacgatacaaatactcgatacgcaacacgtcgaaccgcgacaaacccgcatactaccgaaactctacccgcactcgcgcctcgacgcccgacttcccacgcccgacgcgcaacaaatcgcgatacaaactcaaaacctacctctacaaccgactataccgactcataaccgcgactaaacaaaaacgctcaacgaacgacctacgaaccgcgaaaccgccacacaaccaacaaaaaccaaaaaacaaaaccacaaccacttccgcccaacgcttcccttaacctccaactcccgcctcccgccatccgacgctaccgcgtctaactaactatcgttacaattacgtaacaaccgactaaaaaaaataaacgaaatcgctaatcgcgacctcccacg

SEQ ID NO: 16655 - DNA, 695 bp, Artificial Sequence
  chemically treated genomic DNA (Homo sapiens) CpG-island No: 16655
ttcgttaagttagttttttaagattttttattttaggcgggttttttagtttttttatgtagttaggcgagttttttggttttattacgttatcgagcgagttcggtttttcgtttgttatcgttcgtcggggcgggttttcggtgttttcgtgttgtcgtgggggttttttggattgtcgtcgtcgttaggttggtaatttacgtcgttaggtttttcggtcggggttcgcgggcgtacgaaggcgtttatggcggtggcgtggttcgagcgtagtagttgtagttggcgtcgttcgcggcggtataggtattcgatgcgtagtacgtcggatcgcggtaggttcgtatgttgtcggaattttgttcgtattcgcgtttcggcgttcggttttttacgttcggcgcgtagtagatcgcggtataggtttagaatttgtttttgtagtcggttgtgtcggtttatgatcgcggttaagtagagacgtttagcgaacgatttgcgaatcgcggagtcgttatatagttagtaaaggttaaagggtaaagttatagttattttcgtttagcgttttttttggtttttaattttcgtttttcgttattcggcgttgtcgcgtttgattggttgtcgttgtagttacgtaatagtcggttgggagaagtgggcggagtcgttggtcgcggttttttacg

SEQ ID NO: 16656 - DNA, 695 bp, Artificial Sequence
  chemically treated genomic DNA (Homo sapiens) CpG-island No: 16656
cgtaaaaaaccgcgaccaacgactccgcccacttctcccaaccgactattacgtaactacaacgacaaccaatcaaacgcgacaacgccgaataacgaaaaacgaaaattaaaaaccaaaaaaaacgctaaacgaaaataactataactttaccctttaacctttactaactatataacgactccgcgattcgcaaatcgttcgctaaacgtctctacttaaccgcgatcataaaccgacacaaccgactacaaaaacaaattctaaacctataccgcgatctactacgcgccgaacgtaaaaaaccgaacgccgaaacgcgaatacgaacaaaattccgacaacatacgaacctaccgcgatccgacgtactacgcatcgaatacctataccgccgcgaacgacgccaactacaactactacgctcgaaccacgccaccgccataaacgccttcgtacgcccgcgaaccccgaccgaaaaacctaacgacgtaaattaccaacctaacgacgacgacaatccaaaaaacccccacgacaacacgaaaacaccgaaaacccgccccgacgaacgataacaaacgaaaaaccgaactcgctcgataacgtaataaaaccaaaaaactcgcctaactacataaaaaaactaaaaaacccgcctaaaataaaaaatcttaaaaaactaacttaacgaa

SEQ ID NO: 16657 - DNA, 695 bp, Artificial Sequence
  chemically treated genomic DNA (Homo sapiens) CpG-island No: 16657
aagtcgttttttttgaagtgggagatggtcggggaggcgtagtttcgtcgtttttaagcggcggttttcgagcggcgattattttattattttttaatttagtttttttcggtttttcgtttttttttcgatttcgttttcgaaattattagtttaatttatttttttttattttagatattttgttaggcgatagttacgtcgattttggtgttcgcggggtttagtttaaagaagggagaagtcgtttgtttcgtgtagcgttcgttataacggtttttttaatcgtttttagcggtgataatcgtttacggagttgcgtagtatagttattggtttggggggatgggagggaacgagtaagaagtggggggcggagcgagaattgcgaaggcggtcggttttattttcgcgagacgggaaagtcggtttcgtatggcgttggcggtacgtagcgcgtttgcgcggtggcgggttgcgtagttgttgggggcgaggtagatcgagtagtagttgttttagttaaagagttgtagcgcgtatcgttttttttgtttacgttagaattatttagtttttagagcgtattattttgtcgtttcggcgcgatggtaatggttcgttttgttagtgtgtataacgaatcgtgtcgtttggagcgtatttttagtcgaggggaagatttttttaagtta

SEQ ID NO: 16658 - DNA, 695 bp, Artificial Sequence
  chemically treated genomic DNA (Homo sapiens) CpG-island No: 16658
taacttaaaaaaatcttcccctcgactaaaaatacgctccaaacgacacgattcgttatacacactaacaaaacgaaccattaccatcgcgccgaaacgacaaaataatacgctctaaaaactaaataattctaacgtaaacaaaaaaaacgatacgcgctacaactctttaactaaaacaactactactcgatctacctcgcccccaacaactacgcaacccgccaccgcgcaaacgcgctacgtaccgccaacgccatacgaaaccgactttcccgtctcgcgaaaataaaaccgaccgccttcgcaattctcgctccgccccccacttcttactcgttccctcccatccccccaaaccaataactatactacgcaactccgtaaacgattatcaccgctaaaaacgattaaaaaaaccgttataacgaacgctacacgaaacaaacgacttctcccttctttaaactaaaccccgcgaacaccaaaatcgacgtaactatcgcctaacaaaatatctaaaataaaaaaaaataaattaaactaataatttcgaaaacgaaatcgaaaaaaaaacgaaaaaccgaaaaaaactaaattaaaaaataataaaataatcgccgctcgaaaaccgccgcttaaaaacgacgaaactacgcctccccgaccatctcccacttcaaaaaaaacgactt

SEQ ID NO: 16659 - DNA, 695 bp, Artificial Sequence
  chemically treated genomic DNA (Homo sapiens) CpG-island No: 16659
taatttgaaggagtttttttttcggttggaaatgcgttttaaacggtacggttcgttgtatatattggtagaacgagttattgttatcgcgtcgaggcggtagaatggtacgttttgaaagttggatggttttaacgtaagtaagaaaaacggtgcgcgttgtagttttttaattggaatagttgttgttcggtttatttcgtttttaatagttgcgtaattcgttatcgcgtaggcgcgttgcgtgtcgttagcgttatgcgaaatcgattttttcgtttcgcgagagtggggtcggtcgttttcgtagttttcgtttcgttttttattttttgttcgtttttttttatttttttaagttagtagttgtgttgcgtagtttcgtaagcggttgttatcgttggagacggttgggagaatcgttgtggcgagcgttatacgaggtaaacgattttttttttttttgaattggatttcgcgagtattagagtcggcgtaattatcgtttgatagggtatttgaagtaaaagggggtaggttgggttggtggtttcgagagcggagtcgggagaaggacgaaaggtcgggaggggttgggttggggggtagtggggtggtcgtcgttcggaggtcgtcgtttggaagcggcggggttgcgttttttcgattattttttattttagggagggcggttt

SEQ ID NO: 16660 - DNA, 695 bp, Artificial Sequence
  chemically treated genomic DNA (Homo sapiens) CpG-island No: 16660
aaaccgccctccctaaaataaaaaataatcgaaaaaacgcaaccccgccgcttccaaacgacgacctccgaacgacgaccaccccactaccccccaacccaacccctcccgacctttcgtccttctcccgactccgctctcgaaaccaccaacccaacctacccccttttacttcaaataccctatcaaacgataattacgccgactctaatactcgcgaaatccaattcaaaaaaaaaaaaaatcgtttacctcgtataacgctcgccacaacgattctcccaaccgtctccaacgataacaaccgcttacgaaactacgcaacacaactactaacttaaaaaaataaaaaaaaacgaacaaaaaataaaaaacgaaacgaaaactacgaaaacgaccgaccccactctcgcgaaacgaaaaaatcgatttcgcataacgctaacgacacgcaacgcgcctacgcgataacgaattacgcaactattaaaaacgaaataaaccgaacaacaactattccaattaaaaaactacaacgcgcaccgtttttcttacttacgttaaaaccatccaactttcaaaacgtaccattctaccgcctcgacgcgataacaataactcgttctaccaatatatacaacgaaccgtaccgtttaaaacgcatttccaaccgaaaaaaaaactccttcaaatta

SEQ ID NO: 16661 - DNA, 589 bp, Artificial Sequence
  chemically treated genomic DNA (Homo sapiens) CpG-island No: 16661
tgtattgcgcgtttacgatgtcgtcgattatattgtcggtaaatttatcgtttatgatttttagtttattggttattacggcggttaggcgtagtttgtcgcgtaggtatttagtaaagaaagtaaagtcgtcggaggtaatcgttattttttagtttagcgtttttagtttgagtattagttgcgttaagtttggtattagcggtagatttttacgtatttgttgtagaatattggcgttagcgttttttagcgtcgttatacggttgcgtaggttggcggtaaaatcgagttcgtcgcgtatcgttcgttcggttattttcgttattatttcgttcgttttcgtttagttggttattttattaatatatttaatttggatggcggtggagtttatatttattattagtaaattcggcgtgcgtaggtgcgggattttttttagcggggcgatatttcgttgcgtttcgtggttaagcgtgtatttcgtgcggtgagtgaatttgttcgattaattaatttgataatttttacgtattaggcgggaataattattatgggcgtatttaagttgtttggtaatgggtta

SEQ ID NO: 16662 - DNA, 589 bp, Artificial Sequence
  chemically treated genomic DNA (Homo sapiens) CpG-island No: 16662
taacccattaccaaacaacttaaatacgcccataataattattcccgcctaatacgtaaaaattatcaaattaattaatcgaacaaattcactcaccgcacgaaatacacgcttaaccacgaaacgcaacgaaatatcgccccgctaaaaaaaatcccgcacctacgcacgccgaatttactaataataaatataaactccaccgccatccaaattaaatatattaataaaataaccaactaaacgaaaacgaacgaaataataacgaaaataaccgaacgaacgatacgcgacgaactcgattttaccgccaacctacgcaaccgtataacgacgctaaaaaacgctaacgccaatattctacaacaaatacgtaaaaatctaccgctaataccaaacttaacgcaactaatactcaaactaaaaacgctaaactaaaaaataacgattacctccgacgactttactttctttactaaatacctacgcgacaaactacgcctaaccgccgtaataaccaataaactaaaaatcataaacgataaatttaccgacaatataatcgacgacatcgtaaacgcgcaataca

SEQ ID NO: 16663 - DNA, 589 bp, Artificial Sequence
  chemically treated genomic DNA (Homo sapiens) CpG-island No: 16663
tgatttattattaagtaatttgggtgcgtttatggtaattgttttcgtttggtgcgtgaaaattattaagttgattggtcgggtaggtttatttatcgtacggggtatacgtttggttacgaagcgtagcggaatgtcgtttcgttggggaaaatttcgtatttgcgtacgtcgggtttgttggtgatggatatggattttatcgttatttagattgaatgtattgatgaaatggttaattgggcggaaacgggcgagatggtggcgaaagtaatcgaacgggcgatgcgcggcgaattcgattttatcgttagtttgcgtagtcgtgtggcgacgttgaaaggcgttgacgttaatattttgtaataggtgcgtgaaaatttgtcgttgatgttaggtttaacgtaattggtgtttaagttggaaacgttgggttggaaagtggcgattgttttcggcggttttattttttttgttgaatatttgcgcgataagttgcgtttgatcgtcgtggtagttaatgaattggagattatggacggtaaatttatcggtaatgtgatcggcgatatcgtagacgcgtagtata

SEQ ID NO: 16664 - DNA, 589 bp, Artificial Sequence
  chemically treated genomic DNA (Homo sapiens) CpG-island No: 16664
tatactacgcgtctacgatatcgccgatcacattaccgataaatttaccgtccataatctccaattcattaactaccacgacgatcaaacgcaacttatcgcgcaaatattcaacaaaaaaaataaaaccgccgaaaacaatcgccactttccaacccaacgtttccaacttaaacaccaattacgttaaacctaacatcaacgacaaattttcacgcacctattacaaaatattaacgtcaacgcctttcaacgtcgccacacgactacgcaaactaacgataaaatcgaattcgccgcgcatcgcccgttcgattactttcgccaccatctcgcccgtttccgcccaattaaccatttcatcaatacattcaatctaaataacgataaaatccatatccatcaccaacaaacccgacgtacgcaaatacgaaattttccccaacgaaacgacattccgctacgcttcgtaaccaaacgtataccccgtacgataaataaacctacccgaccaatcaacttaataattttcacgcaccaaacgaaaacaattaccataaacgcacccaaattacttaataataaatca

SEQ ID NO: 16665 - DNA, 1179 bp, Artificial Sequence
  chemically treated genomic DNA (Homo sapiens) CpG-island No: 16665
  misc_feature (1078)..(1078): n is either a, c, g or t
cgcggtgatgttgcgtcgaggttgaggcgcggggttggagagtcgtcgcgaaggcgacggttgtggtacgagtttcgcggagtgtgcggttttgagagatcgattaggattcggcgcgaggatgggaggcgcgcgttttcggcggggaggggttgattattttattgttaggttaagtttgcgtttttttttcggttagatgagttttattcgggggttcgacggaatgtttatgggggttcgtatttattagtaacgtattgtttgttcggcgacggttttcggtgttttttttatgttcgcggtttatttttcgttttaatatattatagcgaaagttttattttttaattcgttttgggtttattttttttggttttttttaatcgtcgcgttatttttcgataaacgttttgcgttttgtagtagttcgcgtagttgatatttatttttagtggttattcggatttggtatagcgtgtttttggttttttttttatcgttgtgggtattcggttgtttcgtcgttcgtattttcggtttaatttgtttcgtacgatttttttaatttagttttaattatcgtttttatgatagcgtttatagttttttttgtttatattttcgttgtgttcgtacggtcggagcgtattggttaatttttttttattttgatattttttttatattatatcgttcgttggtatcggttgtttaatatgtgtcggatcgtcgtatagcggttattcgattttaattttacgatttgtattgatcggtttattttgtattagtacgattttcggcgatattaatgacgtggtgatcgtttgattagattgtttttggataatacgatcgtcggtgattagaggatgtgtttttaggagtttgagtagttatgcgttagattgtagagtacgttcggcgacgtttcgttatttttttgatgcgtgggttacgtagcgtgtgtattgggcgtggttagacgagacgattgtttgttgattattattttattttgcgcgtattgtatttacgaattacgaggtacgggcgtagtttattcgtttttatntagtgacggatggcgtcgattttttgttagttcgcgttattttttaggttcgggggggaagatttaaagtattttttttttttttggtttatggattatat

SEQ ID NO: 16666 - DNA, 1179 bp, Artificial Sequence
  chemically treated genomic DNA (Homo sapiens) CpG-island No: 16666
  misc_feature (102)..(102): n is either a, c, g or t
atataatccataaaccaaaaaaaaaaaaaatactttaaatcttcccccccgaacctaaaaaataacgcgaactaacaaaaaatcgacgccatccgtcactanataaaaacgaataaactacgcccgtacctcgtaattcgtaaatacaatacgcgcaaaataaaataataatcaacaaacaatcgtctcgtctaaccacgcccaatacacacgctacgtaacccacgcatcaaaaaaataacgaaacgtcgccgaacgtactctacaatctaacgcataactactcaaactcctaaaaacacatcctctaatcaccgacgatcgtattatccaaaaacaatctaatcaaacgatcaccacgtcattaatatcgccgaaaatcgtactaatacaaaataaaccgatcaatacaaatcgtaaaattaaaatcgaataaccgctatacgacgatccgacacatattaaacaaccgataccaacgaacgatataatataaaaaaaatatcaaaataaaaaaaaattaaccaatacgctccgaccgtacgaacacaacgaaaatataaacaaaaaaaactataaacgctatcataaaaacgataattaaaactaaattaaaaaaatcgtacgaaacaaattaaaccgaaaatacgaacgacgaaacaaccgaatacccacaacgataaaaaaaaaaccaaaaacacgctataccaaatccgaataaccactaaaaataaatatcaactacgcgaactactacaaaacgcaaaacgtttatcgaaaaataacgcgacgattaaaaaaaaccaaaaaaaataaacccaaaacgaattaaaaaataaaactttcgctataatatattaaaacgaaaaataaaccgcgaacataaaaaaaacaccgaaaaccgtcgccgaacaaacaatacgttactaataaatacgaacccccataaacattccgtcgaacccccgaataaaactcatctaaccgaaaaaaaaacgcaaacttaacctaacaataaaataatcaacccctccccgccgaaaacgcgcgcctcccatcctcgcgccgaatcctaatcgatctctcaaaaccgcacactccgcgaaactcgtaccacaaccgtcgccttcgcgacgactctccaaccccgcgcctcaacctcgacgcaacatcaccgcg

SEQ ID NO: 16667 - DNA, 1179 bp, Artificial Sequence
  chemically treated genomic DNA (Homo sapiens) CpG-island No: 16667
  misc_feature (102)..(102): n is either a, c, g or t
atatagtttatagattaagggaaaaagaaatattttgagttttttttttcgggtttgaaggataacgcgggttgatagaggatcgacgttattcgttattgnatagagacgagtgagttgcgttcgtgtttcgtagttcgtaggtatagtacgcgtagggtgagatagtaattagtaagtagtcgtttcgtttagttacgtttagtatatacgttgcgtaatttacgtattaagaagatgacgggacgtcgtcgggcgtgttttgtagtttggcgtatagttgtttaagtttttggaaatatattttttggttatcggcggtcgtattatttaggagtagtttgattaggcgattattacgttattggtatcgtcggaggtcgtattagtatagagtgagtcgattaatataaatcgtgaggttaggatcggatgatcgttgtacgacggttcggtatatgttgggtagtcggtgttagcgggcggtgtagtgtaggaggaatgttagggtgaggaagggttgattagtgcgtttcgatcgtgcgaatatagcgaaggtatgaatagaagaggttgtaggcgttattatgggggcggtgattgaggttggattagaaggatcgtgcggggtaggttagatcggaagtgcgagcgacgaggtagtcggatatttatagcggtagaggggaggttaaaggtacgttatgttaagttcgagtgattattgagagtggatattagttacgcgggttgttgtaaggcgtaaagcgtttatcggaggatggcgcgacgattagaggaaattaggagagatggatttagagcgagttgagagatgaaattttcgttgtggtgtattagggcgaagagtgaatcgcgggtatagggagaatatcgagggtcgtcgtcgagtaggtagtacgttgttggtaagtgcgaatttttatgagtatttcgtcgaattttcgaatgggatttatttgatcgagggaggagcgtagatttgatttggtagtaagatagttaattttttttcgtcgggagcgcgcgttttttattttcgcgtcgggttttgatcggttttttagagtcgtatatttcgcggagttcgtgttatagtcgtcgttttcgcggcggttttttagtttcgcgttttagtttcggcgtagtattatcgcg

SEQ ID NO: 16668 - DNA, 1179 bp, Artificial Sequence
  chemically treated genomic DNA (Homo sapiens) CpG-island No: 16668
  misc_feature (1078)..(1078): n is either a, c, g or t
cgcgataatactacgccgaaactaaaacgcgaaactaaaaaaccgccgcgaaaacgacgactataacacgaactccgcgaaatatacgactctaaaaaaccgatcaaaacccgacgcgaaaataaaaaacgcgcgctcccgacgaaaaaaaattaactatcttactaccaaatcaaatctacgctcctccctcgatcaaataaatcccattcgaaaattcgacgaaatactcataaaaattcgcacttaccaacaacgtactacctactcgacgacgaccctcgatattctccctatacccgcgattcactcttcgccctaatacaccacaacgaaaatttcatctctcaactcgctctaaatccatctctcctaatttcctctaatcgtcgcgccatcctccgataaacgctttacgccttacaacaacccgcgtaactaatatccactctcaataatcactcgaacttaacataacgtacctttaacctcccctctaccgctataaatatccgactacctcgtcgctcgcacttccgatctaacctaccccgcacgatccttctaatccaacctcaatcaccgcccccataataacgcctacaacctcttctattcataccttcgctatattcgcacgatcgaaacgcactaatcaacccttcctcaccctaacattcctcctacactacaccgcccgctaacaccgactacccaacatataccgaaccgtcgtacaacgatcatccgatcctaacctcacgatttatattaatcgactcactctatactaatacgacctccgacgataccaataacgtaataatcgcctaatcaaactactcctaaataatacgaccgccgataaccaaaaaatatatttccaaaaacttaaacaactatacgccaaactacaaaacacgcccgacgacgtcccgtcatcttcttaatacgtaaattacgcaacgtatatactaaacgtaactaaacgaaacgactacttactaattactatctcaccctacgcgtactatacctacgaactacgaaacacgaacgcaactcactcgtctctatncaataacgaataacgtcgatcctctatcaacccgcgttatccttcaaacccgaaaaaaaaaactcaaaatatttctttttcccttaatctataaactatat

SEQ ID NO: 16669 - DNA, 590 bp, Artificial Sequence
  chemically treated genomic DNA (Homo sapiens) CpG-island No: 16669
ggggggcgagttggggtgtgaggattcgaaagggtcgatgcgggtggtataggggcggcgttcgttgcggtggtattagtgtggaaggggggggaggggtttagggagggagtcggtgtcggggggaatggtggggaggggaaggggtgggttgggatcggaggtggggggatcgagggagtggggttggggtgaggggaggtggatttgcgggatggtggggtggtgggggtgggcgtgaagacgaggggtcgtcggagggagggaatgggttacggacgtgggtgtagtcggtggggggggacgcgagtttggggtaggggggggacggtagggggggtttggaaggtgggcgggggtgggggggatggggggtcggtggggggggagggaggcggggtttgaggaggtttggggggggggggcggagggttgggattgtaggcgtgaggtatcgtgtcgggtcgaaatagggtagtggtggtgtggttcgggttggagagtaggggtgtagttcggggttcgtcggggtgcgatttgtttggtagaaaaaagaaaatagtaaaaaaaaatatttatattgtgggatt

SEQ ID NO: 16670 - DNA, 590 bp, Artificial Sequence
  chemically treated genomic DNA (Homo sapiens) CpG-island No: 16670
aatcccacaatataaatatttttttttactattttcttttttctaccaaacaaatcgcaccccgacgaaccccgaactacacccctactctccaacccgaaccacaccaccactaccctatttcgacccgacacgatacctcacgcctacaatcccaaccctccgccccccccccccaaacctcctcaaaccccgcctccctccccccccaccgaccccccatcccccccacccccgcccaccttccaaaccccccctaccgtcccccccctaccccaaactcgcgtccccccccaccgactacacccacgtccgtaacccattccctccctccgacgacccctcgtcttcacgcccacccccaccaccccaccatcccgcaaatccacctcccctcaccccaaccccactccctcgatccccccacctccgatcccaacccaccccttcccctccccaccattccccccgacaccgactccctccctaaacccctccccccccttccacactaataccaccgcaacgaacgccgcccctataccacccgcatcgaccctttcgaatcctcacaccccaactcgcccccc

SEQ ID NO: 16671 - DNA, 590 bp, Artificial Sequence
  chemically treated genomic DNA (Homo sapiens) CpG-island No: 16671
aattttataatgtaagtgtttttttttgttatttttttttttttgttaagtaggtcgtatttcgacggatttcgaattgtatttttgttttttagttcgggttatattattattattttgtttcggttcggtacggtgttttacgtttgtaattttagtttttcgttttttttttttaagtttttttagatttcgtttttttttttttttatcggttttttattttttttattttcgtttattttttagattttttttatcgttttttttttattttaagttcgcgtttttttttatcggttatatttacgttcgtagtttatttttttttttcggcgatttttcgtttttacgtttatttttattattttattatttcgtaaatttatttttttttattttagttttattttttcggtttttttattttcgattttaatttatttttttttttttttattatttttttcgatatcgattttttttttaggtttttttttttttttttatattagtgttatcgtaacggacgtcgtttttatattattcgtatcggttttttcgaatttttatattttaattcgtttttt

SEQ ID NO: 16672 - DNA, 590 bp, Artificial Sequence
  chemically treated genomic DNA (Homo sapiens) CpG-island No: 16672
aaaaaacgaattaaaatataaaaattcgaaaaaaccgatacgaataatataaaaacgacgtccgttacgataacactaatataaaaaaaaaaaaaaaaacctaaaaaaaaaatcgatatcgaaaaaaataataaaaaaaaaaaaaaataaattaaaatcgaaaataaaaaaaccgaaaaaataaaactaaaataaaaaaaaataaatttacgaaataataaaataataaaaataaacgtaaaaacgaaaaatcgccgaaaaaaaaaaataaactacgaacgtaaatataaccgataaaaaaaaacgcgaacttaaaataaaaaaaaaacgataaaaaaaatctaaaaaataaacgaaaataaaaaaaataaaaaaccgataaaaaaaaaaaaaaacgaaatctaaaaaaacttaaaaaaaaaaaacgaaaaactaaaattacaaacgtaaaacaccgtaccgaaccgaaacaaaataataataatataacccgaactaaaaaacaaaaatacaattcgaaatccgtcgaaatacgacctacttaacaaaaaaaaaaaaataacaaaaaaaaacacttacattataaaatt

SEQ ID NO: 16673 - DNA, 554 bp, Artificial Sequence
  chemically treated genomic DNA (Homo sapiens) CpG-island No: 16673
acgggaggtcgttggttgcgtattttgggcgtcgagtgttcgggatgagtttacgttcgcgtttgcggttttttttatttgtcgatttgtcgggggtttattgagttgacggcgtatttgggtttcggtcgtagcgtggggcgcggcgttcgggagtaggtgtgtaggagcgtagcgcgcggcgagcgtagttttcgtttcggagttcggtcgcgtcgcgtgttcgggcggttaggtagcggcggcggcggcggcgggcggcgggcgggcggcggttttcgggtaggtgtcgagcggcgagcggagtcgggtcgggcggagcgcggggggcgaggtcggcgcgtcgttcgcgggaggtcggggagcggtaggggtatgtggatattggttttttttttgttttagagtttcgcgaatggtgagtttttcggtttgtgatgaatttcgtttttttattattgatcgggggggcgggggggtggggggtggtattggatgtatgggtaaagtttttttttttttttcgttttatttgtgtttaaaatttcgtgttt

SEQ ID NO: 16674 - DNA, 554 bp, Artificial Sequence
  chemically treated genomic DNA (Homo sapiens) CpG-island No: 16674
aaacacgaaattttaaacacaaataaaacgaaaaaaaaaaaaaaactttacccatacatccaataccaccccccacccccccgcccccccgatcaataataaaaaaacgaaattcatcacaaaccgaaaaactcaccattcgcgaaactctaaaacaaaaaaaaaaccaatatccacatacccctaccgctccccgacctcccgcgaacgacgcgccgacctcgccccccgcgctccgcccgacccgactccgctcgccgctcgacacctacccgaaaaccgccgcccgcccgccgcccgccgccgccgccgccgctacctaaccgcccgaacacgcgacgcgaccgaactccgaaacgaaaactacgctcgccgcgcgctacgctcctacacacctactcccgaacgccgcgccccacgctacgaccgaaacccaaatacgccgtcaactcaataaacccccgacaaatcgacaaataaaaaaaaccgcaaacgcgaacgtaaactcatcccgaacactcgacgcccaaaatacgcaaccaacgacctcccgt

SEQ ID NO: 16675 - DNA, 554 bp, Artificial Sequence
  chemically treated genomic DNA (Homo sapiens) CpG-island No: 16675
aagtacgaaattttaaatatagatgaagcggaaaaagaaagaagattttatttatgtatttaatgttattttttattttttcgttttttcggttaatgataaggaaacgaaatttattataaatcgaaaggtttattattcgcgaagttttggaataaggagagagttagtatttatatgtttttgtcgtttttcggtttttcgcgagcgacgcgtcggtttcgtttttcgcgtttcgttcggttcggtttcgttcgtcgttcggtatttgttcgggggtcgtcgttcgttcgtcgttcgtcgtcgtcgtcgtcgttgtttagtcgttcgggtacgcggcgcggtcgggtttcggagcgagggttgcgttcgtcgcgcgttgcgtttttgtatatttgttttcgggcgtcgcgttttacgttgcggtcggagtttaggtgcgtcgttagtttagtgggttttcggtaggtcggtaggtggagagagtcgtagacgcgggcgtgagtttatttcgggtattcggcgtttagaatgcgtagttagcggtttttcgt

SEQ ID NO: 16676 - DNA, 554 bp, Artificial Sequence
  chemically treated genomic DNA (Homo sapiens) CpG-island No: 16676
acgaaaaaccgctaactacgcattctaaacgccgaatacccgaaataaactcacgcccgcgtctacgactctctccacctaccgacctaccgaaaacccactaaactaacgacgcacctaaactccgaccgcaacgtaaaacgcgacgcccgaaaacaaatatacaaaaacgcaacgcgcgacgaacgcaaccctcgctccgaaacccgaccgcgccgcgtacccgaacgactaaacaacgacgacgacgacgacgaacgacgaacgaacgacgacccccgaacaaataccgaacgacgaacgaaaccgaaccgaacgaaacgcgaaaaacgaaaccgacgcgtcgctcgcgaaaaaccgaaaaacgacaaaaacatataaatactaactctctccttattccaaaacttcgcgaataataaacctttcgatttataataaatttcgtttccttatcattaaccgaaaaaacgaaaaaataaaaaataacattaaatacataaataaaatcttctttctttttccgcttcatctatatttaaaatttcgtactt

SEQ ID NO: 16677 - DNA, 503 bp, Artificial Sequence
  chemically treated genomic DNA (Homo sapiens) CpG-island No: 16677
ggcgttttgtgtaaacggggtaggtttcgcggggattttatcgggacgtggtttcgttttcgcgcgttttggtaggcggggggttgcgtgtgtttgttttttttttttttttttttttttcgtttttttttttcggtgacgattcgtcgtaatgtggtggtaggaagtatgacgtcgtgggtcgaggttgtttttgttttcgtcgttttcggcggttgtaggtagcgggcgcgtagcgcgggcggtagtcgagttatttggcgggggtagggtcggagcgcggcgttgtttttattttcgtttaggtgtagggggagttcgcgcggggcggggggtcgagggcggtcgcgggattttcggttttgttgttcgttgttagttggtcggagtttttgttagttcgagtttacgttcgtttttttgaacggtagttggcgtttttcgtttgttttataagaggttaatttttgttggtgttgtagtttttttgtggtttttttagg

SEQ ID NO: 16678 - DNA, 503 bp, Artificial Sequence
  chemically treated genomic DNA (Homo sapiens) CpG-island No: 16678
cctaaaaaaaccacaaaaaaactacaacaccaacaaaaattaacctcttataaaacaaacgaaaaacgccaactaccgttcaaaaaaacgaacgtaaactcgaactaacaaaaactccgaccaactaacaacgaacaacaaaaccgaaaatcccgcgaccgccctcgaccccccgccccgcgcgaactccccctacacctaaacgaaaataaaaacaacgccgcgctccgaccctacccccgccaaataactcgactaccgcccgcgctacgcgcccgctacctacaaccgccgaaaacgacgaaaacaaaaacaacctcgacccacgacgtcatacttcctaccaccacattacgacgaatcgtcaccgaaaaaaaaaaacgaaaaaaaaaaaaaaaaaaaaaaaacaaacacacgcaaccccccgcctaccaaaacgcgcgaaaacgaaaccacgtcccgataaaatccccgcgaaacctaccccgtttacacaaaacgcc

SEQ ID NO: 16679 - DNA, 503 bp, Artificial Sequence
  chemically treated genomic DNA (Homo sapiens) CpG-island No: 16679
tttggggaagttataaagaagttgtaatattaataaagattaattttttgtggggtagacgaaaagcgttagttgtcgtttaggggggcgaacgtgggttcgggttggtagaggtttcggttagttggtagcggatagtagggtcgggggtttcgcggtcgttttcggtttttcgtttcgcgcggattttttttgtatttgagcgggggtgaggatagcgtcgcgtttcggttttgttttcgttaggtagttcggttgtcgttcgcgttgcgcgttcgttgtttgtagtcgtcgggagcgacgagagtagaggtagtttcggtttacggcgttatgttttttgttattatattacggcgaatcgttatcgggagaggggagcgaggggagagggggagggaggggagtagatatacgtagtttttcgtttgttaaaacgcgcggagacggggttacgtttcggtggagttttcgcgggatttgtttcgtttgtataaagcgtt

SEQ ID NO: 16680 - DNA, 503 bp, Artificial Sequence
  chemically treated genomic DNA (Homo sapiens) CpG-island No: 16680
aacgctttatacaaacgaaacaaatcccgcgaaaactccaccgaaacgtaaccccgtctccgcgcgttttaacaaacgaaaaactacgtatatctactcccctccctccccctctcccctcgctcccctctcccgataacgattcgccgtaatataataacaaaaaacataacgccgtaaaccgaaactacctctactctcgtcgctcccgacgactacaaacaacgaacgcgcaacgcgaacgacaaccgaactacctaacgaaaacaaaaccgaaacgcgacgctatcctcacccccgctcaaatacaaaaaaaatccgcgcgaaacgaaaaaccgaaaacgaccgcgaaacccccgaccctactatccgctaccaactaaccgaaacctctaccaacccgaacccacgttcgcccccctaaacgacaactaacgcttttcgtctaccccacaaaaaattaatctttattaatattacaacttctttataacttccccaaa

SEQ ID NO: 16681 - DNA, 1312 bp, Artificial Sequence
  chemically treated genomic DNA (Homo sapiens) CpG-island No: 16681
  misc_feature (468)..(468): n is either a, c, g or t
tcgtcgtttcgggtaggtcgtgcgtttatttttcgtcgtaagttcgggtggggtagtcgcggggatacgcgggggtcgttttcgatttcggtttaaggttgtggggttggaggggcgggcgggtcggttttagttcggagtttcgcgtgaatttcggggaggaattcggttggcgtcggggtttcgtacgtttttttttcgcggtttcgagcgtttttttacggttacgtttttcgcgtttagaatttttcggcgatttcgcgttttttgcgcgtttttcggaggtggtcgcggtacgggaggcgggtagtacggggttcggttcggtttaagcgttttcgtttcgtatttcgcggagggggtcgcgttcgaatcgggcggggcggggcgggggcgttttcggggcgcgggcgcggcggtaggtgggcgcgtttttcggcggggggggttcggcgggtcgcgcgtttntttcggaattcggtcgtgttatttttatgatgtttagttacgggtacggttttcggagtgcggtcgtcgtcgttatcgttcggtaggtcgcggggagggggcggtttgggggggtcgtttcgtttttcgtttcgttttttttttttcgcgttttttacggcgcggttcgggcgcggggcggcggtagcggcggcgcgcggggaggcggggaggcggggggttcggtcggacgtttttgcgtttttttttcgcgtttcggtcgagggcggagcgcgttggttttgtagttttcggttcgttttcggttcgtcgtttttttcgggacgtgggacgcgggcgtaggcggggttcgcgcggcgggcggcgggggacgggcggaggtgagcgggtgtagggtcggggtcggggggttcgggggttgggaagttggggggtcggggataggagggttagttaggtcggggtcggcgcgtcgtgtaggtcgcggcgggcgggcggcgggggtttttcgaggtaggcggacggggatcggcgtcggggttgtttcgtttttcgggcggggattttgtttttggttttcgtgcgattttcggttcgcgcgtttcgcgtttttggagttttaggtgaggcgtaggtgagggttcgcggtggggagttttggttcggttcggggcggtcgttgtttttcgagaatggtcgcggttcggtcggtttggagattgcggtttacgttttgcgttaggcggagttttcgggagggtggtcgttttttcgggttttaagttcgttagttttcggattttagaaatataatttcgggggtgtagatttgtttggaggttcg

SEQ ID NO: 16682 - DNA, 1312 bp, Artificial Sequence
  chemically treated genomic DNA (Homo sapiens) CpG-island No: 16682
  misc_feature (845)..(845): n is either a, c, g or t
cgaacctccaaacaaatctacacccccgaaattatatttctaaaatccgaaaactaacgaacttaaaacccgaaaaaacgaccaccctcccgaaaactccgcctaacgcaaaacgtaaaccgcaatctccaaaccgaccgaaccgcgaccattctcgaaaaacaacgaccgccccgaaccgaaccaaaactccccaccgcgaaccctcacctacgcctcacctaaaactccaaaaacgcgaaacgcgcgaaccgaaaatcgcacgaaaaccaaaaacaaaatccccgcccgaaaaacgaaacaaccccgacgccgatccccgtccgcctacctcgaaaaacccccgccgcccgcccgccgcgacctacacgacgcgccgaccccgacctaactaaccctcctatccccgaccccccaacttcccaacccccgaaccccccgaccccgaccctacacccgctcacctccgcccgtcccccgccgcccgccgcgcgaaccccgcctacgcccgcgtcccacgtcccgaaaaaaacgacgaaccgaaaacgaaccgaaaactacaaaaccaacgcgctccgccctcgaccgaaacgcgaaaaaaaaacgcaaaaacgtccgaccgaaccccccgcctccccgcctccccgcgcgccgccgctaccgccgccccgcgcccgaaccgcgccgtaaaaaacgcgaaaaaaaaaaaacgaaacgaaaaacgaaacgacccccccaaaccgccccctccccgcgacctaccgaacgataacgacgacgaccgcactccgaaaaccgtacccgtaactaaacatcataaaaataacacgaccgaattccgaaanaaacgcgcgacccgccgaaccccccccgccgaaaaacgcgcccacctaccgccgcgcccgcgccccgaaaacgcccccgccccgccccgcccgattcgaacgcgaccccctccgcgaaatacgaaacgaaaacgcttaaaccgaaccgaaccccgtactacccgcctcccgtaccgcgaccacctccgaaaaacgcgcaaaaaacgcgaaatcgccgaaaaattctaaacgcgaaaaacgtaaccgtaaaaaaacgctcgaaaccgcgaaaaaaaaacgtacgaaaccccgacgccaaccgaattcctccccgaaattcacgcgaaactccgaactaaaaccgacccgcccgcccctccaaccccacaaccttaaaccgaaatcgaaaacgacccccgcgtatccccgcgactaccccacccgaacttacgacgaaaaataaacgcacgacctacccgaaacgacga

SEQ ID NO: 16683 - DNA, 1312 bp, Artificial Sequence
  chemically treated genomic DNA (Homo sapiens) CpG-island No: 16683
  misc_feature (845)..(845): n is either a, c, g or t
cgggtttttaagtaggtttgtattttcggagttatgtttttgggattcgaggattagcgagtttggggttcgggagagcggttattttttcggaagtttcgtttggcgtagggcgtgaatcgtagtttttaggtcggtcgggtcgcggttattttcggagggtagcggtcgtttcgggtcgggttaaagttttttatcgcgggtttttatttgcgttttatttggggttttaggagcgcggggcgcgcgggtcgagagtcgtacggaggttagagataggattttcgttcggggaacggagtagtttcggcgtcgattttcgttcgtttgtttcggggagttttcgtcgttcgttcgtcgcggtttgtacggcgcgtcggtttcggtttggttggtttttttgttttcgattttttagttttttagttttcgagtttttcggtttcggttttgtattcgtttattttcgttcgtttttcgtcgttcgtcgcgcggatttcgtttgcgttcgcgttttacgtttcgggggaggcggcgggtcgggggcgggtcggaggttgtagggttagcgcgtttcgttttcggtcggggcgcggggagggggcgtaggggcgttcggtcgggtttttcgttttttcgttttttcgcgcgtcgtcgttgtcgtcgtttcgcgttcgggtcgcgtcgtgggaagcgcgggaggggaggggcggggcggggggcggggcgatttttttaagtcgtttttttttcgcgatttatcggacggtggcggcggcggtcgtatttcggaagtcgtgttcgtggttgggtattatgggaatggtacggtcgagtttcggggnaggcgcgcggttcgtcggatttttttcgtcggagagcgcgtttatttgtcgtcgcgttcgcgtttcggggacgttttcgtttcgtttcgttcggttcggacgcggtttttttcgcggggtgcggggcgaaggcgtttgggtcgggtcgagtttcgtgttgttcgtttttcgtatcgcggttattttcggggggcgcgtagggggcgcggggtcgtcgggaagttttgggcgcggggggcgtggtcgtgggaaagcgttcggagtcgcgggaagggagcgtgcggggtttcggcgttaatcgagttttttttcgaagtttacgcggggtttcgggttgagatcggttcgttcgtttttttagttttatagttttgggtcggggtcgggggcggttttcgcgtgttttcgcggttgttttattcgagtttgcggcggggagtggacgtacgatttgttcggggcggcgg

SEQ ID NO: 16684 - DNA, 1312 bp, Artificial Sequence
  chemically treated genomic DNA (Homo sapiens) CpG-island No: 16684
  misc_feature (468)..(468): n is either a, c, g or t
ccgccgccccgaacaaatcgtacgtccactccccgccgcaaactcgaataaaacaaccgcgaaaacacgcgaaaaccgcccccgaccccgacccaaaactataaaactaaaaaaacgaacgaaccgatctcaacccgaaaccccgcgtaaacttcgaaaaaaaactcgattaacgccgaaaccccgcacgctcccttcccgcgactccgaacgctttcccacgaccacgccccccgcgcccaaaacttcccgacgaccccgcgccccctacgcgccccccgaaaataaccgcgatacgaaaaacgaacaacacgaaactcgacccgacccaaacgccttcgccccgcaccccgcgaaaaaaaccgcgtccgaaccgaacgaaacgaaacgaaaacgtccccgaaacgcgaacgcgacgacaaataaacgcgctctccgacgaaaaaaatccgacgaaccgcgcgcctnccccgaaactcgaccgtaccattcccataatacccaaccacgaacacgacttccgaaatacgaccgccgccgccaccgtccgataaatcgcgaaaaaaaaacgacttaaaaaaatcgccccgccccccgccccgcccctcccctcccgcgcttcccacgacgcgacccgaacgcgaaacgacgacaacgacgacgcgcgaaaaaacgaaaaaacgaaaaacccgaccgaacgcccctacgccccctccccgcgccccgaccgaaaacgaaacgcgctaaccctacaacctccgacccgcccccgacccgccgcctcccccgaaacgtaaaacgcgaacgcaaacgaaatccgcgcgacgaacgacgaaaaacgaacgaaaataaacgaatacaaaaccgaaaccgaaaaactcgaaaactaaaaaactaaaaaatcgaaaacaaaaaaaccaaccaaaccgaaaccgacgcgccgtacaaaccgcgacgaacgaacgacgaaaactccccgaaacaaacgaacgaaaatcgacgccgaaactactccgttccccgaacgaaaatcctatctctaacctccgtacgactctcgacccgcgcgccccgcgctcctaaaaccccaaataaaacgcaaataaaaacccgcgataaaaaactttaacccgacccgaaacgaccgctaccctccgaaaataaccgcgacccgaccgacctaaaaactacgattcacgccctacgccaaacgaaacttccgaaaaaataaccgctctcccgaaccccaaactcgctaatcctcgaatcccaaaaacataactccgaaaatacaaacctacttaaaaacccg

SEQ ID NO: 16685 - DNA, 746 bp, Artificial Sequence
  chemically treated genomic DNA (Homo sapiens) CpG-island No: 16685
gtattgcggtttcgcgcggatggcgacggaaggggaggtcgttcggtttggtttggagggagatttcgttttgtttcgcgttttagttatggcgatattttcggtcgcgttgtttcgaatattcggcgcgggtgagcgcgcgtttgcgggattttggggaggagtatgcgaggaggatgcggaggggcgcggggattcgatggagcggcggggacgtggaggggattcggggcgagcgcggaggggattcggggagggcgcggggacgcggaggggattcgttagggacgcggaggggttcgttggggatgcggtggggagcgggcgtggtgtattcgggattcggcgttaggatttttatttatttttttttaggtgttcgggtttcgtcgcgttggttgggttttttcgggaaggcgattttttcggtttgttcggtcgagtcgtaggacgtttggaagcgcgacggtttttatgattcgcgagtcggaggatagtatcggtaatattgggcgtttagtcgagttgggtgggaacgaggagaggtcggtagtcgcgggggatgcgaattttagaggggtttgggcgttgtacgcggtcgaaattgcgcgtttcgttgggttttttttattttcgtgttcgtcgtcgttcggttttgtttgacgtagtatagcgggttgaggttatcgttttattatggatagggtgagagggagcgggcgggttagtggttagtataggtttcg

SEQ ID NO: 16686 - DNA, 746 bp, Artificial Sequence
  chemically treated genomic DNA (Homo sapiens) CpG-island No: 16686
cgaaacctatactaaccactaacccgcccgctccctctcaccctatccataataaaacgataacctcaacccgctatactacgtcaaacaaaaccgaacgacgacgaacacgaaaataaaaaaaacccaacgaaacgcgcaatttcgaccgcgtacaacgcccaaacccctctaaaattcgcatcccccgcgactaccgacctctcctcgttcccacccaactcgactaaacgcccaatattaccgatactatcctccgactcgcgaatcataaaaaccgtcgcgcttccaaacgtcctacgactcgaccgaacaaaccgaaaaaatcgccttcccgaaaaaacccaaccaacgcgacgaaacccgaacacctaaaaaaaaataaataaaaatcctaacgccgaatcccgaatacaccacgcccgctccccaccgcatccccaacgaacccctccgcgtccctaacgaatcccctccgcgtccccgcgccctccccgaatcccctccgcgctcgccccgaatcccctccacgtccccgccgctccatcgaatccccgcgcccctccgcatcctcctcgcatactcctccccaaaatcccgcaaacgcgcgctcacccgcgccgaatattcgaaacaacgcgaccgaaaatatcgccataactaaaacgcgaaacaaaacgaaatctccctccaaaccaaaccgaacgacctccccttccgtcgccatccgcgcgaaaccgcaatac

SEQ ID NO: 16687 - DNA, 746 bp, Artificial Sequence
  chemically treated genomic DNA (Homo sapiens) CpG-island No: 16687
cgaagtttgtgttaattattggttcgttcgtttttttttattttatttatggtgaggcggtggttttagttcgttgtgttacgttaggtaggatcgagcggcggcgagtacgggagtgggaggagtttagcggagcgcgtagtttcgatcgcgtgtagcgtttaggtttttttagggttcgtatttttcgcggttgtcggttttttttcgtttttatttaattcggttgggcgtttagtgttatcggtgttgtttttcgattcgcggattataagggtcgtcgcgtttttaagcgttttgcggttcggtcgagtaggtcgggggggtcgttttttcgagaaagtttaattagcgcgacggggttcgggtatttggggggaagtagatagaggttttggcgtcgagtttcgaatgtattacgttcgttttttatcgtatttttaacgggttttttcgcgtttttaacgggtttttttcgcgttttcgcgtttttttcgagtttttttcgcgttcgtttcgggttttttttacgttttcgtcgttttatcgggttttcgcgttttttcgtatttttttcgtatgtttttttttagggtttcgtaagcgcgcgtttattcgcgtcgagtattcggggtagcgcggtcgaggatgtcgttatggttgggacgcggggtagagcgaggtttttttttaggttaggtcgagcggttttttttttcgtcgttattcgcgcggggtcgtagtgt

SEQ ID NO: 16688 - DNA, 746 bp, Artificial Sequence
  chemically treated genomic DNA (Homo sapiens) CpG-island No: 16688
acactacgaccccgcgcgaataacgacgaaaaaaaaaaccgctcgacctaacctaaaaaaaaacctcgctctaccccgcgtcccaaccataacgacatcctcgaccgcgctaccccgaatactcgacgcgaataaacgcgcgcttacgaaaccctaaaaaaaaacatacgaaaaaaatacgaaaaaacgcgaaaacccgataaaacgacgaaaacgtaaaaaaaacccgaaacgaacgcgaaaaaaactcgaaaaaaacgcgaaaacgcgaaaaaaacccgttaaaaacgcgaaaaaacccgttaaaaatacgataaaaaacgaacgtaatacattcgaaactcgacgccaaaacctctatctacttccccccaaatacccgaaccccgtcgcgctaattaaactttctcgaaaaaacgacccccccgacctactcgaccgaaccgcaaaacgcttaaaaacgcgacgacccttataatccgcgaatcgaaaaacaacaccgataacactaaacgcccaaccgaattaaataaaaacgaaaaaaaaccgacaaccgcgaaaaatacgaaccctaaaaaaacctaaacgctacacgcgatcgaaactacgcgctccgctaaactcctcccactcccgtactcgccgccgctcgatcctacctaacgtaacacaacgaactaaaaccaccgcctcaccataaataaaataaaaaaaaacgaacgaaccaataattaacacaaacttcg

SEQ ID NO: 16689 - DNA, 635 bp, Artificial Sequence
  chemically treated genomic DNA (Homo sapiens) CpG-island No: 16689
ttattacgggatagcgttaggtagtattttttatagtcggagttcgaattgtcgcgagaatagcggtcggtttggaagtcgttcggcgcgggagcgcgaattttcgcgagaatgtcgttagtttcggaggcgattgcggtaggagttcgagttttcgcgcgataggtattaattcgttagacgcgcgttgtaggagcgcggaatatggcgcggtacgggttatcggggagtcggtggacgcgtagtaggagcgcgacgtgcgggagttcgttcggggtgtcgtcggtttttaggacgaggtagattttaatttttagttcgttttaaatttcgtttggtttaattttaggtgtggggtacggcgcgcgggcgggttttcggttatagttcggagttcgcgcgtgggtttcgtatagttcggggtcggggcgcgttggggtagggtatggggcggaggcgggcgcggttttagggagttttcgtaggttttgttatcgtttgtttttcgtcggttagcgttttcggcgcggtgttttgcgtattatagggcgtgttattcgggacgcgttttgatcgttacggggaaagcgtgaattgggttttttgtcggtcggcgcgcgcgtttgtaattttag

SEQ ID NO: 16690 - DNA, 635 bp, Artificial Sequence
  chemically treated genomic DNA (Homo sapiens) CpG-island No: 16690
ctaaaattacaaacgcgcgcgccgaccgacaaaaaacccaattcacgctttccccgtaacgatcaaaacgcgtcccgaataacacgccctataatacgcaaaacaccgcgccgaaaacgctaaccgacgaaaaacaaacgataacaaaacctacgaaaactccctaaaaccgcgcccgcctccgccccataccctaccccaacgcgccccgaccccgaactatacgaaacccacgcgcgaactccgaactataaccgaaaacccgcccgcgcgccgtaccccacacctaaaattaaaccaaacgaaatttaaaacgaactaaaaattaaaatctacctcgtcctaaaaaccgacgacaccccgaacgaactcccgcacgtcgcgctcctactacgcgtccaccgactccccgataacccgtaccgcgccatattccgcgctcctacaacgcgcgtctaacgaattaatacctatcgcgcgaaaactcgaactcctaccgcaatcgcctccgaaactaacgacattctcgcgaaaattcgcgctcccgcgccgaacgacttccaaaccgaccgctattctcgcgacaattcgaactccgactataaaaaatactacctaacgctatcccgtaataa

SEQ ID NO: 16691 - DNA, 635 bp, Artificial Sequence
  chemically treated genomic DNA (Homo sapiens) CpG-island No: 16691
ttggggttgtaggcgcgcgcgtcggtcggtaagaaatttagtttacgtttttttcgtgacgattaggacgcgtttcgggtaatacgttttgtggtgcgtagggtatcgcgtcgagagcgttggtcggcggggagtaggcggtggtagggtttgcgaaggttttttgaggtcgcgttcgttttcgttttatgttttgttttagcgcgtttcgatttcgggttgtgcgggatttacgcgcgggtttcgggttgtggtcgggaattcgttcgcgcgtcgtgttttatatttgaagttggattaggcgaagtttagggcgagttggaagttggggtttgtttcgttttggaggtcggcgatatttcggacgagttttcgtacgtcgcgtttttgttgcgcgtttatcgatttttcggtggttcgtgtcgcgttatgtttcgcgtttttgtagcgcgcgtttaacgaattggtgtttgtcgcgcgagagttcgggtttttgtcgtagtcgttttcggagttggcggtattttcgcgagagttcgcgttttcgcgtcgggcgatttttaagtcgatcgttattttcgcgatagttcgagtttcggttgtggagggtattgtttggcgttgtttcgtggtgg

SEQ ID NO: 16692 - DNA, 635 bp, Artificial Sequence
  chemically treated genomic DNA (Homo sapiens) CpG-island No: 16692
ccaccacgaaacaacgccaaacaataccctccacaaccgaaactcgaactatcgcgaaaataacgatcgacttaaaaatcgcccgacgcgaaaacgcgaactctcgcgaaaataccgccaactccgaaaacgactacgacaaaaacccgaactctcgcgcgacaaacaccaattcgttaaacgcgcgctacaaaaacgcgaaacataacgcgacacgaaccaccgaaaaatcgataaacgcgcaacaaaaacgcgacgtacgaaaactcgtccgaaatatcgccgacctccaaaacgaaacaaaccccaacttccaactcgccctaaacttcgcctaatccaacttcaaatataaaacacgacgcgcgaacgaattcccgaccacaacccgaaacccgcgcgtaaatcccgcacaacccgaaatcgaaacgcgctaaaacaaaacataaaacgaaaacgaacgcgacctcaaaaaaccttcgcaaaccctaccaccgcctactccccgccgaccaacgctctcgacgcgataccctacgcaccacaaaacgtattacccgaaacgcgtcctaatcgtcacgaaaaaaacgtaaactaaatttcttaccgaccgacgcgcgcgcctacaaccccaa

SEQ ID NO: 16693 - DNA, 547 bp, Artificial Sequence
  chemically treated genomic DNA (Homo sapiens) CpG-island No: 16693
gggcgtttcggtcgtagtgagggtatcggtattatatttttattggttttacgagtgtatatttgttacggttcgcgtttatttatagcgtgattcgtttttttaggtttcgtgtttgtagatttagatattatttggaaaatcgttggttattcgtagggaaaaggtagtatgcgtggggttttcgcgggtttcggtttggtcgggattttgtcgttaagttgttaagtatagtaatgtgcgtattgtattaggtattatcgcggtttcgattacgttttatttcggagttcgacggacgattgtaagaaatattatcgttttcggcgtagttacggtgtttttcgtcgttagaaaataaacgttttcgagttttagtttttagcggcgattacgcggcgttgggtttaattagtattcggtttttttgttggatttaatagcgtagttgatttcgtttagacgttttttttagtttaaattacgttttattaacgtcgttttttaattatttttgtattttttttgttatatttataatgtgttg

SEQ ID NO: 16694 - DNA, 547 bp, Artificial Sequence
  chemically treated genomic DNA (Homo sapiens) CpG-island No: 16694
caacacattataaatataacaaaaaaaatacaaaaataattaaaaaacgacgttaataaaacgtaatttaaactaaaaaaaacgtctaaacgaaatcaactacgctattaaatccaacaaaaaaaccgaatactaattaaacccaacgccgcgtaatcgccgctaaaaactaaaactcgaaaacgtttattttctaacgacgaaaaacaccgtaactacgccgaaaacgataatatttcttacaatcgtccgtcgaactccgaaataaaacgtaatcgaaaccgcgataatacctaatacaatacgcacattactatacttaacaacttaacgacaaaatcccgaccaaaccgaaacccgcgaaaaccccacgcatactaccttttccctacgaataaccaacgattttccaaataatatctaaatctacaaacacgaaacctaaaaaaacgaatcacgctataaataaacgcgaaccgtaacaaatatacactcgtaaaaccaataaaaatataataccgataccctcactacgaccgaaacgccc

SEQ ID NO: 16695 - DNA, 547 bp, Artificial Sequence
  chemically treated genomic DNA (Homo sapiens) CpG-island No: 16695
tagtatattgtgggtgtgataagaagggtgtaagaataattgggaaacggcgttgatggaacgtgatttaagttgagaggggcgtttggacggagttagttgcgttattaagtttagtaagggagtcgggtgttgattgagtttagcgtcgcgtggtcgtcgttggggattgaggttcgggagcgtttgttttttggcggcggagggtatcgtggttgcgtcgggagcggtggtgttttttgtagtcgttcgtcggatttcggaatgaggcgtggtcggagtcgcggtgatgtttggtgtagtgcgtatattgttatgtttgatagtttggcggtagagtttcggttaggtcgggattcgcgggggttttacgtatgttgttttttttttgcgggtggttagcggttttttaagtgatgtttagatttgtaggtacggagtttggaagaacgagttacgttgtgagtgggcgcgggtcgtagtaggtgtgtattcgtagggttagtagggatatagtgtcggtgtttttattgcgatcgaggcgttt

SEQ ID NO: 16696 - DNA, 547 bp, Artificial Sequence
  chemically treated genomic DNA (Homo sapiens) CpG-island No: 16696
aaacgcctcgatcgcaataaaaacaccgacactatatccctactaaccctacgaatacacacctactacgacccgcgcccactcacaacgtaactcgttcttccaaactccgtacctacaaatctaaacatcacttaaaaaaccgctaaccacccgcaaaaaaaaaacaacatacgtaaaacccccgcgaatcccgacctaaccgaaactctaccgccaaactatcaaacataacaatatacgcactacaccaaacatcaccgcgactccgaccacgcctcattccgaaatccgacgaacgactacaaaaaacaccaccgctcccgacgcaaccacgataccctccgccgccaaaaaacaaacgctcccgaacctcaatccccaacgacgaccacgcgacgctaaactcaatcaacacccgactcccttactaaacttaataacgcaactaactccgtccaaacgcccctctcaacttaaatcacgttccatcaacgccgtttcccaattattcttacacccttcttatcacacccacaatatacta

SEQ ID NO: 16697 - DNA, 764 bp, Artificial Sequence
  chemically treated genomic DNA (Homo sapiens) CpG-island No: 16697
atagtttgcggaggaggaagttcgcgcgggcgggggagggggtagggtgttggcggtggcgggcggtgttagtagcgggcgcggttttagttcgggcggacgcggtcggcggggagggggttaacgcgcgcggtttttatgataatgagttgtatggtgaaatagggaggtcggcgtttagggttttttcgtcgtcgtcgtcgtcgtcgtcgtcgtcgttatcgcgggagttagagttgtcgggaggagcggtattcgcgttagattggagcgggagggcggcggagggtagttgttgggaattttttagtcgagagggcgagcgattcggagagagatttcgagagtttgggagcggtagggcgtgcgagcgtcgtagttagcggagtaaatttcgaaatagatttggaaagttaggttttcggaggaaatgggattgtgaacgaatcggagagtaagaagggaaggaagcgtcgggattgttgatgttagaggagttcggaaagtcgcgttggaaaaatttgaagatagtcggggttttgttttttttttaggagagatatcgtcggtcgtttttatacgttttttcggcgttttcgggtgttttttgagagtcggcgatagcgtttagtcgggttgttgcggggcgacggaggattgaggggcgcgcggagcggagatcgaggagcgattttaggaatatagataagtgtttggtggtttgacgtggattttaatgaatttggattttatgtggatttggt

SEQ ID NO: 16698 - DNA, 764 bp, Artificial Sequence
  chemically treated genomic DNA (Homo sapiens) CpG-island No: 16698
accaaatccacataaaatccaaattcattaaaatccacgtcaaaccaccaaacacttatctatattcctaaaatcgctcctcgatctccgctccgcgcgcccctcaatcctccgtcgccccgcaacaacccgactaaacgctatcgccgactctcaaaaaacacccgaaaacgccgaaaaaacgtataaaaacgaccgacgatatctctcctaaaaaaaaaacaaaaccccgactatcttcaaatttttccaacgcgactttccgaactcctctaacatcaacaatcccgacgcttccttcccttcttactctccgattcgttcacaatcccatttcctccgaaaacctaactttccaaatctatttcgaaatttactccgctaactacgacgctcgcacgccctaccgctcccaaactctcgaaatctctctccgaatcgctcgccctctcgactaaaaaattcccaacaactaccctccgccgccctcccgctccaatctaacgcgaataccgctcctcccgacaactctaactcccgcgataacgacgacgacgacgacgacgacgacgacgaaaaaaccctaaacgccgacctccctatttcaccatacaactcattatcataaaaaccgcgcgcgttaaccccctccccgccgaccgcgtccgcccgaactaaaaccgcgcccgctactaacaccgcccgccaccgccaacaccctaccccctcccccgcccgcgcgaacttcctcctccgcaaactat

SEQ ID NO: 16699 - DNA, 764 bp, Artificial Sequence
  chemically treated genomic DNA (Homo sapiens) CpG-island No: 16699
attaaatttatatggagtttaaatttattaaaatttacgttaagttattagatatttatttgtatttttgaagtcgtttttcggttttcgtttcgcgcgttttttagtttttcgtcgtttcgtagtagttcggttgggcgttgtcgtcggtttttagggggtattcggaggcgtcgagggggcgtgtgggggcggtcggcggtgttttttttgaggaagaagtagagtttcggttgtttttagatttttttagcgcgatttttcgggtttttttgatattagtaatttcggcgtttttttttttttttgtttttcggttcgtttatagttttatttttttcgggagtttggttttttagatttatttcgaggtttgtttcgttggttgcggcgttcgtacgttttatcgtttttaagttttcggggttttttttcggatcgttcgttttttcggttgaaaaatttttagtaattgtttttcgtcgttttttcgttttagtttggcgcggatgtcgtttttttcggtagttttggttttcgcggtggcggcggcggcggcggcggcggcggcggcggaggagttttgagcgtcggtttttttattttattatgtagtttattattatagaggtcgcgcgcgttaatttttttttcgtcggtcgcgttcgttcgggttggggtcgcgttcgttgttggtatcgttcgttatcgttagtattttgttttttttttcgttcgcgcggattttttttttcgtaagttgt

SEQ ID NO: 16700 - DNA, 764 bp, Artificial Sequence
  chemically treated genomic DNA (Homo sapiens) CpG-island No: 16700
acaacttacgaaaaaaaaaatccgcgcgaacgaaaaaaaaaacaaaatactaacgataacgaacgataccaacaacgaacgcgaccccaacccgaacgaacgcgaccgacgaaaaaaaaattaacgcgcgcgacctctataataataaactacataataaaataaaaaaaccgacgctcaaaactcctccgccgccgccgccgccgccgccgccgccgccaccgcgaaaaccaaaactaccgaaaaaaacgacatccgcgccaaactaaaacgaaaaaacgacgaaaaacaattactaaaaatttttcaaccgaaaaaacgaacgatccgaaaaaaaaccccgaaaacttaaaaacgataaaacgtacgaacgccgcaaccaacgaaacaaacctcgaaataaatctaaaaaaccaaactcccgaaaaaaataaaactataaacgaaccgaaaaacaaaaaaaaaaaaaaacgccgaaattactaatatcaaaaaaacccgaaaaatcgcgctaaaaaaatctaaaaacaaccgaaactctacttcttcctcaaaaaaaacaccgccgaccgcccccacacgccccctcgacgcctccgaataccccctaaaaaccgacgacaacgcccaaccgaactactacgaaacgacgaaaaactaaaaaacgcgcgaaacgaaaaccgaaaaacgacttcaaaaatacaaataaatatctaataacttaacgtaaattttaataaatttaaactccatataaatttaat

SEQ ID NO: 16701 - DNA, 641 bp, Artificial Sequence
  chemically treated genomic DNA (Homo sapiens) CpG-island No: 16701
gggcgtaggcgcgggtttttgatttgcgtgtggtttttgagcgcgtcgtcgttttgtaggtataggttcgcgagttcgcgttttcgggcgcgtagtcgttttattttttcgcgtagtcgtcgcggttttagttcggcgcgtagttgcgtttagagggtgcggttgaaatgttcgtataggcgttagtttagcgcgtattagtttcgcgcgcgttttcgggtttcgggcgataggcgggttacggagcgcgcgttgcgggagttgagtttgaaggttattatgttgtttagcgtttagcgtagtcggcgtcgtagtagtattagggattcgtttaggtgttcggcgatgagtattagtcggaagcgtcgttttatttcggcgatgcgcgcgcgtacgtagtttttttcgtattgcgcgttggggtcgaagtcgaagtcgaattatatgttgtttttggcgtagacgtttttgaggtggcggttgtcgttgtagaacgttcgcggcgaggttaggaacgcgtttaggttcggggcgtttcggaaggcgggggcgtaggttttgtagtagatgaaggaggattttagttggaatacggggttttttaggatggagaagtagaaggtgtcgttgggtatgatttt

SEQ ID NO: 16702 - DNA, 641 bp, Artificial Sequence
  chemically treated genomic DNA (Homo sapiens) CpG-island No: 16702
aaaatcatacccaacgacaccttctacttctccatcctaaaaaaccccgtattccaactaaaatcctccttcatctactacaaaacctacgcccccgccttccgaaacgccccgaacctaaacgcgttcctaacctcgccgcgaacgttctacaacgacaaccgccacctcaaaaacgtctacgccaaaaacaacatataattcgacttcgacttcgaccccaacgcgcaatacgaaaaaaactacgtacgcgcgcgcatcgccgaaataaaacgacgcttccgactaatactcatcgccgaacacctaaacgaatccctaatactactacgacgccgactacgctaaacgctaaacaacataataaccttcaaactcaactcccgcaacgcgcgctccgtaacccgcctatcgcccgaaacccgaaaacgcgcgcgaaactaatacgcgctaaactaacgcctatacgaacatttcaaccgcaccctctaaacgcaactacgcgccgaactaaaaccgcgacgactacgcgaaaaaataaaacgactacgcgcccgaaaacgcgaactcgcgaacctatacctacaaaacgacgacgcgctcaaaaaccacacgcaaatcaaaaacccgcgcctacgccc

SEQ ID NO: 16703 - DNA, 641 bp, Artificial Sequence
  chemically treated genomic DNA (Homo sapiens) CpG-island No: 16703
aaagttatgtttaacgatattttttatttttttattttgaggaatttcgtgttttagttggagtttttttttatttattataaaatttacgttttcgtttttcggggcgtttcgagtttggacgcgtttttggtttcgtcgcggacgttttataacgatagtcgttattttaggaacgtttacgttaagaataatatgtggttcgatttcggtttcgattttaacgcgtagtgcgaggagggttacgtgcgcgcgcgtatcgtcgaggtggaacggcgttttcggttggtgtttatcgtcgagtatttggacgaatttttggtgttgttgcggcgtcggttgcgttgggcgttggataatatggtggtttttaggtttaattttcgtagcgcgcgtttcgtggttcgtttgtcgttcgagattcgggagcgcgcgcggagttggtgcgcgttggattggcgtttgtacgagtattttaatcgtattttttgggcgtagttgcgcgtcgagttggggtcgcggcggttgcgcggggaggtggagcggttgcgcgttcggaggcgcgaattcgcgagtttgtgtttgtaggacggcggcgcgtttaagaattatacgtagattagagattcgcgtttgcgttt

SEQ ID NO: 16704 - DNA, 641 bp, Artificial Sequence
  chemically treated genomic DNA (Homo sapiens) CpG-island No: 16704
aaacgcaaacgcgaatctctaatctacgtataattcttaaacgcgccgccgtcctacaaacacaaactcgcgaattcgcgcctccgaacgcgcaaccgctccacctccccgcgcaaccgccgcgaccccaactcgacgcgcaactacgcccaaaaaatacgattaaaatactcgtacaaacgccaatccaacgcgcaccaactccgcgcgcgctcccgaatctcgaacgacaaacgaaccacgaaacgcgcgctacgaaaattaaacctaaaaaccaccatattatccaacgcccaacgcaaccgacgccgcaacaacaccaaaaattcgtccaaatactcgacgataaacaccaaccgaaaacgccgttccacctcgacgatacgcgcgcgcacgtaaccctcctcgcactacgcgttaaaatcgaaaccgaaatcgaaccacatattattcttaacgtaaacgttcctaaaataacgactatcgttataaaacgtccgcgacgaaaccaaaaacgcgtccaaactcgaaacgccccgaaaaacgaaaacgtaaattttataataaataaaaaaaaactccaactaaaacacgaaattcctcaaaataaaaaaataaaaaatatcgttaaacataacttt

SEQ ID NO: 16705 - DNA, 636 bp, Artificial Sequence
  chemically treated genomic DNA (Homo sapiens) CpG-island No: 16705
tgatgggtaacgaaaggggtgggtttaaggtaattgtttcgttaagaggtgatgagggtattgtgggtaacgaggagtagcgtagggttcgtagaatagattagaattttttcgaggtattttgggaagggttagtattttcggttttaggtcggttatttcgaattagaggtggggtgggggttcggttgtcgcggtgtttggtgggacgcgaggtttgattttgttgtttagtcgtttttgtcgcgtaatttatttttatttgtttttcgattttggaacgttagttaatgagagtattaagttgatacgttattaaggtcgatttcgtatacgttggagttaattaaaatgttgtaagggttaaagtcgattaattattatagtaatttcgtcgcggggcggaattaaaagagggttttttttaggagagaggcggggcgatgttttagcgggcgtggtaaaatgtttagtatagattaatggcgggttagtatcggaattcgcggcgacgcgagttaataggcgtaggcgttgcgagttaatgggaagggtgggaggggcgtcgtggttattttgcgagtgagaattaatataaaaggatattttagggaaagtgggcgggattttatgtat

SEQ ID NO: 16706 - DNA, 636 bp, Artificial Sequence
  chemically treated genomic DNA (Homo sapiens) CpG-island No: 16706
atacataaaatcccgcccactttccctaaaatatccttttatattaattctcactcgcaaaataaccacgacgcccctcccacccttcccattaactcgcaacgcctacgcctattaactcgcgtcgccgcgaattccgatactaacccgccattaatctatactaaacattttaccacgcccgctaaaacatcgccccgcctctctcctaaaaaaaaccctcttttaattccgccccgcgacgaaattactataataattaatcgactttaacccttacaacattttaattaactccaacgtatacgaaatcgaccttaataacgtatcaacttaatactctcattaactaacgttccaaaatcgaaaaacaaataaaaataaattacgcgacaaaaacgactaaacaacaaaatcaaacctcgcgtcccaccaaacaccgcgacaaccgaacccccaccccacctctaattcgaaataaccgacctaaaaccgaaaatactaacccttcccaaaatacctcgaaaaaattctaatctattctacgaaccctacgctactcctcgttacccacaataccctcatcacctcttaacgaaacaattaccttaaacccacccctttcgttacccatca

SEQ ID NO: 16707 - DNA, 636 bp, Artificial Sequence
  chemically treated genomic DNA (Homo sapiens) CpG-island No: 16707
gtgtataaagtttcgtttattttttttgaaatgtttttttgtattggtttttattcgtagggtagttacggcgttttttttattttttttattggttcgtagcgtttgcgtttattggttcgcgtcgtcgcgggtttcggtgttaattcgttattggtttgtgttgagtattttgttacgttcgttgaggtatcgtttcgttttttttttggaggaggtttttttttgatttcgtttcgcggcgaggttgttgtgataattggtcggttttgatttttgtagtattttgattggttttagcgtgtacggggtcgattttggtggcgtattagtttggtatttttattggttaacgttttagggtcgaaggataggtaaaggtgggttgcgcggtagaggcggttaggtagtaaggttaggtttcgcgttttattaggtatcgcggtagtcgggtttttattttatttttggttcggagtagtcgatttaaaatcggaagtgttggttttttttagagtgtttcgggagaattttaatttgttttgcgaattttgcgttgtttttcgttatttataatgtttttattattttttagcgaaatagttgttttagatttatttttttcgttatttatta

SEQ ID NO: 16708 - DNA, 636 bp, Artificial Sequence
  chemically treated genomic DNA (Homo sapiens) CpG-island No: 16708
taataaataacgaaaaaaataaatctaaaacaactatttcgctaaaaaataataaaaacattataaataacgaaaaacaacgcaaaattcgcaaaacaaattaaaattctcccgaaacactctaaaaaaaaccaacacttccgattttaaatcgactactccgaaccaaaaataaaataaaaacccgactaccgcgatacctaataaaacgcgaaacctaaccttactacctaaccgcctctaccgcgcaacccacctttacctatccttcgaccctaaaacgttaaccaataaaaataccaaactaatacgccaccaaaatcgaccccgtacacgctaaaaccaatcaaaatactacaaaaatcaaaaccgaccaattatcacaacaacctcgccgcgaaacgaaatcaaaaaaaaacctcctccaaaaaaaaaacgaaacgatacctcaacgaacgtaacaaaatactcaacacaaaccaataacgaattaacaccgaaacccgcgacgacgcgaaccaataaacgcaaacgctacgaaccaataaaaaaaataaaaaaaacgccgtaactaccctacgaataaaaaccaatacaaaaaaacatttcaaaaaaaataaacgaaactttatacac

SEQ ID NO: 16709 - DNA, 612 bp, Artificial Sequence
  chemically treated genomic DNA (Homo sapiens) CpG-island No: 16709
cgttcgtttttcggtttttgatgaaacggcgatttattattttttttttagattttggttcgtagtcggattatttcgggcgcgttgtcgattacgtggcgaagcggtgttttttagcgtcgtggttgcgcgtttattggtcggcggttggagtttcgggcgcgtttattggttgcggggggcgtttacgtggtagggggtttgggatggatttcggggtttcgagagttggtaggaaagttaaagggggtagcgcggtcgcggggagttcgagtttcgggtgattgttggagggaggaggtgatcgcgtagttttcgtgtacggacggatttcgtcgttcgcggggggcgcgaattcgagttcgggtttagtttttgtcgttacggtagttgtttttgtttttttagggcggatgttgtcgcgggttggcgcgtttgttttcgggatttatgagttgaattcggtacgtagttttttaagtttcgagttcgagggaagggttggggataataaggcgagggcgtgtagcggggatttttttgggtttttgttatttatatttttatcgtgcgatttgtattggtatatcggggttggaatattttaggtag

SEQ ID NO: 16710 - DNA, 612 bp, Artificial Sequence
  chemically treated genomic DNA (Homo sapiens) CpG-island No: 16710
ctacctaaaatattccaaccccgatataccaatacaaatcgcacgataaaaatataaataacaaaaacccaaaaaaatccccgctacacgccctcgccttattatccccaacccttccctcgaactcgaaacttaaaaaactacgtaccgaattcaactcataaatcccgaaaacaaacgcgccaacccgcgacaacatccgccctaaaaaaacaaaaacaactaccgtaacgacaaaaactaaacccgaactcgaattcgcgccccccgcgaacgacgaaatccgtccgtacacgaaaactacgcgatcacctcctccctccaacaatcacccgaaactcgaactccccgcgaccgcgctaccccctttaactttcctaccaactctcgaaaccccgaaatccatcccaaaccccctaccacgtaaacgccccccgcaaccaataaacgcgcccgaaactccaaccgccgaccaataaacgcgcaaccacgacgctaaaaaacaccgcttcgccacgtaatcgacaacgcgcccgaaataatccgactacgaaccaaaatctaaaaaaaaaataataaatcgccgtttcatcaaaaaccgaaaaacgaacg

SEQ ID NO: 16711 - DNA, 612 bp, Artificial Sequence
  chemically treated genomic DNA (Homo sapiens) CpG-island No: 16711
ttatttagagtgttttagtttcggtgtgttagtgtaagtcgtacggtgaaaatgtaggtgataggaatttaaagaggttttcgttgtacgttttcgttttgttgtttttagtttttttttcggattcgagatttggggagttacgtatcgggtttagtttataagtttcgagggtagacgcgttagttcgcggtagtattcgttttgggggaatagggatagttgtcgtgacggtaggagttgggttcgggttcgggttcgcgtttttcgcgggcggcgaagttcgttcgtgtacgagagttgcgcggttattttttttttttagtagttattcgggattcgagtttttcgcggtcgcgttgttttttttaatttttttgttagttttcgggatttcggggtttattttaggttttttgttacgtgaacgtttttcgtagttaatgggcgcgttcgggattttagtcgtcgattaatgggcgcgtagttacggcgttggggagtatcgtttcgttacgtgatcggtagcgcgttcggagtgattcggttgcgggttagggtttgggaagggggtggtgggtcgtcgttttattagaagtcggaggacgggcg

SEQ ID NO: 16712 - DNA, 612 bp, Artificial Sequence
  chemically treated genomic DNA (Homo sapiens) CpG-island No: 16712
cgcccgtcctccgacttctaataaaacgacgacccaccacccccttcccaaaccctaacccgcaaccgaatcactccgaacgcgctaccgatcacgtaacgaaacgatactccccaacgccgtaactacgcgcccattaatcgacgactaaaatcccgaacgcgcccattaactacgaaaaacgttcacgtaacaaaaaacctaaaataaaccccgaaatcccgaaaactaacaaaaaaattaaaaaaaacaacgcgaccgcgaaaaactcgaatcccgaataactactaaaaaaaaaaaataaccgcgcaactctcgtacacgaacgaacttcgccgcccgcgaaaaacgcgaacccgaacccgaacccaactcctaccgtcacgacaactatccctattcccccaaaacgaatactaccgcgaactaacgcgtctaccctcgaaacttataaactaaacccgatacgtaactccccaaatctcgaatccgaaaaaaaaactaaaaacaacaaaacgaaaacgtacaacgaaaacctctttaaattcctatcacctacattttcaccgtacgacttacactaacacaccgaaactaaaacactctaaataa

SEQ ID NO: 16713 - DNA, 1478 bp, Artificial Sequence
  chemically treated genomic DNA (Homo sapiens) CpG-island No: 16713
gcgttttcgtggttttattatttaagttttttattttattggggagaagcgttttttttcggtatttatattaaataataaattcgatacggtttttgaggaaagcgggagtcgtcgtttgggagagacgtaggggtttaaggcgtaggtaaattaatagtttttcgcgttgtttcgcgcggtcgttcgcgtcgtttgatatattttttttggtcgggttttttttcggcgtcgttgatcgttttcggttaggcgttttgtttcggggttcgggttcgttttttttttcgggttggcgggttttacgcgcgttatcgcgtttaatacgtatttttaacgcgtttcgggtcgggtttttggggattgcgtggtcgggttcgaggggtacgaaacgtttttcgtcgttttcgtcgttttcgtcgtcgtttattatttcgacgattattttttcgtttttttttttttcgtcgttatttttttttttcgcgttttttcggggttttttttttatacgttcgagtttttttcgtcgtttgttttcgtttttttcgttttcgttttttttttttagaagtagtagtatcggcgacgaggcggcggcggcggtttcggtggttcgaggggggtcggtttcggcgttgcgcggcggcggcggtagcggcggtttttagtttttcggggcgggcgtcggggtcgggttcgggatagggggcgggagttcgggtagggcggtttttttggcgggcgcgggcgtcggttcggtaggttgtagcgcggcgttttttcggcggttgtttaggttggagcgtttggttagacgtcgcgtttgtatgtttgagcgcggggttgcgggtcgcggcgcggggtcggagagtttgttatttttttttttttttttgttttcgtcggtggtcgtagggtcggggattcgcggtcgtaaggggttgtaggagtcgtcggttaggattcgcggttgttattggttgtagaggcgcgggcgtcgttttcgttggatcggtcggcggggacgtcggcggtcggcggttacggcggggcggcgcggcggtcgcgggcgggggtgggtgtgagcgagcggcgcgttgtcgttttcgtcgtcgtcgtcgtcgttcgggagtcgcgggtcgcgttgcgttttatgcggtcggcggtcgagttcgcgcgcgtttttttcggtcggttgcgttcgcgcgtttcgggtttatcgttgtcgtgtttcggcgcgagttgtttgtgttgtatgttttttattatcgttttttttttcgcgagttattttttataatttttcggttttttcgtttagataaaattcggattggatttttttttttttttatttatagttttcgaaagtttggcgtttcgaagtagttggttttgatattagggtaaacgtttaatcgtagtttattttttttttcggagggaggggagtagatttcgttggaagtaaggtt

SEQ ID NO: 16714 - DNA, 1478 bp, Artificial Sequence
  chemically treated genomic DNA (Homo sapiens) CpG-island No: 16714
aaccttacttccaacgaaatctactcccctccctccgaaaaaaaaaataaactacgattaaacgtttaccctaatatcaaaaccaactacttcgaaacgccaaactttcgaaaactataaataaaaaaaaaaaaaaatccaatccgaattttatctaaacgaaaaaaccgaaaaattataaaaaataactcgcgaaaaaaaaaacgataataaaaaacatacaacacaaacaactcgcgccgaaacacgacaacgataaacccgaaacgcgcgaacgcaaccgaccgaaaaaaacgcgcgcgaactcgaccgccgaccgcataaaacgcaacgcgacccgcgactcccgaacgacgacgacgacgacgaaaacgacaacgcgccgctcgctcacacccacccccgcccgcgaccgccgcgccgccccgccgtaaccgccgaccgccgacgtccccgccgaccgatccaacgaaaacgacgcccgcgcctctacaaccaataacaaccgcgaatcctaaccgacgactcctacaaccccttacgaccgcgaatccccgaccctacgaccaccgacgaaaacaaaaaaaaaaaaaaaaataacaaactctccgaccccgcgccgcgacccgcaaccccgcgctcaaacatacaaacgcgacgtctaaccaaacgctccaacctaaacaaccgccgaaaaaacgccgcgctacaacctaccgaaccgacgcccgcgcccgccaaaaaaaccgccctacccgaactcccgccccctatcccgaacccgaccccgacgcccgccccgaaaaactaaaaaccgccgctaccgccgccgccgcgcaacgccgaaaccgacccccctcgaaccaccgaaaccgccgccgccgcctcgtcgccgatactactacttctaaaaaaaaaaaacgaaaacgaaaaaaacgaaaacaaacgacgaaaaaaactcgaacgtataaaaaaaaaaccccgaaaaaacgcgaaaaaaaaaaataacgacgaaaaaaaaaaaaacgaaaaaataatcgtcgaaataataaacgacgacgaaaacgacgaaaacgacgaaaaacgtttcgtacccctcgaacccgaccacgcaatccccaaaaacccgacccgaaacgcgttaaaaatacgtattaaacgcgataacgcgcgtaaaacccgccaacccgaaaaaaaaaacgaacccgaaccccgaaacaaaacgcctaaccgaaaacgatcaacgacgccgaaaaaaaacccgaccaaaaaaaatatatcaaacgacgcgaacgaccgcgcgaaacaacgcgaaaaactattaatttacctacgccttaaacccctacgtctctcccaaacgacgactcccgctttcctcaaaaaccgtatcgaatttattatttaatataaataccgaaaaaaaacgcttctccccaataaaataaaaaacttaaataataaaaccacgaaaacgc

SEQ ID NO: 16715 - DNA, 1478 bp, Artificial Sequence
  chemically treated genomic DNA (Homo sapiens) CpG-island No: 16715
aattttatttttagcgaagtttattttttttttttcggagggaagaatgggttgcggttaagcgtttgttttggtgttagggttaattgtttcgaagcgttagattttcggagattgtgggtaagagaaaaaaaaaatttagttcgggttttgtttgagcggggggatcggagggttgtgaggaatggttcgcgaagaggggggcggtggtggaaaatatataatataaatagttcgcgtcgaggtacggtagcggtaggttcggagcgcgcgggcgtagtcggtcgggagaggcgcgcgcgggttcggtcgtcggtcgtatggagcgtagcgcggttcgcggttttcgggcggcggcggcggcggcggaggcggtagcgcgtcgttcgtttatatttattttcgttcgcggtcgtcgcgtcgtttcgtcgtagtcgtcggtcgtcggcgttttcgtcggtcggtttagcgaaggcggcgttcgcgtttttgtagttagtggtagtcgcgggttttggtcggcggtttttgtagttttttgcggtcgcgagttttcggttttgcggttatcggcggaggtagaggaggaagaggaggtgataaatttttcggtttcgcgtcgcggttcgtaatttcgcgtttaggtatgtaggcgcggcgtttagttaagcgttttagtttgggtagtcgtcgggggggcgtcgcgttgtagtttgtcgggtcggcgttcgcgttcgttaaggaagtcgttttattcgggttttcgttttttgtttcgggttcggtttcggcgttcgtttcggagagttggaggtcgtcgttgtcgtcgtcgtcgcgtagcgtcgggatcggtttttttcgggttatcggggtcgtcgtcgtcgtttcgtcgtcggtgttgttgtttttaggggaggaagacgaggacgaggagggcgggagtaggcggcggagggggttcgggcgtgtggaggagaagtttcgagggggcgcggaggaggaggatgacgacgaggaagaggaggacgaggaggtggtcgtcgaggtggtggacggcgacgaagacgacgaggacggcgaggagcgtttcgtgtttttcggattcggttacgtagtttttaggggttcggttcggggcgcgttgaaggtgcgtgttgggcgcggtggcgcgcgtgggattcgttagttcggggagggggacgggttcgggtttcggggtaaggcgtttggtcgaggacggttagcggcgtcggggagagattcggttaggaggggtgtgttaggcggcgcgggcggtcgcgcggggtagcgcgaggaattgttgatttgtttgcgttttgggtttttgcgttttttttaggcggcggttttcgttttttttaaaggtcgtgtcgggtttgttgtttggtgtgggtgtcgggaaagggcgtttttttttagtgaggtggggaatttgggtgatgggattacggaggcgt

SEQ ID NO: 16716 - DNA, 1478 bp, Artificial Sequence
  chemically treated genomic DNA (Homo sapiens) CpG-island No: 16716
acgcctccgtaatcccatcacccaaattccccacctcactaaaaaaaaacgccctttcccgacacccacaccaaacaacaaacccgacacgacctttaaaaaaaacgaaaaccgccgcctaaaaaaaacgcaaaaacccaaaacgcaaacaaatcaacaattcctcgcgctaccccgcgcgaccgcccgcgccgcctaacacacccctcctaaccgaatctctccccgacgccgctaaccgtcctcgaccaaacgccttaccccgaaacccgaacccgtccccctccccgaactaacgaatcccacgcgcgccaccgcgcccaacacgcaccttcaacgcgccccgaaccgaacccctaaaaactacgtaaccgaatccgaaaaacacgaaacgctcctcgccgtcctcgtcgtcttcgtcgccgtccaccacctcgacgaccacctcctcgtcctcctcttcctcgtcgtcatcctcctcctccgcgccccctcgaaacttctcctccacacgcccgaaccccctccgccgcctactcccgccctcctcgtcctcgtcttcctcccctaaaaacaacaacaccgacgacgaaacgacgacgacgaccccgataacccgaaaaaaaccgatcccgacgctacgcgacgacgacgacaacgacgacctccaactctccgaaacgaacgccgaaaccgaacccgaaacaaaaaacgaaaacccgaataaaacgacttccttaacgaacgcgaacgccgacccgacaaactacaacgcgacgcccccccgacgactacccaaactaaaacgcttaactaaacgccgcgcctacatacctaaacgcgaaattacgaaccgcgacgcgaaaccgaaaaatttatcacctcctcttcctcctctacctccgccgataaccgcaaaaccgaaaactcgcgaccgcaaaaaactacaaaaaccgccgaccaaaacccgcgactaccactaactacaaaaacgcgaacgccgccttcgctaaaccgaccgacgaaaacgccgacgaccgacgactacgacgaaacgacgcgacgaccgcgaacgaaaataaatataaacgaacgacgcgctaccgcctccgccgccgccgccgccgcccgaaaaccgcgaaccgcgctacgctccatacgaccgacgaccgaacccgcgcgcgcctctcccgaccgactacgcccgcgcgctccgaacctaccgctaccgtacctcgacgcgaactatttatattatatattttccaccaccgcccccctcttcgcgaaccattcctcacaaccctccgatccccccgctcaaacaaaacccgaactaaattttttttttctcttacccacaatctccgaaaatctaacgcttcgaaacaattaaccctaacaccaaaacaaacgcttaaccgcaacccattcttccctccgaaaaaaaaaaaataaacttcgctaaaaataaaatt

SEQ ID NO: 16717 - DNA, 636 bp, Artificial Sequence
  chemically treated genomic DNA (Homo sapiens) CpG-island No: 16717
ttttcgcggtcgtcgggttcggagtttaaagttggggggcgggcggggaggcgtttttcggacgcgcgatttttaggtttcggaatattcgtcgtttatacggtatcgttcggtttagacgtcgtaggtttcggaggcgggcgaggttcggggcgttcgtcgatttatttttttaagaagtttaggaatagtttttggtatttttcggttatttcgtcgcggatttttaggtgttggttgtcggcgttcggtttcgttgtcgtcgcgaggtttatatttgtttagtgtcgaggattcgtttgcgttacgttcgatcgttataagtcgtttttttttagacgttgtagttttgcgcgcgtcgtcgtcgttttcgtttcgttttttttttcgatttgtacggtcggaattaatcgtgatataggagttggagatttcgcgttaaatttgattaatgaacggcgtttttttaagagttttagtttacggaaagggatttcgcgttaaatgtaaagtttttttggagaaagtttatttgtttttgcgtttgcgtagtgtagtcgtggttcgcgggtatttttggttgttggaataagttcgaatttgagggttttgttcgagtggttttttaaatgtttt

SEQ ID NO: 16718 - DNA, 636 bp, Artificial Sequence
  chemically treated genomic DNA (Homo sapiens) CpG-island No: 16718
aaaacatttaaaaaaccactcgaacaaaaccctcaaattcgaacttattccaacaaccaaaaatacccgcgaaccacgactacactacgcaaacgcaaaaacaaataaactttctccaaaaaaactttacatttaacgcgaaatccctttccgtaaactaaaactcttaaaaaaacgccgttcattaatcaaatttaacgcgaaatctccaactcctatatcacgattaattccgaccgtacaaatcgaaaaaaaaaacgaaacgaaaacgacgacgacgcgcgcaaaactacaacgtctaaaaaaaaacgacttataacgatcgaacgtaacgcaaacgaatcctcgacactaaacaaatataaacctcgcgacgacaacgaaaccgaacgccgacaaccaacacctaaaaatccgcgacgaaataaccgaaaaataccaaaaactattcctaaacttcttaaaaaaataaatcgacgaacgccccgaacctcgcccgcctccgaaacctacgacgtctaaaccgaacgataccgtataaacgacgaatattccgaaacctaaaaatcgcgcgtccgaaaaacgcctccccgcccgccccccaactttaaactccgaacccgacgaccgcgaaaa

SEQ ID NO: 16719 - DNA, 636 bp, Artificial Sequence
  chemically treated genomic DNA (Homo sapiens) CpG-island No: 16719
agaatatttgaaaaattattcggataaaatttttagattcgaatttgttttagtagttaaaaatattcgcgggttacggttatattgcgtaggcgtaaaggtagatgggttttttttagaagggttttgtatttggcgcgaaattttttttcgtgggttggggtttttggagaggcgtcgtttattggttaggtttggcgcgaaatttttagtttttgtgttacgattggtttcggtcgtgtaggtcggaagagggggcggggcggaagcggcggcggcgcgcgtaaagttgtagcgtttggaaaaaagcgatttgtggcggtcgagcgtggcgtaggcgaattttcggtattaagtaaatatggatttcgcggcggtagcggagtcgggcgtcggtagttagtatttggaggttcgcgacgaggtggtcgagaagtgttagaaattgtttttggattttttggaggagtaagtcggcgagcgtttcgggtttcgttcgttttcggagtttgcggcgtttgggtcgggcggtgtcgtgtgggcggcgggtgtttcggaatttgggggtcgcgcgttcgggaagcgttttttcgttcgttttttaattttaggtttcgagttcggcggtcgcgagga

SEQ ID NO: 16720 - DNA, 636 bp, Artificial Sequence
  chemically treated genomic DNA (Homo sapiens) CpG-island No: 16720
tcctcgcgaccgccgaactcgaaacctaaaattaaaaaacgaacgaaaaaacgcttcccgaacgcgcgacccccaaattccgaaacacccgccgcccacacgacaccgcccgacccaaacgccgcaaactccgaaaacgaacgaaacccgaaacgctcgccgacttactcctccaaaaaatccaaaaacaatttctaacacttctcgaccacctcgtcgcgaacctccaaatactaactaccgacgcccgactccgctaccgccgcgaaatccatatttacttaataccgaaaattcgcctacgccacgctcgaccgccacaaatcgcttttttccaaacgctacaactttacgcgcgccgccgccgcttccgccccgccccctcttccgacctacacgaccgaaaccaatcgtaacacaaaaactaaaaatttcgcgccaaacctaaccaataaacgacgcctctccaaaaaccccaacccacgaaaaaaaatttcgcgccaaatacaaaacccttctaaaaaaaacccatctacctttacgcctacgcaatataaccgtaacccgcgaatatttttaactactaaaacaaattcgaatctaaaaattttatccgaataatttttcaaatattct

SEQ ID NO: 16721 - DNA, 549 bp, Artificial Sequence
  chemically treated genomic DNA (Homo sapiens) CpG-island No: 16721
gggggggagacgagtgggagaggtagggggacgggcggggaagcgggtcggacgagagtgaggtggttttaggggcgggttgtgtgagacggtgcgtgtggagaggcgggttcggagcggaggcgttgcgacgtcgggtacggcgcgaagcggagaagggcgagagatttgggcgagtagggtaatcgcgttacgcgcgagtcgtgtggattcgaggggcgcggagttcgcgtaggcggggtggttcgtgagcgtcgggagcgcggagagcgtgagtatacggatcggtgggatcgtagagatgtgtggcgcggagaggggcggtcgagttgaaagtggagacggcggggacgggagagcggggtagtttcggaattgtgagaggcgagacgtcgcgaacgttcggagcgcgggaatttcggagtcgcgagattgtagtagcggcggtcgcgggacgtcggagagggagggtcgcggatgggtgaagtcggaagggtggaaagcggagtgttcgtgtgaggagacgttgagattgggggaggtcgagtt

SEQ ID NO: 16722 - DNA, 549 bp, Artificial Sequence
  chemically treated genomic DNA (Homo sapiens) CpG-island No: 16722
aactcgacctcccccaatctcaacgtctcctcacacgaacactccgctttccacccttccgacttcacccatccgcgaccctccctctccgacgtcccgcgaccgccgctactacaatctcgcgactccgaaattcccgcgctccgaacgttcgcgacgtctcgcctctcacaattccgaaactaccccgctctcccgtccccgccgtctccactttcaactcgaccgcccctctccgcgccacacatctctacgatcccaccgatccgtatactcacgctctccgcgctcccgacgctcacgaaccaccccgcctacgcgaactccgcgcccctcgaatccacacgactcgcgcgtaacgcgattaccctactcgcccaaatctctcgcccttctccgcttcgcgccgtacccgacgtcgcaacgcctccgctccgaacccgcctctccacacgcaccgtctcacacaacccgcccctaaaaccacctcactctcgtccgacccgcttccccgcccgtccccctacctctcccactcgtctccccccc

SEQ ID NO: 16723 - DNA, 549 bp, Artificial Sequence
  chemically treated genomic DNA (Homo sapiens) CpG-island No: 16723
aattcgattttttttagttttagcgtttttttatacgggtatttcgttttttattttttcggttttatttattcgcggtttttttttttcgacgtttcgcgatcgtcgttattatagtttcgcgatttcggaattttcgcgtttcgggcgttcgcgacgtttcgttttttatagtttcgaggttgtttcgttttttcgttttcgtcgtttttatttttaattcggtcgttttttttcgcgttatatatttttgcggttttatcgattcgtgtatttacgtttttcgcgttttcggcgtttacggattatttcgtttgcgcggatttcgcgtttttcgggtttatacggttcgcgcgtaacgcggttgttttgttcgtttagatttttcgttttttttcgtttcgcgtcgtgttcggcgtcgtagcgttttcgtttcgaattcgtttttttatacgtatcgttttatataattcgtttttgggattattttattttcgttcgattcgttttttcgttcgtttttttattttttttattcgtttttttttt

SEQ ID NO: 16724 - DNA, 549 bp, Artificial Sequence
  chemically treated genomic DNA (Homo sapiens) CpG-island No: 16724
aaaaaaaaaacgaataaaaaaaataaaaaaacgaacgaaaaaacgaatcgaacgaaaataaaataatcccaaaaacgaattatataaaacgatacgtataaaaaaacgaattcgaaacgaaaacgctacgacgccgaacacgacgcgaaacgaaaaaaaacgaaaaatctaaacgaacaaaacaaccgcgttacgcgcgaaccgtataaacccgaaaaacgcgaaatccgcgcaaacgaaataatccgtaaacgccgaaaacgcgaaaaacgtaaatacacgaatcgataaaaccgcaaaaatatataacgcgaaaaaaaacgaccgaattaaaaataaaaacgacgaaaacgaaaaaacgaaacaacctcgaaactataaaaaacgaaacgtcgcgaacgcccgaaacgcgaaaattccgaaatcgcgaaactataataacgacgatcgcgaaacgtcgaaaaaaaaaaaccgcgaataaataaaaccgaaaaaataaaaaacgaaatacccgtataaaaaaacgctaaaactaaaaaaaatcgaatt

SEQ ID NO: 16725 - DNA, 774 bp, Artificial Sequence
  chemically treated genomic DNA (Homo sapiens) CpG-island No: 16725
atattaggcgattaatttgtcgtaaggtttttttgattttgatggttcgcgttatttataggagcggttggcgtattacgttgtatagggggtaaattaatacgcgtttatgatcggcgtgtaggttttgcgcgaggcgattgtttagaaaacggaacgtttgtatggttattaattagatgtcgatagcgatattatcgtaacggtaggggcgacggaagcgttatacgcggcgattatcgtattggtgcgtaatggcgatgaagtgatttgttttgattttagttatgatagttacgttttcgttatcgcgttttttgggggaatagtgaagcgtatggtattgtaattatcgtattttcgcgttgattggtaggaatttgtcgtattattaagcgagcgtattagattggtgatttttaatatttcgtataattttagtgtaattgtttggtagtaggttgatttcgtcgttttgtggtaggcgatcgtcgggtacgagatttttgttattagcgatgaagtttacgagtatattaattttttataatagggttatgttagtgtgttggcgtattcgtagttgcgtgagcgggtagtggcggtttttttatttggtaagatttattatatgatcggttggaaagtgggttattgtgttgcgttagcgtttattagcgtcgaaattcgtaaggtatattagtatttgattttttcggtgaaaaatttcggtataagatggcgtttggttgatatgttacgtgtagaatttga

SEQ ID NO: 16726 - DNA, 774 bp, Artificial Sequence
  chemically treated genomic DNA (Homo sapiens) CpG-island No: 16726
tcaaattctacacgtaacatatcaaccaaacgccatcttataccgaaatttttcaccgaaaaaatcaaatactaatataccttacgaatttcgacgctaataaacgctaacgcaacacaataacccactttccaaccgatcatataataaatcttaccaaataaaaaaaccgccactacccgctcacgcaactacgaatacgccaacacactaacataaccctattataaaaaattaatatactcgtaaacttcatcgctaataacaaaaatctcgtacccgacgatcgcctaccacaaaacgacgaaatcaacctactaccaaacaattacactaaaattatacgaaatattaaaaatcaccaatctaatacgctcgcttaataatacgacaaattcctaccaatcaacgcgaaaatacgataattacaataccatacgcttcactattcccccaaaaaacgcgataacgaaaacgtaactatcataactaaaatcaaaacaaatcacttcatcgccattacgcaccaatacgataatcgccgcgtataacgcttccgtcgcccctaccgttacgataatatcgctatcgacatctaattaataaccatacaaacgttccgttttctaaacaatcgcctcgcgcaaaacctacacgccgatcataaacgcgtattaatttaccccctatacaacgtaatacgccaaccgctcctataaataacgcgaaccatcaaaatcaaaaaaaccttacgacaaattaatcgcctaatat

SEQ ID NO: 16727 - DNA, 774 bp, Artificial Sequence
  chemically treated genomic DNA (Homo sapiens) CpG-island No: 16727
ttaggttttgtacgtagtatattagttaagcgttattttgtgtcggggttttttatcgaaaaggttagatattgatgtattttgcgaatttcggcgttgatgggcgttggcgtaatataataatttattttttagtcggttatatgataggttttgttaaatgaagaaatcgttattgttcgtttacgtagttgcggatgcgttagtatattggtatggttttgttgtgaaaagttgatgtgttcgtagattttatcgttaatgataaaaatttcgtgttcggcgatcgtttgttataaagcggcgaaattagtttgttgttagatagttgtattggggttatgcggagtgttgaggattattagtttggtgcgttcgtttaataatgcggtaaatttttgttagttaacgcgaaaatgcggtggttgtagtgttatacgttttattatttttttagaaagcgcgatggcgggggcgtaattgttatagttgggattaaaataaattattttatcgttattgcgtattagtgcggtaatcgtcgcgtataacgttttcgtcgtttttgtcgttacggtgatatcgttatcggtatttggttgatagttatataaacgtttcgttttttgagtaatcgtttcgcgtaaggtttgtacgtcggttatgggcgcgtattggtttgttttttgtgtaacgtggtgcgttagtcgtttttgtaaatagcgcggattattaaaattaggaaagttttgcgataggttaatcgtttggtgt

SEQ ID NO: 16728 - DNA, 774 bp, Artificial Sequence
  chemically treated genomic DNA (Homo sapiens) CpG-island No: 16728
acaccaaacgattaacctatcgcaaaactttcctaattttaataatccgcgctatttacaaaaacgactaacgcaccacgttacacaaaaaacaaaccaatacgcgcccataaccgacgtacaaaccttacgcgaaacgattactcaaaaaacgaaacgtttatataactatcaaccaaataccgataacgatatcaccgtaacgacaaaaacgacgaaaacgttatacgcgacgattaccgcactaatacgcaataacgataaaataatttattttaatcccaactataacaattacgcccccgccatcgcgctttctaaaaaaataataaaacgtataacactacaaccaccgcattttcgcgttaactaacaaaaatttaccgcattattaaacgaacgcaccaaactaataatcctcaacactccgcataaccccaatacaactatctaacaacaaactaatttcgccgctttataacaaacgatcgccgaacacgaaatttttatcattaacgataaaatctacgaacacatcaacttttcacaacaaaaccataccaatatactaacgcatccgcaactacgtaaacgaacaataacgatttcttcatttaacaaaacctatcatataaccgactaaaaaataaattattatattacgccaacgcccatcaacgccgaaattcgcaaaatacatcaatatctaaccttttcgataaaaaaccccgacacaaaataacgcttaactaatatactacgtacaaaacctaa

SEQ ID NO: 16729 - DNA, 627 bp, Artificial Sequence
  chemically treated genomic DNA (Homo sapiens) CpG-island No: 16729
acgtgtcgcggcggtttggaaattgtaggcggttagtgtcgttttcgtttcgcggttttcgtggggcgtttcgagggtgcgttattgtggcgcggcggatttagggcgttcgggggatgcgggtttaagcgttgcgtcgtaggtaaagttcgttttcggttttggggaagtttgtgattagcggaatagaagggtattatttttttgtttcgaggcggttttgcgttcgcggtgttagaatttggggttattcgagcggcgtgggcgcgggcggtagtcggcgtcgcgagaagcgatttttagaaatcgcgggtttttagtttcggggtagcgcgttaagagcgtagagtgggaaagtgaattgatcgtttaagtagcgggtggttaattcgcgtgttatgttcgggttttcggggattttattttatttatttacggtttttttttcgatattttttacggtcgtcgttttatttgttcgggtatttgttcgggtttttttttgggcgttgcgtattttacggcgttttcggcgggtgtttcggaggtaggttgtgtgcgcgtgtaaagtggtttttcggaaggtttaataataataatatataaaattttaggtttttacggata

SEQ ID NO: 16730 - DNA, 627 bp, Artificial Sequence
  chemically treated genomic DNA (Homo sapiens) CpG-island No: 16730
tatccgtaaaaacctaaaattttatatattattattattaaaccttccgaaaaaccactttacacgcgcacacaacctacctccgaaacacccgccgaaaacgccgtaaaatacgcaacgcccaaaaaaaaacccgaacaaatacccgaacaaataaaacgacgaccgtaaaaaatatcgaaaaaaaaaccgtaaataaataaaataaaatccccgaaaacccgaacataacacgcgaattaaccacccgctacttaaacgatcaattcactttcccactctacgctcttaacgcgctaccccgaaactaaaaacccgcgatttctaaaaatcgcttctcgcgacgccgactaccgcccgcgcccacgccgctcgaataaccccaaattctaacaccgcgaacgcaaaaccgcctcgaaacaaaaaaataatacccttctattccgctaatcacaaacttccccaaaaccgaaaacgaactttacctacgacgcaacgcttaaacccgcatcccccgaacgccctaaatccgccgcgccacaataacgcaccctcgaaacgccccacgaaaaccgcgaaacgaaaacgacactaaccgcctacaatttccaaaccgccgcgacacgt

SEQ ID NO: 16731 - DNA, 627 bp, Artificial Sequence
  chemically treated genomic DNA (Homo sapiens) CpG-island No: 16731
tgttcgtaagaatttagagttttatgtattattattattaagtttttcgagggattattttgtacgcgtatataatttgttttcgggatattcgtcgggggcgtcgtggggtgcgtagcgtttaaggggagattcgggtaggtattcgagtaggtggagcggcgatcgtggagggtgtcgggagggaaatcgtaggtggatagagtgggattttcgagagttcggatatgatacgcgggttgattattcgttgtttaggcgattagtttatttttttattttgcgtttttggcgcgttgtttcggggttggagattcgcggtttttgagagtcgtttttcgcggcgtcggttgtcgttcgcgtttacgtcgttcggataattttaggttttggtatcgcgagcgtaaagtcgtttcggagtagggaaatggtgtttttttgtttcgttggttataagtttttttaaagtcgagaacgaattttgtttacgacgtaacgtttgggttcgtatttttcgggcgttttggattcgtcgcgttatagtagcgtattttcggggcgttttacggagatcgcgaggcgagagcggtattggtcgtttgtagtttttaaatcgtcgcggtacgt

SEQ ID NO: 16732 - DNA, 627 bp, Artificial Sequence
  chemically treated genomic DNA (Homo sapiens) CpG-island No: 16732
acgtaccgcgacgatttaaaaactacaaacgaccaataccgctctcgcctcgcgatctccgtaaaacgccccgaaaatacgctactataacgcgacgaatccaaaacgcccgaaaaatacgaacccaaacgttacgtcgtaaacaaaattcgttctcgactttaaaaaaacttataaccaacgaaacaaaaaaacaccatttccctactccgaaacgactttacgctcgcgataccaaaacctaaaattatccgaacgacgtaaacgcgaacgacaaccgacgccgcgaaaaacgactctcaaaaaccgcgaatctccaaccccgaaacaacgcgccaaaaacgcaaaataaaaaaataaactaatcgcctaaacaacgaataatcaacccgcgtatcatatccgaactctcgaaaatcccactctatccacctacgatttccctcccgacaccctccacgatcgccgctccacctactcgaatacctacccgaatctccccttaaacgctacgcaccccacgacgcccccgacgaatatcccgaaaacaaattatatacgcgtacaaaataatccctcgaaaaacttaataataataatacataaaactctaaattcttacgaaca

SEQ ID NO: 16733 - DNA, 785 bp, Artificial Sequence
  chemically treated genomic DNA (Homo sapiens) CpG-island No: 16733
tttagggcgatgtaatttttgtcgtcgtaggcgtattggtggtattcgcggaggaagcgttagttcgattttacgtcgtagttatatattttttggacggtgtgagaatttggttcggatttcgcggttagttcggtttttcgagtttcgtttcgtttcgattaatttggggggatttttggtttaaattgaaaatgaaatcgggtaaaggcgtttgggtttttttcggggtaagggtttcggggtttcgcggtttcggggcggatttcggattcggagattgtgggcgatttggttcgttcgtgggggatgagaggtcgtgatttgcgtttcgggtcggggttatttatcggtttcgttttggttgtagtagtcgcgtagggtttttaggtttattcggtgagtttgtgagtgggtttttatttttcgtgttttttcgttttaatatttcggatttttttgttttatttacggcgttcgcggttttattttttggttcgcggcgtcgttgtcgaatcgtacgaattgcgtgtcgtttacgtagtttattgcgatgaagcggggtttttcgcggtcgggtcgggatacggatgtgaagaaatattttatggagtgagagtttggggacgaggagtggttgagattcgttcgatttttttttcggcgcggtttttcgggttttgcgttttcgttaggcgggttcgttgtttttttttatagaggtcgtttttttttcgatttcgtatttattcgtttaggtttgggttagggttagagttttcgag

SEQ ID NO: 16734 - DNA, 785 bp, Artificial Sequence
  chemically treated genomic DNA (Homo sapiens) CpG-island No: 16734
ctcgaaaactctaaccctaacccaaacctaaacgaataaatacgaaatcgaaaaaaaaacgacctctataaaaaaaaacaacgaacccgcctaacgaaaacgcaaaacccgaaaaaccgcgccgaaaaaaaaatcgaacgaatctcaaccactcctcgtccccaaactctcactccataaaatatttcttcacatccgtatcccgacccgaccgcgaaaaaccccgcttcatcgcaataaactacgtaaacgacacgcaattcgtacgattcgacaacgacgccgcgaaccaaaaaataaaaccgcgaacgccgtaaataaaacaaaaaaatccgaaatattaaaacgaaaaaacacgaaaaataaaaacccactcacaaactcaccgaataaacctaaaaaccctacgcgactactacaaccaaaacgaaaccgataaataaccccgacccgaaacgcaaatcacgacctctcatcccccacgaacgaaccaaatcgcccacaatctccgaatccgaaatccgccccgaaaccgcgaaaccccgaaacccttaccccgaaaaaaacccaaacgcctttacccgatttcattttcaatttaaaccaaaaatccccccaaattaatcgaaacgaaacgaaactcgaaaaaccgaactaaccgcgaaatccgaaccaaattctcacaccgtccaaaaaatatataactacgacgtaaaatcgaactaacgcttcctccgcgaataccaccaatacgcctacgacgacaaaaattacatcgccctaaa

SEQ ID NO: 16735 - DNA, 785 bp, Artificial Sequence
  chemically treated genomic DNA (Homo sapiens) CpG-island No: 16735
ttcgggggttttggttttgatttagatttgggcgggtgagtgcggggtcgggagggaaacggtttttgtggggagaagtaacgggttcgtttggcgggggcgtaggattcgggaagtcgcgtcgggaggagggtcgggcgggttttagttatttttcgtttttaggtttttattttatgaggtatttttttatattcgtgtttcggttcggtcgcggggagtttcgttttatcgtagtgggttacgtggacgatacgtagttcgtgcggttcgatagcgacgtcgcgagttagaggatggagtcgcgggcgtcgtggatagagtaggagggttcggagtattgggacggggagatacggaaagtgaaggtttatttatagatttatcgagtggatttggggattttgcgcggttattataattagagcgaggtcggtgagtgatttcggttcggggcgtaggttacgattttttattttttacggacgggttaggtcgtttatagttttcgggttcgagattcgtttcgaagtcgcgggatttcgagatttttgtttcgggagaggtttaggcgtttttattcggttttatttttagtttaggttaaaaatttttttaggttggtcggggcggggcggggttcgggggatcgggttgatcgcggggttcgggttaggtttttatatcgtttagaggatgtatggttgcgacgtggggtcggattggcgtttttttcgcgggtattattagtacgtttacgacggtaaggattatatcgttttgaa

SEQ ID NO: 16736 - DNA, 785 bp, Artificial Sequence
  chemically treated genomic DNA (Homo sapiens) CpG-island No: 16736
ttcaaaacgatataatccttaccgtcgtaaacgtactaataatacccgcgaaaaaaacgccaatccgaccccacgtcgcaaccatacatcctctaaacgatataaaaacctaacccgaaccccgcgatcaacccgatcccccgaaccccgccccgccccgaccaacctaaaaaaatttttaacctaaactaaaaataaaaccgaataaaaacgcctaaacctctcccgaaacaaaaatctcgaaatcccgcgacttcgaaacgaatctcgaacccgaaaactataaacgacctaacccgtccgtaaaaaataaaaaatcgtaacctacgccccgaaccgaaatcactcaccgacctcgctctaattataataaccgcgcaaaatccccaaatccactcgataaatctataaataaaccttcactttccgtatctccccgtcccaatactccgaaccctcctactctatccacgacgcccgcgactccatcctctaactcgcgacgtcgctatcgaaccgcacgaactacgtatcgtccacgtaacccactacgataaaacgaaactccccgcgaccgaaccgaaacacgaatataaaaaaatacctcataaaataaaaacctaaaaacgaaaaataactaaaacccgcccgaccctcctcccgacgcgacttcccgaatcctacgcccccgccaaacgaacccgttacttctccccacaaaaaccgtttccctcccgaccccgcactcacccgcccaaatctaaatcaaaaccaaaacccccgaa

SEQ ID NO: 16737 - DNA, 571 bp, Artificial Sequence
  chemically treated genomic DNA (Homo sapiens) CpG-island No: 16737
tttatcgttatagttattcgtttgatggcgagacgtggtatatcgtgtcggtgacgtatgaggcgtggaagttgtcggacgattatatcggcgggcgcggtttttttatcggcgcgtttgtgggtttgtattgcgaggatattagcggcgacggttgttacgcggatttcgattattttattttacgaagttttcggtttttaatcgcgtttaggttcgggttagtttagcgcgcgcgagagcgcgagttcggtttgttgaagttgttcgcggaaattagtttagtttcgcgtcgtttacgcgggaggttagcgtcgataggtttagggcggcgatgacgcgggattcgtggttttatatcggtatcgttacgtagcgtacgttttgttcgtttttttcgttgtttagcgcgtagttttgttcgcgggtttgcgttagggcgtttattacggtttcgtagagacgcgtagcggtggcggcgcgttttacgtagttgtattgatagttttttagtgtattgtatttattttgttggacgatgaaatggaatagtttttaatatgttaaagtt

SEQ ID NO: 16738 - DNA, 571 bp, Artificial Sequence
  chemically treated genomic DNA (Homo sapiens) CpG-island No: 16738
aactttaacatattaaaaactattccatttcatcgtccaacaaaataaatacaatacactaaaaaactatcaatacaactacgtaaaacgcgccgccaccgctacgcgtctctacgaaaccgtaataaacgccctaacgcaaacccgcgaacaaaactacgcgctaaacaacgaaaaaaacgaacaaaacgtacgctacgtaacgataccgatataaaaccacgaatcccgcgtcatcgccgccctaaacctatcgacgctaacctcccgcgtaaacgacgcgaaactaaactaatttccgcgaacaacttcaacaaaccgaactcgcgctctcgcgcgcgctaaactaacccgaacctaaacgcgattaaaaaccgaaaacttcgtaaaataaaataatcgaaatccgcgtaacaaccgtcgccgctaatatcctcgcaatacaaacccacaaacgcgccgataaaaaaaccgcgcccgccgatataatcgtccgacaacttccacgcctcatacgtcaccgacacgatataccacgtctcgccatcaaacgaataactataacgataaa

SEQ ID NO: 16739 - DNA, 571 bp, Artificial Sequence
  chemically treated genomic DNA (Homo sapiens) CpG-island No: 16739
ggttttgatatattaggggttattttattttatcgtttaataaaatgggtgtagtatattggagggttattagtatagttacgtggagcgcgtcgttatcgttgcgcgtttttgcgaagtcgtaatgagcgttttggcgtagattcgcgagtaaggttacgcgttggatagcgaagagaacgagtagggcgtgcgttgcgtggcggtgtcggtgtggaattacgagtttcgcgttatcgtcgttttgagtttgtcgacgttgatttttcgcgtggacgacgcggagttgggttaattttcgcgagtagttttagtaggtcgggttcgcgttttcgcgcgcgttgggttagttcgggtttgagcgcggttaggagtcgggggtttcgtagggtgaagtagtcgaagttcgcgtagtagtcgtcgtcgttgatgttttcgtagtgtaggtttataaacgcgtcggtgaagaagtcgcgttcgtcgatgtagtcgttcgatagtttttacgttttatacgttatcggtacggtgtgttacgtttcgttattaaacgagtagttgtagcggtaga

SEQ ID NO: 16740 - DNA, 571 bp, Artificial Sequence
  chemically treated genomic DNA (Homo sapiens) CpG-island No: 16740
tctaccgctacaactactcgtttaataacgaaacgtaacacaccgtaccgataacgtataaaacgtaaaaactatcgaacgactacatcgacgaacgcgacttcttcaccgacgcgtttataaacctacactacgaaaacatcaacgacgacgactactacgcgaacttcgactacttcaccctacgaaacccccgactcctaaccgcgctcaaacccgaactaacccaacgcgcgcgaaaacgcgaacccgacctactaaaactactcgcgaaaattaacccaactccgcgtcgtccacgcgaaaaatcaacgtcgacaaactcaaaacgacgataacgcgaaactcgtaattccacaccgacaccgccacgcaacgcacgccctactcgttctcttcgctatccaacgcgtaaccttactcgcgaatctacgccaaaacgctcattacgacttcgcaaaaacgcgcaacgataacgacgcgctccacgtaactatactaataaccctccaatatactacacccattttattaaacgataaaataaaataacccctaatatatcaaaacc

SEQ ID NO: 16741 - DNA, 508 bp, Artificial Sequence
  chemically treated genomic DNA (Homo sapiens) CpG-island No: 16741
ttagcgcgagagcgttcgaaggggaggtcgaggaggagcgggaggaggagtttcgtcgtttttgtagggtttcgtttaaagttcgcgcgcgcgcgcggcgcggtttcgggaagatggaggtcgggcgcgttagagagtcggcgtttgagggcgtttgggttggggttaggtcggggggcggggcgaggttgtagtatcgggggcggggtcgcgttttggaggcggggtttcgggcgaggggcgtggtttgcgggtattcggtgggtggggaggtttgggttgggttgggttgggtttagcggtagcgcgcggttcgtagattttgttttatttcggttttcgagatcgaagtttcggaggtggtttcgcggatttggagtagtgagttattagtgtcggggagcgggaggcggtagcgtcggtgggcgtcgattttttttcgggtgattttgagaagggtttttttttttttggttttggtgttttttcggtgaagggttgttttttt

SEQ ID NO: 16742 - DNA, 508 bp, Artificial Sequence
  chemically treated genomic DNA (Homo sapiens) CpG-island No: 16742
aaaaaaacaacccttcaccgaaaaaacaccaaaaccaaaaaaaaaaaaacccttctcaaaatcacccgaaaaaaaatcgacgcccaccgacgctaccgcctcccgctccccgacactaataactcactactccaaatccgcgaaaccacctccgaaacttcgatctcgaaaaccgaaataaaacaaaatctacgaaccgcgcgctaccgctaaacccaacccaacccaacccaaacctccccacccaccgaatacccgcaaaccacgcccctcgcccgaaaccccgcctccaaaacgcgaccccgcccccgatactacaacctcgccccgccccccgacctaaccccaacccaaacgccctcaaacgccgactctctaacgcgcccgacctccatcttcccgaaaccgcgccgcgcgcgcgcgcgaactttaaacgaaaccctacaaaaacgacgaaactcctcctcccgctcctcctcgacctccccttcgaacgctctcgcgctaa

SEQ ID NO: 16743 - DNA, 508 bp, Artificial Sequence
  chemically treated genomic DNA (Homo sapiens) CpG-island No: 16743
aagggaataattttttatcgggagaatattaaggttagaaggggaagagttttttttaaggttattcgggaggaaatcggcgtttatcggcgttgtcgtttttcgtttttcggtattggtgatttattgttttaggttcgcggggttattttcgagatttcggtttcgaggatcgaggtgggatagggtttgcggatcgcgcgttgtcgttggatttagtttaatttaatttaggtttttttatttatcgggtgttcgtaggttacgtttttcgttcggagtttcgtttttagaacgcggtttcgttttcgatattgtagtttcgtttcgtttttcggtttaattttagtttaggcgtttttaggcgtcggttttttagcgcgttcgatttttattttttcggggtcgcgtcgcgcgcgcgcgcgggttttgggcgggattttgtagaggcggcggggttttttttttcgttttttttcggtttttttttcgggcgttttcgcgttaa

SEQ ID NO: 16744 - DNA, 508 bp, Artificial Sequence
  chemically treated genomic DNA (Homo sapiens) CpG-island No: 16744
ttaacgcgaaaacgcccgaaaaaaaaaccgaaaaaaaacgaaaaaaaaaaccccgccgcctctacaaaatcccgcccaaaacccgcgcgcgcgcgcgacgcgaccccgaaaaaataaaaatcgaacgcgctaaaaaaccgacgcctaaaaacgcctaaactaaaattaaaccgaaaaacgaaacgaaactacaatatcgaaaacgaaaccgcgttctaaaaacgaaactccgaacgaaaaacgtaacctacgaacacccgataaataaaaaaacctaaattaaattaaactaaatccaacgacaacgcgcgatccgcaaaccctatcccacctcgatcctcgaaaccgaaatctcgaaaataaccccgcgaacctaaaacaataaatcaccaataccgaaaaacgaaaaacgacaacgccgataaacgccgatttcctcccgaataaccttaaaaaaaactcttccccttctaaccttaatattctcccgataaaaaattattccctt

SEQ ID NO: 16745 - DNA, 1158 bp, Artificial Sequence
  chemically treated genomic DNA (Homo sapiens) CpG-island No: 16745
  misc_feature (1091)..(1091): n is either a, c, g or t
  misc_feature (1093)..(1093): n is either a, c, g or t
  misc_feature (1097)..(1098): n is either a, c, g or t
  misc_feature (1156)..(1156): n is either a, c, g or t
tgtcgtttcggggtcgtaggagttattcgggttttcgcgttttaaggtttttgtgtcggtggggcgcgggaagatcggtttcgggggttggggttgcggtttaaaggttaaaaatgcgggagaggcgtgggcgcgaggcgggataagtttcgtatagtcgtcgtttcgtaagggtaaaaaagtagaaaaagtcgtttggggttaaattttcgggtttgagaaattacgttttcgaggacgaattcgcggtgggaggatatatggggtataggggatattgttcgcggcgtttgttcggttcgtcgtgggtgcgagtcgtcgttttcgtttcggtagttagcgcggtttacgtggagttattgcgttggtcgagtcgtcgggtcgtttgggtttcgggagtgcgcgttcgagtttttcgtcgcggtcgtttacgttcgagcgtcgtcgtcgtcggtttcgcgtgtgtttcgttgaagggaaggggcgggtcgggggtgggggcggaggggttgtggttttattgtagcgggggtttttgtgtttttgtgcggaaatgatatacggagtttcgttacgttacgcgagagtaggtatcggatatatataaagagaggggaaaatatacggcgttcgtcgttcgtcgtttttagcgttttttcgggtcgttttggtaggtttttcgcgcgcggtttttatttttcggttttgcgtttttttttttatgtggcgtttaaattcggcgcgggttcgtcggtataagtatagaattcgcgttttaggtaagtgcggggcggattaagtcggtcgcgcgcgggaagtcgtatggcggtttcgggtcgagtcggtcggtagagtggttgtaatatttatgtcggggtgggggcgggacgaggggagggtatacggagaggtgttgtttcgagcgcgtttagcggtagtagcgcgtattttcggtgcggtttgagcgatcggagcggtgcgagggtattcgtggttcgtcgcgttttatttgtggtgtgcggttttttttgtgtacgttcggaacgcggcggtttttataggcgtttttggggagtatcgtgcgttcgcgngncggnngggggttcgtcgcggtgaaatagttcggcgtcgtcggtagttgttcggtttaaatttngt

SEQ ID NO: 16746 - DNA, 1158 bp, Artificial Sequence
  chemically treated genomic DNA (Homo sapiens) CpG-island No: 16746
  misc_feature (3)..(3): n is either a, c, g or t
  misc_feature (61)..(62): n is either a, c, g or t
  misc_feature (66)..(66): n is either a, c, g or t
  misc_feature (68)..(68): n is either a, c, g or t
acnaaatttaaaccgaacaactaccgacgacgccgaactatttcaccgcgacgaacccccnnccgncncgcgaacgcacgatactccccaaaaacgcctataaaaaccgccgcgttccgaacgtacacaaaaaaaaccgcacaccacaaataaaacgcgacgaaccacgaataccctcgcaccgctccgatcgctcaaaccgcaccgaaaatacgcgctactaccgctaaacgcgctcgaaacaacacctctccgtataccctcccctcgtcccgcccccaccccgacataaatattacaaccactctaccgaccgactcgacccgaaaccgccatacgacttcccgcgcgcgaccgacttaatccgccccgcacttacctaaaacgcgaattctatacttataccgacgaacccgcgccgaatttaaacgccacataaaaaaaaaaacgcaaaaccgaaaaataaaaaccgcgcgcgaaaaacctaccaaaacgacccgaaaaaacgctaaaaacgacgaacgacgaacgccgtatattttcccctctctttatatatatccgatacctactctcgcgtaacgtaacgaaactccgtatatcatttccgcacaaaaacacaaaaacccccgctacaataaaaccacaacccctccgcccccacccccgacccgccccttcccttcaacgaaacacacgcgaaaccgacgacgacgacgctcgaacgtaaacgaccgcgacgaaaaactcgaacgcgcactcccgaaacccaaacgacccgacgactcgaccaacgcaataactccacgtaaaccgcgctaactaccgaaacgaaaacgacgactcgcacccacgacgaaccgaacaaacgccgcgaacaatatcccctataccccatatatcctcccaccgcgaattcgtcctcgaaaacgtaatttctcaaacccgaaaatttaaccccaaacgactttttctacttttttacccttacgaaacgacgactatacgaaacttatcccgcctcgcgcccacgcctctcccgcatttttaacctttaaaccgcaaccccaacccccgaaaccgatcttcccgcgccccaccgacacaaaaaccttaaaacgcgaaaacccgaataactcctacgaccccgaaacgaca

SEQ ID NO: 16747 - DNA, 1158 bp, Artificial Sequence
  chemically treated genomic DNA (Homo sapiens) CpG-island No: 16747
  misc_feature (3)..(3): n is either a, c, g or t
  misc_feature (61)..(62): n is either a, c, g or t
  misc_feature (66)..(66): n is either a, c, g or t
  misc_feature (68)..(68): n is either a, c, g or t
gtnaaatttgggtcgggtagttgtcggcggcgtcggattgttttatcgcggcgaatttttnntcgntncgcgggcgtacggtgttttttaagaacgtttatggaagtcgtcgcgtttcgagcgtgtataaaaggggtcgtatattataaatgagacgcggcgagttacggatgttttcgtatcgtttcggtcgtttaggtcgtatcgggggtgcgcgttattatcgttgggcgcgttcggagtagtattttttcgtatatttttttttcgtttcgtttttatttcggtatggatgttgtagttattttatcggtcggttcgattcggagtcgttatacgatttttcgcgcgcggtcggtttgattcgtttcgtatttatttgggacgcgagttttgtatttatgtcggcgggttcgcgtcgagtttgggcgttatatgggggggagggcgtagggtcggggagtgggggtcgcgcgcggagggtttgttagggcggttcggggaggcgttgggggcggcgggcggcgagcgtcgtgtatttttttttttttttgtgtgtgttcgatgtttgttttcgcgtgacgtgacgggatttcgtgtgttattttcgtataaggatataggagttttcgttgtagtggaattataattttttcgtttttattttcggttcgttttttttttttagcggggtatacgcgggatcggcggcggcggcgttcgggcgtgaacggtcgcggcggggagttcgggcgcgtattttcgggatttaggcggttcggcggttcggttagcgtagtggttttacgtgggtcgcgttggttgtcggggcgggggcggcggttcgtatttacggcgggtcgggtaggcgtcgcgaataatgttttttgtattttatgtgtttttttatcgcgagttcgttttcggaaacgtggttttttagattcgagagtttggttttaaacggttttttttatttttttgtttttgcgggacggcgattgtgcggagtttgtttcgtttcgcgtttacgtttttttcgtatttttggtttttgggtcgtagttttagttttcggggtcggttttttcgcgttttatcggtataaagattttggggcgcgagggttcgggtggtttttgcggtttcggggcggta

SEQ ID NO: 16748 - DNA, 1158 bp, Artificial Sequence
  chemically treated genomic DNA (Homo sapiens) CpG-island No: 16748
  misc_feature (1091)..(1091): n is either a, c, g or t
  misc_feature (1093)..(1093): n is either a, c, g or t
  misc_feature (1097)..(1098): n is either a, c, g or t
  misc_feature (1156)..(1156): n is either a, c, g or t
taccgccccgaaaccgcaaaaaccacccgaaccctcgcgccccaaaatctttataccgataaaacgcgaaaaaaccgaccccgaaaactaaaactacgacccaaaaaccaaaaatacgaaaaaaacgtaaacgcgaaacgaaacaaactccgcacaatcgccgtcccgcaaaaacaaaaaaataaaaaaaaccgtttaaaaccaaactctcgaatctaaaaaaccacgtttccgaaaacgaactcgcgataaaaaaacacataaaatacaaaaaacattattcgcgacgcctacccgacccgccgtaaatacgaaccgccgcccccgccccgacaaccaacgcgacccacgtaaaaccactacgctaaccgaaccgccgaaccgcctaaatcccgaaaatacgcgcccgaactccccgccgcgaccgttcacgcccgaacgccgccgccgccgatcccgcgtataccccgctaaaaaaaaaaaacgaaccgaaaataaaaacgaaaaaattataattccactacaacgaaaactcctatatccttatacgaaaataacacacgaaatcccgtcacgtcacgcgaaaacaaacatcgaacacacacaaaaaaaaaaaaaaatacacgacgctcgccgcccgccgcccccaacgcctccccgaaccgccctaacaaaccctccgcgcgcgacccccactccccgaccctacgccctcccccccatataacgcccaaactcgacgcgaacccgccgacataaatacaaaactcgcgtcccaaataaatacgaaacgaatcaaaccgaccgcgcgcgaaaaatcgtataacgactccgaatcgaaccgaccgataaaataactacaacatccataccgaaataaaaacgaaacgaaaaaaaaatatacgaaaaaatactactccgaacgcgcccaacgataataacgcgcacccccgatacgacctaaacgaccgaaacgatacgaaaacatccgtaactcgccgcgtctcatttataatatacgaccccttttatacacgctcgaaacgcgacgacttccataaacgttcttaaaaaacaccgtacgcccgcgnancgannaaaaattcgccgcgataaaacaatccgacgccgccgacaactacccgacccaaatttnac

SEQ ID NO: 16749 - DNA, 581 bp, Artificial Sequence
  chemically treated genomic DNA (Homo sapiens) CpG-island No: 16749
atcgtcgttaatttttggtgtttcgtgaaagatgttttttttttcggggtttcggagtcggagtatttgtagatagtttttgtttttttattcggttgtcggtttgggggtttcgtcgtttttcggagtcgttcgtcgcgttttttagttcgcgtcgttttgcgcggttcgtcggtttttttatttattagattttttgtgcgtatcgtcgcgcgttttttttattttttaaatgcggagcggagcggggagtaaaattattttcggtttggatttagcgttttcggggatcggtcgcgcgttttttgcgttcgcgggtcgggatgcggttttgagttagcggcggtttttagttcgattgggtttgtcggggttgtttcgcgtacggtaaggttcggggttggggcgcggggcgcggggagcgttggtcgggagcggggggtcgggttttgcggcgcgcgggggcgtgggtgtcgggcgtaggggatcgcggcgcggtcgcgtattgtaggcgtgtttttttgttttttttttcgttttttttaaatgaagggaaagaaaattgttatagattaaatgtt

SEQ ID NO: 16750 - DNA, 581 bp, Artificial Sequence
  chemically treated genomic DNA (Homo sapiens) CpG-island No: 16750
aacatttaatctataacaattttctttcccttcatttaaaaaaaacgaaaaaaaaaacaaaaaaacacgcctacaatacgcgaccgcgccgcgatcccctacgcccgacacccacgcccccgcgcgccgcaaaacccgaccccccgctcccgaccaacgctccccgcgccccgcgccccaaccccgaaccttaccgtacgcgaaacaaccccgacaaacccaatcgaactaaaaaccgccgctaactcaaaaccgcatcccgacccgcgaacgcaaaaaacgcgcgaccgatccccgaaaacgctaaatccaaaccgaaaataattttactccccgctccgctccgcatttaaaaaataaaaaaaacgcgcgacgatacgcacaaaaaatctaataaataaaaaaaccgacgaaccgcgcaaaacgacgcgaactaaaaaacgcgacgaacgactccgaaaaacgacgaaacccccaaaccgacaaccgaataaaaaaacaaaaactatctacaaatactccgactccgaaaccccgaaaaaaaaaacatctttcacgaaacaccaaaaattaacgacgat

SEQ ID NO: 16751 - DNA, 581 bp, Artificial Sequence
  chemically treated genomic DNA (Homo sapiens) CpG-island No: 16751
gatatttggtttgtaataattttttttttttttatttaaaaggaacgaaggagaaaatagaagagtacgtttgtagtgcgcggtcgcgtcgcggttttttgcgttcggtatttacgttttcgcgcgtcgtaggattcggtttttcgttttcggttagcgtttttcgcgtttcgcgttttagtttcgggttttatcgtgcgcggggtagtttcggtaggtttagtcgggttggaagtcgtcgttggtttagagtcgtatttcggttcgcggacgtagggggcgcgcggtcggttttcggaggcgttgggtttaggtcgaggatggttttgtttttcgtttcgtttcgtatttaggaggtgggaggagcgcgcggcgatgcgtataggaaatttgataggtgaggaggtcggcgggtcgcgtagggcggcgcgggttgggggacgcggcgggcggtttcgggaggcgacgggatttttaggtcggtagtcgagtgaagaggtaggaattgtttataaatgtttcggtttcgaagtttcgagggaaagagtattttttacggagtattaggaattgacgacggt

SEQ ID NO: 16752 - DNA, 581 bp, Artificial Sequence
  chemically treated genomic DNA (Homo sapiens) CpG-island No: 16752
accgtcgtcaattcctaatactccgtaaaaaatactctttccctcgaaacttcgaaaccgaaacatttataaacaattcctacctcttcactcgactaccgacctaaaaatcccgtcgcctcccgaaaccgcccgccgcgtcccccaacccgcgccgccctacgcgacccgccgacctcctcacctatcaaatttcctatacgcatcgccgcgcgctcctcccacctcctaaatacgaaacgaaacgaaaaacaaaaccatcctcgacctaaacccaacgcctccgaaaaccgaccgcgcgccccctacgtccgcgaaccgaaatacgactctaaaccaacgacgacttccaacccgactaaacctaccgaaactaccccgcgcacgataaaacccgaaactaaaacgcgaaacgcgaaaaacgctaaccgaaaacgaaaaaccgaatcctacgacgcgcgaaaacgtaaataccgaacgcaaaaaaccgcgacgcgaccgcgcactacaaacgtactcttctattttctccttcgttccttttaaataaaaaaaaaaaaaattattacaaaccaaatatc

SEQ ID NO: 16753 - DNA, 540 bp, Artificial Sequence
  chemically treated genomic DNA (Homo sapiens) CpG-island No: 16753
gttcgcgtaataggcgtttggcgtaggcgttaattggatgattattatttgcgtcgcgtcgttcgcgacggtagaaaaaggttacgtaatggtataacgttgcgggggtgaaatttagatagagttgttcggtaattggacgttggacgacgttcgcgattggtatcgtattggcgtgcggtaggttatttattatcgcggtcgtgatgtataggttagcgggtaatagtggggcgaagtcgatttggtacgtatgaaggcgtttttagatatcggttttgagttttttattattggcgggattatttttgttgatttgtcgttgtttaaagatattcgcgtgaaagcgtttattgtcgggcgggtattggtaggcgcggtaaattcggcgtaagtggttggcgatttttatgcgtaaatcgacgttatttggggaggtgcgcgtgcgtaattattagttagggatttatgaaaaagcgttggcgaaagattttttttggtcggagcggttggtgttggtaaaaagttgcggttttgatt

SEQ ID NO: 16754 - DNA, 540 bp, Artificial Sequence
  chemically treated genomic DNA (Homo sapiens) CpG-island No: 16754
aatcaaaaccgcaactttttaccaacaccaaccgctccgaccaaaaaaaatctttcgccaacgctttttcataaatccctaactaataattacgcacgcgcacctccccaaataacgtcgatttacgcataaaaatcgccaaccacttacgccgaatttaccgcgcctaccaatacccgcccgacaataaacgctttcacgcgaatatctttaaacaacgacaaatcaacaaaaataatcccgccaataataaaaaactcaaaaccgatatctaaaaacgccttcatacgtaccaaatcgacttcgccccactattacccgctaacctatacatcacgaccgcgataataaataacctaccgcacgccaatacgataccaatcgcgaacgtcgtccaacgtccaattaccgaacaactctatctaaatttcacccccgcaacgttataccattacgtaacctttttctaccgtcgcgaacgacgcgacgcaaataataatcatccaattaacgcctacgccaaacgcctattacgcgaac

SEQ ID NO: 16755 - DNA, 540 bp, Artificial Sequence
  chemically treated genomic DNA (Homo sapiens) CpG-island No: 16755
aattaaaatcgtagttttttgttagtattagtcgtttcggttaggagagatttttcgttagcgtttttttataaatttttaattgatgattacgtacgcgtatttttttagatagcgtcgatttgcgtatggaaatcgttagttatttgcgtcggatttgtcgcgtttgttagtgttcgttcggtaataaacgtttttacgcggatatttttaaatagcggtaggttagtaggggtaatttcgttagtaatggaaagtttaaggtcgatatttgaaagcgtttttatgcgtgttagatcggtttcgttttattgttgttcgttggtttgtgtattacgatcgcgatgataaatggtttgtcgtacgttaatacgatgttagtcgcgggcgtcgtttagcgtttagttatcgaatagttttatttgaattttattttcgtagcgttgtgttattgcgtggtttttttttatcgtcgcgagcggcgcggcgtagatgatggttatttagttagcgtttgcgttaaacgtttgttgcgcgagt

SEQ ID NO: 16756 - DNA, 540 bp, Artificial Sequence
  chemically treated genomic DNA (Homo sapiens) CpG-island No: 16756
actcgcgcaacaaacgtttaacgcaaacgctaactaaataaccatcatctacgccgcgccgctcgcgacgataaaaaaaaaccacgcaataacacaacgctacgaaaataaaattcaaataaaactattcgataactaaacgctaaacgacgcccgcgactaacatcgtattaacgtacgacaaaccatttatcatcgcgatcgtaatacacaaaccaacgaacaacaataaaacgaaaccgatctaacacgcataaaaacgctttcaaatatcgaccttaaactttccattactaacgaaattacccctactaacctaccgctatttaaaaatatccgcgtaaaaacgtttattaccgaacgaacactaacaaacgcgacaaatccgacgcaaataactaacgatttccatacgcaaatcgacgctatctaaaaaaatacgcgtacgtaatcatcaattaaaaatttataaaaaaacgctaacgaaaaatctctcctaaccgaaacgactaatactaacaaaaaactacgattttaatt

SEQ ID NO: 16757 - DNA, 884 bp, Artificial Sequence
  chemically treated genomic DNA (Homo sapiens) CpG-island No: 16757
ttttattttttatgttcgtcgtattgttattgtttgtggtgttgtggttcgattttttcgtgcggatatttttattagtaatcgaaggtcgcgattttaattcgatgttgtaatatttcggttttattttttatttatcgttgttttattttggttatggcggtttgatggtagcggcgagcgtggcgttggcgagtttattgcgcggcgagtttgatggtgtttgcgttcgaatttgttggcgttgggcgttatttggttggagtgtattaacggcggggattattttcggtttttggtgggtttattgcgaattcggttggggcggttggtggttttgggattcggtggaaaacgtttttttattattttggttttttgttattgcgttgttgtatagtttgtttttgatacgttagcgggggattttttgttattggtcgttgttgttggcgatagttattttgatgttgtcgttgttgggtattttaattgttcgttttggtattttggtttcggtttatgcgttcgcgttggataacgttcgcgtcgtgtcgttgtttagtttgtttgtattgattagttttgcgtttttggttttgtatgggttgggaacgtcgggacggtgggttcggcgggtgtattttatcgggcggataaacgtcggggaaaatgtttaaatattttcgggaaaggcgggtgggtaggttatgcgtttaggggtttatgagtatcggatcggtggggaaatatttttttaattcggcggaaataaaagggtcgtatttgagagcggggatagtattttttttttcggagggcgtatcgttaatttataatcgcggtagaagtattatagacgggaggtagtaaatcgacggcgg

SEQ ID NO: 16758 - DNA, 884 bp, Artificial Sequence
  chemically treated genomic DNA (Homo sapiens) CpG-island No: 16758
ccgccgtcgatttactacctcccgtctataatacttctaccgcgattataaattaacgatacgccctccgaaaaaaaaaatactatccccgctctcaaatacgacccttttatttccgccgaattaaaaaaatatttccccaccgatccgatactcataaacccctaaacgcataacctacccacccgcctttcccgaaaatatttaaacattttccccgacgtttatccgcccgataaaatacacccgccgaacccaccgtcccgacgttcccaacccatacaaaaccaaaaacgcaaaactaatcaatacaaacaaactaaacaacgacacgacgcgaacgttatccaacgcgaacgcataaaccgaaaccaaaataccaaaacgaacaattaaaatacccaacaacgacaacatcaaaataactatcgccaacaacaacgaccaataacaaaaaatcccccgctaacgtatcaaaaacaaactatacaacaacgcaataacaaaaaaccaaaataataaaaaaacgttttccaccgaatcccaaaaccaccaaccgccccaaccgaattcgcaataaacccaccaaaaaccgaaaataatccccgccgttaatacactccaaccaaataacgcccaacgccaacaaattcgaacgcaaacaccatcaaactcgccgcgcaataaactcgccaacgccacgctcgccgctaccatcaaaccgccataaccaaaataaaacaacgataaataaaaaataaaaccgaaatattacaacatcgaattaaaatcgcgaccttcgattactaataaaaatatccgcacgaaaaaatcgaaccacaacaccacaaacaataacaatacgacgaacataaaaaataaaa

SEQ ID NO: 16759 - DNA, 884 bp, Artificial Sequence
  chemically treated genomic DNA (Homo sapiens) CpG-island No: 16759
tcgtcgtcggtttattgtttttcgtttgtggtatttttgtcgcggttataaattggcggtgcgtttttcgaggggagaggtgttgttttcgtttttaggtgcggtttttttattttcgtcggattaaaggggtgtttttttatcggttcggtgtttatgagtttttgggcgtataatttgtttattcgtttttttcgagggtatttaagtatttttttcggcgtttattcgttcggtaaaatgtattcgtcgggtttatcgtttcggcgtttttagtttatatagagttagagacgtaaggttaattagtgtaaataggttgaataacggtacggcgcggacgttatttagcgcgaacgtatgaatcgaaattagaatgttagaacggataattaaggtgtttagtagcgatagtattagagtaattatcgttagtaatagcgattagtggtaaaaaatttttcgttggcgtgttagggataaattgtgtagtagcgtagtggtagaaagttagggtaataaagaggcgttttttatcggattttagaattattagtcgttttagtcgagttcgtagtaggtttattaggaatcgaggatgattttcgtcgttaatgtattttagttaggtaacgtttagcgttagtaaattcgggcgtaggtattattaaattcgtcgcgtagtagattcgttagcgttacgttcgtcgttattattaaatcgttatagttaaggtaaagtagcggtggatgaaagataagatcgggatgttgtagtatcggattgagatcgcggttttcgattgttggtggaaatattcgtacgaagggatcggattatagtattataaatagtagtagtgcggcgagtatgagagataaaa

SEQ ID NO: 16760 - DNA, 884 bp, Artificial Sequence
  chemically treated genomic DNA (Homo sapiens) CpG-island No: 16760
ttttatctctcatactcgccgcactactactatttataatactataatccgatcccttcgtacgaatatttccaccaacaatcgaaaaccgcgatctcaatccgatactacaacatcccgatcttatctttcatccaccgctactttaccttaactataacgatttaataataacgacgaacgtaacgctaacgaatctactacgcgacgaatttaataatacctacgcccgaatttactaacgctaaacgttacctaactaaaatacattaacgacgaaaatcatcctcgattcctaataaacctactacgaactcgactaaaacgactaataattctaaaatccgataaaaaacgcctctttattaccctaactttctaccactacgctactacacaatttatccctaacacgccaacgaaaaattttttaccactaatcgctattactaacgataattactctaatactatcgctactaaacaccttaattatccgttctaacattctaatttcgattcatacgttcgcgctaaataacgtccgcgccgtaccgttattcaacctatttacactaattaaccttacgtctctaactctatataaactaaaaacgccgaaacgataaacccgacgaatacattttaccgaacgaataaacgccgaaaaaaatacttaaataccctcgaaaaaaacgaataaacaaattatacgcccaaaaactcataaacaccgaaccgataaaaaaacacccctttaatccgacgaaaataaaaaaaccgcacctaaaaacgaaaacaacacctctcccctcgaaaaacgcaccgccaatttataaccgcgacaaaaataccacaaacgaaaaacaataaaccgacgacga

SEQ ID NO: 16761 - DNA, 586 bp, Artificial Sequence
  chemically treated genomic DNA (Homo sapiens) CpG-island No: 16761
cgttggtcgtatttgtcgttttttttttatttcggatggaagaattcgttgaacgtcgttcggcggtagttgtaatacgcgtcgtttgtttatagggattatggcgggtcgattatggataagagtaagcgttatttggcgtggtgggttgtcgggttattggcggtggcggttatcgtggcgtggtggttgttgcgttcggtaggtgtgtcggaaggttttgttgttagtaatgggcgtattgaagcgacggaagtggatattgttagtaaaattgtcgggcgtatcgatattattttggtgaaagaaggtaagtagttcgcgaaggtgaagtgttggcgaagatggatattcgcgtgttgtaggaatagcgattggaagttatcgcgtaaattaaagaggtataaagcgttttgattgacgcgataagtttgttgtagtatcgataaaaggaaaaatcgaggtcggtaacgtagataggggaaatatacggattagcggtaaattggatttcgaagtaaagacgtataatagacggtattagggaataatcggatttaattaaggggataatatagataaataa

SEQ ID NO: 16762 - DNA, 586 bp, Artificial Sequence
  chemically treated genomic DNA (Homo sapiens) CpG-island No: 16762
ttatttatctatattatccccttaattaaatccgattattccctaataccgtctattatacgtctttacttcgaaatccaatttaccgctaatccgtatatttcccctatctacgttaccgacctcgatttttccttttatcgatactacaacaaacttatcgcgtcaatcaaaacgctttatacctctttaatttacgcgataacttccaatcgctattcctacaacacgcgaatatccatcttcgccaacacttcaccttcgcgaactacttaccttctttcaccaaaataatatcgatacgcccgacaattttactaacaatatccacttccgtcgcttcaatacgcccattactaacaacaaaaccttccgacacacctaccgaacgcaacaaccaccacgccacgataaccgccaccgccaataacccgacaacccaccacgccaaataacgcttactcttatccataatcgacccgccataatccctataaacaaacgacgcgtattacaactaccgccgaacgacgttcaacgaattcttccatccgaaataaaaaaaaaacgacaaatacgaccaacg

SEQ ID NO: 16763 - DNA, 586 bp, Artificial Sequence
  chemically treated genomic DNA (Homo sapiens) CpG-island No: 16763
ttgtttgtttatattgtttttttggttgggttcgattgttttttggtatcgtttattatgcgtttttgtttcggagtttagtttgtcgttggttcgtgtgttttttttgtttgcgttgtcggtttcgatttttttttttgtcggtgttgtagtaagtttgtcgcgttagttaaggcgttttgtgtttttttgatttgcgcgatggtttttagtcgttgtttttgtaatacgcgagtatttattttcgttagtattttattttcgcgaattatttgtttttttttattagaatggtgtcgatacgttcggtaattttgttggtaatatttattttcgtcgttttaatgcgtttattattgatagtaaagtttttcggtatatttgtcgggcgtaatagttattacgttacgatagtcgttatcgttagtaattcgataatttattacgttagatggcgtttatttttatttataatcgattcgttataatttttgtaagtaaacgacgcgtgttataattgtcgtcgaacgacgtttagcggatttttttattcgggataagaaggaaacggtaaatacgattagcg

SEQ ID NO: 16764 - DNA, 586 bp, Artificial Sequence
  chemically treated genomic DNA (Homo sapiens) CpG-island No: 16764
cgctaatcgtatttaccgtttccttcttatcccgaataaaaaaatccgctaaacgtcgttcgacgacaattataacacgcgtcgtttacttacaaaaattataacgaatcgattataaataaaaataaacgccatctaacgtaataaattatcgaattactaacgataacgactatcgtaacgtaataactattacgcccgacaaatataccgaaaaactttactatcaataataaacgcattaaaacgacgaaaataaatattaccaacaaaattaccgaacgtatcgacaccattctaataaaaaaaaacaaataattcgcgaaaataaaatactaacgaaaataaatactcgcgtattacaaaaacaacgactaaaaaccatcgcgcaaatcaaaaaaacacaaaacgccttaactaacgcgacaaacttactacaacaccgacaaaaaaaaaaatcgaaaccgacaacgcaaacaaaaaaaacacacgaaccaacgacaaactaaactccgaaacaaaaacgcataataaacgataccaaaaaacaatcgaacccaaccaaaaaaacaatataaacaaacaa

SEQ ID NO: 16765 - DNA, 2006 bp, Artificial Sequence
  chemically treated genomic DNA (Homo sapiens) CpG-island No: 16765
cgagttataagcgcggtggagcggggaagcgaatgaaatcgtttagttgaatggttggttgcgtacgttatattttcgtagaggcggtcgtatttggagttttatttttgtcgtaggattttcgcgagtcgtttttatcgtttcgtttcgcgtcgtttttaatgattgttttttgttaaaataaatttggtcgttttaaaaataaaataaaatttttagtcgggaacgtagttattttcgggtcgttttttagtgcgggttatattttgtattttacgggtcggggttttcgcgaggggaaggggcgggggcggggggcggtgtacggaaaattcggggagtaaacgtgtttaatgtttattaatttttcgtagtttttgttgtgttcgttgtttttttagtttaattttttcggtaataattggaaagatacgaaacgtatacgagtgattattttttcggcgcggggggggcggggggcggggggtcgggggcgggcggcgggcggcgggcggggggcgcgggcgagtattttttagggtaaggtcggtaggaggaattcgagggagcgcggggacgggcgcgtatagatttggtattgttttagtttttgtattagtatttgcggtcgagagacgcgcggttaggggtggggtcgggttcggggcgtttttgttttattttcgtttattattcgcgattttcggcggcggggatattggggacgttaagttcgtagtcgttcgcgggttcgtatttatttgggtcgtttttcgatacgggttcgtcgataggtatcgggcgataaggaagtatagttttgcgggaagataaggagttaggttaagtttcggcggggaggggagggggacggggttaggggagtcgggggagttcggggagtcggggaagtcgaagtagtcgggagcgttagggcgggggtggtacggtttcgcgttttattcgattcgatgagaggtatcgggcgtcgggcggacgacggtttcgttatggtcgggcgcggggcgggaggcgggagcgagcgagcgagcggagcgtgtaggtcgcgtcgaggtttgatcgggttggcgttttttttttttaggcgcgcgtcgtcgtcgtcgtcgtcgtcgttatatcgtgcgcgtcgtttggatcgacgttttcgcgggggaggaagtagttttttcgcgggagacgaaaagtagttttttcgcggggggcgggggtttgcgttaagagaggatcggagttcgtgtttcgttcggggaggcgaatttcgtttagttttttgttttcggggattcgatgaggagaaagtgacgcggaggtaaagatttgggcgtcgtagtagcgagtgggggaggggagggcgcgtggttcgaatttttgcgcgtaatgaggcggttgttcgggttttgtgaggcggtagcgcgacgtcgggtggtttagtagcgggcgggtgtcgggggcggaagcgcggttataagagggggcgatttatcgtcgtttttcgtgggatttgggttttttacgcgggatcgtaggggtttcgagtcgcgggttgggtaaggtcgttcgtttcgggtcgttcggaagggttattttacggatcggtcgtttggggttagtgcgttttgtttcgtacggaagatttttcgtttcgaggataggaaagtttttaaagtgaggattggttcgtcgcgtttttcgtagaggggaacgtcgttcggattcgcgtttttggggcgggggtttcgtatgttggcgttgtcggagcgtttgcggcgttgaaggttgtcgagatttagttatattttttataagttagtagttcggtagaaaattatataaaatgtagcgtttcgtcgagggggtgcgagtcgggggagtagcgcgtagttgcggttgacggttcggttggatttatttaagtatggataggaaaacgggattgtggggagagggtggtgtagacgggtcgtagattttttttaggaagagaa

SEQ ID NO: 16766 - DNA, 2006 bp, Artificial Sequence
  chemically treated genomic DNA (Homo sapiens) CpG-island No: 16766
ttctcttcctaaaaaaaatctacgacccgtctacaccaccctctccccacaatcccgttttcctatccatacttaaataaatccaaccgaaccgtcaaccgcaactacgcgctactcccccgactcgcaccccctcgacgaaacgctacattttatataattttctaccgaactactaacttataaaaaatataactaaatctcgacaaccttcaacgccgcaaacgctccgacaacgccaacatacgaaacccccgccccaaaaacgcgaatccgaacgacgttcccctctacgaaaaacgcgacgaaccaatcctcactttaaaaactttcctatcctcgaaacgaaaaatcttccgtacgaaacaaaacgcactaaccccaaacgaccgatccgtaaaataacccttccgaacgacccgaaacgaacgaccttacccaacccgcgactcgaaacccctacgatcccgcgtaaaaaacccaaatcccacgaaaaacgacgataaatcgccccctcttataaccgcgcttccgcccccgacacccgcccgctactaaaccacccgacgtcgcgctaccgcctcacaaaacccgaacaaccgcctcattacgcgcaaaaattcgaaccacgcgccctcccctcccccactcgctactacgacgcccaaatctttacctccgcgtcactttctcctcatcgaatccccgaaaacaaaaaactaaacgaaattcgcctccccgaacgaaacacgaactccgatcctctcttaacgcaaacccccgccccccgcgaaaaaactacttttcgtctcccgcgaaaaaactacttcctcccccgcgaaaacgtcgatccaaacgacgcgcacgatataacgacgacgacgacgacgacgacgcgcgcctaaaaaaaaaaaacgccaacccgatcaaacctcgacgcgacctacacgctccgctcgctcgctcgctcccgcctcccgccccgcgcccgaccataacgaaaccgtcgtccgcccgacgcccgatacctctcatcgaatcgaataaaacgcgaaaccgtaccacccccgccctaacgctcccgactacttcgacttccccgactccccgaactcccccgactcccctaaccccgtccccctcccctccccgccgaaacttaacctaactccttatcttcccgcaaaactatacttccttatcgcccgatacctatcgacgaacccgtatcgaaaaacgacccaaataaatacgaacccgcgaacgactacgaacttaacgtccccaatatccccgccgccgaaaatcgcgaataataaacgaaaataaaacaaaaacgccccgaacccgaccccacccctaaccgcgcgtctctcgaccgcaaatactaatacaaaaactaaaacaataccaaatctatacgcgcccgtccccgcgctccctcgaattcctcctaccgaccttaccctaaaaaatactcgcccgcgccccccgcccgccgcccgccgcccgcccccgaccccccgccccccgccccccccgcgccgaaaaaataatcactcgtatacgtttcgtatctttccaattattaccgaaaaaattaaactaaaaaaacaacgaacacaacaaaaactacgaaaaattaataaacattaaacacgtttactccccgaattttccgtacaccgccccccgcccccgccccttcccctcgcgaaaaccccgacccgtaaaatacaaaatataacccgcactaaaaaacgacccgaaaataactacgttcccgactaaaaattttattttatttttaaaacgaccaaatttattttaacaaaaaacaatcattaaaaacgacgcgaaacgaaacgataaaaacgactcgcgaaaatcctacgacaaaaataaaactccaaatacgaccgcctctacgaaaatataacgtacgcaaccaaccattcaactaaacgatttcattcgcttccccgctccaccgcgcttataactcg

SEQ ID NO: 16767 - DNA, 2006 bp, Artificial Sequence
  chemically treated genomic DNA (Homo sapiens) CpG-island No: 16767
ttttttttttaaggagggtttgcggttcgtttgtattattttttttttatagtttcgtttttttgtttatgtttggatggatttagtcgagtcgttagtcgtagttgcgcgttgttttttcgattcgtattttttcggcgaagcgttgtattttatgtaattttttgtcgggttgttggtttgtgggggatgtggttgggtttcggtagtttttagcgtcgtagacgtttcggtaacgttagtatacgaggttttcgttttaggagcgcgggttcgggcggcgtttttttttgcgggaggcgcggcgagttaatttttattttaaaagtttttttgttttcgaagcgaggggtttttcgtgcggggtaagacgtattggttttagacgatcggttcgtgaaatgattttttcgagcgattcggagcgggcgattttgtttaattcgcgattcggggtttttgcggtttcgcgtagaggatttaggttttacggggggcggcggtgaatcgtttttttttgtggtcgcgttttcgttttcggtattcgttcgttgttgggttattcggcgtcgcgttgtcgttttataaagttcgggtagtcgttttattgcgcgtagggattcggattacgcgttttttttttttttattcgttgttgcggcgtttaggtttttgttttcgcgttattttttttttatcgagttttcggaggtagagagttgagcgaggttcgttttttcgggcgggatacgagtttcggtttttttttggcgtaaattttcgtttttcgcggagggattatttttcgtttttcgcggaggaattattttttttttcgcggaggcgtcggtttaggcggcgcgtacggtatggcggcggcggcggcggcggcggcgcgcgtttgagaagaggggacgttagttcggttaggtttcggcgcggtttatacgtttcgttcgttcgttcgttttcgtttttcgtttcgcgttcggttatggcggagtcgtcgttcgttcgacgttcggtgttttttatcgagtcgggtaagacgcgaggtcgtgttattttcgttttggcgttttcggttgtttcggttttttcggtttttcgggttttttcggtttttttggtttcgtttttttttttttttcgtcggggtttgatttgattttttgttttttcgtagagttgtatttttttatcgttcggtatttatcggcgggttcgtgtcggagagcggtttaggtgagtgcgggttcgcgggcggttgcggatttggcgtttttagtgttttcgtcgtcgggggtcgcgggtggtgggcgggggtgaaataggagcgtttcgggttcgattttatttttgatcgcgcgtttttcggtcgtaggtgttggtgtaggagttggagtagtattaggtttgtgcgcgttcgttttcgcgttttttcgggttttttttgtcgattttgttttgagggatgttcgttcgcgtttttcgttcgtcgttcgtcgttcgttttcggtttttcgtttttcgtttttttcgcgtcggaggggtggttattcgtgtgcgtttcgtgtttttttagttgttgtcgaagagattggattgggagggtaacgagtataataggagttacgaggagttggtgagtattgggtacgtttgtttttcgggtttttcgtgtatcgtttttcgttttcgtttttttttttcgcggggatttcggttcgtggggtgtaaagtgtgattcgtattggggggcggttcggggatagttgcgttttcggttgaagattttgttttgtttttgaggcggttaggtttgttttggtaggaaatagttattgggggcggcgcggggcggagcggtgggggcgattcgcggaggttttgcggtaggggtggggttttaggtgcggtcgtttttgcgggggtgtggcgtgcgtagttagttatttaattgggcggttttattcgttttttcgttttatcgcgtttgtaattcg

SEQ ID NO: 16768 - DNA, 2006 bp, Artificial Sequence
  chemically treated genomic DNA (Homo sapiens) CpG-island No: 16768
cgaattacaaacgcgataaaacgaaaaaacgaataaaaccgcccaattaaataactaactacgcacgccacacccccgcaaaaacgaccgcacctaaaaccccacccctaccgcaaaacctccgcgaatcgcccccaccgctccgccccgcgccgcccccaataactatttcctaccaaaacaaacctaaccgcctcaaaaacaaaacaaaatcttcaaccgaaaacgcaactatccccgaaccgccccccaatacgaatcacactttacaccccacgaaccgaaatccccgcgaaaaaaaaaaacgaaaacgaaaaacgatacacgaaaaacccgaaaaacaaacgtacccaatactcaccaactcctcgtaactcctattatactcgttaccctcccaatccaatctcttcgacaacaactaaaaaaacacgaaacgcacacgaataaccacccctccgacgcgaaaaaaacgaaaaacgaaaaaccgaaaacgaacgacgaacgacgaacgaaaaacgcgaacgaacatccctcaaaacaaaatcgacaaaaaaaacccgaaaaaacgcgaaaacgaacgcgcacaaacctaatactactccaactcctacaccaacacctacgaccgaaaaacgcgcgatcaaaaataaaatcgaacccgaaacgctcctatttcacccccgcccaccacccgcgacccccgacgacgaaaacactaaaaacgccaaatccgcaaccgcccgcgaacccgcactcacctaaaccgctctccgacacgaacccgccgataaataccgaacgataaaaaaatacaactctacgaaaaaacaaaaaatcaaatcaaaccccgacgaaaaaaaaaaaaaaacgaaaccaaaaaaaccgaaaaaacccgaaaaaccgaaaaaaccgaaacaaccgaaaacgccaaaacgaaaataacacgacctcgcgtcttacccgactcgataaaaaacaccgaacgtcgaacgaacgacgactccgccataaccgaacgcgaaacgaaaaacgaaaacgaacgaacgaacgaaacgtataaaccgcgccgaaacctaaccgaactaacgtcccctcttctcaaacgcgcgccgccgccgccgccgccgccgccataccgtacgcgccgcctaaaccgacgcctccgcgaaaaaaaaaataattcctccgcgaaaaacgaaaaataatccctccgcgaaaaacgaaaatttacgccaaaaaaaaaccgaaactcgtatcccgcccgaaaaaacgaacctcgctcaactctctacctccgaaaactcgataaaaaaaaaataacgcgaaaacaaaaacctaaacgccgcaacaacgaataaaaaaaaaaaaaacgcgtaatccgaatccctacgcgcaataaaacgactacccgaactttataaaacgacaacgcgacgccgaataacccaacaacgaacgaataccgaaaacgaaaacgcgaccacaaaaaaaaacgattcaccgccgccccccgtaaaacctaaatcctctacgcgaaaccgcaaaaaccccgaatcgcgaattaaacaaaatcgcccgctccgaatcgctcgaaaaaatcatttcacgaaccgatcgtctaaaaccaatacgtcttaccccgcacgaaaaacccctcgcttcgaaaacaaaaaaacttttaaaataaaaattaactcgccgcgcctcccgcaaaaaaaaacgccgcccgaacccgcgctcctaaaacgaaaacctcgtatactaacgttaccgaaacgtctacgacgctaaaaactaccgaaacccaaccacatcccccacaaaccaacaacccgacaaaaaattacataaaatacaacgcttcgccgaaaaaatacgaatcgaaaaaacaacgcgcaactacgactaacgactcgactaaatccatccaaacataaacaaaaaaacgaaactataaaaaaaaaataatacaaacgaaccgcaaaccctccttaaaaaaaaaa

SEQ ID NO: 16769 - DNA, 788 bp, Artificial Sequence
  chemically treated genomic DNA (Homo sapiens) CpG-island No: 16769
ttggcggcgttttcggcggagttgatttgcggagacggagacgtacgaatagaggcgggtcgtagttttaggattcgcgggttcgttcggtttcgagaataatgttcggtcgcgtgacgttacggtttttcgtcgtttcgttcgaatagtttttttagttttttcggtcgttaaacgttttagaacgttcgttttcgcggtcgtcgagcgttcgtttgttcgttcgtcggtttttaagcgtttttcgggttcgtcgttatcgtgggtgtaacggggtttgggtttcgcggggttcggcggggcgtcggcggcggttttagggggcgtgtgcgggtcgcggtcgtcgtttattttttttttgggtatcgtggcggcggggaaggcgcgtgtcgggtgtttgcggggaaggcgcgtgtcgggtgtttgcgggtcgcggcgcgtcgatagttttcgcgaaattgggttgttttgtcgttgttatttttttcgtcgttcgagttgttgagatttatagcgggggcggtgggagaatcggatggaatcggattgggagttcgttttttttttttttcgcgttttcggtcgcgggtttttttttttcgtcggtcgggtcgttttttattttcgtttattggttacgggatttagttcgcgttcggaataggtgaggcgggtttttaattgatttcggatttcgttttttttcgggggtttttttttttttttcgggcgtttttattttttttcgtcgtttcgcggggttttagatttaggcgaagggggcgggg

SEQ ID NO: 16770 - DNA, 788 bp, Artificial Sequence
  chemically treated genomic DNA (Homo sapiens) CpG-island No: 16770
ccccgcccccttcgcctaaatctaaaaccccgcgaaacgacgaaaaaaaataaaaacgcccgaaaaaaaaaaaaaaacccccgaaaaaaaacgaaatccgaaatcaattaaaaacccgcctcacctattccgaacgcgaactaaatcccgtaaccaataaacgaaaataaaaaacgacccgaccgacgaaaaaaaaaaacccgcgaccgaaaacgcgaaaaaaaaaaaaaacgaactcccaatccgattccatccgattctcccaccgcccccgctataaatctcaacaactcgaacgacgaaaaaaataacaacgacaaaacaacccaatttcgcgaaaactatcgacgcgccgcgacccgcaaacacccgacacgcgccttccccgcaaacacccgacacgcgccttccccgccgccacgatacccaaaaaaaaaataaacgacgaccgcgacccgcacacgccccctaaaaccgccgccgacgccccgccgaaccccgcgaaacccaaaccccgttacacccacgataacgacgaacccgaaaaacgcttaaaaaccgacgaacgaacaaacgaacgctcgacgaccgcgaaaacgaacgttctaaaacgtttaacgaccgaaaaaactaaaaaaactattcgaacgaaacgacgaaaaaccgtaacgtcacgcgaccgaacattattctcgaaaccgaacgaacccgcgaatcctaaaactacgacccgcctctattcgtacgtctccgtctccgcaaatcaactccgccgaaaacgccgccaa

SEQ ID NO: 16771 - DNA, 788 bp, Artificial Sequence
  chemically treated genomic DNA (Homo sapiens) CpG-island No: 16771
tttcgtttttttcgtttgggtttggggtttcgcgagacggcggaaaggggtgggggcgttcggggggggggggggggttttcggaagggggcggggttcgggattaattaagggttcgttttatttatttcgggcgcgggttgagtttcgtagttaatgggcgggggtggggggcggttcggtcggcggggagggggagttcgcggtcggggacgcggggggaggaggaggcgggtttttaattcggttttattcggtttttttatcgttttcgttgtgggttttagtagttcgggcggcgggaggagtggtagcggtaaggtagtttagtttcgcgaaggttgtcggcgcgtcgcggttcgtaggtattcggtacgcgtttttttcgtaggtattcggtacgcgtttttttcgtcgttacgatgtttaagaggaaggtgagcggcggtcgcggttcgtatacgttttttggagtcgtcgtcggcgtttcgtcgggtttcgcgaggtttaggtttcgttgtatttacggtggcgacgggttcgggaggcgtttggagatcggcgggcgggtaggcgagcgttcggcggtcgcgggggcgggcgttttggaacgtttggcggtcgggggagttgagggggttattcgaacggggcggcgggaagtcgtgacgttacgcggtcgggtattgttttcggggtcgggcgggttcgcgagttttgggattgcggttcgtttttattcgtgcgttttcgttttcgtaggttagtttcgtcgaaggcgtcgttaa

SEQ ID NO: 16772 - DNA, 788 bp, Artificial Sequence
  chemically treated genomic DNA (Homo sapiens) CpG-island No: 16772
ttaacgacgccttcgacgaaactaacctacgaaaacgaaaacgcacgaataaaaacgaaccgcaatcccaaaactcgcgaacccgcccgaccccgaaaacaatacccgaccgcgtaacgtcacgacttcccgccgccccgttcgaataaccccctcaactcccccgaccgccaaacgttccaaaacgcccgcccccgcgaccgccgaacgctcgcctacccgcccgccgatctccaaacgcctcccgaacccgtcgccaccgtaaatacaacgaaacctaaacctcgcgaaacccgacgaaacgccgacgacgactccaaaaaacgtatacgaaccgcgaccgccgctcaccttcctcttaaacatcgtaacgacgaaaaaaacgcgtaccgaatacctacgaaaaaaacgcgtaccgaatacctacgaaccgcgacgcgccgacaaccttcgcgaaactaaactaccttaccgctaccactcctcccgccgcccgaactactaaaacccacaacgaaaacgataaaaaaaccgaataaaaccgaattaaaaacccgcctcctcctccccccgcgtccccgaccgcgaactccccctccccgccgaccgaaccgccccccacccccgcccattaactacgaaactcaacccgcgcccgaaataaataaaacgaacccttaattaatcccgaaccccgcccccttccgaaaaccccccccccccccccgaacgcccccacccctttccgccgtctcgcgaaaccccaaacccaaacgaaaaaaacgaaa

SEQ ID NO: 16773 - DNA, 551 bp, Artificial Sequence
  chemically treated genomic DNA (Homo sapiens) CpG-island No: 16773
ttttgatttcgttagttatattattttataggatattgtggtcgatggcggtttaacgttgggggtataagtatgatttggaaacgttatttaacgttcgacgaattgaacgttattagcgataatataatggtggcgtatttgggaattgtgtatattcgtttgggcgatgatgtgttggaagtcgaaatgtcggttgatattcgtatttattagtcgttcggtttattatatggcggcgcgtcggcggcgttggcggaaacgttgggatcgatggtcggatttatgatgattcgcgacggatagtgtgtggtaggtatagaatttaatgtaatatattatcgttcggtgtttgagggaaaggtacgcggcgtttgttagtcgttgtattttggtcggtaaaattagagttgggatatcgtcgtttttcgattgaattaggcggcgttgggtcgtttggtttggtaattttggtttttcgggtttttggcggggttattcggggtaacgattttttcgggggcgtattttcggatttaagtttttttatt

SEQ ID NO: 16774 - DNA, 551 bp, Artificial Sequence
  chemically treated genomic DNA (Homo sapiens) CpG-island No: 16774
aataaaaaaacttaaatccgaaaatacgcccccgaaaaaatcgttaccccgaataaccccgccaaaaacccgaaaaaccaaaattaccaaaccaaacgacccaacgccgcctaattcaatcgaaaaacgacgatatcccaactctaattttaccgaccaaaatacaacgactaacaaacgccgcgtacctttccctcaaacaccgaacgataatatattacattaaattctatacctaccacacactatccgtcgcgaatcatcataaatccgaccatcgatcccaacgtttccgccaacgccgccgacgcgccgccatataataaaccgaacgactaataaatacgaatatcaaccgacatttcgacttccaacacatcatcgcccaaacgaatatacacaattcccaaatacgccaccattatattatcgctaataacgttcaattcgtcgaacgttaaataacgtttccaaatcatacttatacccccaacgttaaaccgccatcgaccacaatatcctataaaataatataactaacgaaatcaaaa

SEQ ID NO: 16775 - DNA, 551 bp, Artificial Sequence
  chemically treated genomic DNA (Homo sapiens) CpG-island No: 16775
ggtgggggggtttgggttcgaaggtgcgttttcggagaaatcgttgtttcgggtaatttcgttaagggttcggggagttaaggttgttaagttaaacggtttagcgtcgtttggtttaatcggaaaacgacgatgttttagttttgattttgtcgattaagatgtagcggttggtagacgtcgcgtattttttttttagatatcgggcgatggtgtgttgtattaagttttgtgtttattatatattgttcgtcgcgggttattataaattcggttatcgattttagcgttttcgttagcgtcgtcgacgcgtcgttatgtagtaaatcgaacggttgatgagtacgggtattaatcggtatttcggtttttagtatattatcgtttagacgggtatatataatttttagatgcgttattattgtgttatcgttggtggcgtttagttcgtcgagcgttaaatggcgtttttagattatgtttatgtttttagcgttgagtcgttatcgattataatattttgtagggtaatatggttggcgaggttagag

SEQ ID NO: 16776 - DNA, 551 bp, Artificial Sequence
  chemically treated genomic DNA (Homo sapiens) CpG-island No: 16776
ctctaacctcgccaaccatattaccctacaaaatattataatcgataacgactcaacgctaaaaacataaacataatctaaaaacgccatttaacgctcgacgaactaaacgccaccaacgataacacaataataacgcatctaaaaattatatatacccgtctaaacgataatatactaaaaaccgaaataccgattaatacccgtactcatcaaccgttcgatttactacataacgacgcgtcgacgacgctaacgaaaacgctaaaatcgataaccgaatttataataacccgcgacgaacaatatataataaacacaaaacttaatacaacacaccatcgcccgatatctaaaaaaaaaatacgcgacgtctaccaaccgctacatcttaatcgacaaaatcaaaactaaaacatcgtcgttttccgattaaaccaaacgacgctaaaccgtttaacttaacaaccttaactccccgaacccttaacgaaattacccgaaacaacgatttctccgaaaacgcaccttcgaacccaaacccccccacc

SEQ ID NO: 16777 - DNA, 514 bp, Artificial Sequence
  chemically treated genomic DNA (Homo sapiens) CpG-island No: 16777
  misc_feature (182)..(182): n is either a, c, g or t
cgcggcgttttttagttttatcgtttttagtggtagcggtaagcgtagcgttatcggcgggtttttttaacgttaggtaggtttttcgcgtcgttgggtgtgtatggtgtgtagtggattaaaggcgttgcgcgggttttgggtatgatggtggtaattttgatgtcgcgtagggcgtaagngcgaaatcggtttgttatcggttaaaatttttttcgtcgtttgagcgaacgttagcgggtaaaatgtttagcgttgcggcgtaggttatatgatttttcgattgtcgttatcgtcgattaacgttagtacgcgttcggcgttgtagggtttaacgatatatcgtgtattagcggttgcgcggtttgtagcgcgatattacgtagtttaatttgttgcggtattagtgtgcgtgtttcgttattagatgagggtttagatgatcgcgtagtgcgttatttagttagtgattttgtgtttttgggaaataagttatattgatacggatacgtat

SEQ ID NO: 16778 - DNA, 514 bp, Artificial Sequence
  chemically treated genomic DNA (Homo sapiens) CpG-island No: 16778
  misc_feature (333)..(333): n is either a, c, g or t
atacgtatccgtatcaatataacttatttcccaaaaacacaaaatcactaactaaataacgcactacgcgatcatctaaaccctcatctaataacgaaacacgcacactaataccgcaacaaattaaactacgtaatatcgcgctacaaaccgcgcaaccgctaatacacgatatatcgttaaaccctacaacgccgaacgcgtactaacgttaatcgacgataacgacaatcgaaaaatcatataacctacgccgcaacgctaaacattttacccgctaacgttcgctcaaacgacgaaaaaaattttaaccgataacaaaccgatttcgcncttacgccctacgcgacatcaaaattaccaccatcatacccaaaacccgcgcaacgcctttaatccactacacaccatacacacccaacgacgcgaaaaacctacctaacgttaaaaaaacccgccgataacgctacgcttaccgctaccactaaaaacgataaaactaaaaaacgccgcg

SEQ ID NO: 16779 - DNA, 514 bp, Artificial Sequence
  chemically treated genomic DNA (Homo sapiens) CpG-island No: 16779
  misc_feature (333)..(333): n is either a, c, g or t
atacgtattcgtattagtgtaatttattttttaaaagtataaagttattggttgggtgacgtattgcgcgattatttggatttttatttggtgacggagtacgtatattaatgtcgtaatagattgaattacgtaatatcgcgttataggtcgcgtagtcgttggtatacggtgtatcgttaagttttgtaacgtcgggcgcgtgttggcgttagtcggcggtagcggtagtcgggaaattatgtaatttgcgtcgtaacgttgggtattttgttcgttggcgttcgtttagacggcgggggaaattttagtcgatggtaaatcggtttcgtntttgcgttttgcgcggtattaaaattgttattattatgtttagaattcgcgtagcgtttttaatttattgtatattatgtatatttagcggcgcgggaaatttgtttggcgttagggaaattcgtcgatgacgttacgtttatcgttgttattagaagcggtggggttggaaaacgtcgcg

SEQ ID NO: 16780 - DNA, 514 bp, Artificial Sequence
  chemically treated genomic DNA (Homo sapiens) CpG-island No: 16780
  misc_feature (182)..(182): n is either a, c, g or t
cgcgacgttttccaaccccaccgcttctaataacaacgataaacgtaacgtcatcgacgaatttccctaacgccaaacaaatttcccgcgccgctaaatatacataatatacaataaattaaaaacgctacgcgaattctaaacataataataacaattttaataccgcgcaaaacgcaaanacgaaaccgatttaccatcgactaaaatttcccccgccgtctaaacgaacgccaacgaacaaaatacccaacgttacgacgcaaattacataatttcccgactaccgctaccgccgactaacgccaacacgcgcccgacgttacaaaacttaacgatacaccgtataccaacgactacgcgacctataacgcgatattacgtaattcaatctattacgacattaatatacgtactccgtcaccaaataaaaatccaaataatcgcgcaatacgtcacccaaccaataactttatacttttaaaaaataaattacactaatacgaatacgtat

SEQ ID NO: 16781 - DNA, 1011 bp, Artificial Sequence
  chemically treated genomic DNA (Homo sapiens) CpG-island No: 16781
  misc_feature (227)..(227): n is either a, c, g or t
tgcggtcggtataggagtagtaagggtcgaggttatcgataattagcggcgtatcggaaacggtgttgtcgcgtagtatgtagcgtagggtcggttagttcgcgtaggtcgcggtacggtagcgttagcggtatagtttttggttgtcgtcggttatgttttagtggatattatcgtcgcgcggcgtttcggtaaagtttagcgtaaagcggtgcggaatgtaggtnaagttttttattattagtgggttattcggtaggttatttagatcgtagtcgattatgtttagcgcggtatagatttcgttgatacgtatttttagacgggaaataacgtcgtagttttgttcgttgtggatttttattggtagtaggttatagtcgataaacgggtgatcggcgcgggtattacgggcgtgatcgttggtacggattatcgggtcgacgttattgaagtcgcgagcgattttcgggtttagacgattaatgtcgatagtgcgttgttttatgttcggagtgtttagtagtatatttattagtttttgtattttacgacgtatttgttgtgttagttggcgggtttggattatgtcgttttttagtagatcgcgacgaatttcgtcgattaagtttaggtcgtaggttttacgcgtatcggtaaggatttttgttatttttatggaggttttacgtacgcggaagaattgtataaagtcggagtcgaagtcggtaaagtgataggttaggttaaggttgagtagatgcgagtgtaagcgttttatttttagtagaatggcgcggattatttgcgtacgttttggtatttgaatatttatcgcgttttttatcgacgtggtgtaggcggtgttgtgggtaaagtcgtagatttcgtatatacggttagagaggaaggttatttcgttataatttatacgggttttcgttagtttttttatgtcgcgatggacgtagaatagacggtagtcggcgtcgatatgttttcgttatcgat

SEQ ID NO: 16782 - DNA, 1011 bp, Artificial Sequence
  chemically treated genomic DNA (Homo sapiens) CpG-island No: 16782
  misc_feature (785)..(785): n is either a, c, g or t
atcgataacgaaaacatatcgacgccgactaccgtctattctacgtccatcgcgacataaaaaaactaacgaaaacccgtataaattataacgaaataaccttcctctctaaccgtatatacgaaatctacgactttacccacaacaccgcctacaccacgtcgataaaaaacgcgataaatattcaaataccaaaacgtacgcaaataatccgcgccattctactaaaaataaaacgcttacactcgcatctactcaaccttaacctaacctatcactttaccgacttcgactccgactttatacaattcttccgcgtacgtaaaacctccataaaaataacaaaaatccttaccgatacgcgtaaaacctacgacctaaacttaatcgacgaaattcgtcgcgatctactaaaaaacgacataatccaaacccgccaactaacacaacaaatacgtcgtaaaatacaaaaactaataaatatactactaaacactccgaacataaaacaacgcactatcgacattaatcgtctaaacccgaaaatcgctcgcgacttcaataacgtcgacccgataatccgtaccaacgatcacgcccgtaatacccgcgccgatcacccgtttatcgactataacctactaccaataaaaatccacaacgaacaaaactacgacgttatttcccgtctaaaaatacgtatcaacgaaatctataccgcgctaaacataatcgactacgatctaaataacctaccgaataacccactaataataaaaaacttnacctacattccgcaccgctttacgctaaactttaccgaaacgccgcgcgacgataatatccactaaaacataaccgacgacaaccaaaaactataccgctaacgctaccgtaccgcgacctacgcgaactaaccgaccctacgctacatactacgcgacaacaccgtttccgatacgccgctaattatcgataacctcgacccttactactcctataccgaccgca

SEQ ID NO: 16783 - DNA, 1011 bp, Artificial Sequence
  chemically treated genomic DNA (Homo sapiens) CpG-island No: 16783
  misc_feature (785)..(785): n is either a, c, g or t
gtcgatggcgaaaatatatcgacgtcgattatcgtttgttttacgtttatcgcggtatggaaaaattggcggaaattcgtatgggttataacgaagtgatttttttttttgatcgtgtgtgcgggatttgcggttttgtttatagtatcgtttatattacgtcggtggaaaacgcgatgggtatttaggtgttagaacgtgcgtagatgattcgcgttattttgttggaggtagaacgtttgtattcgtatttgtttaattttggtttggtttgttattttatcggtttcgatttcggttttatgtagttttttcgcgtgcgtgaaatttttatgaaaatggtagagatttttatcggtgcgcgtaaaatttacggtttgaatttgatcggcgggattcgtcgcgatttgttgaaagacgatatgatttagattcgttagttggtataatagatgcgtcgtgaagtgtaggagttggtggatgtgttgttgagtatttcgaatatggaatagcgtattgtcggtattggtcgtttggattcggaaatcgttcgcgattttagtaacgtcggttcgatggttcgtgttagcggttacgttcgtgatattcgcgtcgattattcgtttgtcggttatggtttgttgttaatggaagtttatagcgagtagggttgcgacgttatttttcgtttgaaagtgcgtattaacgaagtttatatcgcgttgaatatgatcgattacggtttggataatttgtcgggtggtttattgatggtggaaggtttnatttatatttcgtatcgttttgcgttgggttttgtcgaagcgtcgcgcggcgatgatatttattggagtatgatcggcgataattagaagttgtatcgttggcgttgtcgtgtcgcgatttacgcgaattggtcgattttgcgttatatgttgcgcggtaatatcgttttcgatgcgtcgttgattatcggtagtttcgatttttgttatttttgtatcgatcgta

SEQ ID NO: 16784 - DNA, 1011 bp, Artificial Sequence
  chemically treated genomic DNA (Homo sapiens) CpG-island No: 16784
  misc_feature (227)..(227): n is either a, c, g or t
tacgatcgatacaaaaataacaaaaatcgaaactaccgataatcaacgacgcatcgaaaacgatattaccgcgcaacatataacgcaaaatcgaccaattcgcgtaaatcgcgacacgacaacgccaacgatacaacttctaattatcgccgatcatactccaataaatatcatcgccgcgcgacgcttcgacaaaacccaacgcaaaacgatacgaaatataaatnaaaccttccaccatcaataaaccacccgacaaattatccaaaccgtaatcgatcatattcaacgcgatataaacttcgttaatacgcactttcaaacgaaaaataacgtcgcaaccctactcgctataaacttccattaacaacaaaccataaccgacaaacgaataatcgacgcgaatatcacgaacgtaaccgctaacacgaaccatcgaaccgacgttactaaaatcgcgaacgatttccgaatccaaacgaccaataccgacaatacgctattccatattcgaaatactcaacaacacatccaccaactcctacacttcacgacgcatctattataccaactaacgaatctaaatcatatcgtctttcaacaaatcgcgacgaatcccgccgatcaaattcaaaccgtaaattttacgcgcaccgataaaaatctctaccattttcataaaaatttcacgcacgcgaaaaaactacataaaaccgaaatcgaaaccgataaaataacaaaccaaaccaaaattaaacaaatacgaatacaaacgttctacctccaacaaaataacgcgaatcatctacgcacgttctaacacctaaatacccatcgcgttttccaccgacgtaatataaacgatactataaacaaaaccgcaaatcccgcacacacgatcaaaaaaaaaaatcacttcgttataacccatacgaatttccgccaatttttccataccgcgataaacgtaaaacaaacgataatcgacgtcgatatattttcgccatcgac

SEQ ID NO: 16785 - DNA, 512 bp, Artificial Sequence
  chemically treated genomic DNA (Homo sapiens) CpG-island No: 16785
taggtattcgttcggtttgaaaagtcggatcggaattattcgcgagttttttttttgtcgattgaagcggggattttcgtattgcgcgatttagggggattttttagtcggatttcgtttttttcgttcgtcgcgttttagcgttaggtttttacgtcggacgttcgtcgtcgttttttatttttatttacgggttatgtcgattattaacggagtttggaagaagagtaattcggaaaagtaacggttttttggtattttgggatatcgttattatcgttgatcgggaaggttgagttttcgtgggtttttcgttcggttgcgttttcgttttgtttcgttaacggtttcgttcgttggaggttcgataatagtcgtcggtatggtcggcgcgttattgcgcgtgcgcggtcggggttgggtcggggtttcgaagttcggtcggggtttcgagtttgttgaattatattttttttatgttatattagtattaattttaaaagggatatata

SEQ ID NO: 16786 - DNA, 512 bp, Artificial Sequence
  chemically treated genomic DNA (Homo sapiens) CpG-island No: 16786
tatatatcccttttaaaattaatactaatataacataaaaaaaatataattcaacaaactcgaaaccccgaccgaacttcgaaaccccgacccaaccccgaccgcgcacgcgcaataacgcgccgaccataccgacgactattatcgaacctccaacgaacgaaaccgttaacgaaacaaaacgaaaacgcaaccgaacgaaaaacccacgaaaactcaaccttcccgatcaacgataataacgatatcccaaaataccaaaaaaccgttacttttccgaattactcttcttccaaactccgttaataatcgacataacccgtaaataaaaataaaaaacgacgacgaacgtccgacgtaaaaacctaacgctaaaacgcgacgaacgaaaaaaacgaaatccgactaaaaaatccccctaaatcgcgcaatacgaaaatccccgcttcaatcgacaaaaaaaaaactcgcgaataattccgatccgacttttcaaaccgaacgaataccta

SEQ ID NO: 16787 - DNA, 512 bp, Artificial Sequence
  chemically treated genomic DNA (Homo sapiens) CpG-island No: 16787
tgtatattttttttaaaattagtgttaatgtagtatgagggaaatgtaatttaataagttcggagtttcggtcgagtttcggagtttcggtttagtttcggtcgcgtacgcgtagtgacgcgtcggttatgtcggcggttgttgtcgggtttttagcgggcggggtcgttggcggagtagagcggaggcgtagtcgggcggagggtttacgagggtttagttttttcggttagcggtggtgacggtattttagagtgttagagaatcgttgttttttcgagttgttttttttttaggtttcgttggtggtcggtatggttcgtgagtgggggtgggaagcggcggcgagcgttcggcgtgggagtttagcgttgaggcgcggcgggcgggggaggcggagttcggttggagaatttttttgggtcgcgtagtgcggggattttcgttttagtcggtagagagagagttcgcgggtggtttcggttcggttttttaggtcggacgggtgtttg

SEQ ID NO: 16788 - DNA, 512 bp, Artificial Sequence
  chemically treated genomic DNA (Homo sapiens) CpG-island No: 16788
caaacacccgtccgacctaaaaaaccgaaccgaaaccacccgcgaactctctctctaccgactaaaacgaaaatccccgcactacgcgacccaaaaaaattctccaaccgaactccgcctcccccgcccgccgcgcctcaacgctaaactcccacgccgaacgctcgccgccgcttcccacccccactcacgaaccataccgaccaccaacgaaacctaaaaaaaaaacaactcgaaaaaacaacgattctctaacactctaaaataccgtcaccaccgctaaccgaaaaaactaaaccctcgtaaaccctccgcccgactacgcctccgctctactccgccaacgaccccgcccgctaaaaacccgacaacaaccgccgacataaccgacgcgtcactacgcgtacgcgaccgaaactaaaccgaaactccgaaactcgaccgaaactccgaacttattaaattacatttccctcatactacattaacactaattttaaaaaaaatataca

SEQ ID NO: 16789 - DNA, 840 bp, Artificial Sequence
  chemically treated genomic DNA (Homo sapiens) CpG-island No: 16789
ttttggttttttgtggcgcggtattttgtcgtaatgcggtatcgatgacgaagtgtttgtattttattcgacgtgttcgcgtcgatcgttcgaggttattgtggttcgttattttttcgttattcgtattttgtttagagtgtgttatttgttttaggtagatttgcgataggtgttagcgttatcgattcgttgattatggttcgtattcgtgagtttattcgtttcgcgttttatttttttatttattacgtgtggttttggtgttgttgtttgttcgacgttgttgtagaagttgtatttcggtgatgtttcgggtgtttgtaaagaattgtagcgttggatttatgttggcggtaagtagtggaaagggtttgattattcggcgcgagattgagcgtgaagtttgcgagtggggttagaaatgagtcgattaatcgtaattatttgcgttgtcgttatttgtttgttggtttttatggtttgggttattaattattatcgcgataacgttattatttataaagattagcgcgataaagttattaaaagttttcgtttggttaacgatattattaaagatatgtagattcgttagcgtgatgtcgttgtattggatgttaaatatatcggagaattggttgatgcgaaagaaattattgagcgtttgtatagcgatgttattgttggtcgtaagcggttgtaagtcgtcgttatttgtgtaaagttaacgatcggagttagtagtatgggcgatggagaaagtttaagatttatagtagatgttgaatttaattattatcgttttcgaagtggaatcgataggataatcgcgtaggt

SEQ ID NO: 16790 - DNA, 840 bp, Artificial Sequence
  chemically treated genomic DNA (Homo sapiens) CpG-island No: 16790
acctacgcgattatcctatcgattccacttcgaaaacgataataattaaattcaacatctactataaatcttaaactttctccatcgcccatactactaactccgatcgttaactttacacaaataacgacgacttacaaccgcttacgaccaacaataacatcgctatacaaacgctcaataatttctttcgcatcaaccaattctccgatatatttaacatccaatacaacgacatcacgctaacgaatctacatatctttaataatatcgttaaccaaacgaaaacttttaataactttatcgcgctaatctttataaataataacgttatcgcgataataattaataacccaaaccataaaaaccaacaaacaaataacgacaacgcaaataattacgattaatcgactcatttctaaccccactcgcaaacttcacgctcaatctcgcgccgaataatcaaaccctttccactacttaccgccaacataaatccaacgctacaattctttacaaacacccgaaacatcaccgaaatacaacttctacaacaacgtcgaacaaacaacaacaccaaaaccacacgtaataaataaaaaaataaaacgcgaaacgaataaactcacgaatacgaaccataatcaacgaatcgataacgctaacacctatcgcaaatctacctaaaacaaataacacactctaaacaaaatacgaataacgaaaaaataacgaaccacaataacctcgaacgatcgacgcgaacacgtcgaataaaatacaaacacttcgtcatcgataccgcattacgacaaaataccgcgccacaaaaaaccaaaa

SEQ ID NO: 16791 - DNA, 840 bp, Artificial Sequence
  chemically treated genomic DNA (Homo sapiens) CpG-island No: 16791
atttgcgcggttattttgtcgattttatttcggagacggtaataattgagtttagtatttgttgtaagttttgggttttttttatcgtttatgttgttggtttcggtcgttgattttgtataggtggcggcgatttgtagtcgtttacggttagtaatgatatcgttatgtagacgtttaatggtttttttcgtattagttagtttttcggtgtatttggtatttagtgtagcgatattacgttgacgggtttgtatgtttttgatggtgtcgttagttaggcggagatttttggtggttttgtcgcgttggtttttgtaggtgatggcgttgtcgcggtagtggttaatggtttaggttatggaaattagtaggtagataacgatagcgtagatgattgcggttaatcggtttatttttggttttattcgtagattttacgtttaatttcgcgtcgggtgattagattttttttattgtttgtcgttagtataagtttagcgttgtagttttttataagtattcggaatattatcggagtatagtttttatagtagcgtcgagtaggtaatagtattagagttatacgtaataggtgaaggagtaaagcgcggagcgggtaggtttacggatgcgaattatgattagcgggtcgatggcgttggtatttatcgtagatttgtttaaagtaggtggtatattttagataggatacggatgacgagggaatgacggattatagtggtttcgaacggtcgacgcgaatacgtcggatagggtataagtatttcgttatcgatgtcgtattgcgataagatgtcgcgttataagggattaaga

SEQ ID NO: 16792 - DNA, 840 bp, Artificial Sequence
  chemically treated genomic DNA (Homo sapiens) CpG-island No: 16792
tcttaatcccttataacgcgacatcttatcgcaatacgacatcgataacgaaatacttataccctatccgacgtattcgcgtcgaccgttcgaaaccactataatccgtcattccctcgtcatccgtatcctatctaaaatataccacctactttaaacaaatctacgataaataccaacgccatcgacccgctaatcataattcgcatccgtaaacctacccgctccgcgctttactccttcacctattacgtataactctaatactattacctactcgacgctactataaaaactatactccgataatattccgaatacttataaaaaactacaacgctaaacttatactaacgacaaacaataaaaaaaatctaatcacccgacgcgaaattaaacgtaaaatctacgaataaaaccaaaaataaaccgattaaccgcaatcatctacgctatcgttatctacctactaatttccataacctaaaccattaaccactaccgcgacaacgccatcacctacaaaaaccaacgcgacaaaaccaccaaaaatctccgcctaactaacgacaccatcaaaaacatacaaacccgtcaacgtaatatcgctacactaaataccaaatacaccgaaaaactaactaatacgaaaaaaaccattaaacgtctacataacgatatcattactaaccgtaaacgactacaaatcgccgccacctatacaaaatcaacgaccgaaaccaacaacataaacgataaaaaaaacccaaaacttacaacaaatactaaactcaattattaccgtctccgaaataaaatcgacaaaataaccgcgcaaat

SEQ ID NO: 16793 - DNA, 573 bp, Artificial Sequence
  chemically treated genomic DNA (Homo sapiens) CpG-island No: 16793
ggcgtacgttttttggtcgttagtaattgtattaggattattagtggatgcgtgatttcggtgaaagtttgttggtttatcgttcgtcgatcgatattcggttcggtgaaagaagtgataggttagaaatttaacggtaattaggaaaaagcgtttaattttttgacgtcgtattagaagtggggtatttattttatttatagcgataatttgttgatgttgattttaggtcgcggtggttcggtggtttggttgagtgaagtcgatgttaaagatttgggtatcgtcgataacgattggattgaagtttttaatagtaacggtgttttgattgttcgtgcggttgttagttagcgtgtttcggtagggatgattatgatgtattacgcgtaggaacgtatcgttaatttgtttggttcggaaattatttaatagcgtggtggtatttataattcggttattcgtattacgtcgaaatcgacgtatatgatcggcggttatgtttatttggtatacggttttaattattatggtatcgtaggttttaatcgcgatgagtttgttgtagtgcgt

SEQ ID NO: 16794 - DNA, 573 bp, Artificial Sequence
  chemically treated genomic DNA (Homo sapiens) CpG-island No: 16794
acgcactacaacaaactcatcgcgattaaaacctacgataccataataattaaaaccgtataccaaataaacataaccgccgatcatatacgtcgatttcgacgtaatacgaataaccgaattataaataccaccacgctattaaataatttccgaaccaaacaaattaacgatacgttcctacgcgtaatacatcataatcatccctaccgaaacacgctaactaacaaccgcacgaacaatcaaaacaccgttactattaaaaacttcaatccaatcgttatcgacgatacccaaatctttaacatcgacttcactcaaccaaaccaccgaaccaccgcgacctaaaatcaacatcaacaaattatcgctataaataaaataaataccccacttctaatacgacgtcaaaaaattaaacgctttttcctaattaccgttaaatttctaacctatcacttctttcaccgaaccgaatatcgatcgacgaacgataaaccaacaaactttcaccgaaatcacgcatccactaataatcctaatacaattactaacgaccaaaaaacgtacgcc

SEQ ID NO: 16795 - DNA, 573 bp, Artificial Sequence
  chemically treated genomic DNA (Homo sapiens) CpG-island No: 16795
acgtattataataaatttatcgcggttagaatttacggtgttatagtagttaaagtcgtatgttagatgggtatagtcgtcgattatatgcgtcggtttcggcgtgatacgggtgatcgagttatggatattattacgttgttgggtaattttcgaattaggtaggttaacgatacgtttttgcgcgtggtatattatggttatttttgtcggaatacgttggttgataatcgtacgggtagttagagtatcgttgttgttgaagattttaatttagtcgttatcggcgatatttagatttttggtatcggttttatttaattagattatcggattatcgcgatttaaagttagtattagtaggttgtcgttgtaggtggagtggatattttatttttggtgcggcgttaggaagttgagcgtttttttttggttgtcgttggatttttggtttattattttttttatcgaatcgggtgtcgatcggcggacgataaattagtaggtttttatcgaaattacgtatttattggtgattttgatatagttgttgacgattagagagcgtacgtt

SEQ ID NO: 16796 - DNA, 573 bp, Artificial Sequence
  chemically treated genomic DNA (Homo sapiens) CpG-island No: 16796
aacgtacgctctctaatcgtcaacaactatatcaaaatcaccaataaatacgtaatttcgataaaaacctactaatttatcgtccgccgatcgacacccgattcgataaaaaaaataataaaccaaaaatccaacgacaaccaaaaaaaaacgctcaacttcctaacgccgcaccaaaaataaaatatccactccacctacaacgacaacctactaatactaactttaaatcgcgataatccgataatctaattaaataaaaccgataccaaaaatctaaatatcgccgataacgactaaattaaaatcttcaacaacaacgatactctaactacccgtacgattatcaaccaacgtattccgacaaaaataaccataatataccacgcgcaaaaacgtatcgttaacctacctaattcgaaaattacccaacaacgtaataatatccataactcgatcacccgtatcacgccgaaaccgacgcatataatcgacgactatacccatctaacatacgactttaactactataacaccgtaaattctaaccgcgataaatttattataatacgt

SEQ ID NO: 16797 - DNA, 719 bp, Artificial Sequence
  chemically treated genomic DNA (Homo sapiens) CpG-island No: 16797
ttgttgtcgtcgtagaagacgtgtttttggcgtagggcgacgatgcgttcgtagtagcgtagggcgtaatttatttgatgtagcgtgacgattacggtgatgtcgtcgttttggttgatgtcgcgtagggtgtttattacgatgcgcgttgattttgggtttagcgaggcgatgggtttatcggttagaattattttcgtttgttgtattagcgtacgggtaatcgttatacgttgttgttggtcgtcggagagggtggaaacgcgttgatgggtaaaatgtattatgttaacgcgggttagcgtttgtaacgcgcgttgtttttgttcgtcggtgaattagttaaaataggtgcgttagaacggcgtgttgtcgagcgcgttaattagtacgttttttagtacgtttaggcggtttattaggttgaattgttggaatatgtagtcggtatgggcgcggtttttgcggatatcgcgggttaggcggttttcgcgttggaattgtttgcggataagcgttcgatatgggtatcgatagagttatcggcgcggaatagtattaggtatagtacgtataagggggattatcggagaacgagggttcgaagaggtttacgatatcggataagcgttatatacgacgtaagattgagcgtaatatagtagcgaggttttatacgataatagtgagtatagattataaaaggatatagagagaat

SEQ ID NO: 16798 - DNA, 719 bp, Artificial Sequence
  chemically treated genomic DNA (Homo sapiens) CpG-island No: 16798
attctctctatatccttttataatctatactcactattatcgtataaaacctcgctactatattacgctcaatcttacgtcgtatataacgcttatccgatatcgtaaacctcttcgaaccctcgttctccgataatcccccttatacgtactatacctaatactattccgcgccgataactctatcgatacccatatcgaacgcttatccgcaaacaattccaacgcgaaaaccgcctaacccgcgatatccgcaaaaaccgcgcccataccgactacatattccaacaattcaacctaataaaccgcctaaacgtactaaaaaacgtactaattaacgcgctcgacaacacgccgttctaacgcacctattttaactaattcaccgacgaacaaaaacaacgcgcgttacaaacgctaacccgcgttaacataatacattttacccatcaacgcgtttccaccctctccgacgaccaacaacaacgtataacgattacccgtacgctaatacaacaaacgaaaataattctaaccgataaacccatcgcctcgctaaacccaaaatcaacgcgcatcgtaataaacaccctacgcgacatcaaccaaaacgacgacatcaccgtaatcgtcacgctacatcaaataaattacgccctacgctactacgaacgcatcgtcgccctacgccaaaaacacgtcttctacgacgacaacaa

SEQ ID NO: 16799 - DNA, 719 bp, Artificial Sequence
  chemically treated genomic DNA (Homo sapiens) CpG-island No: 16799
attttttttatgtttttttatggtttgtatttattgttgtcgtgtgaggtttcgttattgtattgcgtttagttttgcgtcgtgtgtggcgtttgttcggtgtcgtgggttttttcgggttttcgtttttcggtaattttttttgtacgtattgtatttggtgttgtttcgcgtcgatgattttgtcggtatttatgtcgggcgtttgttcgtaagtagttttagcgcgaaggtcgtttggttcgcgatattcgtaaaagtcgcgtttatatcggttatatattttaataatttaatttggtgaatcgtttgagcgtattggagaacgtgttgattggcgcgttcggtagtacgtcgttttggcgtatttgttttagttggtttatcggcgagtagaaatagcgcgcgttataggcgttgattcgcgttggtatggtgtattttgtttattagcgcgtttttatttttttcggcggttagtagtaacgtgtggcgattgttcgtgcgttgatgtagtaggcgaaagtgattttggtcgatgaatttatcgtttcgttggatttagaattagcgcgtatcgtgatggatattttgcgcgatattaattagaacgacggtattatcgtggtcgttacgttgtattaggtggattacgttttgcgttattgcgaacgtatcgtcgttttgcgttaggggtacgttttttacgacggtagtag

SEQ ID NO: 16800 - DNA, 719 bp, Artificial Sequence
  chemically treated genomic DNA (Homo sapiens) CpG-island No: 16800
ctactaccgtcgtaaaaaacgtacccctaacgcaaaacgacgatacgttcgcaataacgcaaaacgtaatccacctaatacaacgtaacgaccacgataataccgtcgttctaattaatatcgcgcaaaatatccatcacgatacgcgctaattctaaatccaacgaaacgataaattcatcgaccaaaatcactttcgcctactacatcaacgcacgaacaatcgccacacgttactactaaccgccgaaaaaaataaaaacgcgctaataaacaaaatacaccataccaacgcgaatcaacgcctataacgcgcgctatttctactcgccgataaaccaactaaaacaaatacgccaaaacgacgtactaccgaacgcgccaatcaacacgttctccaatacgctcaaacgattcaccaaattaaattattaaaatatataaccgatataaacgcgacttttacgaatatcgcgaaccaaacgaccttcgcgctaaaactacttacgaacaaacgcccgacataaataccgacaaaatcatcgacgcgaaacaacaccaaatacaatacgtacaaaaaaaattaccgaaaaacgaaaacccgaaaaaacccacgacaccgaacaaacgccacacacgacgcaaaactaaacgcaatacaataacgaaacctcacacgacaacaataaatacaaaccataaaaaaacataaaaaaaat

SEQ ID NO: 16801 - DNA, 760 bp, Artificial Sequence
  chemically treated genomic DNA (Homo sapiens) CpG-island No: 16801
gtgtttgtgacggatgacggagtagggagtgaagtagtgattgataaagatttcgtcgttgcgttgttcgtcgagtagattaatgtagatggattggtgatttttatcgatgttgatgcggtatatgaaaattggggaacgtcgtagtaacgtgttattcgttatgttatatcggatgagttagcgttatttgttaaagtcgatggttcgatggggtcgaatgtaacggcggtgagtggttatgttagaagtcgtggtaaattcgcgtggattggggcgttatcgcgaattgaagagacgttggcgggcgaagcggggatttgtatttcgttgtagtcgtaggtattagatatttgtgtttgatgcgacgtttgacgcgttttattaggtttataatcggtgtcgtattcggtaattggtgtataatgtttgatgcgatgtttgacgtattttattaggtttataatgggtatcggatcggtaggtcggataaggcgtttacgtcgtattcggtaagaatagagtattagttaatcgaatttattttgcgtttaaattacgtcgttggtatatttcggcggtagtagcgggattaaggtttttagcgtcgtagttagacgcgatgtgtcgttgtcggttaaatttcgatgcgttagtttacgtttcggaagggattttttagtcgtattaggggcgattttttaggggaggtttagttaggtatattatatcggtttagtcgatgggttttacgggggat

SEQ ID NO: 16802 - DNA, 760 bp, Artificial Sequence
  chemically treated genomic DNA (Homo sapiens) CpG-island No: 16802
atcccccgtaaaacccatcgactaaaccgatataatatacctaactaaacctcccctaaaaaatcgcccctaatacgactaaaaaatcccttccgaaacgtaaactaacgcatcgaaatttaaccgacaacgacacatcgcgtctaactacgacgctaaaaaccttaatcccgctactaccgccgaaatataccaacgacgtaatttaaacgcaaaataaattcgattaactaatactctattcttaccgaatacgacgtaaacgccttatccgacctaccgatccgatacccattataaacctaataaaatacgtcaaacatcgcatcaaacattatacaccaattaccgaatacgacaccgattataaacctaataaaacgcgtcaaacgtcgcatcaaacacaaatatctaatacctacgactacaacgaaatacaaatccccgcttcgcccgccaacgtctcttcaattcgcgataacgccccaatccacgcgaatttaccacgacttctaacataaccactcaccgccgttacattcgaccccatcgaaccatcgactttaacaaataacgctaactcatccgatataacataacgaataacacgttactacgacgttccccaattttcatataccgcatcaacatcgataaaaatcaccaatccatctacattaatctactcgacgaacaacgcaacgacgaaatctttatcaatcactacttcactccctactccgtcatccgtcacaaacac

SEQ ID NO: 16803 - DNA, 760 bp, Artificial Sequence
  chemically treated genomic DNA (Homo sapiens) CpG-island No: 16803
atttttcgtgaagtttatcgattggatcgatgtgatatgtttggttgagttttttttggggaatcgtttttggtacgattaaggagtttttttcggggcgtaaattggcgtatcggaatttgatcgatagcgatatatcgcgtttgattgcgacgttggaagttttaatttcgttgttgtcgtcggaatatgttagcggcgtgatttgggcgtagagtaagttcggttaattggtgttttatttttgtcggatgcggcgtaaacgttttattcggtttatcgattcggtatttattgtaggtttgataagatgcgttaagtatcgtattaggtattgtgtattaattgtcggatgcggtatcggttgtaggtttgataagacgcgttaagcgtcgtattaggtataaatgtttaatgtttacgattatagcgaaatataggttttcgtttcgttcgttagcgtttttttaattcgcgataacgttttaatttacgcgggtttattacggtttttgatataattatttatcgtcgttatattcggttttatcgaattatcggttttggtaaatggcgttaatttattcggtgtggtatggcgaatggtacgttgttgcggcgttttttagtttttatatatcgtattagtatcggtgaggattattagtttatttgtattaatttgttcggcgagtaacgtagcggcgagatttttattaattattgttttattttttgtttcgttattcgttataggtat

SEQ ID NO: 16804 - DNA, 760 bp, Artificial Sequence
  chemically treated genomic DNA (Homo sapiens) CpG-island No: 16804
atacctataacgaataacgaaacaaaaaataaaacaataattaataaaaatctcgccgctacgttactcgccgaacaaattaatacaaataaactaataatcctcaccgatactaatacgatatataaaaactaaaaaacgccgcaacaacgtaccattcgccataccacaccgaataaattaacgccatttaccaaaaccgataattcgataaaaccgaatataacgacgataaataattatatcaaaaaccgtaataaacccgcgtaaattaaaacgttatcgcgaattaaaaaaacgctaacgaacgaaacgaaaacctatatttcgctataatcgtaaacattaaacatttatacctaatacgacgcttaacgcgtcttatcaaacctacaaccgataccgcatccgacaattaatacacaatacctaatacgatacttaacgcatcttatcaaacctacaataaataccgaatcgataaaccgaataaaacgtttacgccgcatccgacaaaaataaaacaccaattaaccgaacttactctacgcccaaatcacgccgctaacatattccgacgacaacaacgaaattaaaacttccaacgtcgcaatcaaacgcgatatatcgctatcgatcaaattccgatacgccaatttacgccccgaaaaaaactccttaatcgtaccaaaaacgattccccaaaaaaaactcaaccaaacatatcacatcgatccaatcgataaacttcacgaaaaat

SEQ ID NO: 16805 - DNA, 661 bp, Artificial Sequence
  chemically treated genomic DNA (Homo sapiens) CpG-island No: 16805
tagtgtttttgattaattattagcgggtttagttgacggttggtggagtttagcgggttaacggtcgggtagatatttagagacgcgatttgacggtttagtattacggttgcgttaaggtgcgtaaaggtggttgtcggagacgggttagttaagttattcgtaggtacgtatattgtttgtacggaggtgatagaattagttttggtggaggtgatacgtttttgtagaacgtttatttttttcgttagggtcgggtgataatttaacggtgaaggtatacggtttagtagtgcggatattttcgtatcggttaggtgtaacgatagatgttgttaacgaatagtagaacgttacgattttcgttacggaattttttagttatggttagatcggttagagtaacgcgtagacggtttttcggcggttcgtttatttggttatatattagggatattttgtcgataacgttggagtcggttatttcgtggtagaagtcgttatttttacgagtacgtttatttacgttcgtaaatatagagtaatcggagtgttcgatcgcgatgttacgaatgagttttattatgtttacggttttatttatattcgtattatcgaatagattaattttatcgtttttagcgaacggatatattaggtt

SEQ ID NO: 16806 - DNA, 661 bp, Artificial Sequence
  chemically treated genomic DNA (Homo sapiens) CpG-island No: 16806
aacctaatatatccgttcgctaaaaacgataaaattaatctattcgataatacgaatataaataaaaccgtaaacataataaaactcattcgtaacatcgcgatcgaacactccgattactctatatttacgaacgtaaataaacgtactcgtaaaaataacgacttctaccacgaaataaccgactccaacgttatcgacaaaatatccctaatatataaccaaataaacgaaccgccgaaaaaccgtctacgcgttactctaaccgatctaaccataactaaaaaattccgtaacgaaaatcgtaacgttctactattcgttaacaacatctatcgttacacctaaccgatacgaaaatatccgcactactaaaccgtataccttcaccgttaaattatcacccgaccctaacgaaaaaaataaacgttctacaaaaacgtatcacctccaccaaaactaattctatcacctccgtacaaacaatatacgtacctacgaataacttaactaacccgtctccgacaaccacctttacgcaccttaacgcaaccgtaatactaaaccgtcaaatcgcgtctctaaatatctacccgaccgttaacccgctaaactccaccaaccgtcaactaaacccgctaataattaatcaaaaacacta

SEQ ID NO: 16807 - DNA, 661 bp, Artificial Sequence
  chemically treated genomic DNA (Homo sapiens) CpG-island No: 16807
gatttgatgtgttcgttcgttaagggcggtaaagttggtttgttcggtggtgcgggtgtaggtaaaatcgtaaatatgatggagtttattcgtaatatcgcgatcgagtatttcggttattttgtgtttgcgggcgtaggtgaacgtattcgtgagggtaacgatttttattacgaaatgatcgattttaacgttatcgataaagtatttttggtgtatggttagatgaacgagtcgtcgggaaatcgtttgcgcgttgttttgatcggtttgattatggttgagaaatttcgtgacgaaggtcgtgacgttttgttgttcgttgataatatttatcgttatatttggtcggtacggaagtattcgtattgttgggtcgtatgtttttatcgttaggttattattcgattttggcggaagagatgggcgttttgtaggaacgtattatttttattaaaattggttttattattttcgtataggtagtatacgtatttgcggatgatttgattgattcgttttcggtaattatttttgcgtattttgacgtaatcgtggtattgagtcgttagatcgcgtttttgggtatttattcggtcgttgattcgttggattttattagtcgttagttggattcgttggtggttggttaggaatatta

SEQ ID NO: 16808 - DNA, 661 bp, Artificial Sequence
  chemically treated genomic DNA (Homo sapiens) CpG-island No: 16808
taatattcctaaccaaccaccaacgaatccaactaacgactaataaaatccaacgaatcaacgaccgaataaatacccaaaaacgcgatctaacgactcaataccacgattacgtcaaaatacgcaaaaataattaccgaaaacgaatcaatcaaatcatccgcaaatacgtatactacctatacgaaaataataaaaccaattttaataaaaataatacgttcctacaaaacgcccatctcttccgccaaaatcgaataataacctaacgataaaaacatacgacccaacaatacgaatacttccgtaccgaccaaatataacgataaatattatcaacgaacaacaaaacgtcacgaccttcgtcacgaaatttctcaaccataatcaaaccgatcaaaacaacgcgcaaacgatttcccgacgactcgttcatctaaccatacaccaaaaatactttatcgataacgttaaaatcgatcatttcgtaataaaaatcgttaccctcacgaatacgttcacctacgcccgcaaacacaaaataaccgaaatactcgatcgcgatattacgaataaactccatcatatttacgattttacctacacccgcaccaccgaacaaaccaactttaccgcccttaacgaacgaacacatcaaatc

SEQ ID NO: 16809 - DNA, 610 bp, Artificial Sequence
  chemically treated genomic DNA (Homo sapiens) CpG-island No: 16809
  misc_feature (604)..(604): n is either a, c, g or t
ttattggcgatagtgagttagtcgtagcgaaagtgtgttatgaagtggggttggacgcgggagaggtggttattggtaatgatatcgaaacgttatttgacgacgaattggtaaatcgtgtatagcgtattacgttgtttgttcgtttgacgtcgatgtataaagaacgtagttgtgattttattgaatcgcgaagggtatgtggaaggttgaatgcgcgagggttaaaatgatgcgttcgtttgacgcgtaggcggatttcggtattattgtgggacggcgtagaagatatagtcgtgaagcggtatgttattatttggcgggaatatagatttgatggagcggatagaaggggtaagtagggaacgtcgtaattacgtagtatgttgtagtttttaaagggcggagtattatatcggacgggtatcggcgaggataggtatatagttatcgggagtgcgaaaataattcgacgggttaatgacgggtaacgagaaggataaatatatacggacgacggacgggttaaatgtagattataaatgagtagggtaataaataatatgtggtgttggttgcgtgcgttgaaggttcgtgttaatgnaaaata

SEQ ID NO: 16810 - DNA, 610 bp, Artificial Sequence
  chemically treated genomic DNA (Homo sapiens) CpG-island No: 16810
  misc_feature (7)..(7): n is either a, c, g or t
tattttncattaacacgaaccttcaacgcacgcaaccaacaccacatattatttattaccctactcatttataatctacatttaacccgtccgtcgtccgtatatatttatccttctcgttacccgtcattaacccgtcgaattattttcgcactcccgataactatatacctatcctcgccgatacccgtccgatataatactccgccctttaaaaactacaacatactacgtaattacgacgttccctacttaccccttctatccgctccatcaaatctatattcccgccaaataataacataccgcttcacgactatatcttctacgccgtcccacaataataccgaaatccgcctacgcgtcaaacgaacgcatcattttaaccctcgcgcattcaaccttccacatacccttcgcgattcaataaaatcacaactacgttctttatacatcgacgtcaaacgaacaaacaacgtaatacgctatacacgatttaccaattcgtcgtcaaataacgtttcgatatcattaccaataaccacctctcccgcgtccaaccccacttcataacacactttcgctacgactaactcactatcgccaataa

SEQ ID NO: 16811 - DNA, 610 bp, Artificial Sequence
  chemically treated genomic DNA (Homo sapiens) CpG-island No: 16811
  misc_feature (7)..(7): n is either a, c, g or t
tgttttntattaatacggatttttaacgtacgtagttaatattatatgttgtttgttattttgtttatttgtggtttgtatttggttcgttcgtcgttcgtgtgtgtttgtttttttcgttgttcgttattggttcgtcgaattattttcgtattttcggtggttgtatgtttgttttcgtcggtgttcgttcggtgtagtgtttcgttttttgaggattgtagtatgttgcgtagttgcgacgttttttgtttgttttttttgttcgttttattaggtttgtgttttcgttagatgatagtatgtcgttttacggttatattttttgcgtcgttttatagtagtgtcgagattcgtttgcgcgttaggcgggcgtattattttgattttcgcgtatttagttttttatatgtttttcgcggtttagtaaggttataattgcgttttttatgtatcggcgttaggcgggtagatagcgtggtacgttgtgtacgatttgttagttcgtcgttagatagcgtttcgatattattattaatgattatttttttcgcgtttagttttattttatggtatattttcgttgcgattgatttattgtcgttagtaa

SEQ ID NO: 16812 - DNA, 610 bp, Artificial Sequence
  chemically treated genomic DNA (Homo sapiens) CpG-island No: 16812
  misc_feature (604)..(604): n is either a, c, g or t
ttactaacgacaataaatcaatcgcaacgaaaatataccataaaataaaactaaacgcgaaaaaaataatcattaataataatatcgaaacgctatctaacgacgaactaacaaatcgtacacaacgtaccacgctatctacccgcctaacgccgatacataaaaaacgcaattataaccttactaaaccgcgaaaaacatataaaaaactaaatacgcgaaaatcaaaataatacgcccgcctaacgcgcaaacgaatctcgacactactataaaacgacgcaaaaaatataaccgtaaaacgacatactatcatctaacgaaaacacaaacctaataaaacgaacaaaaaaaacaaacaaaaaacgtcgcaactacgcaacatactacaatcctcaaaaaacgaaacactacaccgaacgaacaccgacgaaaacaaacatacaaccaccgaaaatacgaaaataattcgacgaaccaataacgaacaacgaaaaaaacaaacacacacgaacgacgaacgaaccaaatacaaaccacaaataaacaaaataacaaacaacatataatattaactacgtacgttaaaaatccgtattaatanaaaaca

SEQ ID NO: 16813 - DNA, 543 bp, Artificial Sequence
  chemically treated genomic DNA (Homo sapiens) CpG-island No: 16813
tcgtatcgtcgtgtttttcggtttaagttttaatattcgggcgaattgggcgtgtttattagttcggtagtatgaattattattcgttagttattttattggagacgacggaagatcgttgtcgaagcggcgttttatcggtttttagtatgacgttttgtattgttttattgttgaagtcgtcggtagtgatcgtttagtgtagtgttttacgattatagtagtttagcgcgaacgtgatacgtagttttttttcgttattatagtagattcgaattcgttagagtattatcgttgatgtttttttttacgggttatatttgttattagtatagtgtttcgtattcgatggcggtatagtaggttttcgtttaagtaatagcgtattttggcgtatgattcgtaatacgtttggtattgatcgtagtaattattaattttgtcgtttgcgaagtagcgtttatattcgacgataattatacgttggtagtttttcgataatataggtgtaatatcggagaagtatattttagtattattacg

SEQ ID NO: 16814 - DNA, 543 bp, Artificial Sequence
  chemically treated genomic DNA (Homo sapiens) CpG-island No: 16814
cgtaataatactaaaatatacttctccgatattacacctatattatcgaaaaactaccaacgtataattatcgtcgaatataaacgctacttcgcaaacgacaaaattaataattactacgatcaataccaaacgtattacgaatcatacgccaaaatacgctattacttaaacgaaaacctactataccgccatcgaatacgaaacactatactaataacaaatataacccgtaaaaaaaaacatcaacgataatactctaacgaattcgaatctactataataacgaaaaaaaactacgtatcacgttcgcgctaaactactataatcgtaaaacactacactaaacgatcactaccgacgacttcaacaataaaacaatacaaaacgtcatactaaaaaccgataaaacgccgcttcgacaacgatcttccgtcgtctccaataaaataactaacgaataataattcatactaccgaactaataaacacgcccaattcgcccgaatattaaaacttaaaccgaaaaacacgacgatacga

SEQ ID NO: 16815 - DNA, 543 bp, Artificial Sequence
  chemically treated genomic DNA (Homo sapiens) CpG-island No: 16815
cgtgatgatattgagatgtgttttttcgatattatatttatgttatcggagagttgttaacgtatggttatcgtcgggtatgggcgttgtttcgtagacggtagaattgatggttgttgcgattaatgttaaacgtgttacggattatgcgttagaatgcgttgttgtttgagcgaaaatttgttgtatcgttatcgaatacggggtattatattagtggtagatgtggttcgtgaaagaaagtattagcgatggtgttttgacgggttcgagtttgttgtgataacggagagagattgcgtgttacgttcgcgttggattgttgtgatcgtgaggtattgtattgggcggttattatcggcggttttaatagtgaaatagtataggacgttatgttgggagtcggtggaacgtcgtttcggtaacgatttttcgtcgtttttagtggagtggttgacggataatggtttatgttatcgggttaatgaatacgtttagttcgttcgaatgttgggatttgaatcgaagaatacggcggtgcgg

SEQ ID NO: 16816 - DNA, 543 bp, Artificial Sequence
  chemically treated genomic DNA (Homo sapiens) CpG-island No: 16816
ccgcaccgccgtattcttcgattcaaatcccaacattcgaacgaactaaacgtattcattaacccgataacataaaccattatccgtcaaccactccactaaaaacgacgaaaaatcgttaccgaaacgacgttccaccgactcccaacataacgtcctatactatttcactattaaaaccgccgataataaccgcccaatacaatacctcacgatcacaacaatccaacgcgaacgtaacacgcaatctctctccgttatcacaacaaactcgaacccgtcaaaacaccatcgctaatactttctttcacgaaccacatctaccactaatataataccccgtattcgataacgatacaacaaattttcgctcaaacaacaacgcattctaacgcataatccgtaacacgtttaacattaatcgcaacaaccatcaattctaccgtctacgaaacaacgcccatacccgacgataaccatacgttaacaactctccgataacataaatataatatcgaaaaaacacatctcaatatcatcacg

SEQ ID NO: 16817 - DNA, 916 bp, Artificial Sequence
  chemically treated genomic DNA (Homo sapiens) CpG-island No: 16817
ttcggtcgttagcgggtaaaggtttgagcgtcgtagttttagtcgttggagttgattagttttttttttttttttaacgtgttacgtatcgcgttatcgaaagcgattagtcgttgtgggatgagtgtacgtagcgcggtattattcgttagtagatcgtgttttagtttttgaattaacgttttggcggtggtgggcggtacggaagtaattatattgagaaattatatcgaaatttagcgggtggggagggggatggggattaattagcggcgtttatcgtttatcgttataaaatgtttaaattgttgttgataattgagtatttttggttcggcggtttcgaagatgcggtgttcgttggtcggatgatttaataacgtaattagatagtgtagtaagttttttagcgtaatgggcgtggtgcgtgaacgaatttagcgcggaggcgttaagattggtaggttgtagattatatcgcgtatgatttcgaacgtcgcggaatttgcgttaacgataatttcggttcgtagttcggttacgggtatattcgttttacgtagaatgttcgtcgtagtttgacgagtacgtagatgattcgattgtttatgtggcggggtttgtaacgaattaagaaagattaattgtttaattggtattttacgtagcgtatcgcggacgttgagagttatttggcgttttttgagcgataaaatcgtcgttttcgtttatgttgtgtattagaaaatagatcgtatcgatattttgtaatagggtcggtaggttattcggttagttgagatcgattttatggtaattgacgttttgttagttgtagtttttgtaagtttgtcgatatgacgtgtcgtcgttaggatttgatgttttttgttggttgatttgtgcgtatttagat

SEQ ID NO: 16818 - DNA, 916 bp, Artificial Sequence
  chemically treated genomic DNA (Homo sapiens) CpG-island No: 16818
atctaaatacgcacaaatcaaccaacaaaaaacatcaaatcctaacgacgacacgtcatatcgacaaacttacaaaaactacaactaacaaaacgtcaattaccataaaatcgatctcaactaaccgaataacctaccgaccctattacaaaatatcgatacgatctattttctaatacacaacataaacgaaaacgacgattttatcgctcaaaaaacgccaaataactctcaacgtccgcgatacgctacgtaaaataccaattaaacaattaatctttcttaattcgttacaaaccccgccacataaacaatcgaatcatctacgtactcgtcaaactacgacgaacattctacgtaaaacgaatatacccgtaaccgaactacgaaccgaaattatcgttaacgcaaattccgcgacgttcgaaatcatacgcgatataatctacaacctaccaatcttaacgcctccgcgctaaattcgttcacgcaccacgcccattacgctaaaaaacttactacactatctaattacgttattaaatcatccgaccaacgaacaccgcatcttcgaaaccgccgaaccaaaaatactcaattatcaacaacaatttaaacattttataacgataaacgataaacgccgctaattaatccccatccccctccccacccgctaaatttcgatataatttctcaatataattacttccgtaccgcccaccaccgccaaaacgttaattcaaaaactaaaacacgatctactaacgaataataccgcgctacgtacactcatcccacaacgactaatcgctttcgataacgcgatacgtaacacgttaaaaaaaaaaaaaaaactaatcaactccaacgactaaaactacgacgctcaaacctttacccgctaacgaccgaa

SEQ ID NO: 16819 - DNA, 916 bp, Artificial Sequence
  chemically treated genomic DNA (Homo sapiens) CpG-island No: 16819
atttgggtgcgtataggttagttagtaaggggtattagattttggcggcggtacgttatgtcgataggtttgtaaaggttgtaattggtaaagcgttagttgttatgaagtcgattttagttggtcggataatttatcggttttgttgtaggatatcgatacggtttattttttggtgtatagtatgggcgaaggcggcgattttatcgtttaggaggcgttaggtggtttttaacgttcgcgatgcgttacgtgaagtattagttaagtaattaattttttttagttcgttgtaggtttcgttatatgagtagtcggattatttgcgtgttcgttaggttacggcggatattttgcgtgaagcgaatgtattcgtgatcgaattgcgggtcggaattatcgttggcgtaggtttcgcggcgttcgaagttatgcgcgatatggtttataatttgttagttttaacgttttcgcgttgggttcgtttacgtattacgtttattgcgttggaaaatttgttgtattatttggttgcgttgttagattattcggttagcgaatatcgtattttcgaagtcgtcggattagaggtgtttagttattagtaatagtttgaatattttatggcggtgagcggtaagcgtcgttggttgatttttatttttttttttattcgttggatttcggtgtggttttttaatgtgattattttcgtatcgtttattatcgttagggcgttgatttaggggttgaaatacgatttgttggcggatgatatcgcgttacgtgtatttattttataacggttgatcgttttcgatgacgcggtacgtagtacgttgaaagaggaggaaaaattggttaattttagcgattggggttacgacgtttaggtttttgttcgttggcgatcgga

SEQ ID NO: 16820 - DNA, 916 bp, Artificial Sequence
  chemically treated genomic DNA (Homo sapiens) CpG-island No: 16820
tccgatcgccaacgaacaaaaacctaaacgtcgtaaccccaatcgctaaaattaaccaatttttcctcctctttcaacgtactacgtaccgcgtcatcgaaaacgatcaaccgttataaaataaatacacgtaacgcgatatcatccgccaacaaatcgtatttcaacccctaaatcaacgccctaacgataataaacgatacgaaaataatcacattaaaaaaccacaccgaaatccaacgaataaaaaaaaaaataaaaatcaaccaacgacgcttaccgctcaccgccataaaatattcaaactattactaataactaaacacctctaatccgacgacttcgaaaatacgatattcgctaaccgaataatctaacaacgcaaccaaataatacaacaaattttccaacgcaataaacgtaatacgtaaacgaacccaacgcgaaaacgttaaaactaacaaattataaaccatatcgcgcataacttcgaacgccgcgaaacctacgccaacgataattccgacccgcaattcgatcacgaatacattcgcttcacgcaaaatatccgccgtaacctaacgaacacgcaaataatccgactactcatataacgaaacctacaacgaactaaaaaaaattaattacttaactaatacttcacgtaacgcatcgcgaacgttaaaaaccacctaacgcctcctaaacgataaaatcgccgccttcgcccatactatacaccaaaaaataaaccgtatcgatatcctacaacaaaaccgataaattatccgaccaactaaaatcgacttcataacaactaacgctttaccaattacaacctttacaaacctatcgacataacgtaccgccgccaaaatctaataccccttactaactaacctatacgcacccaaat

SEQ ID NO: 16821 - DNA, 624 bp, Artificial Sequence
  chemically treated genomic DNA (Homo sapiens) CpG-island No: 16821
gtggcgatattcgttagcggtggcgcgtagttcgggcgttttattattacgcgttgggtcgttagtaagcgtgtaggttttagtaatttatcggtattaagattcggttttattagcgattgaaagatacgtatttttttttttattagcgcgtttttttgtttatgcgggaatatcgggtcgagataaattatttgcgggcgcggggtaatattagttagcgtcgttaggttggaggcgtgaattaattgtaatcgtttttgtaattagtcgtcgattttcgtattcgtataattacgcgttaggtcgtcgtcgagtagcgcggtaattattggattacgttttagtattcgtacgcggtagtcgattgaagttagtataaaggtatcgcgtttaagttttgtagtggtatttattatattcggtaaataatcgtttttaatgtttatcgttttcgttatcgttttatcgcgattatcgtcgaatttgcgtcggtgcgttatcgtttcgataataaaattaataaagatgtcgttaagttttggtttattacgtttgcgtaaattttagatgtttcgggggttatattaggttattaggttgtttttattcgtgttttagttt

SEQ ID NO: 16822 - DNA, 624 bp, Artificial Sequence
  chemically treated genomic DNA (Homo sapiens) CpG-island No: 16822
aaactaaaacacgaataaaaacaacctaataacctaatataacccccgaaacatctaaaatttacgcaaacgtaataaaccaaaacttaacgacatctttattaattttattatcgaaacgataacgcaccgacgcaaattcgacgataatcgcgataaaacgataacgaaaacgataaacattaaaaacgattatttaccgaatataataaataccactacaaaacttaaacgcgatacctttatactaacttcaatcgactaccgcgtacgaatactaaaacgtaatccaataattaccgcgctactcgacgacgacctaacgcgtaattatacgaatacgaaaatcgacgactaattacaaaaacgattacaattaattcacgcctccaacctaacgacgctaactaatattaccccgcgcccgcaaataatttatctcgacccgatattcccgcataaacaaaaaaacgcgctaataaaaaaaaaaatacgtatctttcaatcgctaataaaaccgaatcttaataccgataaattactaaaacctacacgcttactaacgacccaacgcgtaataataaaacgcccgaactacgcgccaccgctaacgaatatcgccac

SEQ ID NO: 16823 - DNA, 624 bp, Artificial Sequence
  chemically treated genomic DNA (Homo sapiens) CpG-island No: 16823
gggttggagtacggatgaggataatttgatggtttggtgtaattttcggaatatttggaatttgcgtaagcgtgatgagttaaaatttggcggtatttttgttgattttgttgtcggagcgatggcgtatcgacgtaaattcggcggtggtcgcggtgaggcggtggcgaaagcggtgggtattaaaggcgattatttgtcggatgtggtggatgttattgtaggatttgggcgcgatgtttttgtattggttttagtcggttgtcgcgtgcggatgttggagcgtaatttagtggttgtcgcgttattcgacgacggtttggcgcgtggttatgcggatgcggaaatcggcggttggttgtaggagcggttgtagttaatttacgtttttagtttgacggcgttgattgatattatttcgcgttcgtaggtggtttatttcgattcgatgttttcgtataagtagaaaagcgcgttagtgaaaaaagagatgcgtgttttttagtcgttggtgggatcggattttgatgtcgatggattattggagtttgtacgtttgttggcgatttaacgcgtggtggtaaagcgttcggattacgcgttatcgttggcgaatgtcgttat

SEQ ID NO: 16824 - DNA, 624 bp, Artificial Sequence
  chemically treated genomic DNA (Homo sapiens) CpG-island No: 16824
ataacgacattcgccaacgataacgcgtaatccgaacgctttaccaccacgcgttaaatcgccaacaaacgtacaaactccaataatccatcgacatcaaaatccgatcccaccaacgactaaaaaacacgcatctcttttttcactaacgcgcttttctacttatacgaaaacatcgaatcgaaataaaccacctacgaacgcgaaataatatcaatcaacgccgtcaaactaaaaacgtaaattaactacaaccgctcctacaaccaaccgccgatttccgcatccgcataaccacgcgccaaaccgtcgtcgaataacgcgacaaccactaaattacgctccaacatccgcacgcgacaaccgactaaaaccaatacaaaaacatcgcgcccaaatcctacaataacatccaccacatccgacaaataatcgcctttaatacccaccgctttcgccaccgcctcaccgcgaccaccgccgaatttacgtcgatacgccatcgctccgacaacaaaatcaacaaaaataccgccaaattttaactcatcacgcttacgcaaattccaaatattccgaaaattacaccaaaccatcaaattatcctcatccgtactccaaccc

SEQ ID NO: 16825 - DNA, 805 bp, Artificial Sequence
  chemically treated genomic DNA (Homo sapiens) CpG-island No: 16825
tcggggtacgtattggtgtttttatcggcgtggtttgttcggtgtgtttcggcggagtgacgttcggttattcggttaattttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtagggtcgtggtggttgttcggatggtgtgagcgggtgtcggaaagcggatgaggtgtttgttgcgtcgatgacggcgatcgggtattgatcgggttgggtggatcgagttataggcgtataatagacgtttatacggaaaatcggtcggtgaaaatatacggggaataatcgggtgaacgaggggttacgggaaaatcggagtggtattgatttcgattaggttacggggaaaaaaaatcgagaggttaacgaggggaggaaagcggcgtgcgaagaatagtagggcgtcgataaaattagggtaaagagtatttgtatcggagtgtataatatata

SEQ ID NO: 16826 - DNA, 805 bp, Artificial Sequence
  chemically treated genomic DNA (Homo sapiens) CpG-island No: 16826
tatatattatacactccgatacaaatactctttaccctaattttatcgacgccctactattcttcgcacgccgctttcctcccctcgttaacctctcgattttttttccccgtaacctaatcgaaatcaataccactccgattttcccgtaacccctcgttcacccgattattccccgtatattttcaccgaccgattttccgtataaacgtctattatacgcctataactcgatccacccaacccgatcaatacccgatcgccgtcatcgacgcaacaaacacctcatccgctttccgacacccgctcacaccatccgaacaaccaccacgaccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaaccacgccgataaaaacaccaatacgtaccccga

SEQ ID NO: 16827 - DNA, 805 bp, Artificial Sequence
  chemically treated genomic DNA (Homo sapiens) CpG-island No: 16827
tgtgtgttgtatatttcgatgtaggtgttttttgttttgattttgtcggcgttttgttgtttttcgtacgtcgttttttttttttcgttggtttttcggtttttttttttcgtggtttggtcggggttagtattatttcggttttttcgtggtttttcgtttattcggttgtttttcgtgtgtttttatcggtcggtttttcgtgtgaacgtttgttgtgcgtttgtaattcggtttatttagttcggttagtattcggtcgtcgttatcggcgtagtaagtattttattcgtttttcggtattcgtttatattattcgagtagttattacggttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtaggggattgatcggatggtcggacgttatttcgtcggggtatatcgaataggttacgtcggtgggggtattaatacgtatttcgg

SEQ ID NO: 16828 - DNA, 805 bp, Artificial Sequence
  chemically treated genomic DNA (Homo sapiens) CpG-island No: 16828
ccgaaatacgtattaatacccccaccgacgtaacctattcgatataccccgacgaaataacgtccgaccatccgatcaatcccctactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaccgtaataactactcgaataatataaacgaataccgaaaaacgaataaaatacttactacgccgataacgacgaccgaatactaaccgaactaaataaaccgaattacaaacgcacaacaaacgttcacacgaaaaaccgaccgataaaaacacacgaaaaacaaccgaataaacgaaaaaccacgaaaaaaccgaaataatactaaccccgaccaaaccacgaaaaaaaaaaaccgaaaaaccaacgaaaaaaaaaaaacgacgtacgaaaaacaacaaaacgccgacaaaatcaaaacaaaaaacacctacatcgaaatatacaacacaca

SEQ ID NO: 16829 - DNA, 542 bp, Artificial Sequence
  chemically treated genomic DNA (Homo sapiens) CpG-island No: 16829
tttaaaaacggtaaggtaaaatcgcgtcgggcgcgtacgtattgaagcgggtacgtaaacgtaacgggaaaaacgcgggtaagcgcggcggaggtattgggcggaaaatattatacgacggaaattgacgaaatagaagggggaacgagagacggagggaacggggaaggagaacgttggagggacgaggagggggatagggatcggttacgatcgcgtatcggacggattaggagggcgaatcggacggagagggagcggcggataacggatcggtatatcgaggggggaacggcgagggacgaggatcggggtatcggacgggattaagtatcggcgaatacggttttcggtattacgtaacgcgggtatcgtaagggaaacgaaagcgtaatagaagggagaaacgagaaggatagggtagggatatcgaggatatttacgtcggagagtatcggagggtataaggaacgcgaaaaaaaaggaggggggaggaataggggggaaaagaaaggaagaggatagcgacgagaaagaaagga

SEQ ID NO: 16830 - DNA, 542 bp, Artificial Sequence
  chemically treated genomic DNA (Homo sapiens) CpG-island No: 16830
tcctttctttctcgtcgctatcctcttcctttcttttcccccctattcctcccccctccttttttttcgcgttccttataccctccgatactctccgacgtaaatatcctcgatatccctaccctatccttctcgtttctcccttctattacgctttcgtttcccttacgatacccgcgttacgtaataccgaaaaccgtattcgccgatacttaatcccgtccgataccccgatcctcgtccctcgccgttcccccctcgatataccgatccgttatccgccgctccctctccgtccgattcgccctcctaatccgtccgatacgcgatcgtaaccgatccctatccccctcctcgtccctccaacgttctccttccccgttccctccgtctctcgttcccccttctatttcgtcaatttccgtcgtataatattttccgcccaatacctccgccgcgcttacccgcgtttttcccgttacgtttacgtacccgcttcaatacgtacgcgcccgacgcgattttaccttaccgtttttaaa

SEQ ID NO: 16831 - DNA, 542 bp, Artificial Sequence
  chemically treated genomic DNA (Homo sapiens) CpG-island No: 16831
ttttttttttttcgtcgttgttttttttttttttttttttttttgttttttttttttttttttttttcgcgttttttgtgtttttcggtgtttttcggcgtgggtgttttcggtgtttttgttttgtttttttcgttttttttttttgttgcgttttcgttttttttgcggtgttcgcgttgcgtggtgtcgggggtcgtgttcgtcggtgtttggtttcgttcggtgtttcggttttcgtttttcgtcgtttttttttcggtgtgtcggttcgttgttcgtcgtttttttttcgttcggttcgtttttttggttcgttcggtgcgcggtcgtggtcggtttttgttttttttttcgtttttttagcgtttttttttttcgtttttttcgtttttcgtttttttttttgtttcgttagttttcgtcgtgtggtgtttttcgtttaatgttttcgtcgcgtttgttcgcgtttttttcgttgcgtttgcgtgttcgttttagtgcgtgcgcgttcggcgcggttttgttttgtcgtttttgag

SEQ ID NO: 16832 - DNA, 542 bp, Artificial Sequence
  chemically treated genomic DNA (Homo sapiens) CpG-island No: 16832
ctcaaaaacgacaaaacaaaaccgcgccgaacgcgcacgcactaaaacgaacacgcaaacgcaacgaaaaaaacgcgaacaaacgcgacgaaaacattaaacgaaaaacaccacacgacgaaaactaacgaaacaaaaaaaaaaacgaaaaacgaaaaaaacgaaaaaaaaaaacgctaaaaaaacgaaaaaaaaaacaaaaaccgaccacgaccgcgcaccgaacgaaccaaaaaaacgaaccgaacgaaaaaaaaacgacgaacaacgaaccgacacaccgaaaaaaaaacgacgaaaaacgaaaaccgaaacaccgaacgaaaccaaacaccgacgaacacgacccccgacaccacgcaacgcgaacaccgcaaaaaaaacgaaaacgcaacaaaaaaaaaaaacgaaaaaaacaaaacaaaaacaccgaaaacacccacgccgaaaaacaccgaaaaacacaaaaaacgcgaaaaaaaaaaaaaaaaaaaaaacaaaaaaaaaaaaaaaaaaaaaaaacaacgacgaaaaaaaaaaaa

SEQ ID NO: 16833 - DNA, 1335 bp, Artificial Sequence
  chemically treated genomic DNA (Homo sapiens) CpG-island No: 16833
ttggcggcggggttttttcggttcggttcgcggcgtttttttgtcgtcgtttcggggtgtttttgtttcgttgcgagttcggtatcgcggcgacggcggcgcgaagagggaagcgggcggcggcggcggtcgcgttaagatgcgtcgggttatcgtaggttgaggcgttcgtcgttttcgttttttttttcgttcgtttttttttttttcgtttgtttttttcgttcgttcgtttttttttttttttcgtttttttttcgcgttttttcgttcgttttttcgcgtttcgtttttttcgtttcgcgttttgcggtgttgtagttgcgggcggttttagttgtttttagatgtgggttgggcggttcgcggggaattttcgcgtcggttgcgagtgcggggtttcggttgtagttcggttgttatggattcgtcggcgggagtcgttcgtcgtttgttttgtttcgcgttgttgttgttgttgttgttgttgtcgtcgtcgtttttgtcgtcgtcgtcgtcgttcgcgaacgttaggttcgtcgtcgtcgtcgattttttaggtaggtgcggttcggtttttatttttcgggattttcgtcggtttggttttgtttcgcgtgtttcgtcgttttttttttaggcgtcgtttagtttgatttgggtaaatttcgcgcgtttcgttcggggttaagttggttaatttcggggtcgggttggtcgcgtagggggcgtttcgtatcgttttcgagcgttttgggtcgggggagtttcggagtattggcggtttttgagtcgcggagggtggggacggagggtcgggaaaagtttcgcggttaagagcgtagagttagttttagcgggttcgaggggggagttagggcgaggcggcgtcggggttcgcgttcggggacgtttcggaggagtcggttgtcgagcgcgtagttttgggttttaaggattggttggggcgtttcgtagggaattttcggagatcggagggattttgttttattttttttagttttcgggcgttcggggagacggggtcggtagcgggttgagcgggagttggataggtaggataggtcgttcgtgttcggggaagtcgagatttcgtcgtttcggaggttggcggtgagggtattcgggcggtaggggttcgtcgaggggtcgtggtatacgggtaagggggttaattcggaatggttttcgagtagttttacgttttgttaaggacggtaggtgtaagggtcgggggattttttgacggggtcgttttttcgggtacggggaggtttttatcgagttttaattttgaacggggtagggggtaga

SEQ ID NO: 16834 - DNA, 1335 bp, Artificial Sequence
  chemically treated genomic DNA (Homo sapiens) CpG-island No: 16834
tctaccccctaccccgttcaaaattaaaactcgataaaaacctccccgtacccgaaaaaacgaccccgtcaaaaaatcccccgacccttacacctaccgtccttaacaaaacgtaaaactactcgaaaaccattccgaattaacccccttacccgtataccacgacccctcgacgaacccctaccgcccgaataccctcaccgccaacctccgaaacgacgaaatctcgacttccccgaacacgaacgacctatcctacctatccaactcccgctcaacccgctaccgaccccgtctccccgaacgcccgaaaactaaaaaaaataaaacaaaatccctccgatctccgaaaattccctacgaaacgccccaaccaatccttaaaacccaaaactacgcgctcgacaaccgactcctccgaaacgtccccgaacgcgaaccccgacgccgcctcgccctaactcccccctcgaacccgctaaaactaactctacgctcttaaccgcgaaacttttcccgaccctccgtccccaccctccgcgactcaaaaaccgccaatactccgaaactcccccgacccaaaacgctcgaaaacgatacgaaacgccccctacgcgaccaacccgaccccgaaattaaccaacttaaccccgaacgaaacgcgcgaaatttacccaaatcaaactaaacgacgcctaaaaaaaaaacgacgaaacacgcgaaacaaaaccaaaccgacgaaaatcccgaaaaataaaaaccgaaccgcacctacctaaaaaatcgacgacgacgacgaacctaacgttcgcgaacgacgacgacgacgacaaaaacgacgacgacaacaacaacaacaacaacaacaacgcgaaacaaaacaaacgacgaacgactcccgccgacgaatccataacaaccgaactacaaccgaaaccccgcactcgcaaccgacgcgaaaattccccgcgaaccgcccaacccacatctaaaaacaactaaaaccgcccgcaactacaacaccgcaaaacgcgaaacgaaaaaaacgaaacgcgaaaaaacgaacgaaaaaacgcgaaaaaaaaacgaaaaaaaaaaaaaaacgaacgaacgaaaaaaacaaacgaaaaaaaaaaaaacgaacgaaaaaaaaaacgaaaacgacgaacgcctcaacctacgataacccgacgcatcttaacgcgaccgccgccgccgcccgcttccctcttcgcgccgccgtcgccgcgataccgaactcgcaacgaaacaaaaacaccccgaaacgacgacaaaaaaacgccgcgaaccgaaccgaaaaaaccccgccgccaa

SEQ ID NO: 16835 - DNA, 1335 bp, Artificial Sequence
  chemically treated genomic DNA (Homo sapiens) CpG-island No: 16835
tttgttttttgtttcgtttagggttggggttcggtgggaattttttcgtgttcgaagggacgatttcgttagagagtttttcgatttttgtatttatcgtttttggtaggacgtggagttgttcggaagttatttcgggttggtttttttattcgtgtgttacgatttttcggcgggtttttgtcgttcgagtgtttttatcgttagttttcggagcggcggagtttcggttttttcgagtacgagcggtttgttttgtttgtttagttttcgtttagttcgttgtcggtttcgttttttcgagcgttcgaggattgggaggggtggaatagggttttttcgattttcggggattttttgcggggcgttttaattaatttttagggtttaaggttacgcgttcggtagtcggttttttcggagcgttttcggacgcgagtttcggcgtcgtttcgttttggtttttttttcggattcgttggggttgattttgcgtttttggtcgcggggtttttttcggtttttcgtttttatttttcgcgatttaggagtcgttagtgtttcgaggttttttcggtttaaggcgttcgggggcggtgcggggcgttttttgcgcgattaattcggtttcgaagttggttaatttggtttcgggcggggcgcgcggagtttgtttaagttaggttggacgacgtttggggagggggcggcggggtacgcgggatagggttaggtcggcgggggtttcggggagtaggggtcgggtcgtatttatttggggggtcggcggcggcggcgagtttggcgttcgcgggcggcggcggcggcggtaggagcggcggcggtagtagtagtagtagtagtagtagcgcggggtagagtaggcggcgagcggttttcgtcggcggatttatggtagtcggattgtagtcggggtttcgtattcgtagtcggcgcgaaagtttttcgcgagtcgtttagtttatatttgggggtagttggagtcgttcgtagttgtagtatcgtagggcgcggggcggaggaggcgaggcgcggaggggcgggcgggggagcgcggagggaaggcggggagagggaaggagcgagcgagcgagggaggtaggcgggagggagggaggcgagcgagggggagggcggggacggcgggcgttttagtttgcggtgattcggcgtattttggcgcggtcgtcgtcgtcgttcgttttttttttcgcgtcgtcgtcgtcgcggtgtcgggttcgtagcgaagtagagatatttcgaggcggcggtagagaagcgtcgcgggtcgggtcgggggagtttcgtcgttag

SEQ ID NO: 16836 - DNA, 1335 bp, Artificial Sequence
  chemically treated genomic DNA (Homo sapiens) CpG-island No: 16836
ctaacgacgaaactcccccgacccgacccgcgacgcttctctaccgccgcctcgaaatatctctacttcgctacgaacccgacaccgcgacgacgacgacgcgaaaaaaaaaacgaacgacgacgacgaccgcgccaaaatacgccgaatcaccgcaaactaaaacgcccgccgtccccgccctccccctcgctcgcctccctccctcccgcctacctccctcgctcgctcgctccttccctctccccgccttccctccgcgctcccccgcccgcccctccgcgcctcgcctcctccgccccgcgccctacgatactacaactacgaacgactccaactacccccaaatataaactaaacgactcgcgaaaaactttcgcgccgactacgaatacgaaaccccgactacaatccgactaccataaatccgccgacgaaaaccgctcgccgcctactctaccccgcgctactactactactactactactaccgccgccgctcctaccgccgccgccgccgcccgcgaacgccaaactcgccgccgccgccgaccccccaaataaatacgacccgacccctactccccgaaacccccgccgacctaaccctatcccgcgtaccccgccgccccctccccaaacgtcgtccaacctaacttaaacaaactccgcgcgccccgcccgaaaccaaattaaccaacttcgaaaccgaattaatcgcgcaaaaaacgccccgcaccgcccccgaacgccttaaaccgaaaaaacctcgaaacactaacgactcctaaatcgcgaaaaataaaaacgaaaaaccgaaaaaaaccccgcgaccaaaaacgcaaaatcaaccccaacgaatccgaaaaaaaaaccaaaacgaaacgacgccgaaactcgcgtccgaaaacgctccgaaaaaaccgactaccgaacgcgtaaccttaaaccctaaaaattaattaaaacgccccgcaaaaaatccccgaaaatcgaaaaaaccctattccacccctcccaatcctcgaacgctcgaaaaaacgaaaccgacaacgaactaaacgaaaactaaacaaacaaaacaaaccgctcgtactcgaaaaaaccgaaactccgccgctccgaaaactaacgataaaaacactcgaacgacaaaaacccgccgaaaaatcgtaacacacgaataaaaaaaccaacccgaaataacttccgaacaactccacgtcctaccaaaaacgataaatacaaaaatcgaaaaactctctaacgaaatcgtcccttcgaacacgaaaaaattcccaccgaaccccaaccctaaacgaaacaaaaaacaaa

SEQ ID NO: 16837 - DNA, 782 bp, Artificial Sequence
  chemically treated genomic DNA (Homo sapiens) CpG-island No: 16837
attatattcgttttatttaagcgtagttggttttcgtttttgagttgggtcgttgtattcgtcgtgttggtcgtttcgtggtagggcgcggaaatggtttcgtttacgttgattaaagacggcggtaatatggcgacgttcgtcgtcgattttttttcgttcgattttagttagtggtaggattattttatcgaaatggtcgttacgttgtaaatcgtcgtttggggtatcgcgttggcggtggttttttttattttttttggtttgatgagcgtcgaaaatttggtgtcgtggtgggtttattagttcgttcgtcgtttgatggacgtttgtcgcgttattaacgaaatggttttcgttatgttgttcgtggtcgtcgtcggtttcggttcgttcgttggcgtgttggcgtgttggcgttgttatttatattatcggcgtgttttttaagttgtttttcgaagcggtggaagcgattgagttcggttcggtggaaggtattcgcgttatcggtgttaataagttcgaagagattttttacggcgtgttgttataggtgatgttattgttgattttttattttttttatcgtttcgaagtttaacgttcgttcggcgatcgtcgtcgtgtattggtcgagtcgtatggcgggatcggcgttattttgtgggaagcgatttaggcggtttttagttttaataaattttgcgttttgatggtgtttattatcgttacggttagatttgttggatttttttttttaacggttgcgtaagtattta

SEQ ID NO: 16838 - DNA, 782 bp, Artificial Sequence
  chemically treated genomic DNA (Homo sapiens) CpG-island No: 16838
taaatacttacgcaaccgttaaaaaaaaaaatccaacaaatctaaccgtaacgataataaacaccatcaaaacgcaaaatttattaaaactaaaaaccgcctaaatcgcttcccacaaaataacgccgatcccgccatacgactcgaccaatacacgacgacgatcgccgaacgaacgttaaacttcgaaacgataaaaaaaataaaaaatcaacaataacatcacctataacaacacgccgtaaaaaatctcttcgaacttattaacaccgataacgcgaataccttccaccgaaccgaactcaatcgcttccaccgcttcgaaaaacaacttaaaaaacacgccgataatataaataacaacgccaacacgccaacacgccaacgaacgaaccgaaaccgacgacgaccacgaacaacataacgaaaaccatttcgttaataacgcgacaaacgtccatcaaacgacgaacgaactaataaacccaccacgacaccaaattttcgacgctcatcaaaccaaaaaaaataaaaaaaaccaccgccaacgcgataccccaaacgacgatttacaacgtaacgaccatttcgataaaataatcctaccactaactaaaatcgaacgaaaaaaaatcgacgacgaacgtcgccatattaccgccgtctttaatcaacgtaaacgaaaccatttccgcgccctaccacgaaacgaccaacacgacgaatacaacgacccaactcaaaaacgaaaaccaactacgcttaaataaaacgaatataat

SEQ ID NO: 16839 - DNA, 782 bp, Artificial Sequence
  chemically treated genomic DNA (Homo sapiens) CpG-island No: 16839
taagtgtttacgtaatcgttgagagaggaaatttagtaggtttgatcgtgacgatgataagtattattagggcgtaggatttgttggaattggaaatcgtttgaatcgttttttatagggtgacgtcgatttcgttatgcgattcgattaatgtacgacgacggtcgtcgagcggacgttggatttcgaagcgatagagggagtaggagattagtagtggtattatttgtggtagtacgtcgtagaggattttttcgagtttgttggtatcggtggcgcgaatgttttttatcgggtcgggtttaatcgtttttatcgtttcggaaagtagtttggagagtacgtcggtggtgtggataatagcgttagtacgttagtacgttagcgaacgggtcgaggtcgacggcgattacgaatagtatggcgaagattatttcgttaatggcgcggtaggcgtttattaggcggcgaacgggttggtaaatttattacggtattaggttttcggcgtttattaggttaaaggggatggagagaattatcgttagcgcggtgttttagacggcgatttgtagcgtgacggttatttcggtgaggtaattttgttattggttgaaatcgggcgggaagaagtcggcggcgaacgtcgttatgttgtcgtcgtttttgattagcgtaagcggggttattttcgcgttttgttacgagacgattaatacggcgagtataacggtttagtttagaagcgagaattagttgcgtttgggtggggcgaatgtgat

SEQ ID NO: 16840 - DNA, 782 bp, Artificial Sequence
  chemically treated genomic DNA (Homo sapiens) CpG-island No: 16840
atcacattcgccccacccaaacgcaactaattctcgcttctaaactaaaccgttatactcgccgtattaatcgtctcgtaacaaaacgcgaaaataaccccgcttacgctaatcaaaaacgacgacaacataacgacgttcgccgccgacttcttcccgcccgatttcaaccaataacaaaattacctcaccgaaataaccgtcacgctacaaatcgccgtctaaaacaccgcgctaacgataattctctccatcccctttaacctaataaacgccgaaaacctaataccgtaataaatttaccaacccgttcgccgcctaataaacgcctaccgcgccattaacgaaataatcttcgccatactattcgtaatcgccgtcgacctcgacccgttcgctaacgtactaacgtactaacgctattatccacaccaccgacgtactctccaaactactttccgaaacgataaaaacgattaaacccgacccgataaaaaacattcgcgccaccgataccaacaaactcgaaaaaatcctctacgacgtactaccacaaataataccactactaatctcctactccctctatcgcttcgaaatccaacgtccgctcgacgaccgtcgtcgtacattaatcgaatcgcataacgaaatcgacgtcaccctataaaaaacgattcaaacgatttccaattccaacaaatcctacgccctaataatacttatcatcgtcacgatcaaacctactaaatttcctctctcaacgattacgtaaacactta

SEQ ID NO: 16841 - DNA, 879 bp, Artificial Sequence
  chemically treated genomic DNA (Homo sapiens) CpG-island No: 16841
  misc_feature (141)..(141): n is either a, c, g or t
tttgtttgcgcgcgggttattttaagtttatgggttcggttttgatgcgtaggtgtatcgatatattttgcgggtttagtggtttgcggcgcgtatttttttggtgaatggtgaataagggcggggcggaaaatggtttgncggaaatgagattgtttgggtaggttaatgaggtacggtttcgggaggggagtaaagtgcgtggttgggattacgcgcgaaaatatgttgttgttttattttaggggcgttattacggtcggttttagggtgatcgggtcggtggtattagttgtttttattggggatgatttggggatagggcgttgatcgcgtagtcggcgggtattgatggtaggtcgttggggatgttgttaggtgatgatgacgcgtcgatgggaatgtgtgaggtggagaaggtaaagggatagggatttagggattattggacggggcgtgtgcgtatttgggaatcgagggcgtatggcgtttgatgtatattatagaatgtcgggtttgatatgtgattgcgcgtgtgtgagtttatggggaggggtcgatcgtcggcgatagtttgttgggatcggggtgggggtttgttttaattggattagtatatacgaggggcgcgtaaagggttggtgggcgatggggcgcgtgggcggttttgaagtgaggattagggttcgatggaatggtggcggttttaggtagaatagggagagagattgtttggagtgtcgttggtggcgattagggtttgtattacgtacgatagtggcgcggtaagggatttggtaaagagatttttgtagggttttgattagtgaattgtgatgcgcgtgggtatgtgttagttgtagttagtcgatttaagga

SEQ ID NO: 16842 - DNA, 879 bp, Artificial Sequence
  chemically treated genomic DNA (Homo sapiens) CpG-island No: 16842
  misc_feature (739)..(739): n is either a, c, g or t
tccttaaatcgactaactacaactaacacatacccacgcgcatcacaattcactaatcaaaaccctacaaaaatctctttaccaaatcccttaccgcgccactatcgtacgtaatacaaaccctaatcgccaccaacgacactccaaacaatctctctccctattctacctaaaaccgccaccattccatcgaaccctaatcctcacttcaaaaccgcccacgcgccccatcgcccaccaaccctttacgcgcccctcgtatatactaatccaattaaaacaaacccccaccccgatcccaacaaactatcgccgacgatcgacccctccccataaactcacacacgcgcaatcacatatcaaacccgacattctataatatacatcaaacgccatacgccctcgattcccaaatacgcacacgccccgtccaataatccctaaatccctatccctttaccttctccacctcacacattcccatcgacgcgtcatcatcacctaacaacatccccaacgacctaccatcaatacccgccgactacgcgatcaacgccctatccccaaatcatccccaataaaaacaactaataccaccgacccgatcaccctaaaaccgaccgtaataacgcccctaaaataaaacaacaacatattttcgcgcgtaatcccaaccacgcactttactcccctcccgaaaccgtacctcattaacctacccaaacaatctcatttccgncaaaccattttccgccccgcccttattcaccattcaccaaaaaaatacgcgccgcaaaccactaaacccgcaaaatatatcgatacacctacgcatcaaaaccgaacccataaacttaaaataacccgcgcgcaaacaaa

SEQ ID NO: 16843 - DNA, 879 bp, Artificial Sequence
  chemically treated genomic DNA (Homo sapiens) CpG-island No: 16843
  misc_feature (739)..(739): n is either a, c, g or t
tttttagatcgattgattgtaattggtatatgtttacgcgtattatagtttattggttaaaattttataggggtttttttattaaattttttatcgcgttattatcgtgcgtaatgtaagttttaatcgttattagcggtattttaaatagtttttttttttattttatttagggtcgttattattttatcgggttttggtttttattttaaggtcgtttacgcgttttatcgtttattaattttttacgcgtttttcgtatatgttaatttagttggggtaggtttttatttcggttttagtaaattatcgtcggcggtcggtttttttttataggtttatatacgcgtagttatatattaaattcggtattttgtagtgtgtattaaacgttatgcgttttcggtttttaggtacgtatacgtttcgtttaatagtttttaggtttttgtttttttattttttttattttatatatttttatcggcgcgttattattatttagtaatatttttagcgatttattattagtattcgtcggttacgcgattaacgttttgtttttaagttatttttagtagaagtaattggtattatcggttcggttattttagagtcggtcgtaatagcgtttttaaagtaaggtaataatatgttttcgcgcgtagttttagttacgtattttatttttttttcggggtcgtgttttattagtttatttaagtaattttattttcgntaaattatttttcgtttcgtttttatttattatttattaagggggtgcgcgtcgtaagttattaaattcgtaggatatatcggtgtatttacgtattaaagtcgggtttataaatttgggatggttcgcgcgtaagtagg

SEQ ID NO: 16844 - DNA, 879 bp, Artificial Sequence
  chemically treated genomic DNA (Homo sapiens) CpG-island No: 16844
  misc_feature (141)..(141): n is either a, c, g or t
cctacttacgcgcgaaccatcccaaatttataaacccgactttaatacgtaaatacaccgatatatcctacgaatttaataacttacgacgcgcacccccttaataaataataaataaaaacgaaacgaaaaataatttancgaaaataaaattacttaaataaactaataaaacacgaccccgaaaaaaaaataaaatacgtaactaaaactacgcgcgaaaacatattattaccttactttaaaaacgctattacgaccgactctaaaataaccgaaccgataataccaattacttctactaaaaataacttaaaaacaaaacgttaatcgcgtaaccgacgaatactaataataaatcgctaaaaatattactaaataataataacgcgccgataaaaatatataaaataaaaaaaataaaaaaacaaaaacctaaaaactattaaacgaaacgtatacgtacctaaaaaccgaaaacgcataacgtttaatacacactacaaaataccgaatttaatatataactacgcgtatataaacctataaaaaaaaaccgaccgccgacgataatttactaaaaccgaaataaaaacctaccccaactaaattaacatatacgaaaaacgcgtaaaaaattaataaacgataaaacgcgtaaacgaccttaaaataaaaaccaaaacccgataaaataataacgaccctaaataaaataaaaaaaaaaactatttaaaataccgctaataacgattaaaacttacattacgcacgataataacgcgataaaaaatttaataaaaaaacccctataaaattttaaccaataaactataatacgcgtaaacatataccaattacaatcaatcgatctaaaaa

SEQ ID NO: 16845 - DNA, 1222 bp, Artificial Sequence
  chemically treated genomic DNA (Homo sapiens) CpG-island No: 16845
atcgtttcgaggcgtattttttttatttcggaagaggagggcggtaaatttcggaaggcgggggttaggggacgagtttcggggattatcgtcgtttcgttcgtttcgggaagggttcgggtagcgattttggttgtagttggagggttacgggggaagggagcgttttttttcgtaatacgaaggtagcggttagggcgttttttttcggtgaggggtttcggaaaattgtagtaaggcgatagcggggatttttcgaagtgtgcggtgacggagggtgggaggaagttcgagttcgtcggtaatttcgggggtaaatgcgatcggcggcgtgtaggattagttcgtaggaggacgggggaaacgggagttaggatggcggggattttataggacgtcggtcgcgcgcgggggtagtgttgtttcggcggttaggagatgtcggaggcggggagggtcggtggttagttcgttttttttcggcggggttttgtagaaggagaagtcgttgttagtgataggaagagagtcgcggtagtcgtgtatatatgtatcgtttttttcgttcgagtatatatattcggggttgttgttgtttatttatttcgttcgtcggttttttttttttgcggggttcgcgttgtagcggtggttttttgttcgttcggtttcgatcggtttttagttcggttgcgattcgtcggtcgtgttcgattcgtgtttgtcgttttcgatagttagtttgtcgttttcgtcgttgtcgttgttttttttaatttcgttttagttgttggcgattttttttcgtgcgttcgtagttttagcgttcggcgttagtttcgttttcggttcggtttcgcgcgtttcgttttcgagtttatattaattagagttcgcggtttcgttttttttcgttcgtacggttcgggttttcgagtcggcggttggtagtgggggagcgagtttaggtttggcggattttttttgttatcgttttcgtttttcgttttttagtcgcggggatgtttcgggcggtcgtgtcgcgcgttgttttcgttgcggagtgttttggttttatacgtttcgggttcgttcggttgttgggcgttttttagcgtagaggcggatggggttcggggagtcgaagataagtttagatttttttggaggttggttgcgtttttaattcgagtgttttttagttattttaggttttttcgag

SEQ ID NO: 16846 - DNA, 1222 bp, Artificial Sequence
  chemically treated genomic DNA (Homo sapiens) CpG-island No: 16846
ctcgaaaaaacctaaaataactaaaaaacactcgaattaaaaacgcaaccaacctccaaaaaaatctaaacttatcttcgactccccgaaccccatccgcctctacgctaaaaaacgcccaacaaccgaacgaacccgaaacgtataaaaccaaaacactccgcaacgaaaacaacgcgcgacacgaccgcccgaaacatccccgcgactaaaaaacgaaaaacgaaaacgataacaaaaaaaatccgccaaacctaaactcgctcccccactaccaaccgccgactcgaaaacccgaaccgtacgaacgaaaaaaaacgaaaccgcgaactctaattaatataaactcgaaaacgaaacgcgcgaaaccgaaccgaaaacgaaactaacgccgaacgctaaaactacgaacgcacgaaaaaaaatcgccaacaactaaaacgaaattaaaaaaaacaacgacaacgacgaaaacgacaaactaactatcgaaaacgacaaacacgaatcgaacacgaccgacgaatcgcaaccgaactaaaaaccgatcgaaaccgaacgaacaaaaaaccaccgctacaacgcgaaccccgcaaaaaaaaaaaaccgacgaacgaaataaataaacaacaacaaccccgaatatatatactcgaacgaaaaaaacgatacatatatacacgactaccgcgactctcttcctatcactaacaacgacttctccttctacaaaaccccgccgaaaaaaaacgaactaaccaccgaccctccccgcctccgacatctcctaaccgccgaaacaacactacccccgcgcgcgaccgacgtcctataaaatccccgccatcctaactcccgtttcccccgtcctcctacgaactaatcctacacgccgccgatcgcatttacccccgaaattaccgacgaactcgaacttcctcccaccctccgtcaccgcacacttcgaaaaatccccgctatcgccttactacaattttccgaaacccctcaccgaaaaaaaacgccctaaccgctaccttcgtattacgaaaaaaaacgctcccttcccccgtaaccctccaactacaaccaaaatcgctacccgaacccttcccgaaacgaacgaaacgacgataatccccgaaactcgtcccctaacccccgccttccgaaatttaccgccctcctcttccgaaataaaaaaaatacgcctcgaaacgat

SEQ ID NO: 16847 - DNA, 1222 bp, Artificial Sequence
  chemically treated genomic DNA (Homo sapiens) CpG-island No: 16847
ttcgaaaaagtttggggtggttgaaagatattcggattagagacgtagttagtttttagggaggtttgaatttgttttcgatttttcgaattttattcgtttttgcgttgggagacgtttagtagtcgggcgggttcgggacgtgtagagttagagtatttcgtagcggaggtagcgcgcggtacggtcgttcggggtattttcgcggttggggggcggaaggcgagggcggtggtaggaagggttcgttaggtttgagttcgtttttttattgttagtcgtcggttcggaggttcgagtcgtgcggacggaaaggggcggagtcgcgggttttggttggtgtgggttcgggggcggggcgcgcggggtcgggtcggaggcggggttagcgtcgggcgttggagttgcgggcgtacggagaggagtcgttagtagttggagcggagttggaggaagtagcggtagcggcgagggcggtaggttagttgtcggagacggtaagtacggatcgggtacggtcggcgggtcgtagtcgggttggaggtcggtcggaatcgagcgggtaggaggttatcgttgtagcgcgggtttcgtagaggaaggaagtcggcgggcggggtaggtaggtagtagtagtttcgggtgtgtgtgttcgggcgggggaggcggtgtatgtgtgtacggttgtcgcgattttttttttgttattggtagcggtttttttttttgtagagtttcgtcggggggaagcgggttggttatcggtttttttcgttttcggtattttttggtcgtcggggtagtattattttcgcgcgcggtcggcgttttgtgagattttcgttattttgattttcgtttttttcgtttttttgcgagttggttttgtacgtcgtcggtcgtatttgttttcggagttgtcgacgagttcgggtttttttttatttttcgttatcgtatatttcggagggttttcgttgtcgttttgttgtagtttttcggggttttttatcggaggagagcgttttggtcgttgttttcgtgttgcgggaaggagcgtttttttttttcgtggttttttagttgtagttagggtcgttgttcgggtttttttcggggcgggcgaggcggcggtggttttcggagttcgttttttaattttcgtttttcgaagtttgtcgtttttttttttcggggtgggggaagtgcgtttcggggcggt

SEQ ID NO: 16848 - DNA, 1222 bp, Artificial Sequence
  chemically treated genomic DNA (Homo sapiens) CpG-island No: 16848
accgccccgaaacgcacttcccccaccccgaaaaaaaaaaacgacaaacttcgaaaaacgaaaattaaaaaacgaactccgaaaaccaccgccgcctcgcccgccccgaaaaaaacccgaacaacgaccctaactacaactaaaaaaccacgaaaaaaaaaaacgctccttcccgcaacacgaaaacaacgaccaaaacgctctcctccgataaaaaaccccgaaaaactacaacaaaacgacaacgaaaaccctccgaaatatacgataacgaaaaataaaaaaaaacccgaactcgtcgacaactccgaaaacaaatacgaccgacgacgtacaaaaccaactcgcaaaaaaacgaaaaaaacgaaaatcaaaataacgaaaatctcacaaaacgccgaccgcgcgcgaaaataatactaccccgacgaccaaaaaataccgaaaacgaaaaaaaccgataaccaacccgcttccccccgacgaaactctacaaaaaaaaaaaccgctaccaataacaaaaaaaaaatcgcgacaaccgtacacacatacaccgcctcccccgcccgaacacacacacccgaaactactactacctacctaccccgcccgccgacttccttcctctacgaaacccgcgctacaacgataacctcctacccgctcgattccgaccgacctccaacccgactacgacccgccgaccgtacccgatccgtacttaccgtctccgacaactaacctaccgccctcgccgctaccgctacttcctccaactccgctccaactactaacgactcctctccgtacgcccgcaactccaacgcccgacgctaaccccgcctccgacccgaccccgcgcgccccgcccccgaacccacaccaaccaaaacccgcgactccgcccctttccgtccgcacgactcgaacctccgaaccgacgactaacaataaaaaaacgaactcaaacctaacgaacccttcctaccaccgccctcgccttccgccccccaaccgcgaaaataccccgaacgaccgtaccgcgcgctacctccgctacgaaatactctaactctacacgtcccgaacccgcccgactactaaacgtctcccaacgcaaaaacgaataaaattcgaaaaatcgaaaacaaattcaaacctccctaaaaactaactacgtctctaatccgaatatctttcaaccaccccaaactttttcgaa

SEQ ID NO: 16849 - DNA, 630 bp, Artificial Sequence
  chemically treated genomic DNA (Homo sapiens) CpG-island No: 16849
gttcggcgcggtttcgttcgtttttcgttcgtttttcgttttttttcggtttttcgaggcgttcgggttttcggcgcggcggcggagggggcgggtaggtcggcgggcggtgatgtggcgggattttttatgcgttgcggtaggatacgcgttcggcgttgggacgcgattgcgtttagtttttttttttcggaagttgtagttatgatggaagtttgagagttgagtcgttgtgaggcgaggtcgggtttaggcgagggagatgagagacggcggcggtcgcggttcggagttttttttagcgtttgtgagtagtcgcgggggtagcgttttcggggagtcggtcggtttgcggcggcggtagcggcggcgtttttcgtttttttttcgttttttttaatcgtgtagtttttttttcggttttttttgaaagggaaggtggaagtcgtgggttcgggcgggagtcggttgaggcgcggcggcggcggcggtatttttcgtttttggagcgggggggagaagcggcggcggcggcggtcgcggcggttgtagttttagggagggggtttgagtcgtttgttattatttttagggttgggaacgtcggagagttggtttttttttttttat

SEQ ID NO: 16850 - DNA, 630 bp, Artificial Sequence
  chemically treated genomic DNA (Homo sapiens) CpG-island No: 16850
ataaaaaaaaaaaaaccaactctccgacgttcccaaccctaaaaataataacaaacgactcaaaccccctccctaaaactacaaccgccgcgaccgccgccgccgccgcttctcccccccgctccaaaaacgaaaaataccgccgccgccgccgcgcctcaaccgactcccgcccgaacccacgacttccaccttccctttcaaaaaaaaccgaaaaaaaaactacacgattaaaaaaaacgaaaaaaaaacgaaaaacgccgccgctaccgccgccgcaaaccgaccgactccccgaaaacgctacccccgcgactactcacaaacgctaaaaaaaactccgaaccgcgaccgccgccgtctctcatctccctcgcctaaacccgacctcgcctcacaacgactcaactctcaaacttccatcataactacaacttccgaaaaaaaaaaactaaacgcaatcgcgtcccaacgccgaacgcgtatcctaccgcaacgcataaaaaatcccgccacatcaccgcccgccgacctacccgccccctccgccgccgcgccgaaaacccgaacgcctcgaaaaaccgaaaaaaaacgaaaaacgaacgaaaaacgaacgaaaccgcgccgaac

SEQ ID NO: 16851 - DNA, 630 bp, Artificial Sequence
  chemically treated genomic DNA (Homo sapiens) CpG-island No: 16851
gtagaaggggagagattaatttttcggcgtttttagttttggaaatggtgataggcgatttagattttttttttggagttgtagtcgtcgcggtcgtcgtcgtcgtcgtttttttttttcgttttaggagcgggaggtgtcgtcgtcgtcgtcgcgttttagtcggttttcgttcgagtttacggtttttatttttttttttaggagaagtcgaggaagaggttgtacggttagaaaagacgaagaggaggcgagaaacgtcgtcgttgtcgtcgtcgtaggtcggtcggtttttcgagggcgttgttttcgcggttgtttataggcgttgagaggggtttcgggtcgcggtcgtcgtcgttttttatttttttcgtttgagttcggtttcgttttatagcggtttaatttttaaatttttattatggttgtagttttcgagaggagagaattgagcgtagtcgcgttttagcgtcgagcgcgtattttgtcgtagcgtataaagagtttcgttatattatcgttcgtcggtttgttcgtttttttcgtcgtcgcgtcgggagttcgggcgtttcggaagatcgaggggaggcgggaggcgagcgagaggcggacgggatcgcgtcgggt

SEQ ID NO: 16852 - DNA, 630 bp, Artificial Sequence
  chemically treated genomic DNA (Homo sapiens) CpG-island No: 16852
acccgacgcgatcccgtccgcctctcgctcgcctcccgcctcccctcgatcttccgaaacgcccgaactcccgacgcgacgacgaaaaaaacgaacaaaccgacgaacgataatataacgaaactctttatacgctacgacaaaatacgcgctcgacgctaaaacgcgactacgctcaattctctcctctcgaaaactacaaccataataaaaatttaaaaattaaaccgctataaaacgaaaccgaactcaaacgaaaaaaataaaaaacgacgacgaccgcgacccgaaacccctctcaacgcctataaacaaccgcgaaaacaacgccctcgaaaaaccgaccgacctacgacgacgacaacgacgacgtttctcgcctcctcttcgtcttttctaaccgtacaacctcttcctcgacttctcctaaaaaaaaaaataaaaaccgtaaactcgaacgaaaaccgactaaaacgcgacgacgacgacgacacctcccgctcctaaaacgaaaaaaaaaaacgacgacgacgacgaccgcgacgactacaactccaaaaaaaaaatctaaatcgcctatcaccatttccaaaactaaaaacgccgaaaaattaatctctccccttctac

SEQ ID NO: 16853 - DNA, 616 bp, Artificial Sequence
  chemically treated genomic DNA (Homo sapiens) CpG-island No: 16853
gcggcggttggatggttgatttcggcgagtatttgtttatcgatacgtatttgtataacggcgttagtgtcgaaattatgtataacgtttggtttgcgttgtgggcgaagtgtaattacgaagtttttgaagaaacgggtaagttcggcgagatttttttttttatgcgcgtcggttttatcggtagttagaaatattttattatgatgtgggcgggcgattagaacgtcgattggagtttcgacgatggtttggcgtcggttgtttcggcggcgttgtcgttggtaatgatcggatatggattgtattatagcgatattggcggttaatattattttgtttgagatgaagcgtagtaaagagttggtgttgcgttggtgcgattttagcgtttttacgtcgatgatgcgtatttacgaaggtaatcgttttggcgaatattgggcgtttgcggggacgtaaaatatcgttatttggtcgtttatttcgttttatattttgaatttatttgaaaaggcgcgtttgaataaattcgttacggtatggcggtgtttgattagaagtggacgtatttaaattacgtggtaaattttttttgtgaaagaggagagttttt

SEQ ID NO: 16854 - DNA, 616 bp, Artificial Sequence
  chemically treated genomic DNA (Homo sapiens) CpG-island No: 16854
aaaaactctcctctttcacaaaaaaaatttaccacgtaatttaaatacgtccacttctaatcaaacaccgccataccgtaacgaatttattcaaacgcgccttttcaaataaattcaaaatataaaacgaaataaacgaccaaataacgatattttacgtccccgcaaacgcccaatattcgccaaaacgattaccttcgtaaatacgcatcatcgacgtaaaaacgctaaaatcgcaccaacgcaacaccaactctttactacgcttcatctcaaacaaaataatattaaccgccaatatcgctataatacaatccatatccgatcattaccaacgacaacgccgccgaaacaaccgacgccaaaccatcgtcgaaactccaatcgacgttctaatcgcccgcccacatcataataaaatatttctaactaccgataaaaccgacgcgcataaaaaaaaaaatctcgccgaacttacccgtttcttcaaaaacttcgtaattacacttcgcccacaacgcaaaccaaacgttatacataatttcgacactaacgccgttatacaaatacgtatcgataaacaaatactcgccgaaatcaaccatccaaccgccgc

SEQ ID NO: 16855 - DNA, 616 bp, Artificial Sequence
  chemically treated genomic DNA (Homo sapiens) CpG-island No: 16855
aaaggttttttttttttatagggagaatttgttacgtaatttaggtacgtttatttttgattaggtatcgttatatcgtggcggatttatttaggcgcgtttttttaggtaggtttagggtgtaaaacggggtaaacggttaaatggcgatgttttgcgttttcgtaaacgtttagtgttcgttaggacggttattttcgtgggtgcgtattatcggcgtgaaggcgttgaaatcgtattagcgtagtattagttttttgttgcgttttattttaaatagggtggtgttaatcgttaatgtcgttgtggtgtagtttatgttcggttattgttagcgatagcgtcgtcgggataatcgacgttaggttatcgtcgagattttagtcgacgttttggtcgttcgtttatattatggtggagtatttttggttatcggtagaatcggcgcgtataaagaaaaggatttcgtcgagtttgttcgtttttttaagggtttcgtagttatatttcgtttatagcgtaggttaggcgttatgtataatttcggtattgacgtcgttatgtaagtacgtgtcggtgggtagatattcgtcgaagttagttatttagtcgtcgt

SEQ ID NO: 16856 - DNA, 616 bp, Artificial Sequence
  chemically treated genomic DNA (Homo sapiens) CpG-island No: 16856
acgacgactaaataactaacttcgacgaatatctacccaccgacacgtacttacataacgacgtcaataccgaaattatacataacgcctaacctacgctataaacgaaatataactacgaaacccttaaaaaaacgaacaaactcgacgaaatccttttctttatacgcgccgattctaccgataaccaaaaatactccaccataatataaacgaacgaccaaaacgtcgactaaaatctcgacgataacctaacgtcgattatcccgacgacgctatcgctaacaataaccgaacataaactacaccacaacgacattaacgattaacaccaccctatttaaaataaaacgcaacaaaaaactaatactacgctaatacgatttcaacgccttcacgccgataatacgcacccacgaaaataaccgtcctaacgaacactaaacgtttacgaaaacgcaaaacatcgccatttaaccgtttaccccgttttacaccctaaacctacctaaaaaaacgcgcctaaataaatccgccacgatataacgatacctaatcaaaaataaacgtacctaaattacgtaacaaattctccctataaaaaaaaaaaaccttt

SEQ ID NO: 16857 - DNA, 856 bp, Artificial Sequence
  chemically treated genomic DNA (Homo sapiens) CpG-island No: 16857
ttttcggtttgtcgtatgcgcggttttgatttagttttttttcgcgggtgtatcgtcgttatttggttcgaatcgtttatggttataacgggttatatgaatcggaatagtcggtgaagtttagttacgtgatcgtatacggttttacgttatggtttttcgtttgtcgttggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatattatcgttagttcgtcgcggggcgtttagttatagcgtattagcggcgcggtaggtaaattttttcggggtatttcggggtcgtgt

SEQ ID NO: 16858 - DNA, 856 bp, Artificial Sequence
  chemically treated genomic DNA (Homo sapiens) CpG-island No: 16858
acacgaccccgaaataccccgaaaaaatttacctaccgcgccgctaatacgctataactaaacgccccgcgacgaactaacgataatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaacgacaaacgaaaaaccataacgtaaaaccgtatacgatcacgtaactaaacttcaccgactattccgattcatataacccgttataaccataaacgattcgaaccaaataacgacgatacacccgcgaaaaaaaactaaatcaaaaccgcgcatacgacaaaccgaaaa

SEQ ID NO: 16859 - DNA, 856 bp, Artificial Sequence
  chemically treated genomic DNA (Homo sapiens) CpG-island No: 16859
gtacgatttcggaatatttcggagagatttatttgtcgcgtcgttggtgcgttatggttggacgtttcgcggcgaattggcggtggtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttagcggtagacggaaaattatgacgtggagtcgtatacggttacgtagttgagttttatcgattgtttcggtttatgtaattcgttatgattatgagcgattcgggttagatgacggcggtgtattcgcgaggaaaggttgagttagaatcgcgtatacgatagatcgggaa

SEQ ID NO: 16860 - DNA, 856 bp, Artificial Sequence
  chemically treated genomic DNA (Homo sapiens) CpG-island No: 16860
ttcccgatctatcgtatacgcgattctaactcaacctttcctcgcgaatacaccgccgtcatctaacccgaatcgctcataatcataacgaattacataaaccgaaacaatcgataaaactcaactacgtaaccgtatacgactccacgtcataattttccgtctaccgctaacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacaccaccgccaattcgccgcgaaacgtccaaccataacgcaccaacgacgcgacaaataaatctctccgaaatattccgaaatcgtac

SEQ ID NO: 16861 - DNA, 920 bp, Artificial Sequence
  chemically treated genomic DNA (Homo sapiens) CpG-island No: 16861
gtggaaaggtcgtgcgggttttgagtgtgcgtggaaaggtcgtgcgggttttgagtatgtgtggaacggtcgtgcgggttttgagcgtgcgtggaaaggtcgtgcgggttttgagcgtgcgtggaaaggtcgtgcgggttttgatagtgtgtggaaaggtcgcgtgggttttgattgtgcgtggaaaggtcgcgcgggttttgattgtgcgtggaaaggtcgcgcgggttttgagtgtgcgtggaaaggtcgtgcgggttttgattgtgcgtggaaaggtcgcgcgggttttgattgtgcgtggaaaggtcgtgcgggttttgatagtgcgtggaaaggtcgtgcgggttttgagtgtgcgtggaaaggtcgcgcgggttttgattgtgcgtggaaaggtcgcgcgggttttgattgtgcgtggaaaggtcgtgcgggttttgattgtgcgtggaaaggtcgtgcgggttttgagtgtgcgtggaaaggtcgtgcgggttttgagtgtgcgtggaaaggtcgtgcgggttttgagtgtgtgtggaaaggtcgcgcgggttttgagcgtgcgtggaaaggtcgtgcgggttttgagtgtgcgtggaaaggttatgcgggttttgagtgtgcgtggaaaggtcgtgcgggttttgatagtgtgtggaaaggtcgcgcgggttttgattgtgcgtggaaaggtcgtgcgggttttgattgtgtgtggaaaggtcgtgcgggttttgagtgtgtgtggaaaggtcgtgcgggttttgagtgtgcgtggaaaggtcgtgcgggttttgattgtgtgtggaacggtcgtgcgggttttgattgtgtgtggaaaggtcgtgtagattttgagtgtgtgtggaaatatcgtgcgggttttgattgtgtgtggaaaggtcgtgtagatt

SEQ ID NO: 16862 - DNA, 920 bp, Artificial Sequence
  chemically treated genomic DNA (Homo sapiens) CpG-island No: 16862
aatctacacgacctttccacacacaatcaaaacccgcacgatatttccacacacactcaaaatctacacgacctttccacacacaatcaaaacccgcacgaccgttccacacacaatcaaaacccgcacgacctttccacgcacactcaaaacccgcacgacctttccacacacactcaaaacccgcacgacctttccacacacaatcaaaacccgcacgacctttccacgcacaatcaaaacccgcgcgacctttccacacactatcaaaacccgcacgacctttccacgcacactcaaaacccgcataacctttccacgcacactcaaaacccgcacgacctttccacgcacgctcaaaacccgcgcgacctttccacacacactcaaaacccgcacgacctttccacgcacactcaaaacccgcacgacctttccacgcacactcaaaacccgcacgacctttccacgcacaatcaaaacccgcacgacctttccacgcacaatcaaaacccgcgcgacctttccacgcacaatcaaaacccgcgcgacctttccacgcacactcaaaacccgcacgacctttccacgcactatcaaaacccgcacgacctttccacgcacaatcaaaacccgcgcgacctttccacgcacaatcaaaacccgcacgacctttccacgcacactcaaaacccgcgcgacctttccacgcacaatcaaaacccgcgcgacctttccacgcacaatcaaaacccacgcgacctttccacacactatcaaaacccgcacgacctttccacgcacgctcaaaacccgcacgacctttccacgcacgctcaaaacccgcacgaccgttccacacatactcaaaacccgcacgacctttccacgcacactcaaaacccgcacgacctttccac

SEQ ID NO: 16863 - DNA, 920 bp, Artificial Sequence
  chemically treated genomic DNA (Homo sapiens) CpG-island No: 16863
gatttgtacggtttttttatatatagttaggattcgtacggtgtttttatatatatttaggatttgtacggtttttttatatatagttaggattcgtacggtcgttttatatatagttaggattcgtacggtttttttacgtatatttaggattcgtacggtttttttatatatatttaggattcgtacggtttttttatatatagttaggattcgtacggtttttttacgtatagttaggattcgcgcggtttttttatatattgttaggattcgtacggtttttttacgtatatttaggattcgtatggtttttttacgtatatttaggattcgtacggtttttttacgtacgtttaggattcgcgcggtttttttatatatatttaggattcgtacggtttttttacgtatatttaggattcgtacggtttttttacgtatatttaggattcgtacggtttttttacgtatagttaggattcgtacggtttttttacgtatagttaggattcgcgcggtttttttacgtatagttaggattcgcgcggtttttttacgtatatttaggattcgtacggtttttttacgtattgttaggattcgtacggtttttttacgtatagttaggattcgcgcggtttttttacgtatagttaggattcgtacggtttttttacgtatatttaggattcgcgcggtttttttacgtatagttaggattcgcgcggtttttttacgtatagttaggatttacgcggtttttttatatattgttaggattcgtacggtttttttacgtacgtttaggattcgtacggtttttttacgtacgtttaggattcgtacggtcgttttatatatgtttaggattcgtacggtttttttacgtatatttaggattcgtacggtttttttat

SEQ ID NO: 16864 - DNA, 920 bp, Artificial Sequence
  chemically treated genomic DNA (Homo sapiens) CpG-island No: 16864
ataaaaaaaccgtacgaatcctaaatatacgtaaaaaaaccgtacgaatcctaaacatatataaaacgaccgtacgaatcctaaacgtacgtaaaaaaaccgtacgaatcctaaacgtacgtaaaaaaaccgtacgaatcctaacaatatataaaaaaaccgcgtaaatcctaactatacgtaaaaaaaccgcgcgaatcctaactatacgtaaaaaaaccgcgcgaatcctaaatatacgtaaaaaaaccgtacgaatcctaactatacgtaaaaaaaccgcgcgaatcctaactatacgtaaaaaaaccgtacgaatcctaacaatacgtaaaaaaaccgtacgaatcctaaatatacgtaaaaaaaccgcgcgaatcctaactatacgtaaaaaaaccgcgcgaatcctaactatacgtaaaaaaaccgtacgaatcctaactatacgtaaaaaaaccgtacgaatcctaaatatacgtaaaaaaaccgtacgaatcctaaatatacgtaaaaaaaccgtacgaatcctaaatatatataaaaaaaccgcgcgaatcctaaacgtacgtaaaaaaaccgtacgaatcctaaatatacgtaaaaaaaccatacgaatcctaaatatacgtaaaaaaaccgtacgaatcctaacaatatataaaaaaaccgcgcgaatcctaactatacgtaaaaaaaccgtacgaatcctaactatatataaaaaaaccgtacgaatcctaaatatatataaaaaaaccgtacgaatcctaaatatacgtaaaaaaaccgtacgaatcctaactatatataaaacgaccgtacgaatcctaactatatataaaaaaaccgtacaaatcctaaatatatataaaaacaccgtacgaatcctaactatatataaaaaaaccgtacaaatc

SEQ ID NO: 16865 - DNA, 787 bp, Artificial Sequence
  chemically treated genomic DNA (Homo sapiens) CpG-island No: 16865
gtggaaaggacgtgcgcgttttgcgtgtggcgtggaaaggtcgtgcgggttttgagtgtgcgtggaaaggtcgtgcgggttttgattgtgtgtggaacggtcgtgtgggttttgattgtgcgtggaaaggttatgcgggttttgagtgtgtgtggaaaggtcgtgcgggttttgattatgtgtggaaaggtcgtgcgggttttgattgtgtgtggaaaggacgtgcgcgttttgcgtgtggcgtggaaaggttatgcgggttttgagtgtgcgtggaaaggtcgtgtaggttttgattgtgtttggaaaggtcgtgcgggttttgattgtggaaaggtcgtgcgcgttttgattgtgtgtggaaaggtcgtgcgggttttgagtgtgtgtggaaacgtcgtgcgggttttgattgtgtgtggaaaggtcgtgcggattttgattgtgtgtggaaaggtcgtgcgggttttgagtgtgtgtggaacggtcgtgcgggttttgattgtgtgtggaaaggtcgtgcgggttttgagtgtgtgtggaacggtcgtgcgggttttgattgtgtgtggaaaggtcgtgcgggttttgagtgtgtgtggataggttgtgcgggttttgattgtgtgtggaaaggtcgtgcgggttttgattgtgtttggaaaggtcgtgtgggttttgatcgtgtgtggaaaggacgtgcgggttttgagcgtgtgtgtggaaaggtcgtgcgggttttgagtgtgtgtggaaaggttgtgttttttttgtttttagcgatttt

SEQ ID NO: 16866 - DNA, 787 bp, Artificial Sequence
  chemically treated genomic DNA (Homo sapiens) CpG-island No: 16866
aaaatcgctaaaaacaaaaaaaacacaacctttccacacacactcaaaacccgcacgacctttccacacacacgctcaaaacccgcacgtcctttccacacacgatcaaaacccacacgacctttccaaacacaatcaaaacccgcacgacctttccacacacaatcaaaacccgcacaacctatccacacacactcaaaacccgcacgacctttccacacacaatcaaaacccgcacgaccgttccacacacactcaaaacccgcacgacctttccacacacaatcaaaacccgcacgaccgttccacacacactcaaaacccgcacgacctttccacacacaatcaaaatccgcacgacctttccacacacaatcaaaacccgcacgacgtttccacacacactcaaaacccgcacgacctttccacacacaatcaaaacgcgcacgacctttccacaatcaaaacccgcacgacctttccaaacacaatcaaaacctacacgacctttccacgcacactcaaaacccgcataacctttccacgccacacgcaaaacgcgcacgtcctttccacacacaatcaaaacccgcacgacctttccacacataatcaaaacccgcacgacctttccacacacactcaaaacccgcataacctttccacgcacaatcaaaacccacacgaccgttccacacacaatcaaaacccgcacgacctttccacgcacactcaaaacccgcacgacctttccacgccacacgcaaaacgcgcacgtcctttccac

SEQ ID NO: 16867 - DNA, 787 bp, Artificial Sequence
  chemically treated genomic DNA (Homo sapiens) CpG-island No: 16867
ggagtcgttggggataggaggagtatagtttttttatatatatttaggattcgtacggtttttttatatatacgtttaggattcgtacgttttttttatatacgattaggatttatacggtttttttaaatatagttaggattcgtacggtttttttatatatagttaggattcgtatagtttatttatatatatttaggattcgtacggtttttttatatatagttaggattcgtacggtcgttttatatatatttaggattcgtacggtttttttatatatagttaggattcgtacggtcgttttatatatatttaggattcgtacggtttttttatatatagttaggattcgtacggtttttttatatatagttaggattcgtacggcgtttttatatatatttaggattcgtacggtttttttatatatagttaggacgcgtacggtttttttatagttaggattcgtacggtttttttaaatatagttaggatttgtacggtttttttacgtatatttaggattcgtatggtttttttacgttatacgtaggacgcgtacgttttttttatatatagttaggattcgtacggtttttttatatatagttaggattcgtacggtttttttatatatatttaggattcgtatggtttttttacgtatagttaggatttatacggtcgttttatatatagttaggattcgtacggtttttttacgtatatttaggattcgtacggtttttttacgttatacgtaggacgcgtacgttttttttat

SEQ ID NO: 16868 - DNA, 787 bp, Artificial Sequence
  chemically treated genomic DNA (Homo sapiens) CpG-island No: 16868
ataaaaaaaacgtacgcgtcctacgtataacgtaaaaaaaccgtacgaatcctaaatatacgtaaaaaaaccgtacgaatcctaactatatataaaacgaccgtataaatcctaactatacgtaaaaaaaccatacgaatcctaaatatatataaaaaaaccgtacgaatcctaactatatataaaaaaaccgtacgaatcctaactatatataaaaaaaacgtacgcgtcctacgtataacgtaaaaaaaccatacgaatcctaaatatacgtaaaaaaaccgtacaaatcctaactatatttaaaaaaaccgtacgaatcctaactataaaaaaaccgtacgcgtcctaactatatataaaaaaaccgtacgaatcctaaatatatataaaaacgccgtacgaatcctaactatatataaaaaaaccgtacgaatcctaactatatataaaaaaaccgtacgaatcctaaatatatataaaacgaccgtacgaatcctaactatatataaaaaaaccgtacgaatcctaaatatatataaaacgaccgtacgaatcctaactatatataaaaaaaccgtacgaatcctaaatatatataaataaactatacgaatcctaactatatataaaaaaaccgtacgaatcctaactatatttaaaaaaaccgtataaatcctaatcgtatataaaaaaaacgtacgaatcctaaacgtatatataaaaaaaccgtacgaatcctaaatatatataaaaaaactatactcctcctatccccaacgactcc

SEQ ID NO: 16869 - DNA, 538 bp, Artificial Sequence
  chemically treated genomic DNA (Homo sapiens) CpG-island No: 16869
  misc_feature (103)..(103): n is either a, c, g or t
  misc_feature (383)..(383): n is either a, c, g or t
  misc_feature (410)..(411): n is either a, c, g or t
gtatggcgatttaagggggaaagtgataggcgaaatgggtagaggggggtaagcggcggggttagtcgggagtttaatatggtgtatattaatttgggcgganaaattttggtattttggggttggtataggcgaggggtggggaacgttgcgttcgttaggaagggtacggcgtaatagtgtgttgggcgggtagatgttggtagggcgtattaagtgcgatttcggggaatatgggaattatataggttaagagatcggaaagatcgaaggattgtcgggcgtaatttgaagagattcgtttatttcgtaaaatcggcgtgttttcgtaaacgcgatattaggtttatttcgtatgtgagttcggtatgtttatcgttttntttttttatttgtatttggtaaaaaannagcgcgttgttggcgtgtgtgtgggtttgtgtagtggggtggggttcgtggtggtggcgcggtgggggttgggtggttgttgtcggtcggtgttcggttgtttggttgtttgttgcgtgttgcggtt

SEQ ID NO: 16870 - DNA, 538 bp, Artificial Sequence
  chemically treated genomic DNA (Homo sapiens) CpG-island No: 16870
  misc_feature (128)..(129): n is either a, c, g or t
  misc_feature (156)..(156): n is either a, c, g or t
  misc_feature (436)..(436): n is either a, c, g or t
aaccgcaacacgcaacaaacaaccaaacaaccgaacaccgaccgacaacaaccacccaacccccaccgcgccaccaccacgaaccccaccccactacacaaacccacacacacgccaacaacgcgctnnttttttaccaaatacaaataaaaaaanaaaacgataaacataccgaactcacatacgaaataaacctaatatcgcgtttacgaaaacacgccgattttacgaaataaacgaatctcttcaaattacgcccgacaatccttcgatctttccgatctcttaacctatataattcccatattccccgaaatcgcacttaatacgccctaccaacatctacccgcccaacacactattacgccgtacccttcctaacgaacgcaacgttccccacccctcgcctataccaaccccaaaataccaaaatttntccgcccaaattaatatacaccatattaaactcccgactaaccccgccgcttacccccctctacccatttcgcctatcactttcccccttaaatcgccatac

SEQ ID NO: 16871 - DNA, 538 bp, Artificial Sequence
  chemically treated genomic DNA (Homo sapiens) CpG-island No: 16871
  misc_feature (128)..(129): n is either a, c, g or t
  misc_feature (156)..(156): n is either a, c, g or t
  misc_feature (436)..(436): n is either a, c, g or t
gatcgtagtacgtagtaggtaattaagtaatcgaatatcggtcgataataattatttagtttttatcgcgttattattacggattttattttattgtatagatttatatatacgttagtaacgcgttnnttttttgttagatataagtagaggggngaggcggtgaatatatcgggtttatatacgagataggtttagtatcgcgtttgcgaggatacgtcggttttacgaggtgggcgggtttttttaaattgcgttcggtaatttttcggttttttcgattttttggtttgtatagtttttatatttttcgggatcgtatttgatgcgttttgttagtatttattcgtttagtatattattgcgtcgtattttttttaacgggcgtaacgttttttatttttcgtttgtattagttttaaaatgttaaggtttnttcgtttaggttaatgtatattatattaaattttcggttaatttcgtcgtttatttttttttatttatttcgtttgttatttttttttttaggtcgttatat

SEQ ID NO: 16872 - DNA, 538 bp, Artificial Sequence
  chemically treated genomic DNA (Homo sapiens) CpG-island No: 16872
  misc_feature (103)..(103): n is either a, c, g or t
  misc_feature (383)..(383): n is either a, c, g or t
  misc_feature (410)..(411): n is either a, c, g or t
atataacgacctaaaaaaaaaaataacaaacgaaataaataaaaaaaaataaacgacgaaattaaccgaaaatttaatataatatacattaacctaaacgaanaaaccttaacattttaaaactaatacaaacgaaaaataaaaaacgttacgcccgttaaaaaaaatacgacgcaataatatactaaacgaataaatactaacaaaacgcatcaaatacgatcccgaaaaatataaaaactatacaaaccaaaaaatcgaaaaaaccgaaaaattaccgaacgcaatttaaaaaaacccgcccacctcgtaaaaccgacgtatcctcgcaaacgcgatactaaacctatctcgtatataaacccgatatattcaccgcctcncccctctacttatatctaacaaaaaannaacgcgttactaacgtatatataaatctatacaataaaataaaatccgtaataataacgcgataaaaactaaataattattatcgaccgatattcgattacttaattacctactacgtactacgatc

SEQ ID NO: 16873 - DNA, 617 bp, Artificial Sequence
  chemically treated genomic DNA (Homo sapiens) CpG-island No: 16873
ttttacggtagtttttagtttagagttagaattacgacgcgtatttagtttttttttaatagttttgaaggaacggaatagcgtttagtttttcggatcgaatataatgatgttgattatatcgttagcgttgagcgcgtatgttttaatgttatcggtcgggttatacgtttttttgtcgcgggttgattttgtcgttttatcggtttggataatgttgttattagcgttgcggtttatatcgattttaataggttcgaacgttttttcggttatggtgtatttatcgttgagtatcgtcgaaatagtttgttttttttcgatttgagtaatcgttagttttttattttttatgttttgaaggataatgcggcgacggcgatagatcgggttagagagattttgcggatttttattcggtaggcggcggagagttattagtgggttaatttcgtgtttcggttttatataattcggcgtgaatttagacgtgttgtcgttacgggagcggattattttgtcggagataatcggcgagacgtaaagcgttatattgattaggttaggaatttgcgataggtaaattttttttgtattgaagggataggtttcgcgga

SEQ ID NO: 16874 - DNA, 617 bp, Artificial Sequence
  chemically treated genomic DNA (Homo sapiens) CpG-island No: 16874
tccgcgaaacctatcccttcaatacaaaaaaaatttacctatcgcaaattcctaacctaatcaatataacgctttacgtctcgccgattatctccgacaaaataatccgctcccgtaacgacaacacgtctaaattcacgccgaattatataaaaccgaaacacgaaattaacccactaataactctccgccgcctaccgaataaaaatccgcaaaatctctctaacccgatctatcgccgtcgccgcattatccttcaaaacataaaaaataaaaaactaacgattactcaaatcgaaaaaaaacaaactatttcgacgatactcaacgataaatacaccataaccgaaaaaacgttcgaacctattaaaatcgatataaaccgcaacgctaataacaacattatccaaaccgataaaacgacaaaatcaacccgcgacaaaaaaacgtataacccgaccgataacattaaaacatacgcgctcaacgctaacgatataatcaacatcattatattcgatccgaaaaactaaacgctattccgttccttcaaaactattaaaaaaaaactaaatacgcgtcgtaattctaactctaaactaaaaactaccgtaaaa

SEQ ID NO: 16875 - DNA, 617 bp, Artificial Sequence
  chemically treated genomic DNA (Homo sapiens) CpG-island No: 16875
ttcgcgaaatttatttttttagtatagagaaggtttatttgtcgtaaatttttggtttggttaatatggcgttttacgtttcgtcgattgttttcggtaaagtgattcgttttcgtggcggtagtacgtttgaatttacgtcgggttatgtgaagtcgaaatacgaagttaatttattgatgatttttcgtcgtttgtcggatgaggattcgtagaatttttttgattcggtttatcgtcgtcgtcgtattattttttagaatatgaaggatgaagagttggcgattgtttaggtcgaagagaaataggttgtttcggcggtgtttagcggtaaatatattatgatcggggaagcgttcgagtttgttgaagtcgatatgggtcgtagcgttggtaataatattgtttaggtcggtggggcggtagggttaattcgcgataaagaaacgtatgattcgatcgatgatattgaagtatacgcgtttaacgttagcggtgtggttaatattattgtgttcgattcgaaaggttgggcgttgtttcgtttttttaaggttgttgagaagaagttggatacgcgtcgtggttttaattttgagttggaaattgtcgtgaaa

SEQ ID NO: 16876 - DNA, 617 bp, Artificial Sequence
  chemically treated genomic DNA (Homo sapiens) CpG-island No: 16876
tttcacgacaatttccaactcaaaattaaaaccacgacgcgtatccaacttcttctcaacaaccttaaaaaaacgaaacaacgcccaacctttcgaatcgaacacaataatattaaccacaccgctaacgttaaacgcgtatacttcaatatcatcgatcgaatcatacgtttctttatcgcgaattaaccctaccgccccaccgacctaaacaatattattaccaacgctacgacccatatcgacttcaacaaactcgaacgcttccccgatcataatatatttaccgctaaacaccgccgaaacaacctatttctcttcgacctaaacaatcgccaactcttcatccttcatattctaaaaaataatacgacgacgacgataaaccgaatcaaaaaaattctacgaatcctcatccgacaaacgacgaaaaatcatcaataaattaacttcgtatttcgacttcacataacccgacgtaaattcaaacgtactaccgccacgaaaacgaatcactttaccgaaaacaatcgacgaaacgtaaaacgccatattaaccaaaccaaaaatttacgacaaataaaccttctctatactaaaaaaataaatttcgcgaa

SEQ ID NO: 16877 - DNA, 1140 bp, Artificial Sequence
  chemically treated genomic DNA (Homo sapiens) CpG-island No: 16877
ttgtgatgcgggggttagcgggagaggtattcggaagttttcggcgtttgtatttcggtagcgcgaggaaatgtttaaaggtgggtttttaggcgtgggaagttcgatttttttcggggttttcggcgaagtggtcgaggtcgcgttttacgtagggaatttcgtcgggttatttgggtggttcgagttcgtagtagtttttttttcgttcgtttttcggttttttcgacgcgtatttatcggttttattaagtcgtacgtagaggggcggcggggcgttgatcgaggtttaggtttcgattgtcgtcggtcgagtcgcgtagtttgtttgtagatttcggttttttgttcgcgtagtttcggttttattaggttcggtttttcgttcgggtcgtggttttattaatcgtagatttcgttcgtcgtagtcgtatttgcgaggaggggttcgcgcgtcgttgtagtcgtcgtcgtagcgtcgtcgtttcggtttcgtttttatcgcggcgtttcgagattattcgttttcgggcggtttggttttttgtaggcgaggagcggaagtcgttatttggaggcggatttcggcgttatagagtcggggtagtcgcggtaacggcgaggcgcgaggtaggggcgttcggtagatttcgcgatttcgagttagcgggcgtttcgagcgggtagtttcgtcgggggaggcggaggcggttacggcggtcgcgttcgggcgtttttcgcgtagcgttttatgttcgtgtggtgttgtcgttgttttttggtcggttattttaggtgattttttcgtcggggatgggaggggagtaggcggggatgtcgcgttttcgagttttttggtttggttcgggtcgggatcggggtggagggcgagcgtttggatcgtagcgttttttcgtttcggtcgttttgtttggcgtgggggtggggtggggtgcggtgtggtggggtttttgtttcggggagttttgcgttgtttttttttttcgttttggatcgcgcgggttacgggattgcgggatcggttaggtcggattgagtcggttacggcgagttgagattttttagtagtgtaaagttttagtgaagggggttttatgaagtgtttgtttttttaaaaaa

SEQ ID NO: 16878 - DNA, 1140 bp, Artificial Sequence
  chemically treated genomic DNA (Homo sapiens) CpG-island No: 16878
ttttttaaaaaaacaaacacttcataaaacccccttcactaaaactttacactactaaaaaatctcaactcgccgtaaccgactcaatccgacctaaccgatcccgcaatcccgtaacccgcgcgatccaaaacgaaaaaaaaaaacaacgcaaaactccccgaaacaaaaaccccaccacaccgcaccccaccccacccccacgccaaacaaaacgaccgaaacgaaaaaacgctacgatccaaacgctcgccctccaccccgatcccgacccgaaccaaaccaaaaaactcgaaaacgcgacatccccgcctactcccctcccatccccgacgaaaaaatcacctaaaataaccgaccaaaaaacaacgacaacaccacacgaacataaaacgctacgcgaaaaacgcccgaacgcgaccgccgtaaccgcctccgcctcccccgacgaaactacccgctcgaaacgcccgctaactcgaaatcgcgaaatctaccgaacgcccctacctcgcgcctcgccgttaccgcgactaccccgactctataacgccgaaatccgcctccaaataacgacttccgctcctcgcctacaaaaaaccaaaccgcccgaaaacgaataatctcgaaacgccgcgataaaaacgaaaccgaaacgacgacgctacgacgacgactacaacgacgcgcgaacccctcctcgcaaatacgactacgacgaacgaaatctacgattaataaaaccacgacccgaacgaaaaaccgaacctaataaaaccgaaactacgcgaacaaaaaaccgaaatctacaaacaaactacgcgactcgaccgacgacaatcgaaacctaaacctcgatcaacgccccgccgcccctctacgtacgacttaataaaaccgataaatacgcgtcgaaaaaaccgaaaaacgaacgaaaaaaaaactactacgaactcgaaccacccaaataacccgacgaaattccctacgtaaaacgcgacctcgaccacttcgccgaaaaccccgaaaaaaatcgaacttcccacgcctaaaaacccacctttaaacatttcctcgcgctaccgaaatacaaacgccgaaaacttccgaatacctctcccgctaacccccgcatcacaa

SEQ ID NO: 16879 - DNA, 1140 bp, Artificial Sequence
  chemically treated genomic DNA (Homo sapiens) CpG-island No: 16879
ttttttagggaggtaggtattttatagaattttttttattaaaattttgtattattgggaagttttagttcgtcgtaatcgatttagttcggtttagtcgatttcgtagtttcgtgattcgcgcggtttagagcgagaaaagggaatagcgtagggtttttcggagtaaggattttattatatcgtattttattttatttttacgttaggtaggacggtcgaggcgggaggacgttgcggtttaggcgttcgttttttatttcggtttcggttcgggttaggttaaaaagttcgagagcgcggtattttcgtttgttttttttttattttcggcgaggaagttatttgaaatgatcggttagggagtagcggtagtattatacgggtatggagcgttgcgcgaggggcgttcgagcgcggtcgtcgtggtcgttttcgtttttttcggcgaggttgttcgttcggggcgttcgttggttcggggtcgcggggtttgtcgggcgtttttgtttcgcgtttcgtcgttgtcgcggttgtttcggttttgtggcgtcggagttcgtttttagatagcggttttcgtttttcgtttgtagggagttaggtcgttcggaggcgggtgatttcggggcgtcgcgataggggcggagtcggggcggcgacgttgcgacggcggttgtagcggcgcgcgggttttttttcgtaggtgcggttgcggcgggcgaagtttgcgattggtggagttacggttcgggcgaggggtcgggtttgatggagtcgaggttgcgcgggtaggggatcgaggtttgtaggtaaattgcgcggttcgatcggcggtaatcgagatttagatttcggttagcgtttcgtcgtttttttgcgtgcgatttggtgaggtcggtgggtgcgcgtcgagagggtcgagggacgagcggaagagaagttgttgcgaattcgggttatttagatggttcggcggagttttttgcgtaaggcgcggtttcggttatttcgtcgaggatttcgggaagggtcgagttttttacgtttgagaatttatttttgggtattttttcgcgttgtcggggtgtagacgtcgggagttttcgggtgtttttttcgttgattttcgtattatag

SEQ ID NO: 16880 - DNA, 1140 bp, Artificial Sequence
  chemically treated genomic DNA (Homo sapiens) CpG-island No: 16880
ctataatacgaaaatcaacgaaaaaaacacccgaaaactcccgacgtctacaccccgacaacgcgaaaaaatacccaaaaataaattctcaaacgtaaaaaactcgacccttcccgaaatcctcgacgaaataaccgaaaccgcgccttacgcaaaaaactccgccgaaccatctaaataacccgaattcgcaacaacttctcttccgctcgtccctcgaccctctcgacgcgcacccaccgacctcaccaaatcgcacgcaaaaaaacgacgaaacgctaaccgaaatctaaatctcgattaccgccgatcgaaccgcgcaatttacctacaaacctcgatcccctacccgcgcaacctcgactccatcaaacccgacccctcgcccgaaccgtaactccaccaatcgcaaacttcgcccgccgcaaccgcacctacgaaaaaaaacccgcgcgccgctacaaccgccgtcgcaacgtcgccgccccgactccgcccctatcgcgacgccccgaaatcacccgcctccgaacgacctaactccctacaaacgaaaaacgaaaaccgctatctaaaaacgaactccgacgccacaaaaccgaaacaaccgcgacaacgacgaaacgcgaaacaaaaacgcccgacaaaccccgcgaccccgaaccaacgaacgccccgaacgaacaacctcgccgaaaaaaacgaaaacgaccacgacgaccgcgctcgaacgcccctcgcgcaacgctccatacccgtataatactaccgctactccctaaccgatcatttcaaataacttcctcgccgaaaataaaaaaaaaacaaacgaaaataccgcgctctcgaactttttaacctaacccgaaccgaaaccgaaataaaaaacgaacgcctaaaccgcaacgtcctcccgcctcgaccgtcctacctaacgtaaaaataaaataaaatacgatataataaaatccttactccgaaaaaccctacgctattcccttttctcgctctaaaccgcgcgaatcacgaaactacgaaatcgactaaaccgaactaaatcgattacgacgaactaaaacttcccaataatacaaaattttaataaaaaaaattctataaaatacctacctccctaaaaaa

SEQ ID NO: 16881 - DNA, 601 bp, Artificial Sequence
  chemically treated genomic DNA (Homo sapiens) CpG-island No: 16881
tacgtcgtttgggttttagttttcgttttatttttcggcggtttaggtagcgtttttagtttcgagaattttgttttttttgtttcgttttttgcgtttaatcgtttgcgtcgtttttcggttcgagttttggagatttaatatgaagttatcggttagggttttttttattttggggtttcggttgttttgtggtttcgtttttcggagggtaaggcggtcgggggcgcggggagcgaggatagggcgtttcgacgcgtaaagagagaggatagggcgttacgggggttcggggagcgaggataaggtattttggggcgtaaagagagaggatagggcgtttcgggggttcggggagcgaggatagggtatttcgaggcgtagagagagagaggatagggcgtttcggggtttcggggagcgaggatagggtgtttcggggtttaaagagagaggatagggcgttttggagcgttaagagagtatagagtaattcggggagcgagagagaggataggacgtttcggggcgtaagagaaagggtaggaagttttggggtataaagagaggattcggcgtttttggggtttagggagttagg

SEQ ID NO: 16882 - DNA, 601 bp, Artificial Sequence
  chemically treated genomic DNA (Homo sapiens) CpG-island No: 16882
cctaactccctaaaccccaaaaacgccgaatcctctctttataccccaaaacttcctaccctttctcttacgccccgaaacgtcctatcctctctctcgctccccgaattactctatactctcttaacgctccaaaacgccctatcctctctctttaaaccccgaaacaccctatcctcgctccccgaaaccccgaaacgccctatcctctctctctctacgcctcgaaataccctatcctcgctccccgaacccccgaaacgccctatcctctctctttacgccccaaaataccttatcctcgctccccgaacccccgtaacgccctatcctctctctttacgcgtcgaaacgccctatcctcgctccccgcgcccccgaccgccttaccctccgaaaaacgaaaccacaaaacaaccgaaaccccaaaataaaaaaaaccctaaccgataacttcatattaaatctccaaaactcgaaccgaaaaacgacgcaaacgattaaacgcaaaaaacgaaacaaaaaaaacaaaattctcgaaactaaaaacgctacctaaaccgccgaaaaataaaacgaaaactaaaacccaaacgacgta

SEQ ID NO: 16883 - DNA, 601 bp, Artificial Sequence
  chemically treated genomic DNA (Homo sapiens) CpG-island No: 16883
tttagttttttgagttttagggacgtcgggttttttttttgtgttttaagattttttgtttttttttttgcgtttcgagacgttttgttttttttttcgtttttcgggttgttttgtgtttttttagcgttttagaacgttttgttttttttttttgagtttcgggatattttgttttcgtttttcgaggtttcgggacgttttgttttttttttttttgcgtttcgggatgttttgttttcgtttttcgaattttcgggacgttttgttttttttttttgcgttttaggatgttttgttttcgtttttcgagttttcgtgacgttttgttttttttttttgcgcgtcgagacgttttgttttcgtttttcgcgttttcggtcgttttatttttcgaggagcgaggttatagggtagtcgggattttagagtaaagaaaattttggtcggtagttttatgttgagtttttagaattcgggtcggaaggcggcgtaggcggttgggcgtagggggcgggataaaaagaataaagttttcggggttggaaacgttgtttaggtcgtcgggggatgggacggggattgggatttaggcggcgtg

SEQ ID NO: 16884 - DNA, 601 bp, Artificial Sequence
  chemically treated genomic DNA (Homo sapiens) CpG-island No: 16884
cacgccgcctaaatcccaatccccgtcccatcccccgacgacctaaacaacgtttccaaccccgaaaactttattctttttatcccgccccctacgcccaaccgcctacgccgccttccgacccgaattctaaaaactcaacataaaactaccgaccaaaattttctttactctaaaatcccgactaccctataacctcgctcctcgaaaaataaaacgaccgaaaacgcgaaaaacgaaaacaaaacgtctcgacgcgcaaaaaaaaaaaacaaaacgtcacgaaaactcgaaaaacgaaaacaaaacatcctaaaacgcaaaaaaaaaaaacaaaacgtcccgaaaattcgaaaaacgaaaacaaaacatcccgaaacgcaaaaaaaaaaaaaacaaaacgtcccgaaacctcgaaaaacgaaaacaaaatatcccgaaactcaaaaaaaaaaaacaaaacgttctaaaacgctaaaaaaacacaaaacaacccgaaaaacgaaaaaaaaaacaaaacgtctcgaaacgcaaaaaaaaaaacaaaaaatcttaaaacacaaaaaaaaaacccgacgtccctaaaactcaaaaaactaaa

SEQ ID NO: 16885 - DNA, 555 bp, Artificial Sequence
  chemically treated genomic DNA (Homo sapiens) CpG-island No: 16885
tgcgggttattaggcgttttatttttatttcgtatcgtatatgcgggtgatgcgtgatttgataaagtagtatcgtttttttatggagttgatgacgatgttgcggtgacgtgcgtttaaacgggttgtttttgatgcgatattcgcgtcgttagcggtagttagtatagtacgattaataattttattaaggttattaataattttaggttgttttgatcggtttgcggtaatatcgtagagagcgacgttagtacgtcggaattaatgttttgtagatcgtcgattagcgcgttagtcgtgttcgttatgaaggggaacggttttatcgcgtcgttggtcgttagcggaaatagtatttcggtatcgaaaaagaatagcgcggcgggaacgagtagcgtttagatatttattacgttaaattagtcggggatttatattagtaagttagttagtaggtagtagataatcgaatgttatattaacgtggagaagcgtttattgggacgttcggtaaattatgcgttaaaaaacgttgtcggaatcggtagaata

SEQ ID NO: 16886 - DNA, 555 bp, Artificial Sequence
  chemically treated genomic DNA (Homo sapiens) CpG-island No: 16886
tattctaccgattccgacaacgttttttaacgcataatttaccgaacgtcccaataaacgcttctccacgttaatataacattcgattatctactacctactaactaacttactaatataaatccccgactaatttaacgtaataaatatctaaacgctactcgttcccgccgcgctattctttttcgataccgaaatactatttccgctaacgaccaacgacgcgataaaaccgttccccttcataacgaacacgactaacgcgctaatcgacgatctacaaaacattaattccgacgtactaacgtcgctctctacgatattaccgcaaaccgatcaaaacaacctaaaattattaataaccttaataaaattattaatcgtactatactaactaccgctaacgacgcgaatatcgcatcaaaaacaacccgtttaaacgcacgtcaccgcaacatcgtcatcaactccataaaaaaacgatactactttatcaaatcacgcatcacccgcatatacgatacgaaataaaaataaaacgcctaataacccgca

SEQ ID NO: 16887 - DNA, 555 bp, Artificial Sequence
  chemically treated genomic DNA (Homo sapiens) CpG-island No: 16887
tattttgtcgatttcggtagcgttttttggcgtatggtttgtcggacgttttaataaacgtttttttacgttaatgtggtattcggttatttgttgtttgttggttggtttgttgatgtggattttcgattggtttggcgtgatgaatgtttggacgttgttcgttttcgtcgcgttgttttttttcggtgtcgggatgttgttttcgttggcgattagcggcgcgatggagtcgtttttttttatggcgggtacggttggcgcgttggtcggcggtttgtaaaatattggtttcggcgtgttggcgtcgttttttgcgatgttgtcgtaaatcggttagggtagtttggggttgttgatgattttaatgggattgttgatcgtgttgtgttggttgtcgttggcgacgcggatgtcgtattaggggtagttcgtttaagcgtacgttatcgtagtatcgttattagttttatgggagaacgatgttgttttattagattacgtattattcgtatatgcggtgcggagtaagaataaaacgtttgatagttcgta

SEQ ID NO: 16888 - DNA, 555 bp, Artificial Sequence
  chemically treated genomic DNA (Homo sapiens) CpG-island No: 16888
tacgaactatcaaacgttttattcttactccgcaccgcatatacgaataatacgtaatctaataaaacaacatcgttctcccataaaactaataacgatactacgataacgtacgcttaaacgaactacccctaatacgacatccgcgtcgccaacgacaaccaacacaacacgatcaacaatcccattaaaatcatcaacaaccccaaactaccctaaccgatttacgacaacatcgcaaaaaacgacgccaacacgccgaaaccaatattttacaaaccgccgaccaacgcgccaaccgtacccgccataaaaaaaaacgactccatcgcgccgctaatcgccaacgaaaacaacatcccgacaccgaaaaaaaacaacgcgacgaaaacgaacaacgtccaaacattcatcacgccaaaccaatcgaaaatccacatcaacaaaccaaccaacaaacaacaaataaccgaataccacattaacgtaaaaaaacgtttattaaaacgtccgacaaaccatacgccaaaaaacgctaccgaaatcgacaaaata

SEQ ID NO: 16889 - DNA, 553 bp, Artificial Sequence
  chemically treated genomic DNA (Homo sapiens) CpG-island No: 16889
cgcgtgcgcggtgtatcgatcggacgcgttttcggtatttagcgggttatattgaaggttatattagtataaagaattaataaaaagagataataggcgcgttagttttatatcgtatttagtagatcgtcgattagcggtgcgagtaacggattgacgagaatttttatgtttaataggttgttagtatggcgtaattgtgttcgtttatataaatttcgcggtaaagtacgcgttattacgtcgttaacgtcggtgtttattttttgtatcgcgttggcggtaattaatatcgttaaattggaggtcgtgatcgcgattagcgttgttagtataaaaatggatatttcgacgaggattatcggtcggcggtttacgcggtcggaaatcgggttataaaatagttgtgagatatcgtaagttagtagataagcgtttattacgttttgtatcgtttttttacggacgttgagatcgcgcgttatatcggtaatagttggaatataaatggtttgcgttatttgatcgacggttacgagtaatattaatatta

SEQ ID NO: 16890 - DNA, 553 bp, Artificial Sequence
  chemically treated genomic DNA (Homo sapiens) CpG-island No: 16890
taatattaatattactcgtaaccgtcgatcaaataacgcaaaccatttatattccaactattaccgatataacgcgcgatctcaacgtccgtaaaaaaacgatacaaaacgtaataaacgcttatctactaacttacgatatctcacaactattttataacccgatttccgaccgcgtaaaccgccgaccgataatcctcgtcgaaatatccatttttatactaacaacgctaatcgcgatcacgacctccaatttaacgatattaattaccgccaacgcgatacaaaaaataaacaccgacgttaacgacgtaataacgcgtactttaccgcgaaatttatataaacgaacacaattacgccatactaacaacctattaaacataaaaattctcgtcaatccgttactcgcaccgctaatcgacgatctactaaatacgatataaaactaacgcgcctattatctctttttattaattctttatactaatataaccttcaatataacccgctaaataccgaaaacgcgtccgatcgatacaccgcgcacgcg

SEQ ID NO: 16891 - DNA, 553 bp, Artificial Sequence
  chemically treated genomic DNA (Homo sapiens) CpG-island No: 16891
tgatgttggtattattcgtggtcgtcggttagatggcgtaaattatttatattttagttattgtcgatatggcgcgcgattttaacgttcgtgaaggggcggtgtagagcgtaatgggcgtttatttgttgatttacggtgttttatagttgttttatggttcgattttcgatcgcgtgggtcgtcgatcggtgattttcgtcggaatgtttatttttatgttggtaacgttggtcgcggttacgatttttagtttgacggtgttgattgtcgttagcgcgatgtaggggatgggtatcggcgttggcggcgtaatggcgcgtattttatcgcgagatttatatgaacggatatagttgcgttatgttaatagtttgttaaatatggggattttcgttagttcgttgttcgtatcgttaatcggcggtttgttggatacgatgtggaattggcgcgtttgttatttttttttgttggttttttgtgttggtgtgatttttagtatggttcgttggatgtcggaaacgcgttcggtcgatgtatcgcgtacgcg

SEQ ID NO: 16892 - DNA, 553 bp, Artificial Sequence
  chemically treated genomic DNA (Homo sapiens) CpG-island No: 16892
cgcgtacgcgatacatcgaccgaacgcgtttccgacatccaacgaaccatactaaaaatcacaccaacacaaaaaaccaacaaaaaaaaataacaaacgcgccaattccacatcgtatccaacaaaccgccgattaacgatacgaacaacgaactaacgaaaatccccatatttaacaaactattaacataacgcaactatatccgttcatataaatctcgcgataaaatacgcgccattacgccgccaacgccgatacccatcccctacatcgcgctaacgacaatcaacaccgtcaaactaaaaatcgtaaccgcgaccaacgttaccaacataaaaataaacattccgacgaaaatcaccgatcgacgacccacgcgatcgaaaatcgaaccataaaacaactataaaacaccgtaaatcaacaaataaacgcccattacgctctacaccgccccttcacgaacgttaaaatcgcgcgccatatcgacaataactaaaatataaataatttacgccatctaaccgacgaccacgaataataccaacatca

SEQ ID NO: 16893 - DNA, 610 bp, Artificial Sequence
  chemically treated genomic DNA (Homo sapiens) CpG-island No: 16893
atttttatatttttcgggtcgttagtttttcgaagtaggttttagtttcggcgtaagttgtttttttcgtagttttcgttcgtcgttagttcggtatcgtcggacggcgtttttttagtttcgcgtttcgttttttagtttttttcgcgcgttcgagtttacgtcgtttgtttcggttgttaagttttttagacggtcgggttttttcggtatagcgcgggaatttcggttttcggttttacgggacgagggttatagggttcggtcggcgagttagggtatttcggggtttttaggcggtttatcgtttttatttttatcggcgttttttaagtttttagatcgttttcgtcgcgtttttagcgtcgtcgttttcgggtcggtcgaggtttcgcggcgagtttcgtttagcgtttcggaggcgtagttttacggttcgagcgtgcgtagcgtttttcgcggtcgcgtataagcgtaggcgacggtataggaaaggaggtcgcggcgcgttcggttcggttttttttttagttcgttttcggggtcgttggcggtgttcgcgttttcgcgttcgtttttgatttttttcgggcggcggcggcggcggcgg

SEQ ID NO: 16894 - DNA, 610 bp, Artificial Sequence
  chemically treated genomic DNA (Homo sapiens) CpG-island No: 16894
ccgccgccgccgccgccgcccgaaaaaaatcaaaaacgaacgcgaaaacgcgaacaccgccaacgaccccgaaaacgaactaaaaaaaaaaccgaaccgaacgcgccgcgacctcctttcctataccgtcgcctacgcttatacgcgaccgcgaaaaacgctacgcacgctcgaaccgtaaaactacgcctccgaaacgctaaacgaaactcgccgcgaaacctcgaccgacccgaaaacgacgacgctaaaaacgcgacgaaaacgatctaaaaacttaaaaaacgccgataaaaataaaaacgataaaccgcctaaaaaccccgaaataccctaactcgccgaccgaaccctataaccctcgtcccgtaaaaccgaaaaccgaaattcccgcgctataccgaaaaaacccgaccgtctaaaaaacttaacaaccgaaacaaacgacgtaaactcgaacgcgcgaaaaaaactaaaaaacgaaacgcgaaactaaaaaaacgccgtccgacgataccgaactaacgacgaacgaaaactacgaaaaaaacaacttacgccgaaactaaaacctacttcgaaaaactaacgacccgaaaaatataaaaat

SEQ ID NO: 16895 - DNA, 610 bp, Artificial Sequence
  chemically treated genomic DNA (Homo sapiens) CpG-island No: 16895
tcgtcgtcgtcgtcgtcgttcggaggaaattaggggcgggcgcggaggcgcggatatcgttagcggtttcgggggcgggttggggagggggtcgggtcgggcgcgtcgcggtttttttttttgtgtcgtcgtttgcgtttgtgcgcggtcgcggggggcgttgcgtacgttcgggtcgtggggttgcgttttcggggcgttgggcgggattcgtcgcggagtttcggtcggttcgggggcggcggcgttgagggcgcggcggggacggtttgggggtttgggggacgtcggtgggggtgagggcggtgggtcgtttggagatttcggggtgttttggttcgtcggtcgggttttgtagttttcgtttcgtggggtcgggggtcggggttttcgcgttgtgtcgggagggttcggtcgtttggaagatttggtagtcggggtaagcgacgtgggttcggacgcgcgaggagggttggggagcggggcgcggggttggaagggcgtcgttcggcggtgtcgggttggcggcgggcggggattgcggaggaggtagtttgcgtcggggttggggtttgtttcgggggattagcggttcgggaggtatggaggt

SEQ ID NO: 16896 - DNA, 610 bp, Artificial Sequence
  chemically treated genomic DNA (Homo sapiens) CpG-island No: 16896
acctccatacctcccgaaccgctaatcccccgaaacaaaccccaaccccgacgcaaactacctcctccgcaatccccgcccgccgccaacccgacaccgccgaacgacgcccttccaaccccgcgccccgctccccaaccctcctcgcgcgtccgaacccacgtcgcttaccccgactaccaaatcttccaaacgaccgaaccctcccgacacaacgcgaaaaccccgacccccgaccccacgaaacgaaaactacaaaacccgaccgacgaaccaaaacaccccgaaatctccaaacgacccaccgccctcacccccaccgacgtcccccaaacccccaaaccgtccccgccgcgccctcaacgccgccgcccccgaaccgaccgaaactccgcgacgaatcccgcccaacgccccgaaaacgcaaccccacgacccgaacgtacgcaacgccccccgcgaccgcgcacaaacgcaaacgacgacacaaaaaaaaaaaccgcgacgcgcccgacccgaccccctccccaacccgcccccgaaaccgctaacgatatccgcgcctccgcgcccgcccctaatttcctccgaacgacgacgacgacgacga

SEQ ID NO: 16897 - DNA, 521 bp, Artificial Sequence
  chemically treated genomic DNA (Homo sapiens) CpG-island No: 16897
ggtagtgttattggtatgataattcgaatattagtgatgcgtttatttcggttttttcgtattaggagtagttttttttagttttttagcgtttacggtagatagggatcgaattgttttacgacgttttaaatttagttcgcgtattattttaaatggcgaatagttatatttttgggatttattttagttttaggatgtgatgagtcgatatcgaggtgttaaatatcgtcgtcgatatgaatttttgggcggtattagtttgttattttcggagtattttttattcgttgagcgatggtttttttatttagaattatcggattattatgatttgttttcgtatttgttcgcgtcgttacgttcgtagttagttggtttatgttattgtattaatttttggatgttcgataggattagtaattttcgtgttttttcgttattttttaagaggagaacgtttagttaaattatttattagatattgttcgaatcggattacgggttaacgttgaatatta

SEQ ID NO: 16898 - DNA, 521 bp, Artificial Sequence
  chemically treated genomic DNA (Homo sapiens) CpG-island No: 16898
taatattcaacgttaacccgtaatccgattcgaacaatatctaataaataatttaactaaacgttctcctcttaaaaaataacgaaaaaacacgaaaattactaatcctatcgaacatccaaaaattaatacaataacataaaccaactaactacgaacgtaacgacgcgaacaaatacgaaaacaaatcataataatccgataattctaaataaaaaaaccatcgctcaacgaataaaaaatactccgaaaataacaaactaataccgcccaaaaattcatatcgacgacgatatttaacacctcgatatcgactcatcacatcctaaaactaaaataaatcccaaaaatataactattcgccatttaaaataatacgcgaactaaatttaaaacgtcgtaaaacaattcgatccctatctaccgtaaacgctaaaaaactaaaaaaaactactcctaatacgaaaaaaccgaaataaacgcatcactaatattcgaattatcataccaataacactacc

SEQ ID NO: 16899 - DNA, 521 bp, Artificial Sequence
  chemically treated genomic DNA (Homo sapiens) CpG-island No: 16899
tgatgtttaacgttgattcgtaattcggttcggatagtgtttggtgggtagtttgattgggcgttttttttttaaagagtaacggaggagtacgaaggttgttaattttgtcggatatttaggagttagtgtaatggtataagttagttgattgcgagcgtgacggcgcgagtaggtgcgaaagtaggttatagtgattcggtggttttgaatggaagggttatcgtttaacggataaaaggtatttcggggataataggttgatatcgtttaagagtttatatcgacggcggtgtttggtatttcgatgtcggtttattatattttggggttgaagtaggttttaagggtatggttgttcgttatttaaagtggtacgcgagttgggtttagaacgtcgtgagatagttcggtttttatttgtcgtgggcgttggagaattgaggggggttgtttttagtacgagaggatcggagtggacgtattattggtgttcgggttgttatgttaatggtattgtt

SEQ ID NO: 16900 - DNA, 521 bp, Artificial Sequence
  chemically treated genomic DNA (Homo sapiens) CpG-island No: 16900
aacaataccattaacataacaacccgaacaccaataatacgtccactccgatcctctcgtactaaaaacaacccccctcaattctccaacgcccacgacaaataaaaaccgaactatctcacgacgttctaaacccaactcgcgtaccactttaaataacgaacaaccatacccttaaaacctacttcaaccccaaaatataataaaccgacatcgaaataccaaacaccgccgtcgatataaactcttaaacgatatcaacctattatccccgaaataccttttatccgttaaacgataacccttccattcaaaaccaccgaatcactataacctactttcgcacctactcgcgccgtcacgctcgcaatcaactaacttataccattacactaactcctaaatatccgacaaaattaacaaccttcgtactcctccgttactctttaaaaaaaaaacgcccaatcaaactacccaccaaacactatccgaaccgaattacgaatcaacgttaaacatca

SEQ ID NO: 16901 - DNA, 790 bp, Artificial Sequence
  chemically treated genomic DNA (Homo sapiens) CpG-island No: 16901
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgaaattcggagataacggatgattaagtttaatttcgattttcggtttataagggcgcgtggttatttattttttgcgtcgttttatttaacgggtttttggagggtttatttttatcgtttttgtcgagaggtttgaattttaatcgttaggggggaattttaattataatttgtttcgggaagg

SEQ ID NO: 16902 - DNA, 790 bp, Artificial Sequence
  chemically treated genomic DNA (Homo sapiens) CpG-island No: 16902
ccttcccgaaacaaattataattaaaattcccccctaacgattaaaattcaaacctctcgacaaaaacgataaaaataaaccctccaaaaacccgttaaataaaacgacgcaaaaaataaataaccacgcgcccttataaaccgaaaatcgaaattaaacttaatcatccgttatctccgaatttcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 16903 - DNA, 790 bp, Artificial Sequence
  chemically treated genomic DNA (Homo sapiens) CpG-island No: 16903
ttttttcgggataggttgtggttagagtttttttttgacgattaagatttaggtttttcggtagaaacgatgggaatggattttttagagattcgttgaataggacggcgtaaaaagtggatagttacgcgtttttatgggtcggggatcgggattaagtttagttattcgttgttttcgggtttcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 16904 - DNA, 790 bp, Artificial Sequence
  chemically treated genomic DNA (Homo sapiens) CpG-island No: 16904
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgaaacccgaaaacaacgaataactaaacttaatcccgatccccgacccataaaaacgcgtaactatccactttttacgccgtcctattcaacgaatctctaaaaaatccattcccatcgtttctaccgaaaaacctaaatcttaatcgtcaaaaaaaaactctaaccacaacctatcccgaaaaaa

SEQ ID NO: 16905 - DNA, 591 bp, Artificial Sequence
  chemically treated genomic DNA (Homo sapiens) CpG-island No: 16905
ttgttgtcgcgaggggattttgcggggaggcgaggggcgacggggcgagcggggcgcgggtcgatagaggtcgcgggcggcggggtttcgggcgcggcggcggcggttttttttcgcggttgcggcgtttttttcgagcgcggttgttttagtaggggattcgtaagtttaagtttatttttgttgtttttttatataataaagatttgtcgggaaaaaaaagaggagggacgcggcggagtcgggataaaacgtaatttgatatgtggttttattgtacgttgtgtcgaggtatagtcgtataaatgatcgggtcgttcgaggttgtttgtatacggttttcgagtcggatagggatttagttaaggaataattagagcgttatttttcgcgtggtaaaatcgtttttcgtgttgtttttttttggttttcgatttttgttcggtttaacgggatatttttcgttcgcgtttttttttttttttcgggtaaaatatggcggtttattttttataggttataatcgtttataaggttatttttatatagatcggattttagcgtttatcggagttttaacgttaggtttag

SEQ ID NO: 16906 - DNA, 591 bp, Artificial Sequence
  chemically treated genomic DNA (Homo sapiens) CpG-island No: 16906
ctaaacctaacgttaaaactccgataaacgctaaaatccgatctatataaaaataaccttataaacgattataacctataaaaaataaaccgccatattttacccgaaaaaaaaaaaaaaacgcgaacgaaaaatatcccgttaaaccgaacaaaaatcgaaaaccaaaaaaaaacaacacgaaaaacgattttaccacgcgaaaaataacgctctaattattccttaactaaatccctatccgactcgaaaaccgtatacaaacaacctcgaacgacccgatcatttatacgactatacctcgacacaacgtacaataaaaccacatatcaaattacgttttatcccgactccgccgcgtccctcctcttttttttcccgacaaatctttattatataaaaaaacaacaaaaataaacttaaacttacgaatcccctactaaaacaaccgcgctcgaaaaaaacgccgcaaccgcgaaaaaaaaccgccgccgccgcgcccgaaaccccgccgcccgcgacctctatcgacccgcgccccgctcgccccgtcgcccctcgcctccccgcaaaatcccctcgcgacaacaa

SEQ ID NO: 16907 - DNA, 591 bp, Artificial Sequence
  chemically treated genomic DNA (Homo sapiens) CpG-island No: 16907
ttaggtttagcgttggggtttcggtggacgttaaaattcggtttgtgtgagaataattttataggcggttgtggtttatggagggtaggtcgttatgttttgttcgaagggggaaggaaggcgcggacgagggatatttcgttaagtcgggtaggggtcgggaattaggaaggagtagtacggagggcggttttgttacgcgggggataacgttttggttattttttgattaggtttttgttcggttcggaggtcgtatgtaggtaatttcgagcgattcggttatttatacggttgtgtttcggtatagcgtataatggagttatatattaggttacgttttatttcgatttcgtcgcgtttttttttttttttttttcggtagatttttgttgtgtgggagggtagtagggatggatttgagtttgcggattttttgttagagtagtcgcgttcggagaaggcgtcgtagtcgcgaggaggagtcgtcgtcgtcgcgttcgaggtttcgtcgttcgcggtttttgtcggttcgcgtttcgttcgtttcgtcgtttttcgttttttcgtagagttttttcgcggtagtag

SEQ ID NO: 16908 - DNA, 591 bp, Artificial Sequence
  chemically treated genomic DNA (Homo sapiens) CpG-island No: 16908
ctactaccgcgaaaaaactctacgaaaaaacgaaaaacgacgaaacgaacgaaacgcgaaccgacaaaaaccgcgaacgacgaaacctcgaacgcgacgacgacgactcctcctcgcgactacgacgccttctccgaacgcgactactctaacaaaaaatccgcaaactcaaatccatccctactaccctcccacacaacaaaaatctaccgaaaaaaaaaaaaaaaaaaacgcgacgaaatcgaaataaaacgtaacctaatatataactccattatacgctataccgaaacacaaccgtataaataaccgaatcgctcgaaattacctacatacgacctccgaaccgaacaaaaacctaatcaaaaaataaccaaaacgttatcccccgcgtaacaaaaccgccctccgtactactccttcctaattcccgacccctacccgacttaacgaaatatccctcgtccgcgccttccttcccccttcgaacaaaacataacgacctaccctccataaaccacaaccgcctataaaattattctcacacaaaccgaattttaacgtccaccgaaaccccaacgctaaacctaa

SEQ ID NO: 16909 - DNA, 624 bp, Artificial Sequence
  chemically treated genomic DNA (Homo sapiens) CpG-island No: 16909
gaagttagtatagataagacggtgtatagtgttttatttttttttggatagtttatcgcgtagggtcggtcgagcgtttagtttttagatagcgcgtttgattatttagagtattagcgaagtattagggttatagtacgcgttttttttgacgtaggcgaagatagcggggttttaggcgtcgagggtatatcgtttcgtatcgaaaacgtttcgttcggcgcgatgaaggtagaacgtttattttttaattagattgtatgacgttttattttgtaaattattgcgcggtttcgtattttgtaagtattgcggcgttttgtagcggtaattcgaacggagttgttgatacggcgtaatagaggagtattgttataagttttttatggcgattaagtacgatcgacgaggttttagtggttttatcgtgtttcgttaatttgtgcgatgtcggtgcggtggtttcgaaagtacgtataggcgtatagtgaatacgtcgttagcgtcgggagggtatattacgcgtcgacgataaagttatattatcgttttataggtcgggagttttgtatggtttgttttattcgcgttacgagaatatttgtaatttgttttgtagtagtg

SEQ ID NO: 16910 - DNA, 624 bp, Artificial Sequence
  chemically treated genomic DNA (Homo sapiens) CpG-island No: 16910
cactactacaaaacaaattacaaatattctcgtaacgcgaataaaacaaaccatacaaaactcccgacctataaaacgataatataactttatcgtcgacgcgtaatataccctcccgacgctaacgacgtattcactatacgcctatacgtactttcgaaaccaccgcaccgacatcgcacaaattaacgaaacacgataaaaccactaaaacctcgtcgatcgtacttaatcgccataaaaaacttataacaatactcctctattacgccgtatcaacaactccgttcgaattaccgctacaaaacgccgcaatacttacaaaatacgaaaccgcgcaataatttacaaaataaaacgtcatacaatctaattaaaaaataaacgttctaccttcatcgcgccgaacgaaacgttttcgatacgaaacgatataccctcgacgcctaaaaccccgctatcttcgcctacgtcaaaaaaaacgcgtactataaccctaatacttcgctaatactctaaataatcaaacgcgctatctaaaaactaaacgctcgaccgaccctacgcgataaactatccaaaaaaaaataaaacactatacaccgtcttatctatactaacttc

SEQ ID NO: 16911 - DNA, 624 bp, Artificial Sequence
  chemically treated genomic DNA (Homo sapiens) CpG-island No: 16911
tattgttataaggtagattgtaggtattttcgtggcgcgagtggggtaagttatgtaggattttcggtttgtgagacgatggtatgattttgtcgtcgacgcgtagtgtattttttcgacgttgacgacgtgtttattgtacgtttgtgcgtgttttcgagattatcgtatcggtatcgtataagttgacggggtacggtggaattattagggtttcgtcggtcgtatttagtcgttataggaggtttatggtagtgtttttttgttgcgtcgtgttagtaatttcgttcgggttgtcgttgtaggacgtcgtagtgtttgtaggatgcgggatcgcgtagtgatttataggatggggcgttatatagtttgattggaaaatgggcgttttgtttttatcgcgtcgagcggagcgttttcggtgcggagcggtatattttcggcgtttgagatttcgttgttttcgtttgcgttaggaggagcgcgtattgtggttttggtgtttcgttggtgttttgagtggttagacgcgttgtttgaggattggacgttcggtcgattttgcgcgatgaattgtttagggaggaatggagtattgtgtatcgttttgtttgtgttggtttt

SEQ ID NO: 16912 - DNA, 624 bp, Artificial Sequence
  chemically treated genomic DNA (Homo sapiens) CpG-island No: 16912
aaaaccaacacaaacaaaacgatacacaatactccattcctccctaaacaattcatcgcgcaaaatcgaccgaacgtccaatcctcaaacaacgcgtctaaccactcaaaacaccaacgaaacaccaaaaccacaatacgcgctcctcctaacgcaaacgaaaacaacgaaatctcaaacgccgaaaatataccgctccgcaccgaaaacgctccgctcgacgcgataaaaacaaaacgcccattttccaatcaaactatataacgccccatcctataaatcactacgcgatcccgcatcctacaaacactacgacgtcctacaacgacaacccgaacgaaattactaacacgacgcaacaaaaaaacactaccataaacctcctataacgactaaatacgaccgacgaaaccctaataattccaccgtaccccgtcaacttatacgataccgatacgataatctcgaaaacacgcacaaacgtacaataaacacgtcgtcaacgtcgaaaaaatacactacgcgtcgacgacaaaatcataccatcgtctcacaaaccgaaaatcctacataacttaccccactcgcgccacgaaaatacctacaatctaccttataacaata

SEQ ID NO: 16913 - DNA, 603 bp, Artificial Sequence
  chemically treated genomic DNA (Homo sapiens) CpG-island No: 16913
tatttattattttacgaattttcgttagtcgttggaaattaattttcggcgttttgttgtataagtcgtgcgtcgtattaatcgttatcgttaggttgtcgacgttagttagttcgataaagcgtttagttttttgtggatcggttaggaatgtattttcggcgttaacgtttatgttatttttaatatcgtttaggcggtttagttttgtttttacgttgtaattttgtgagtggtagaagttaataatcgattttattagttttacgttttcggtaaacgggaagtggttgtcgtcgattatcgtattgcgtatatttgcgtggattttacggcgaatattatttagcgattcgtggtggtcgagatgtagcgttagtggtatgttgtaggttgtggaataggcgttatatagggcgtagattttttttagcgcgatgtgtttaaaggttttcggcgtttcggcgaggattatcggcgatcgtattttattgtatatttcgaggatcgtttggatcgtttcggcgttatgaatgttaaaagtaggtatcgcgtagttattggtttggggcgttttggtaatagatatttagtggagataat

SEQ ID NO: 16914 - DNA, 603 bp, Artificial Sequence
  chemically treated genomic DNA (Homo sapiens) CpG-island No: 16914
attatctccactaaatatctattaccaaaacgccccaaaccaataactacgcgatacctacttttaacattcataacgccgaaacgatccaaacgatcctcgaaatatacaataaaatacgatcgccgataatcctcgccgaaacgccgaaaacctttaaacacatcgcgctaaaaaaaatctacgccctatataacgcctattccacaacctacaacataccactaacgctacatctcgaccaccacgaatcgctaaataatattcgccgtaaaatccacgcaaatatacgcaatacgataatcgacgacaaccacttcccgtttaccgaaaacgtaaaactaataaaatcgattattaacttctaccactcacaaaattacaacgtaaaaacaaaactaaaccgcctaaacgatattaaaaataacataaacgttaacgccgaaaatacattcctaaccgatccacaaaaaactaaacgctttatcgaactaactaacgtcgacaacctaacgataacgattaatacgacgcacgacttatacaacaaaacgccgaaaattaatttccaacgactaacgaaaattcgtaaaataataaata

SEQ ID NO: 16915 - DNA, 603 bp, Artificial Sequence
  chemically treated genomic DNA (Homo sapiens) CpG-island No: 16915
attatttttattaaatatttgttattaggacgttttaggttaatggttacgcggtgtttgtttttaatatttataacgtcgagacgatttaagcgattttcgaagtgtgtagtgaaatgcgatcgtcggtgattttcgtcggaacgtcggggatttttaaatatatcgcgttggaagagatttacgttttgtgtagcgtttattttataatttataatatgttattggcgttgtatttcgattattacgaatcgttggatgatattcgtcgtgaagtttacgtaggtgtgcgtagtgcgatgatcgacggtagttatttttcgtttgtcgagaacgtgaagttggtgaaatcggttgttgatttttgttatttataagattgtagcgtggaagtagaattgggtcgtttgggcggtgttgaagatgatatgagcgttgacgtcgaaagtgtatttttgatcgatttataagaagttaaacgttttgtcgaattgattggcgtcgatagtttggcggtagcgattggtacggcgtacggtttatatagtaaaacgtcgaagattgatttttagcggttggcggaaattcgtgaagtggtggatg

SEQ ID NO: 16916 - DNA, 603 bp, Artificial Sequence
  chemically treated genomic DNA (Homo sapiens) CpG-island No: 16916
catccaccacttcacgaatttccgccaaccgctaaaaatcaatcttcgacgttttactatataaaccgtacgccgtaccaatcgctaccgccaaactatcgacgccaatcaattcgacaaaacgtttaacttcttataaatcgatcaaaaatacactttcgacgtcaacgctcatatcatcttcaacaccgcccaaacgacccaattctacttccacgctacaatcttataaataacaaaaatcaacaaccgatttcaccaacttcacgttctcgacaaacgaaaaataactaccgtcgatcatcgcactacgcacacctacgtaaacttcacgacgaatatcatccaacgattcgtaataatcgaaatacaacgccaataacatattataaattataaaataaacgctacacaaaacgtaaatctcttccaacgcgatatatttaaaaatccccgacgttccgacgaaaatcaccgacgatcgcatttcactacacacttcgaaaatcgcttaaatcgtctcgacgttataaatattaaaaacaaacaccgcgtaaccattaacctaaaacgtcctaataacaaatatttaataaaaataat

SEQ ID NO: 16917 - DNA, 674 bp, Artificial Sequence
  chemically treated genomic DNA (Homo sapiens) CpG-island No: 16917
tttaggttaacgttaaagcgacggcgggtaaatgtattttgattttcggttacgattttaaagatttttataatttgttggaatagatcgaaggtacgggcgttaatgtttatatttacggcgaaatgttgtttgcgtatggttattcggagttgcgtaaatttaagtatttggtcggtaattacggtagcggttggtagaattagtaagtggagttcgttcgtttttttggttttatcgtgatgatttcgaattgtattatcgatttaatcgtaggcgtttatgacgatcgtatttggattcgtagtattgttggttggtttggcgtgcgttatttggacggtgatgatttttttgcggttattatttaggcgtaatagatggtaggtttttcgtatagcgaaatttcgtattttattatcgtgggttttggtcgttagacgttgtttggcgttgttgatacgttgattgatttggtgagtcgtgaaaaattgcgttatatttttttgtttggtggttgtgacggcgtacgcggcgagcgttattattttatcgatttcgttattagcgtgtcggatgattgtttgattttgattttcgtttgtggtaaatatcgttttaataaatttgagtttggcgatatcgaaggtttgtcgcgtttggtagatgtaggt

SEQ ID NO: 16918 - DNA, 674 bp, Artificial Sequence
  chemically treated genomic DNA (Homo sapiens) CpG-island No: 16918
acctacatctaccaaacgcgacaaaccttcgatatcgccaaactcaaatttattaaaacgatatttaccacaaacgaaaatcaaaatcaaacaatcatccgacacgctaataacgaaatcgataaaataataacgctcgccgcgtacgccgtcacaaccaccaaacaaaaaaatataacgcaatttttcacgactcaccaaatcaatcaacgtatcaacaacgccaaacaacgtctaacgaccaaaacccacgataataaaatacgaaatttcgctatacgaaaaacctaccatctattacgcctaaataataaccgcaaaaaaatcatcaccgtccaaataacgcacgccaaaccaaccaacaatactacgaatccaaatacgatcgtcataaacgcctacgattaaatcgataatacaattcgaaatcatcacgataaaaccaaaaaaacgaacgaactccacttactaattctaccaaccgctaccgtaattaccgaccaaatacttaaatttacgcaactccgaataaccatacgcaaacaacatttcgccgtaaatataaacattaacgcccgtaccttcgatctattccaacaaattataaaaatctttaaaatcgtaaccgaaaatcaaaatacatttacccgccgtcgctttaacgttaacctaaa

SEQ ID NO: 16919 - DNA, 674 bp, Artificial Sequence
  chemically treated genomic DNA (Homo sapiens) CpG-island No: 16919
atttgtatttattagacgcggtagattttcgatatcgttaaatttaagtttgttaaagcgatatttattataggcgagggttaggattaggtagttattcggtacgttggtggcgaaatcggtgaagtagtggcgttcgtcgcgtgcgtcgttatagttattaagtaggaagatatgacgtagttttttacggtttattagattaattagcgtattagtagcgttaagtagcgtttggcgattaaaatttacggtgataaggtgcggaatttcgttgtacgggaagtttgttatttgttgcgtttgggtgataatcgtagagaaattattatcgtttagatgacgtacgttaggttagttaataatgttgcgggtttagatacgatcgttataagcgtttacggttgggtcgatgatgtagttcgaggttattacgatggggttagggaaacgagcgaattttatttgttgattttgttagtcgttgtcgtagttatcgattagatgtttgaatttacgtagtttcgggtagttatgcgtaggtagtatttcgtcgtgggtgtagatattaacgttcgtgttttcggtttgttttagtaggttgtagagatttttgagatcgtgatcggaaattagaatgtatttattcgtcgtcgttttgacgttgatttggg

SEQ ID NO: 16920 - DNA, 674 bp, Artificial Sequence
  chemically treated genomic DNA (Homo sapiens) CpG-island No: 16920
cccaaatcaacgtcaaaacgacgacgaataaatacattctaatttccgatcacgatctcaaaaatctctacaacctactaaaacaaaccgaaaacacgaacgttaatatctacacccacgacgaaatactacctacgcataactacccgaaactacgtaaattcaaacatctaatcgataactacgacaacgactaacaaaatcaacaaataaaattcgctcgtttccctaaccccatcgtaataacctcgaactacatcatcgacccaaccgtaaacgcttataacgatcgtatctaaacccgcaacattattaactaacctaacgtacgtcatctaaacgataataatttctctacgattatcacccaaacgcaacaaataacaaacttcccgtacaacgaaattccgcaccttatcaccgtaaattttaatcgccaaacgctacttaacgctactaatacgctaattaatctaataaaccgtaaaaaactacgtcatatcttcctacttaataactataacgacgcacgcgacgaacgccactacttcaccgatttcgccaccaacgtaccgaataactacctaatcctaaccctcgcctataataaatatcgctttaacaaacttaaatttaacgatatcgaaaatctaccgcgtctaataaatacaaat

SEQ ID NO: 16921 - DNA, 954 bp, Artificial Sequence
  chemically treated genomic DNA (Homo sapiens) CpG-island No: 16921
gcgtatagtttagcgttgtaatcgttgatgcgtttattcgatttataatttatacgattattttgagtattattgtgttgattggcgtagtttgttattacgttaagatgttagcgattttgcgcgttgttattttacgtgcgttaaatcgtcgtttagttgtaatatatagcggttagtttgagtatttagttgatcgttatcggtttttgaacgttcgtgtttttcgtatatgacgtatttatatattgtttgtcgatttttgagaatgtagtgaatttgtatattgcggtttatttagacggtcgtgtaaacgatggttaaatagcgagttggttgcggtaatgttagttgatatagttttcggttttcgggcgataaattgatgggtttttcggatttataatagggggaattattgatgggatcgggtagtattcgttgggcgttacgatcgttttatttattgggttagatattaggttttttggttattgttcgttttttttagtttagcgtgtagacgtaagttttagtttcggatagtttcggtggttagcgcgaagtatcgtgtagaattatcgttaattttaatgagtttaatatcgttgatcgtttgtgtatcgacgtcgttaatgttattaattcgaacgcgagtgtttttttgggtatcgttttttacgtttattttatcggtgggcgaattatcgtcgtttagcgtcgcgttgaacgttattaggttattgttttcggtatagttgtcgttaacggttagtatatttttcggtttttttttttcgttatttatttgaatcgtgtcgttattttttaggttgtcgtcgatagtggttttagcgatacgtagtgttttttttaggtataacgtttatattatttgtagtggtgatatttttcgatattatatcgttgttatggatattaatgtgttgattt

SEQ ID NO: 16922 - DNA, 954 bp, Artificial Sequence
  chemically treated genomic DNA (Homo sapiens) CpG-island No: 16922
aaatcaacacattaatatccataacaacgatataatatcgaaaaatatcaccactacaaataatataaacgttatacctaaaaaaaacactacgtatcgctaaaaccactatcgacgacaacctaaaaaataacgacacgattcaaataaataacgaaaaaaaaaaaccgaaaaatatactaaccgttaacgacaactataccgaaaacaataacctaataacgttcaacgcgacgctaaacgacgataattcgcccaccgataaaataaacgtaaaaaacgatacccaaaaaaacactcgcgttcgaattaataacattaacgacgtcgatacacaaacgatcaacgatattaaactcattaaaattaacgataattctacacgatacttcgcgctaaccaccgaaactatccgaaactaaaacttacgtctacacgctaaactaaaaaaaacgaacaataaccaaaaaacctaatatctaacccaataaataaaacgatcgtaacgcccaacgaatactacccgatcccatcaataattccccctattataaatccgaaaaacccatcaatttatcgcccgaaaaccgaaaactatatcaactaacattaccgcaaccaactcgctatttaaccatcgtttacacgaccgtctaaataaaccgcaatatacaaattcactacattctcaaaaatcgacaaacaatatataaatacgtcatatacgaaaaacacgaacgttcaaaaaccgataacgatcaactaaatactcaaactaaccgctatatattacaactaaacgacgatttaacgcacgtaaaataacaacgcgcaaaatcgctaacatcttaacgtaataacaaactacgccaatcaacacaataatactcaaaataatcgtataaattataaatcgaataaacgcatcaacgattacaacgctaaactatacgc

SEQ ID NO: 16923 - DNA, 954 bp, Artificial Sequence
  chemically treated genomic DNA (Homo sapiens) CpG-island No: 16923
aagttaatatattaatatttataatagcggtgtgatgtcgggaaatgttattattgtaggtgatatgaacgttatgtttggggggggtattgcgtgtcgttaaaattattatcggcggtaatttggagaatggcggtacggtttaaatgaatagcgaaggggggaaatcggggaatgtattgatcgttaacggtaattatatcggaaataatggtttgatgacgtttaacgcgacgttgggcggcgataattcgtttatcgataagatgaacgtgaaaggcgatatttaagggaatattcgcgttcgggttgataatattggcggcgtcggtgtataaacggttaacggtattgaatttattgaggttggcggtaattttgtacggtatttcgcgttgattatcggaattgttcgaagttggggtttacgtttatacgttgggttaaagggaacgggtaatgattagaaaatttggtatttgatttagtaaatgggacggtcgtaacgtttagcggatattattcgattttattaataattttttttgttgtggattcggaaggtttattagtttatcgttcggaggtcggaagttatattagttaatattgtcgtagttaattcgttgtttagttatcgtttatacgatcgtttgggtgagtcgtagtatatagatttattgtatttttaggggtcggtaagtagtatgtggatgcgttatgtacggagggtacgaacgtttaagggtcggtgacggttagttaaatatttaggttaatcgttatgtattgtagttaggcggcgatttggcgtacgtggagtagtaacgcgtaggatcgttggtattttggcgtgatggtaggttacgttaattagtatagtaatatttagagtaatcgtgtgggttataaatcggatgggcgtattagcggttatagcgttgggttgtacgt

SEQ ID NO: 16924 - DNA, 954 bp, Artificial Sequence
  chemically treated genomic DNA (Homo sapiens) CpG-island No: 16924
acgtacaacccaacgctataaccgctaatacgcccatccgatttataacccacacgattactctaaatattactatactaattaacgtaacctaccatcacgccaaaataccaacgatcctacgcgttactactccacgtacgccaaatcgccgcctaactacaatacataacgattaacctaaatatttaactaaccgtcaccgacccttaaacgttcgtaccctccgtacataacgcatccacatactacttaccgacccctaaaaatacaataaatctatatactacgactcacccaaacgatcgtataaacgataactaaacaacgaattaactacgacaatattaactaatataacttccgacctccgaacgataaactaataaaccttccgaatccacaacaaaaaaaattattaataaaatcgaataatatccgctaaacgttacgaccgtcccatttactaaatcaaataccaaattttctaatcattacccgttccctttaacccaacgtataaacgtaaaccccaacttcgaacaattccgataatcaacgcgaaataccgtacaaaattaccgccaacctcaataaattcaataccgttaaccgtttatacaccgacgccgccaatattatcaacccgaacgcgaatattcccttaaatatcgcctttcacgttcatcttatcgataaacgaattatcgccgcccaacgtcgcgttaaacgtcatcaaaccattatttccgatataattaccgttaacgatcaatacattccccgatttccccccttcgctattcatttaaaccgtaccgccattctccaaattaccgccgataataattttaacgacacgcaataccccccccaaacataacgttcatatcacctacaataataacatttcccgacatcacaccgctattataaatattaatatattaactt

SEQ ID NO: 16925 - DNA, 937 bp, Artificial Sequence
  chemically treated genomic DNA (Homo sapiens) CpG-island No: 16925
  misc_feature (828)..(828): n is either a, c, g or t
ttttcgtttttgttttttcggtatacgtagattaatcgttagattcgttaatttgtagtcgataaatgttataatatcggattagacgatcgtaatggcgatgttttttagttgtattagtaattgatggtttatcgttatatttttagcgaagtttacgtcgtttagcgagttggcggtaaaaatttcggttatgatatagtcgataatgttataaacgtcgtgtatatcgaagatatcgtagggattatttattcgtagtaagcgtttgagtatggtaacgttttataagttcgttagattagttattacgtcgataattaacgcgtcgttaattttaatgtagtcgtaggttggcgttacgtcgattagatcggtaatcgcgttagaatacgtttttagtagtgaaggtttattacgtagcgtttatttatcgaagatttagttaagaattgtcgtcgtcgttgcgattatagtatttataaatgttagtgtcgcgattttattcgtcgtgttcgttgattcggcgttgaagtttaaattaatcgatatagagaatggtagtttcggtgaagattatcggtaggttgtgcggtttaaacgtttcgtttatcgaagtttacgcgtttttttattagatacgcgtttattagatcggcgattgcggcgttaatgttgtattacggtgttattcgcgaaatttagcgtatcgtgagaagttagtaaagttatcgttttatattatatgcgtaatcggaattgtaacgaagagcgtttacgtttatattagtacgaaaattaatatagttgagaagcggattcgttttnggtagcgttttaatttataagtcgacgtatgcgggggaacgattttgaaacgttacgtggatatttgattaatgttgttatatcgtcgttagttcgatgtttttagtat

SEQ ID NO: 16926 - DNA, 937 bp, Artificial Sequence
  chemically treated genomic DNA (Homo sapiens) CpG-island No: 16926
  misc_feature (110)..(110): n is either a, c, g or t
atactaaaaacatcgaactaacgacgatataacaacattaatcaaatatccacgtaacgtttcaaaatcgttcccccgcatacgtcgacttataaattaaaacgctaccnaaaacgaatccgcttctcaactatattaattttcgtactaatataaacgtaaacgctcttcgttacaattccgattacgcatataatataaaacgataactttactaacttctcacgatacgctaaatttcgcgaataacaccgtaatacaacattaacgccgcaatcgccgatctaataaacgcgtatctaataaaaaaacgcgtaaacttcgataaacgaaacgtttaaaccgcacaacctaccgataatcttcaccgaaactaccattctctatatcgattaatttaaacttcaacgccgaatcaacgaacacgacgaataaaatcgcgacactaacatttataaatactataatcgcaacgacgacgacaattcttaactaaatcttcgataaataaacgctacgtaataaaccttcactactaaaaacgtattctaacgcgattaccgatctaatcgacgtaacgccaacctacgactacattaaaattaacgacgcgttaattatcgacgtaataactaatctaacgaacttataaaacgttaccatactcaaacgcttactacgaataaataatccctacgatatcttcgatatacacgacgtttataacattatcgactatatcataaccgaaatttttaccgccaactcgctaaacgacgtaaacttcgctaaaaatataacgataaaccatcaattactaatacaactaaaaaacatcgccattacgatcgtctaatccgatattataacatttatcgactacaaattaacgaatctaacgattaatctacgtataccgaaaaaacaaaaacgaaaa

SEQ ID NO: 16927 - DNA, 937 bp, Artificial Sequence
  chemically treated genomic DNA (Homo sapiens) CpG-island No: 16927
  misc_feature (110)..(110): n is either a, c, g or t
atgttgaagatatcgaattgacgacggtatggtagtattaattagatatttacgtggcgttttaggatcgttttttcgtatacgtcggtttgtaagttggggcgttgttnggaacgaattcgttttttagttgtgttgattttcgtgttggtataggcgtgaacgtttttcgttataatttcgattgcgtatatggtgtgggacggtggttttgttggttttttacggtgcgttggatttcgcgggtggtatcgtggtgtaatattaacgtcgtaatcgtcggtttggtgggcgcgtatttgataggaaaacgcgtgggtttcggtaaacgaggcgtttaaatcgtataatttgtcgatggtttttatcgggattgttattttttatatcggttggtttaggttttaacgtcgggttagcgggtacggcgaatgaaatcgcggtattggtatttgtgaatattgtggtcgtaacggcggcggtaatttttggttggattttcggtgaatgggcgttgcgtggtaagtttttattgttgggggcgtgttttggcgcgattgtcggtttggtcggcgtgacgttagtttgcggttatattggggttggcggcgcgttgattatcggcgtggtagttggtttggcgggtttgtggggcgttattatgtttaaacgtttgttgcgggtggatgatttttgcgatgttttcggtgtgtacggcgtttgtggtattgtcggttgtattatgatcgggatttttgtcgttagttcgttgggcggcgtgggtttcgttgaaggtgtgacgatgggttattagttgttggtatagttggaaagtatcgttattacgatcgtttggttcggtgttgtggtatttatcggttataaattggcggatttgacggttggtttgcgtgtatcggaagagtaggagcgagaa

SEQ ID NO: 16928 - DNA, 937 bp, Artificial Sequence
  chemically treated genomic DNA (Homo sapiens) CpG-island No: 16928
  misc_feature (828)..(828): n is either a, c, g or t
ttctcgctcctactcttccgatacacgcaaaccaaccgtcaaatccgccaatttataaccgataaataccacaacaccgaaccaaacgatcgtaataacgatactttccaactataccaacaactaataacccatcgtcacaccttcaacgaaacccacgccgcccaacgaactaacgacaaaaatcccgatcataatacaaccgacaataccacaaacgccgtacacaccgaaaacatcgcaaaaatcatccacccgcaacaaacgtttaaacataataacgccccacaaacccgccaaaccaactaccacgccgataatcaacgcgccgccaaccccaatataaccgcaaactaacgtcacgccgaccaaaccgacaatcgcgccaaaacacgcccccaacaataaaaacttaccacgcaacgcccattcaccgaaaatccaaccaaaaattaccgccgccgttacgaccacaatattcacaaataccaataccgcgatttcattcgccgtacccgctaacccgacgttaaaacctaaaccaaccgatataaaaaataacaatcccgataaaaaccatcgacaaattatacgatttaaacgcctcgtttaccgaaacccacgcgttttcctatcaaatacgcgcccaccaaaccgacgattacgacgttaatattacaccacgataccacccgcgaaatccaacgcaccgtaaaaaaccaacaaaaccaccgtcccacaccatatacgcaatcgaaattataacgaaaaacgttcacgcctataccaacacgaaaatcaacacaactaaaaaacgaattcgttccnaacaacgccccaacttacaaaccgacgtatacgaaaaaacgatcctaaaacgccacgtaaatatctaattaatactaccataccgtcgtcaattcgatatcttcaacat

SEQ ID NO: 16929 - DNA, 589 bp, Artificial Sequence
  chemically treated genomic DNA (Homo sapiens) CpG-island No: 16929
tgcgtttcggttaagttcgcgtcgatttttatcgagcgtatatcgttggcgttaatggcgttaatgttcgtttgcgtatttttaatgtcgatatatgtttgcggcggtacgtttagttttgtataggcggcgagaaagattttcgggttcggtttcgagtttttaagttgggaagtattcgcgtagaaggtgaaaaattcgcgtagttttagcgtcgttaaaatcgtcggcgtatttagggagatagaagttagtttaatcgagatttgttgtgtacggagatttgttagtaaagagcgaatgtcgggtagaatagcgttgatcgttaattcgcgtagtgagtggatatagagtagatttttgcgatacgttagttgcgtttttttttgcgagttaaagtcgttttttttgttttcgtgttgtagaatgcgtcgtagagatttatcgcggttgattttttttagggattcgttaaattgcgtattaatgttgatgttaattttagcggtaatttgttgttacgtttggaaatgtagatgcgcggtatcggtgattatattatttagatcgaaaattattttttgtagtt

SEQ ID NO: 16930 - DNA, 589 bp, Artificial Sequence
  chemically treated genomic DNA (Homo sapiens) CpG-island No: 16930
aactacaaaaaataattttcgatctaaataatataatcaccgataccgcgcatctacatttccaaacgtaacaacaaattaccgctaaaattaacatcaacattaatacgcaatttaacgaatccctaaaaaaaatcaaccgcgataaatctctacgacgcattctacaacacgaaaacaaaaaaaacgactttaactcgcaaaaaaaaacgcaactaacgtatcgcaaaaatctactctatatccactcactacgcgaattaacgatcaacgctattctacccgacattcgctctttactaacaaatctccgtacacaacaaatctcgattaaactaacttctatctccctaaatacgccgacgattttaacgacgctaaaactacgcgaatttttcaccttctacgcgaatacttcccaacttaaaaactcgaaaccgaacccgaaaatctttctcgccgcctatacaaaactaaacgtaccgccgcaaacatatatcgacattaaaaatacgcaaacgaacattaacgccattaacgccaacgatatacgctcgataaaaatcgacgcgaacttaaccgaaacgca

SEQ ID NO: 16931 - DNA, 589 bp, Artificial Sequence
  chemically treated genomic DNA (Homo sapiens) CpG-island No: 16931
aattgtaaggggtaattttcgatttggatggtgtaattatcgatatcgcgtatttgtatttttaggcgtggtagtagattgtcgttgaaattggtattagtattgatgcgtagtttaacgaatttttaaaagggattagtcgcgatgagtttttgcggcgtattttgtaatacgggggtaaagagggcgattttaattcgtaggagagggcgtaattggcgtatcgtaaaaatttgttttatgtttatttattacgcgagttgacggttaacgttgttttattcggtattcgttttttgttggtagattttcgtgtatagtagatttcggttgggttggtttttgtttttttgaatgcgtcgacgattttagcggcgttggagttgcgcgagttttttattttttgcgcggatgttttttaatttaaaaattcgaaatcggattcggaaatttttttcgtcgtttgtgtagggttgggcgtgtcgtcgtaggtatgtatcggtattgaagatgcgtaggcgggtattgacgttattaacgttagcggtatgcgttcggtggggatcggcgcgggtttaatcggggcgta

SEQ ID NO: 16932 - DNA, 589 bp, Artificial Sequence
  chemically treated genomic DNA (Homo sapiens) CpG-island No: 16932
tacgccccgattaaacccgcgccgatccccaccgaacgcataccgctaacgttaataacgtcaatacccgcctacgcatcttcaataccgatacatacctacgacgacacgcccaaccctacacaaacgacgaaaaaaatttccgaatccgatttcgaatttttaaattaaaaaacatccgcgcaaaaaataaaaaactcgcgcaactccaacgccgctaaaatcgtcgacgcattcaaaaaaacaaaaaccaacccaaccgaaatctactatacacgaaaatctaccaacaaaaaacgaataccgaataaaacaacgttaaccgtcaactcgcgtaataaataaacataaaacaaatttttacgatacgccaattacgccctctcctacgaattaaaatcgccctctttacccccgtattacaaaatacgccgcaaaaactcatcgcgactaatcccttttaaaaattcgttaaactacgcatcaatactaataccaatttcaacgacaatctactaccacgcctaaaaatacaaatacgcgatatcgataattacaccatccaaatcgaaaattaccccttacaatt

SEQ ID NO: 16933 - DNA, 529 bp, Artificial Sequence
  chemically treated genomic DNA (Homo sapiens) CpG-island No: 16933
  misc_feature (489)..(489): n is either a, c, g or t
  misc_feature (492)..(492): n is either a, c, g or t
tgatttgtaattcgtagttttgttagaatagagggaaagataattgttgttattgtttaggtaacgtcggattgagatgtaatttatcgttacgtacgtttatttcggtaaaattttgaatcgtttttagttagatagcgttagttgcggtagtatggatattattattataattatgcggattagtattaagatcgattttagtttttcgcgttagaatgatattttgggttagcggtttagcgtgcggtattatgtcgggattgtttatttaatgcgatcgcgaatatggcggttatattttgcgatgggagaaatatgcgtgtaaacgtcggggttgtatggattatatttgcggttgggattgtatggaataggcggtatattatatggtgttttcgtaatgttgtaaagcgttataaaaatgggaagcgcgatgataatgtaaagagaattttcggtttttcgtttttttttttcgttttgttnganggagagacgaagcgaaagggaggagaatagagaagag

SEQ ID NO: 16934 - DNA, 529 bp, Artificial Sequence
  chemically treated genomic DNA (Homo sapiens) CpG-island No: 16934
  misc_feature (38)..(38): n is either a, c, g or t
  misc_feature (41)..(41): n is either a, c, g or t
ctcttctctattctcctccctttcgcttcgtctctccntcnaacaaaacgaaaaaaaaaaacgaaaaaccgaaaattctctttacattatcatcgcgcttcccatttttataacgctttacaacattacgaaaacaccatataatataccgcctattccatacaatcccaaccgcaaatataatccatacaaccccgacgtttacacgcatatttctcccatcgcaaaatataaccgccatattcgcgatcgcattaaataaacaatcccgacataataccgcacgctaaaccgctaacccaaaatatcattctaacgcgaaaaactaaaatcgatcttaatactaatccgcataattataataataatatccatactaccgcaactaacgctatctaactaaaaacgattcaaaattttaccgaaataaacgtacgtaacgataaattacatctcaatccgacgttacctaaacaataacaacaattatctttccctctattctaacaaaactacgaattacaaatca

SEQ ID NO: 16935 - DNA, 529 bp, Artificial Sequence
  chemically treated genomic DNA (Homo sapiens) CpG-island No: 16935
  misc_feature (38)..(38): n is either a, c, g or t
  misc_feature (41)..(41): n is either a, c, g or t
tttttttttgtttttttttttttcgtttcgtttttttnttnagtagggcgggggggagaggcgggaggtcgggggttttttttgtattgttatcgcgttttttatttttgtagcgttttgtaatattgcggggatattatgtgatatatcgtttgttttatgtagttttagtcgtaagtgtagtttatataatttcggcgtttatacgtatgttttttttatcgtaaagtatgatcgttatattcgcgatcgtattaagtaagtaatttcggtatggtgtcgtacgttgggtcgttgatttaaagtattattttggcgcgagggattgaaatcgattttggtgttgattcgtatagttgtgatgatggtatttatgttgtcgtaattggcgttatttggttgggggcgatttagggttttgtcggggtgagcgtgcgtgacggtgaattgtattttaattcggcgttatttgagtagtggtaatagttgtttttttttttgttttggtagggttgcgaattataggtta

SEQ ID NO: 16936 - DNA, 529 bp, Artificial Sequence
  chemically treated genomic DNA (Homo sapiens) CpG-island No: 16936
  misc_feature (489)..(489): n is either a, c, g or t
  misc_feature (492)..(492): n is either a, c, g or t
taacctataattcgcaaccctaccaaaacaaaaaaaaaaacaactattaccactactcaaataacgccgaattaaaatacaattcaccgtcacgcacgctcaccccgacaaaaccctaaatcgcccccaaccaaataacgccaattacgacaacataaataccatcatcacaactatacgaatcaacaccaaaatcgatttcaatccctcgcgccaaaataatactttaaatcaacgacccaacgtacgacaccataccgaaattacttacttaatacgatcgcgaatataacgatcatactttacgataaaaaaaacatacgtataaacgccgaaattatataaactacacttacgactaaaactacataaaacaaacgatatatcacataatatccccgcaatattacaaaacgctacaaaaataaaaaacgcgataacaatacaaaaaaaacccccgacctcccgcctctcccccccgccctactnaanaaaaaaacgaaacgaaaaaaaaaaaaacaaaaaaaaa

SEQ ID NO: 16937 - DNA, 1127 bp, Artificial Sequence
  chemically treated genomic DNA (Homo sapiens) CpG-island No: 16937
  misc_feature (100)..(100): n is either a, c, g or t
tttttcgtttttgttttttttttttgttttttttttttttttcgtgttcgtttttttttttttttttttttttttttcgttttacgttcgcgtattagangatgattgcggcgcgtgcgagcgatatattcgttttcgggaatttggttattttttattttttgttggcggttttttttttttttgtgggtgaaatattttcgcggtttggagattttcgcgttattttttgggtgtatttttttttcggggggttttattttaagggtcgggcgttttaaattaatcgggggagtatagacgtttcggcggaattatttttcgacgcgggattaaattgttttacggggtttttttgcgcggattgttgaaattcgacgtttttaatttgtttgggcggttaaatcgtgtggaatggaaggattaaataatttcggtttgatagaaattttgtaggtttattgcgtcggtgagtttttcgtttttatttattatcggtgcggtagtgattttgcgttttattaggatttttttggcgtcgatggcgcgattttgcgattgtaacgtggtgtcgtcgatcgttatcgttttattgattggcgtggtgagtgcgtcgtcgttaattagttagcgacgtaaatcgtcgtcggtaaagacgttttgtatttgttgttgagcgttatatatcgttattagttttagatcggtgcggttgagttttagtatcgtatttattacgttggcggttaacgttatttgtgggatggtatcgttacggcgtattagatgatgtattttatttagtaagcgagcgtttagtgtttcggttgggtgggagcgggtaaaattttttttattaaattcgcgcgtttgtatgatcgttatcgttagcgcgttatttattattagggtattgacggtgttggaggtcggcgtaaggtgtatcgggtaggtttcgcgttttacggagatatttagtatcgtttttgtcgttaggtttagcggtgacgtcggtttgtcggttatcgttagtagcgcgatagattattttttagacgcggattatttagatttagtattttcgagttaacggagtaagagataatagtattatatcgaggtttcga

SEQ ID NO: 16938 - DNA, 1127 bp, Artificial Sequence
  chemically treated genomic DNA (Homo sapiens) CpG-island No: 16938
  misc_feature (1028)..(1028): n is either a, c, g or t
tcgaaacctcgatataatactattatctcttactccgttaactcgaaaatactaaatctaaataatccgcgtctaaaaaataatctatcgcgctactaacgataaccgacaaaccgacgtcaccgctaaacctaacgacaaaaacgatactaaatatctccgtaaaacgcgaaacctacccgatacaccttacgccgacctccaacaccgtcaataccctaataataaataacgcgctaacgataacgatcatacaaacgcgcgaatttaataaaaaaaattttacccgctcccacccaaccgaaacactaaacgctcgcttactaaataaaatacatcatctaatacgccgtaacgataccatcccacaaataacgttaaccgccaacgtaataaatacgatactaaaactcaaccgcaccgatctaaaactaataacgatatataacgctcaacaacaaatacaaaacgtctttaccgacgacgatttacgtcgctaactaattaacgacgacgcactcaccacgccaatcaataaaacgataacgatcgacgacaccacgttacaatcgcaaaatcgcgccatcgacgccaaaaaaatcctaataaaacgcaaaatcactaccgcaccgataataaataaaaacgaaaaactcaccgacgcaataaacctacaaaatttctatcaaaccgaaattatttaatccttccattccacacgatttaaccgcccaaacaaattaaaaacgtcgaatttcaacaatccgcgcaaaaaaaccccgtaaaacaatttaatcccgcgtcgaaaaataattccgccgaaacgtctatactcccccgattaatttaaaacgcccgacccttaaaataaaaccccccgaaaaaaaaatacacccaaaaaataacgcgaaaatctccaaaccgcgaaaatatttcacccacaaaaaaaaaaaaaaccgccaacaaaaaataaaaaataaccaaattcccgaaaacgaatatatcgctcgcacgcgccgcaatcatcntctaatacgcgaacgtaaaacgaaaaaaaaaaaaaaaaaaaaaaaaaaacgaacacgaaaaaaaaaaaaaaaacaaaaaaaaaaaacaaaaacgaaaaa

SEQ ID NO: 16939 - DNA, 1127 bp, Artificial Sequence
  chemically treated genomic DNA (Homo sapiens) CpG-island No: 16939
  misc_feature (1028)..(1028): n is either a, c, g or t
tcgaagtttcgatgtgatgttgttattttttatttcgttggttcgaaggtattggatttgagtagttcgcgtttggaagataatttatcgcgttgttggcgatgatcggtaaatcgacgttatcgttgggtttggcggtaaaagcggtgttggatattttcgtagaacgcgaagtttgttcgatgtattttgcgtcgatttttagtatcgttaatattttgatgatgggtgacgcgttggcgatggcggttatgtaggcgcgcggatttaatgaagaagattttgttcgtttttatttagtcggggtattgggcgttcgtttgttgaataaagtgtattatttgatgcgtcgtgacgatgttattttataggtggcgttaatcgttagcgtgatggatgcgatgttggaatttagtcgtatcggtttggggttggtggcggtatgtgacgtttaataataggtataaggcgtttttatcgacggcgatttacgtcgttggttggttggcggcggcgtatttattacgttagttaatgaagcgatgacggtcggcggtattacgttgtaatcgtaaagtcgcgttatcgacgttaaagagattttgatgaagcgtaaaattattgtcgtatcggtggtggatgaaaacggggaatttatcggcgtaataaatttgtaggatttttattaggtcgggattatttaatttttttattttatacggtttggtcgtttaagtaggttggggacgtcgggttttaataattcgcgtaggggagtttcgtgggataatttggtttcgcgtcggaaaataatttcgtcggagcgtttgtgttttttcggttggtttagagcgttcggtttttggggtgaggtttttcgaaagaaaggtgtatttaaagaataacgcgggggtttttaaatcgcgaaaatgttttatttataagaaggaagagaatcgttaatagagagtgggaggtaattaaattttcgagagcgaatgtgtcgttcgtacgcgtcgtaattattntttggtgcgcgggcgtgggacgagaggaggagggaggaggaggagagggcgagtacggagaggagagggagaatagaggaggagaataggaacggagag

SEQ ID NO: 16940 - DNA, 1127 bp, Artificial Sequence
  chemically treated genomic DNA (Homo sapiens) CpG-island No: 16940
  misc_feature (100)..(100): n is either a, c, g or t
ctctccgttcctattctcctcctctattctccctctcctctccgtactcgccctctcctcctcctccctcctcctctcgtcccacgcccgcgcaccaaanaataattacgacgcgtacgaacgacacattcgctctcgaaaatttaattacctcccactctctattaacgattctcttccttcttataaataaaacattttcgcgatttaaaaacccccgcgttattctttaaatacacctttctttcgaaaaacctcaccccaaaaaccgaacgctctaaaccaaccgaaaaaacacaaacgctccgacgaaattattttccgacgcgaaaccaaattatcccacgaaactcccctacgcgaattattaaaacccgacgtccccaacctacttaaacgaccaaaccgtataaaataaaaaaattaaataatcccgacctaataaaaatcctacaaatttattacgccgataaattccccgttttcatccaccaccgatacgacaataattttacgcttcatcaaaatctctttaacgtcgataacgcgactttacgattacaacgtaataccgccgaccgtcatcgcttcattaactaacgtaataaatacgccgccgccaaccaaccaacgacgtaaatcgccgtcgataaaaacgccttatacctattattaaacgtcacataccgccaccaaccccaaaccgatacgactaaattccaacatcgcatccatcacgctaacgattaacgccacctataaaataacatcgtcacgacgcatcaaataatacactttattcaacaaacgaacgcccaataccccgactaaataaaaacgaacaaaatcttcttcattaaatccgcgcgcctacataaccgccatcgccaacgcgtcacccatcatcaaaatattaacgatactaaaaatcgacgcaaaatacatcgaacaaacttcgcgttctacgaaaatatccaacaccgcttttaccgccaaacccaacgataacgtcgatttaccgatcatcgccaacaacgcgataaattatcttccaaacgcgaactactcaaatccaataccttcgaaccaacgaaataaaaaataacaacatcacatcgaaacttcga

SEQ ID NO: 16941 - DNA, 611 bp, Artificial Sequence
  chemically treated genomic DNA (Homo sapiens) CpG-island No: 16941
cgcgtcgttagttagcgcgcgttatttatttagtttttcgttatagttcgatgcgataatattatcgtcgcgtattagtatcggcggtgtgtcgatgattgttcgttttagtagatcgcgtagttcggtaaattcgtttatttttttacgtagcgtttgtatcggtgtattatcgatagtttttaattgcgtacgtagtttcggtagttgttggaaagcgtggcgtatacgggttagatcgcgtgggcgagtagttcgtaaagttagacgtgttagaatacgttttaggtcgtcgatttgacgtagtatcggttgtagttcggcggtgaaattttgtaatgcgttaatagtttgttggcgtttaagtaatacgcgggtatcgcgtattggtatatgtagttagcgttttagtatacggttgtttatcggcgtgacggtgtagtcgagtatagaagttagcgtatttttcgtattattcgttaggttttgggtgatttttagattacgacgcgtcgcggtatttataatgatgttgttttgtttacgttttatggtgatggaacgaatatgcggtagagtcgtacgttgggtatttttcgtatattgtaata

SEQ ID NO: 16942 - DNA, 611 bp, Artificial Sequence
  chemically treated genomic DNA (Homo sapiens) CpG-island No: 16942
tattacaatatacgaaaaatacccaacgtacgactctaccgcatattcgttccatcaccataaaacgtaaacaaaacaacatcattataaataccgcgacgcgtcgtaatctaaaaatcacccaaaacctaacgaataatacgaaaaatacgctaacttctatactcgactacaccgtcacgccgataaacaaccgtatactaaaacgctaactacatataccaatacgcgatacccgcgtattacttaaacgccaacaaactattaacgcattacaaaatttcaccgccgaactacaaccgatactacgtcaaatcgacgacctaaaacgtattctaacacgtctaactttacgaactactcgcccacgcgatctaacccgtatacgccacgctttccaacaactaccgaaactacgtacgcaattaaaaactatcgataatacaccgatacaaacgctacgtaaaaaaataaacgaatttaccgaactacgcgatctactaaaacgaacaatcatcgacacaccgccgatactaatacgcgacgataatattatcgcatcgaactataacgaaaaactaaataaataacgcgcgctaactaacgacgcg

SEQ ID NO: 16943 - DNA, 611 bp, Artificial Sequence
  chemically treated genomic DNA (Homo sapiens) CpG-island No: 16943
tgttgtagtatgcgaaagatatttaacgtacgattttgtcgtatattcgttttattattatggaacgtgagtaggatagtattattatggatgtcgcgacgcgtcgtaatttggaaattatttagaatttggcgggtggtgcggaaaatacgttggtttttgtgttcgattgtatcgttacgtcgatgggtagtcgtatgttgaaacgttggttgtatatgttagtgcgcgatattcgcgtgttgtttgagcgttagtaaattattggcgtattgtaggattttatcgtcgggttatagtcggtattgcgttaggtcggcgatttggaacgtattttggtacgtttggttttacgaattgttcgtttacgcgatttggttcgtatgcgttacgttttttagtaattgtcggagttgcgtgcgtagttagaaattgtcgatagtgtatcggtataggcgttacgtgagaagatgggcgagtttgtcgagttgcgcgatttgttggagcgagtaattatcgatatatcgtcggtgttggtacgcgacggtggtgttatcgtatcgggttataacgaagagttggatgagtggcgcgcgttggttgacggcgcg

SEQ ID NO: 16944 - DNA, 611 bp, Artificial Sequence
  chemically treated genomic DNA (Homo sapiens) CpG-island No: 16944
cgcgccgtcaaccaacgcgcgccactcatccaactcttcgttataacccgatacgataacaccaccgtcgcgtaccaacaccgacgatatatcgataattactcgctccaacaaatcgcgcaactcgacaaactcgcccatcttctcacgtaacgcctataccgatacactatcgacaatttctaactacgcacgcaactccgacaattactaaaaaacgtaacgcatacgaaccaaatcgcgtaaacgaacaattcgtaaaaccaaacgtaccaaaatacgttccaaatcgccgacctaacgcaataccgactataacccgacgataaaatcctacaatacgccaataatttactaacgctcaaacaacacgcgaatatcgcgcactaacatatacaaccaacgtttcaacatacgactacccatcgacgtaacgatacaatcgaacacaaaaaccaacgtattttccgcaccacccgccaaattctaaataatttccaaattacgacgcgtcgcgacatccataataatactatcctactcacgttccataataataaaacgaatatacgacaaaatcgtacgttaaatatctttcgcatactacaaca

SEQ ID NO: 16945 - DNA, 620 bp, Artificial Sequence
  chemically treated genomic DNA (Homo sapiens) CpG-island No: 16945
cggtagtataaagttcgcgcggcgcgttttcgacgttaaatcggattagatcgcggggttttaaatcgtagatttaattgttggcgcgcggtgtcgattttaaatttttatagcgggcgacggcgtaggtcgcgacggtttttaattaacgatattttagtaaaattttttgtatatagtagtttcgtaggattagtgcgttgtagttttgtcgttatcgtttcgcggttagtcggttcgtttaggcgaaaacgttcggaattgatatttagcgtcgcgtagtcgaaatttttgttgttttgttagatagtcgttagtaggttgttttgacgtttttgtaatagggttttatcgttgatggtgtttggcgtaacgatacgtataattttgcgtttaatcggatttttgttggtcgtcggatcgttaatttgttcgtagatggtaacggattttttttgatttattagtttggcgagatagttttttatcgtatggtagggaattttcgttatcgggatcggttttttcgtcgaagtatcgcgtttggttagtgaaatatttagtagttgcgacgcgcgttttgcgtcgttataaaatagtttataaaaattatttattcg

SEQ ID NO: 16946 - DNA, 620 bp, Artificial Sequence
  chemically treated genomic DNA (Homo sapiens) CpG-island No: 16946
cgaataaataatttttataaactattttataacgacgcaaaacgcgcgtcgcaactactaaatatttcactaaccaaacgcgatacttcgacgaaaaaaccgatcccgataacgaaaattccctaccatacgataaaaaactatctcgccaaactaataaatcaaaaaaaatccgttaccatctacgaacaaattaacgatccgacgaccaacaaaaatccgattaaacgcaaaattatacgtatcgttacgccaaacaccatcaacgataaaaccctattacaaaaacgtcaaaacaacctactaacgactatctaacaaaacaacaaaaatttcgactacgcgacgctaaatatcaattccgaacgttttcgcctaaacgaaccgactaaccgcgaaacgataacgacaaaactacaacgcactaatcctacgaaactactatatacaaaaaattttactaaaatatcgttaattaaaaaccgtcgcgacctacgccgtcgcccgctataaaaatttaaaatcgacaccgcgcgccaacaattaaatctacgatttaaaaccccgcgatctaatccgatttaacgtcgaaaacgcgccgcgcgaactttatactaccg

SEQ ID NO: 16947 - DNA, 620 bp, Artificial Sequence
  chemically treated genomic DNA (Homo sapiens) CpG-island No: 16947
cggatgggtgatttttatgaattgttttatgacgacgtaaaacgcgcgtcgtaattgttggatattttattgattaaacgcggtgtttcggcgggagagtcgatttcgatggcggggattttttattatgcggtggaaaattatttcgttaaattggtgaattagggagagttcgttgttatttgcgaataaattggcgattcggcgattagtaaaggttcggttgagcgtaaagttgtgcgtatcgttacgttaggtattattagcgatgaagttttgttgtaggagcgttaggataatttgttggcggttatttggtaggatagtaaaggtttcggttacgcgacgttggatattagtttcgggcgttttcgtttgagcgaatcggttgatcgcgaaacgatggcggtagaattgtaacgtattaattttgcggaattgttgtatgtagaagattttgttgaaatgtcgttaattgaaggtcgtcgcggtttgcgtcgtcgttcgttgtgggagtttgaaatcgatatcgcgcgttagtagttgaatttgcgatttgggatttcgcgatttggttcggtttggcgtcgagaacgcgtcgcgcggattttgtgttgtcg

SEQ ID NO: 16948 - DNA, 620 bp, Artificial Sequence
  chemically treated genomic DNA (Homo sapiens) CpG-island No: 16948
cgacaacacaaaatccgcgcgacgcgttctcgacgccaaaccgaaccaaatcgcgaaatcccaaatcgcaaattcaactactaacgcgcgatatcgatttcaaactcccacaacgaacgacgacgcaaaccgcgacgaccttcaattaacgacatttcaacaaaatcttctacatacaacaattccgcaaaattaatacgttacaattctaccgccatcgtttcgcgatcaaccgattcgctcaaacgaaaacgcccgaaactaatatccaacgtcgcgtaaccgaaacctttactatcctaccaaataaccgccaacaaattatcctaacgctcctacaacaaaacttcatcgctaataatacctaacgtaacgatacgcacaactttacgctcaaccgaacctttactaatcgccgaatcgccaatttattcgcaaataacaacgaactctccctaattcaccaatttaacgaaataattttccaccgcataataaaaaatccccgccatcgaaatcgactctcccgccgaaacaccgcgtttaatcaataaaatatccaacaattacgacgcgcgttttacgtcgtcataaaacaattcataaaaatcacccatccg

SEQ ID NO: 16949 - DNA, 539 bp, Artificial Sequence
  chemically treated genomic DNA (Homo sapiens) CpG-island No: 16949
gtcgttaattatataatcgatgttatcgtttagcgtaacgtagtttagtttttattgtgtagtttgtgttttacgcggatttttttgcgattggttacgtatttcgcgtagattaggttggcggaatagtgcgttgtcgttagcgtttagtttgtcgtcgaggtaaattagatcgttttgtttggtgatgattagcgggttgatttcgattaacgttaggtcgcgttttaggaaaatggtcgttaggtttatgaagattttggtgaattgttgaattagtttattttttagatttagtttgaacgttagttcgcgtttttgatacggtatcgggttagttagcggattaagcgtaattttatggattaggtgcggagtttttttcgttattttttcgatttttacgtcgttttcggtggaggttataaagattatacgacgggaattacggttaataacggtatcgagatatagttttttacgatatcggtcgttgttttaattagaatttggttaatcggttggttattggtatttgt

SEQ ID NO: 16950 - DNA, 539 bp, Artificial Sequence
  chemically treated genomic DNA (Homo sapiens) CpG-island No: 16950
acaaataccaataaccaaccgattaaccaaattctaattaaaacaacgaccgatatcgtaaaaaactatatctcgataccgttattaaccgtaattcccgtcgtataatctttataacctccaccgaaaacgacgtaaaaatcgaaaaaataacgaaaaaaactccgcacctaatccataaaattacgcttaatccgctaactaacccgataccgtatcaaaaacgcgaactaacgttcaaactaaatctaaaaaataaactaattcaacaattcaccaaaatcttcataaacctaacgaccattttcctaaaacgcgacctaacgttaatcgaaatcaacccgctaatcatcaccaaacaaaacgatctaatttacctcgacgacaaactaaacgctaacgacaacgcactattccgccaacctaatctacgcgaaatacgtaaccaatcgcaaaaaaatccgcgtaaaacacaaactacacaataaaaactaaactacgttacgctaaacgataacatcgattatataattaacgac

SEQ ID NO: 16951 - DNA, 539 bp, Artificial Sequence
  chemically treated genomic DNA (Homo sapiens) CpG-island No: 16951
atagatgttaatggttaatcggttaattagattttggttgaagtagcgatcgatatcgtaaagagttgtatttcggtgtcgttgttgatcgtagttttcgtcgtgtggtttttatggtttttatcgaaggcggcgtggaaatcgaaaaagtggcggaagaaatttcgtatttgatttataaagttgcgtttgattcgttgattggttcgatgtcgtattagggacgcgagttggcgtttaaattgggtttggaaggtaaattggtttagtagtttattaaaatttttatgggtttggcgattatttttttggagcgcgatttggcgttgatcgaaattaattcgttggttattattaaatagggcgatttgatttgtttcgacggtaaattgggcgttgacggtaacgtattgtttcgttagtttgatttgcgcgaaatgcgtgattagtcgtaggaagattcgcgtgaagtataggttgtatagtgggaattgaattacgttgcgttggacggtaatatcggttgtatggttaacggt

SEQ ID NO: 16952 - DNA, 539 bp, Artificial Sequence
  chemically treated genomic DNA (Homo sapiens) CpG-island No: 16952
accgttaaccatacaaccgatattaccgtccaacgcaacgtaattcaattcccactatacaacctatacttcacgcgaatcttcctacgactaatcacgcatttcgcgcaaatcaaactaacgaaacaatacgttaccgtcaacgcccaatttaccgtcgaaacaaatcaaatcgccctatttaataataaccaacgaattaatttcgatcaacgccaaatcgcgctccaaaaaaataatcgccaaacccataaaaattttaataaactactaaaccaatttaccttccaaacccaatttaaacgccaactcgcgtccctaatacgacatcgaaccaatcaacgaatcaaacgcaactttataaatcaaatacgaaatttcttccgccactttttcgatttccacgccgccttcgataaaaaccataaaaaccacacgacgaaaactacgatcaacaacgacaccgaaatacaactctttacgatatcgatcgctacttcaaccaaaatctaattaaccgattaaccattaacatctat

SEQ ID NO: 16953 - DNA, 699 bp, Artificial Sequence
  chemically treated genomic DNA (Homo sapiens) CpG-island No: 16953
gttcgttgttgtatagttttatcgatttgagcgtggaaacgcgttttgatgtagaagtgaaaagttggtttgttttcgttttataaaaatgttatgaattggtattgttgcgcgatgcgttgaatagtggtgatacggtagttttggtagagtggagcgtttcgatttaggtacgtcgttattttattcgcgtatataattcggcggtagaaaagcgtttggcggcgattatcgtttaggatagttagcgtgcgaatgtttatgaagtgcgtgttgaagtttagcgtgcgcgttttaaattgttagcgtggtcgattattacgattggttttttttcgtaaattacggaaattcgtattttgcgtttggattttaaaaagggtaatttcgacgttaataattatcgtacgggtattgcggaatatattaagtaggttattgttgagtaggaacgtttgggattggatgtgttggtatatggcgaggtcgagcgtatgatttggtggatattttggcgagtattcgacggattgttttacgtaaagcgtgggttcgattacggtttcgtgggtaattcgttgtttgtgtatacgacgacgatacgtatgggatttttttttattaacgtaagagaggggtaaattgggacgcgcgatatggttgaaattaaacgcgtaaaaaattagagagttatagagt

SEQ ID NO: 16954 - DNA, 699 bp, Artificial Sequence
  chemically treated genomic DNA (Homo sapiens) CpG-island No: 16954
actctataactctctaattttttacgcgtttaatttcaaccatatcgcgcgtcccaatttacccctctcttacgttaataaaaaaaaatcccatacgtatcgtcgtcgtatacacaaacaacgaattacccacgaaaccgtaatcgaacccacgctttacgtaaaacaatccgtcgaatactcgccaaaatatccaccaaatcatacgctcgacctcgccatataccaacacatccaatcccaaacgttcctactcaacaataacctacttaatatattccgcaatacccgtacgataattattaacgtcgaaattaccctttttaaaatccaaacgcaaaatacgaatttccgtaatttacgaaaaaaaaccaatcgtaataatcgaccacgctaacaatttaaaacgcgcacgctaaacttcaacacgcacttcataaacattcgcacgctaactatcctaaacgataatcgccgccaaacgcttttctaccgccgaattatatacgcgaataaaataacgacgtacctaaatcgaaacgctccactctaccaaaactaccgtatcaccactattcaacgcatcgcgcaacaataccaattcataacatttttataaaacgaaaacaaaccaacttttcacttctacatcaaaacgcgtttccacgctcaaatcgataaaactatacaacaacgaac

SEQ ID NO: 16955 - DNA, 699 bp, Artificial Sequence
  chemically treated genomic DNA (Homo sapiens) CpG-island No: 16955
gttttatgattttttgattttttacgcgtttggttttagttatatcgcgcgttttagtttgttttttttttacgttggtaggagggaattttatgcgtatcgtcgtcgtatgtataggtaacgggttatttacgggatcgtagtcggatttacgttttgcgtaaaataattcgtcgagtgttcgttaaagtatttattaggttatacgttcggtttcgttatgtattagtatatttagttttaaacgtttttgtttaataatggtttgtttgatatgtttcgtaatgttcgtgcggtagttgttggcgtcgagattgttttttttgaaatttagacgtagggtacgaattttcgtggtttgcgggaaggaattaatcgtggtggtcggttacgttggtagtttaaaacgcgtacgttgggttttagtacgtattttatagatattcgtacgttggttgttttgggcggtgatcgtcgttagacgtttttttatcgtcggattatgtacgcgggtagagtgacgacgtgtttgaatcggggcgttttattttgttagagttgtcgtgttattattgtttagcgtatcgcgtagtagtgttagtttatggtatttttgtagggcgaaggtaaattagttttttatttttgtattaagacgcgtttttacgtttaggtcgatggggttgtgtagtaacgagt

SEQ ID NO: 16956 - DNA, 699 bp, Artificial Sequence
  chemically treated genomic DNA (Homo sapiens) CpG-island No: 16956
actcgttactacacaaccccatcgacctaaacgtaaaaacgcgtcttaatacaaaaataaaaaactaatttaccttcgccctacaaaaataccataaactaacactactacgcgatacgctaaacaataataacacgacaactctaacaaaataaaacgccccgattcaaacacgtcgtcactctacccgcgtacataatccgacgataaaaaaacgtctaacgacgatcaccgcccaaaacaaccaacgtacgaatatctataaaatacgtactaaaacccaacgtacgcgttttaaactaccaacgtaaccgaccaccacgattaattccttcccgcaaaccacgaaaattcgtaccctacgtctaaatttcaaaaaaaacaatctcgacgccaacaactaccgcacgaacattacgaaacatatcaaacaaaccattattaaacaaaaacgtttaaaactaaatatactaatacataacgaaaccgaacgtataacctaataaatactttaacgaacactcgacgaattattttacgcaaaacgtaaatccgactacgatcccgtaaataacccgttacctatacatacgacgacgatacgcataaaattccctcctaccaacgtaaaaaaaaaacaaactaaaacgcgcgatataactaaaaccaaacgcgtaaaaaatcaaaaaatcataaaac

SEQ ID NO: 16957 - DNA, 512 bp, Artificial Sequence
  chemically treated genomic DNA (Homo sapiens) CpG-island No: 16957
gtattcgtttcgttatcgtaaacgcgtttagttggcggtagcgtagtaatttttacgtcgttgtattttaggcgagtcgtgttattagtatcgcggaaggcgagggtgtgtttgaggaagttgacgtcgttacgttcggtgtaattttcgtttagacgttggtgcgcgtcgcgggattttttacgtgttattgcggagtgcgttatatatttagtaacgtttagatcgtggttttagtttaatggtgtagagtaggtcggtgtcgaattatcgttgggaagtgtcggtgatgcgtacgcgtttgaagcgttttgtagttcgttagtttgttatggtttttggtttagttcgggtcgggaattcgggtttttttagtaggtttttgcgcggtttttttattgcgtatttgttatattcgtttgtatgttagcgtggtttgaggatgttcgaagaagggttattggtatattaagtacgtatgtaaagtatattcgcgaatataatagaggttt

SEQ ID NO: 16958 - DNA, 512 bp, Artificial Sequence
  chemically treated genomic DNA (Homo sapiens) CpG-island No: 16958
aaacctctattatattcgcgaatatactttacatacgtacttaatataccaataacccttcttcgaacatcctcaaaccacgctaacatacaaacgaatataacaaatacgcaataaaaaaaccgcgcaaaaacctactaaaaaaacccgaattcccgacccgaactaaaccaaaaaccataacaaactaacgaactacaaaacgcttcaaacgcgtacgcatcaccgacacttcccaacgataattcgacaccgacctactctacaccattaaactaaaaccacgatctaaacgttactaaatatataacgcactccgcaataacacgtaaaaaatcccgcgacgcgcaccaacgtctaaacgaaaattacaccgaacgtaacgacgtcaacttcctcaaacacaccctcgccttccgcgatactaataacacgactcgcctaaaatacaacgacgtaaaaattactacgctaccgccaactaaacgcgtttacgataacgaaacgaatac

SEQ ID NO: 16959 - DNA, 512 bp, Artificial Sequence
  chemically treated genomic DNA (Homo sapiens) CpG-island No: 16959
ggatttttattgtattcgcgagtgtgttttgtatgcgtatttagtatgttagtgattttttttcgagtatttttagattacgttggtatatagacgagtgtaataggtgcgtaatgggaaaatcgcgtaaaggtttgttaggaaagttcggattttcgattcggattgagttagaaattatgataagttggcgagttgtaggacgttttaagcgcgtgcgtattatcgatattttttagcggtggttcgatatcgatttgttttatattattgaattggggttacggtttgaacgttgttgaatgtatggcgtatttcgtaatggtacgtaaagagtttcgcggcgcgtattagcgtttggacgaaggttgtatcgagcgtgacgacgttaatttttttaaatatattttcgtttttcgcgatgttgatggtacgattcgtttggagtatagcgacgtgaagattattacgttgtcgttagttaaacgcgtttacggtggcgaagcggatgt

SEQ ID NO: 16960 - DNA, 512 bp, Artificial Sequence
  chemically treated genomic DNA (Homo sapiens) CpG-island No: 16960
acatccgcttcgccaccgtaaacgcgtttaactaacgacaacgtaataatcttcacgtcgctatactccaaacgaatcgtaccatcaacatcgcgaaaaacgaaaatatatttaaaaaaattaacgtcgtcacgctcgatacaaccttcgtccaaacgctaatacgcgccgcgaaactctttacgtaccattacgaaatacgccatacattcaacaacgttcaaaccgtaaccccaattcaataatataaaacaaatcgatatcgaaccaccgctaaaaaatatcgataatacgcacgcgcttaaaacgtcctacaactcgccaacttatcataatttctaactcaatccgaatcgaaaatccgaactttcctaacaaacctttacgcgattttcccattacgcacctattacactcgtctatataccaacgtaatctaaaaatactcgaaaaaaaatcactaacatactaaatacgcatacaaaacacactcgcgaatacaataaaaatcc

SEQ ID NO: 16961 - DNA, 576 bp, Artificial Sequence
  chemically treated genomic DNA (Homo sapiens) CpG-island No: 16961
  misc_feature (42)..(46): n is either a, c, g or t
  misc_feature (81)..(81): n is either a, c, g or t
  misc_feature (112)..(112): n is either a, c, g or t
tttcgtgttgcgttttcgtttgttcgacggttgggtgttggnnnnngggaagaacgcgacggggacgagagaaacgggagnagtgaattcgggttgtgttttttttggcgtnttatgatgacgtttcggggtgataaattttttttgcgcgtaaggtgtggggttatatttttattacggttgtgttcggcgaggtcgacgtgagtttttgaatttttcgtttaatcgggaaatcgattagatcgttatttattttgcgggtacgttttagcggatcggagattcgtatgttggtgattcggaagcggtatgcgttaatgagttgtaggattttaatttgttttatattggtgttagggtcggagatcgttgaagagtaacgtgaagcgtttttcgttaggcggcggaaatatttacgcgtttgagagtggaattgattcggtttgattttcgtattaggtaattgttggaacgtcgaacgttagttagcgttaatcgagttaggatcggttaagaagtttttatagagttgttttatttagttttggtttgcgttagagaggtaagaagagttta

SEQ ID NO: 16962 - DNA, 576 bp, Artificial Sequence
  chemically treated genomic DNA (Homo sapiens) CpG-island No: 16962
  misc_feature (465)..(465): n is either a, c, g or t
  misc_feature (496)..(496): n is either a, c, g or t
  misc_feature (531)..(535): n is either a, c, g or t
taaactcttcttacctctctaacgcaaaccaaaactaaataaaacaactctataaaaacttcttaaccgatcctaactcgattaacgctaactaacgttcgacgttccaacaattacctaatacgaaaatcaaaccgaatcaattccactctcaaacgcgtaaatatttccgccgcctaacgaaaaacgcttcacgttactcttcaacgatctccgaccctaacaccaatataaaacaaattaaaatcctacaactcattaacgcataccgcttccgaatcaccaacatacgaatctccgatccgctaaaacgtacccgcaaaataaataacgatctaatcgatttcccgattaaacgaaaaattcaaaaactcacgtcgacctcgccgaacacaaccgtaataaaaatataaccccacaccttacgcgcaaaaaaaatttatcaccccgaaacgtcatcataanacgccaaaaaaaacacaacccgaattcactnctcccgtttctctcgtccccgtcgcgttcttcccnnnnnccaacacccaaccgtcgaacaaacgaaaacgcaacacgaaa

SEQ ID NO: 16963 - DNA, 576 bp, Artificial Sequence
  chemically treated genomic DNA (Homo sapiens) CpG-island No: 16963
  misc_feature (465)..(465): n is either a, c, g or t
  misc_feature (496)..(496): n is either a, c, g or t
  misc_feature (531)..(535): n is either a, c, g or t
tggattttttttatttttttggcgtaaattagagttggatagaatagttttatgaagattttttaatcgattttgattcggttgacgttaattggcgttcgacgttttagtagttatttggtacgggagttaaatcggattaattttatttttaaacgcgtgaatattttcgtcgtttggcgaaagacgttttacgttattttttaacgattttcgattttgatattaatgtgaagtaggttaaagttttgtagtttattaacgtatatcgttttcgggttattagtatgcgaattttcgattcgttgggacgtgttcgtaaaataagtggcgatttgatcggtttttcgattggacgagaaatttagggatttacgtcggtttcgtcgggtataatcgtaatgggagtgtgattttatattttgcgcgtagggggagtttattatttcgaaacgttattatggngcgttaaggagaatatagttcgagtttattnttttcgtttttttcgttttcgtcgcgttttttttnnnnnttaatatttaatcgtcggataaacgagagcgtagtacgaga

SEQ ID NO: 16964 - DNA, 576 bp, Artificial Sequence
  chemically treated genomic DNA (Homo sapiens) CpG-island No: 16964
  misc_feature (42)..(46): n is either a, c, g or t
  misc_feature (81)..(81): n is either a, c, g or t
  misc_feature (112)..(112): n is either a, c, g or t
tctcgtactacgctctcgtttatccgacgattaaatattaannnnnaaaaaaaacgcgacgaaaacgaaaaaaacgaaaanaataaactcgaactatattctccttaacgcnccataataacgtttcgaaataataaactccccctacgcgcaaaatataaaatcacactcccattacgattatacccgacgaaaccgacgtaaatccctaaatttctcgtccaatcgaaaaaccgatcaaatcgccacttattttacgaacacgtcccaacgaatcgaaaattcgcatactaataacccgaaaacgatatacgttaataaactacaaaactttaacctacttcacattaatatcaaaatcgaaaatcgttaaaaaataacgtaaaacgtctttcgccaaacgacgaaaatattcacgcgtttaaaaataaaattaatccgatttaactcccgtaccaaataactactaaaacgtcgaacgccaattaacgtcaaccgaatcaaaatcgattaaaaaatcttcataaaactattctatccaactctaatttacgccaaaaaaataaaaaaaatcca

SEQ ID NO: 16965 - DNA, 577 bp, Artificial Sequence
  chemically treated genomic DNA (Homo sapiens) CpG-island No: 16965
agtacgtagcggatatgtacggtcgtgatgcggtatcgtagattattattttcggtataatggcggcgaaagcggtgattcgcgacgtaggtcgcgtgttggggtattcgtacggttttgtcgatcgtatttcgaaattgatttcgttcgattcggggatgacgttggcgaaagcgtagaagtcgagtcgagttgtcgatattacgaagcggagaagaagttacggttgatcgataatgggcgtaacggtagggttatcgtaagcgggaagtttcgtgggtggttatatttttaaataacgattggcgtttatggattatagcgtattcggttcggtgatacgataagtaatcgaaggaatatatttcggtggtatttttatagggtagtaaaacgcgggtaaaagaggtattaggtatagaggcggatatattttatatttagttcgtttttttgttttcgtcgtcgcgtttaatattgtggtaatagtaagtaatatttagaagaatacgtcgatatttattaacgcgatcgatattatagatatagatatatattatatattagtttatttaat

SEQ ID NO: 16966 - DNA, 577 bp, Artificial Sequence
  chemically treated genomic DNA (Homo sapiens) CpG-island No: 16966
attaaataaactaatatataatatatatctatatctataatatcgatcgcgttaataaatatcgacgtattcttctaaatattacttactattaccacaatattaaacgcgacgacgaaaacaaaaaaacgaactaaatataaaatatatccgcctctatacctaatacctcttttacccgcgttttactaccctataaaaataccaccgaaatatattccttcgattacttatcgtatcaccgaaccgaatacgctataatccataaacgccaatcgttatttaaaaatataaccacccacgaaacttcccgcttacgataaccctaccgttacgcccattatcgatcaaccgtaacttcttctccgcttcgtaatatcgacaactcgactcgacttctacgctttcgccaacgtcatccccgaatcgaacgaaatcaatttcgaaatacgatcgacaaaaccgtacgaataccccaacacgcgacctacgtcgcgaatcaccgctttcgccgccattataccgaaaataataatctacgataccgcatcacgaccgtacatatccgctacgtact

SEQ ID NO: 16967 - DNA, 577 bp, Artificial Sequence
  chemically treated genomic DNA (Homo sapiens) CpG-island No: 16967
gttgggtaggttggtgtgtggtgtgtgtttgtgtttgtagtgtcggtcgcgttggtgggtgtcggcgtgtttttttgggtgttgtttattgttgttatagtgttggacgcgacgacgagaatagaaaagcgaattgagtataggatgtgttcgtttttgtatttggtgttttttttgttcgcgttttgttgttttgtgggggtgttatcgagatgtgttttttcggttatttgtcgtgttatcgggtcggatgcgttgtggtttataggcgttaatcgttatttgggggtgtgattatttacggggtttttcgtttgcggtggttttgtcgttgcgtttattgtcggttagtcgtagtttttttttcgtttcgtagtgtcggtagttcggttcggtttttacgttttcgttagcgttattttcggatcgggcgggattagtttcgagatacgatcgataaagtcgtacggatgttttagtacgcggtttacgtcgcggattatcgttttcgtcgttattgtatcgaaggtgatgatttgcgatatcgtattacgatcgtatatgttcgttacgtgtt

SEQ ID NO: 16968 - DNA, 577 bp, Artificial Sequence
  chemically treated genomic DNA (Homo sapiens) CpG-island No: 16968
aacacgtaacgaacatatacgatcgtaatacgatatcgcaaatcatcaccttcgatacaataacgacgaaaacgataatccgcgacgtaaaccgcgtactaaaacatccgtacgactttatcgatcgtatctcgaaactaatcccgcccgatccgaaaataacgctaacgaaaacgtaaaaaccgaaccgaactaccgacactacgaaacgaaaaaaaaactacgactaaccgacaataaacgcaacgacaaaaccaccgcaaacgaaaaaccccgtaaataatcacacccccaaataacgattaacgcctataaaccacaacgcatccgacccgataacacgacaaataaccgaaaaaacacatctcgataacacccccacaaaacaacaaaacgcgaacaaaaaaaacaccaaatacaaaaacgaacacatcctatactcaattcgcttttctattctcgtcgtcgcgtccaacactataacaacaataaacaacacccaaaaaaacacgccgacacccaccaacgcgaccgacactacaaacacaaacacacaccacacaccaacctacccaac

SEQ ID NO: 16969 - DNA, 544 bp, Artificial Sequence
  chemically treated genomic DNA (Homo sapiens) CpG-island No: 16969
gttggtgcgattttagcgtttttacgtcgatgatgcgtatttacgaaggtaatcgttttggcgataattggtagtttgacggcgacgtagaaattatcgtttatttcgttcgtatgattatcgtttttattattttgaaattttatttgaaagaggtcgtcgcgttgaatgcgaagttcggtttgtcggttatgcgttcgttgtttttgtattacgaagacgatgcgtatatttatattttgaaatattagtatttgttaggtcgcgatattttggtcgtttcggtgtatgaagaaggtcgtagcgattggacgttttatttgtcggaggataattgggtttacgtttggacgggtgaagcgtttcggggcggggaagttatcgttaatgcgtttatcggtaagttcgtcggttttttatcgcgtcgatagcgaatgggcggtattgttcgcgtcgttaaaaagtatttaattatattcgttcgtggggaaatttatgggttaagggagaatatcgatgagttatattataacggaagatttag

SEQ ID NO: 16970 - DNA, 544 bp, Artificial Sequence
  chemically treated genomic DNA (Homo sapiens) CpG-island No: 16970
ctaaatcttccgttataatataactcatcgatattctcccttaacccataaatttccccacgaacgaatataattaaatactttttaacgacgcgaacaataccgcccattcgctatcgacgcgataaaaaaccgacgaacttaccgataaacgcattaacgataacttccccgccccgaaacgcttcacccgtccaaacgtaaacccaattatcctccgacaaataaaacgtccaatcgctacgaccttcttcatacaccgaaacgaccaaaatatcgcgacctaacaaatactaatatttcaaaatataaatatacgcatcgtcttcgtaatacaaaaacaacgaacgcataaccgacaaaccgaacttcgcattcaacgcgacgacctctttcaaataaaatttcaaaataataaaaacgataatcatacgaacgaaataaacgataatttctacgtcgccgtcaaactaccaattatcgccaaaacgattaccttcgtaaatacgcatcatcgacgtaaaaacgctaaaatcgcaccaac

SEQ ID NO: 16971 - DNA, 544 bp, Artificial Sequence
  chemically treated genomic DNA (Homo sapiens) CpG-island No: 16971
ttggatttttcgttgtgatgtgatttatcgatgtttttttttggtttatgagtttttttacgggcggatgtgattagatgttttttaacgacgcgaatagtgtcgtttattcgttatcggcgcgataaaagatcggcgggtttgtcgatgggcgtattaacggtaattttttcgtttcggaacgttttattcgtttaggcgtggatttagttatttttcggtagatagagcgtttagtcgttacggttttttttatgtatcggagcgattagaatgtcgcgatttaataggtattgatattttagggtgtaagtgtgcgtatcgttttcgtaatgtaggaatagcgggcgtataatcggtaggtcggatttcgtatttagcgcgacggttttttttaggtaaggttttagggtggtgaagacggtggttatacgggcgaaatgggcgatggtttttgcgtcgtcgttaaattgttagttgtcgttaggacggttattttcgtgggtgcgtattatcggcgtgaaggcgttgaaatcgtattagt

SEQ ID NO: 16972 - DNA, 544 bp, Artificial Sequence
  chemically treated genomic DNA (Homo sapiens) CpG-island No: 16972
actaatacgatttcaacgccttcacgccgataatacgcacccacgaaaataaccgtcctaacgacaactaacaatttaacgacgacgcaaaaaccatcgcccatttcgcccgtataaccaccgtcttcaccaccctaaaaccttacctaaaaaaaaccgtcgcgctaaatacgaaatccgacctaccgattatacgcccgctattcctacattacgaaaacgatacgcacacttacaccctaaaatatcaatacctattaaatcgcgacattctaatcgctccgatacataaaaaaaaccgtaacgactaaacgctctatctaccgaaaaataactaaatccacgcctaaacgaataaaacgttccgaaacgaaaaaattaccgttaatacgcccatcgacaaacccgccgatcttttatcgcgccgataacgaataaacgacactattcgcgtcgttaaaaaacatctaatcacatccgcccgtaaaaaaactcataaaccaaaaaaaaacatcgataaatcacatcacaacgaaaaatccaa

SEQ ID NO: 16973 - DNA, 540 bp, Artificial Sequence
  chemically treated genomic DNA (Homo sapiens) CpG-island No: 16973
ttcggacgatgatagcgtatttttgcgtatcgttaatacgtcgaagcgagagattggttcggttacgttgaaaaagttgggtgagtgggcgatgacgcgtaataaaagtatgtttatcgttagttttgatatgggtttgagttagacgtttagcggacgtggttatgaagtattgattcgttttatttattggttggtagaaatttagcgtttggcggagcgggagtcgattgtcgcggtgcgtgatttgatttatggtatggattatgaattttggttgtacgaaatatcgtttagttcgaaagtcgtcgaaatgcgtatgaagaacgttaattaattgtttagttggatgacggagatgttggaaggtagtgaattggatgagtcgatgacgtttatttaggtggtgacgcgttttattttgcgcgatatgatggagcgtggtgagagtgaagaagagttggattaggtgtaattgatgattttttacgcgtcgaaagggttggagtttttttatgtttatatggtcgggtatggaaa

SEQ ID NO: 16974 - DNA, 540 bp, Artificial Sequence
  chemically treated genomic DNA (Homo sapiens) CpG-island No: 16974
tttccatacccgaccatataaacataaaaaaactccaaccctttcgacgcgtaaaaaatcatcaattacacctaatccaactcttcttcactctcaccacgctccatcatatcgcgcaaaataaaacgcgtcaccacctaaataaacgtcatcgactcatccaattcactaccttccaacatctccgtcatccaactaaacaattaattaacgttcttcatacgcatttcgacgactttcgaactaaacgatatttcgtacaaccaaaattcataatccataccataaatcaaatcacgcaccgcgacaatcgactcccgctccgccaaacgctaaatttctaccaaccaataaataaaacgaatcaatacttcataaccacgtccgctaaacgtctaactcaaacccatatcaaaactaacgataaacatacttttattacgcgtcatcgcccactcacccaactttttcaacgtaaccgaaccaatctctcgcttcgacgtattaacgatacgcaaaaatacgctatcatcgtccgaa

SEQ ID NO: 16975 - DNA, 540 bp, Artificial Sequence
  chemically treated genomic DNA (Homo sapiens) CpG-island No: 16975
tttttatattcgattatgtagatataaggaaattttagttttttcgacgcgtggagagttattagttgtatttgatttagtttttttttatttttattacgttttattatgtcgcgtaaagtaaagcgcgttattatttgggtgagcgttatcggtttatttagtttattgttttttagtattttcgttatttagttaaatagttggttgacgttttttatgcgtatttcggcggttttcgggttgggcgatgtttcgtatagttaggatttataatttatgttatggattagattacgtatcgcggtaatcggttttcgtttcgttagacgttggatttttgttaattagtgagtgaagcgggttaatgttttataattacgttcgttaagcgtttgatttaggtttatattaaagttggcggtaaatatgtttttattgcgcgttatcgtttatttatttagtttttttagcgtagtcgggttaatttttcgtttcggcgtgttaacgatacgtagaaatgcgttgttatcgttcggg

SEQ ID NO: 16976 - DNA, 540 bp, Artificial Sequence
  chemically treated genomic DNA (Homo sapiens) CpG-island No: 16976
cccgaacgataacaacgcatttctacgtatcgttaacacgccgaaacgaaaaattaacccgactacgctaaaaaaactaaataaataaacgataacgcgcaataaaaacatatttaccgccaactttaatataaacctaaatcaaacgcttaacgaacgtaattataaaacattaacccgcttcactcactaattaacaaaaatccaacgtctaacgaaacgaaaaccgattaccgcgatacgtaatctaatccataacataaattataaatcctaactatacgaaacatcgcccaacccgaaaaccgccgaaatacgcataaaaaacgtcaaccaactatttaactaaataacgaaaatactaaaaaacaataaactaaataaaccgataacgctcacccaaataataacgcgctttactttacgcgacataataaaacgtaataaaaataaaaaaaaactaaatcaaatacaactaataactctccacgcgtcgaaaaaactaaaatttccttatatctacataatcgaatataaaaa

SEQ ID NO: 16977 - DNA, 819 bp, Artificial Sequence
  chemically treated genomic DNA (Homo sapiens) CpG-island No: 16977
agcgattggacgcgttggttaatgcggcgggaattttacgtatgggcgcgatcgattagtttagtaaagaggattggtagtagatttttgcggttaacgtcggcggtgcgtttaatttgttttagtaaattatgaattagtttcgtcgttagcggggcggggcgattgttattgtggcgttcgacgtcgcgtatacgtcgcgtattggtatgagtgtttatggcgtatcgaaagcggcgttgaaaagtttggcgttgagcgtcgggttggaattggcgggtagcggcgtgcgttgtaatgtggtttcgtttggttttatcgatatcgatatgtaacgtacgttgtgggtgagcgatgacgtcgaagaatagcgtattcgcggttttggcgagtagtttaaattcggtatttcgttggggaaaatcgttcgtttataagagatcgttaatacgattttgtttttcgtttttgatttcgttagttatattattttataggatattgtggtcgatggcggtttaacgttgggggtataagtatgatttggaaacgttatttaacgttcgacgaattgaacgttattagcgataatataatggtggcgtatttgggaattgtgtatattcgtttgggcgatgatgtgttggaagtcgaaatgtcggttgatattcgtatttattagtcgttcggtttattattggggggggtattggggggttggcggaacgcgggattaagggggattatgtaatcggaggaacgtgtgttgattaatttttttttatttttcgatataagaaagtatcgcgtttattcgtt

SEQ ID NO: 16978 - DNA, 819 bp, Artificial Sequence
  chemically treated genomic DNA (Homo sapiens) CpG-island No: 16978
aacgaataaacgcgatactttcttatatcgaaaaataaaaaaaaattaatcaacacacgttcctccgattacataatcccccttaatcccgcgttccgccaaccccccaataccccccccaataataaaccgaacgactaataaatacgaatatcaaccgacatttcgacttccaacacatcatcgcccaaacgaatatacacaattcccaaatacgccaccattatattatcgctaataacgttcaattcgtcgaacgttaaataacgtttccaaatcatacttatacccccaacgttaaaccgccatcgaccacaatatcctataaaataatataactaacgaaatcaaaaacgaaaaacaaaatcgtattaacgatctcttataaacgaacgattttccccaacgaaataccgaatttaaactactcgccaaaaccgcgaatacgctattcttcgacgtcatcgctcacccacaacgtacgttacatatcgatatcgataaaaccaaacgaaaccacattacaacgcacgccgctacccgccaattccaacccgacgctcaacgccaaacttttcaacgccgctttcgatacgccataaacactcataccaatacgcgacgtatacgcgacgtcgaacgccacaataacaatcgccccgccccgctaacgacgaaactaattcataatttactaaaacaaattaaacgcaccgccgacgttaaccgcaaaaatctactaccaatcctctttactaaactaatcgatcgcgcccatacgtaaaattcccgccgcattaaccaacgcgtccaatcgct

SEQ ID NO: 16979 - DNA, 819 bp, Artificial Sequence
  chemically treated genomic DNA (Homo sapiens) CpG-island No: 16979
gacgggtgaacgcgatatttttttatatcggagagtgagggaagattggttaatatacgttttttcgattatataattttttttgatttcgcgtttcgttagttttttaatgttttttttagtagtagatcgaacggttgatgagtacgggtattaatcggtatttcggtttttagtatattatcgtttagacgggtatatataatttttagatgcgttattattgtgttatcgttggtggcgtttagttcgtcgagcgttaaatggcgtttttagattatgtttatgtttttagcgttgagtcgttatcgattataatattttgtagggtaatatggttggcgaggttagaggcgaggaataaaatcgtgttggcgattttttgtggacgggcgattttttttagcggaatgtcgagtttaaattgttcgttaaagtcgcgaatacgttgtttttcggcgttatcgtttatttatagcgtgcgttgtatatcggtgtcggtggagttaggcgaaattatattatagcgtacgtcgttattcgttagttttagttcgacgtttaacgttaggttttttagcgtcgttttcgatgcgttataagtatttatgttaatacgcggcgtgtgcgcggcgtcggacgttatagtgataatcgtttcgtttcgttgacggcgaaattggtttatggtttgttggaataggttaaacgtatcgtcgacgttaatcgtaaaagtttgttgttagttttttttattgagttgatcggtcgcgtttatgcgtaaaattttcgtcgtattgattagcgcgtttagtcgtt

SEQ ID NO: 16980 - DNA, 819 bp, Artificial Sequence
  chemically treated genomic DNA (Homo sapiens) CpG-island No: 16980
aacgactaaacgcgctaatcaatacgacgaaaattttacgcataaacgcgaccgatcaactcaataaaaaaaactaacaacaaacttttacgattaacgtcgacgatacgtttaacctattccaacaaaccataaaccaatttcgccgtcaacgaaacgaaacgattatcactataacgtccgacgccgcgcacacgccgcgtattaacataaatacttataacgcatcgaaaacgacgctaaaaaacctaacgttaaacgtcgaactaaaactaacgaataacgacgtacgctataatataatttcgcctaactccaccgacaccgatatacaacgcacgctataaataaacgataacgccgaaaaacaacgtattcgcgactttaacgaacaatttaaactcgacattccgctaaaaaaaatcgcccgtccacaaaaaatcgccaacacgattttattcctcgcctctaacctcgccaaccatattaccctacaaaatattataatcgataacgactcaacgctaaaaacataaacataatctaaaaacgccatttaacgctcgacgaactaaacgccaccaacgataacacaataataacgcatctaaaaattatatatacccgtctaaacgataatatactaaaaaccgaaataccgattaatacccgtactcatcaaccgttcgatctactactaaaaaaaacattaaaaaactaacgaaacgcgaaatcaaaaaaaattatataatcgaaaaaacgtatattaaccaatcttccctcactctccgatataaaaaaatatcgcgttcacccgtc

SEQ ID NO: 16981 - DNA, 614 bp, Artificial Sequence
  chemically treated genomic DNA (Homo sapiens) CpG-island No: 16981
  misc_feature (610)..(610): n is either a, c, g or t
gttgtcgggtttttttcggtttaggttttgttggtaacgatatgtatggtgttgatcgggaagttataattcgtattattcggtagtttggtatcggcgtttttatcgttcggtagtgcggagaacggtatttgtaattagacgatatttttgttcggttttagttcgttatttatttagtacggcgtttaggtgtaataaaatatcggtttgttttttttgtagcgattgatggtgtcggttattatcgttgcgtagtttttttgattatgcgttacggtgttggttagtttatacgcggtaagttggtggttgatcgtattttcgtagatttagatagggttataatcggttaaatttcgtttttcgtcgtcgtggtatttattagttggggaattttcggatttttagtgtgttaggtggcgaattggacggtcggggaatatatcgttaggtatcgtttcggcgtataatttttcgttattttttttcgcgttttatttttataggtttattacggaggttcgaaagaggttcggatatcggtgagattatttaatcgaagtttgatagattttcgattttttttcgttttattatacgcgtgtanaaaa

SEQ ID NO: 16982 - DNA, 614 bp, Artificial Sequence
  chemically treated genomic DNA (Homo sapiens) CpG-island No: 16982
  misc_feature (5)..(5): n is either a, c, g or t
ttttntacacgcgtataataaaacgaaaaaaaatcgaaaatctatcaaacttcgattaaataatctcaccgatatccgaacctctttcgaacctccgtaataaacctataaaaataaaacgcgaaaaaaaataacgaaaaattatacgccgaaacgatacctaacgatatattccccgaccgtccaattcgccacctaacacactaaaaatccgaaaattccccaactaataaataccacgacgacgaaaaacgaaatttaaccgattataaccctatctaaatctacgaaaatacgatcaaccaccaacttaccgcgtataaactaaccaacaccgtaacgcataatcaaaaaaactacgcaacgataataaccgacaccatcaatcgctacaaaaaaaacaaaccgatattttattacacctaaacgccgtactaaataaataacgaactaaaaccgaacaaaaatatcgtctaattacaaataccgttctccgcactaccgaacgataaaaacgccgataccaaactaccgaataatacgaattataacttcccgatcaacaccatacatatcgttaccaacaaaacctaaaccgaaaaaaacccgacaac

SEQ ID NO: 16983 - DNA, 614 bp, Artificial Sequence
  chemically treated genomic DNA (Homo sapiens) CpG-island No: 16983
  misc_feature (5)..(5): n is either a, c, g or t
ttttntatacgcgtgtgataaaacggagagaagtcgagagtttattaggtttcggttgagtggttttatcgatgttcggatttttttcggattttcgtggtgggtttgtgaaaatgaaacgcgggaaaaaataacgaaggattgtacgtcggaacggtatttggcgatatgtttttcgatcgtttaattcgttatttggtatattgaagattcgaagattttttaattggtggatattacggcgacggaaaacgggatttaatcggttgtaattttgtttgggtttgcgaaggtgcgattaattattagtttgtcgcgtatgaattgattaatatcgtgacgtataattaggggaattacgtagcgatgatggtcgatattattagtcgttataaagagggtaaatcggtgttttattatatttggacgtcgtattgggtgagtaacgaattgaagtcgggtaaagatgtcgtttggttgtaggtgtcgtttttcgtattgtcgggcgataaaaacgtcgatattaaattgtcgaatggtgcgaattatggtttttcggttagtattatgtatatcgttgttaataaagtttgggtcgagaaaaattcggtagt

SEQ ID NO: 16984 - DNA, 614 bp, Artificial Sequence
  chemically treated genomic DNA (Homo sapiens) CpG-island No: 16984
  misc_feature (610)..(610): n is either a, c, g or t
actaccgaatttttctcgacccaaactttattaacaacgatatacataatactaaccgaaaaaccataattcgcaccattcgacaatttaatatcgacgtttttatcgcccgacaatacgaaaaacgacacctacaaccaaacgacatctttacccgacttcaattcgttactcacccaatacgacgtccaaatataataaaacaccgatttaccctctttataacgactaataatatcgaccatcatcgctacgtaattcccctaattatacgtcacgatattaatcaattcatacgcgacaaactaataattaatcgcaccttcgcaaacccaaacaaaattacaaccgattaaatcccgttttccgtcgccgtaatatccaccaattaaaaaatcttcgaatcttcaatataccaaataacgaattaaacgatcgaaaaacatatcgccaaataccgttccgacgtacaatccttcgttattttttcccgcgtttcattttcacaaacccaccacgaaaatccgaaaaaaatccgaacatcgataaaaccactcaaccgaaacctaataaactctcgacttctctccgttttatcacacgcgtatanaaaa

SEQ ID NO: 16985 - DNA, 806 bp, Artificial Sequence
  chemically treated genomic DNA (Homo sapiens) CpG-island No: 16985
ggtgcgttggatttcgcgggtggtatcgtggtgtatattaacgtcgtaatcgtcggtttggtgggcgcgtatttgataggaaaacgcgtgggtttcggtaaagaggcgtttaaatcgtataatttgtcgatggtttttatcgggattgttattttttatatcggttggtttggttttaacgtcgggttagcgggtacggcgaatgaaatcgcggtattggtatttgtgaatattgtggtcgtaacggcggcggtaatttttggttggattttcggtgaatgggcgttgcgtggtaagtttttattgttgggggcgtgttttggcgcgattgtcggtttggtcggcgtgacgttagtttgcggttatattggggttggcggcgcgttgattatcggcgtggtagttggtttggcgggtttgtggggcgttattatgtttaaacgtttgttgcgggtggatgatttttgcgatgttttcggtgtgtacggcgttcgtggtatagtcggttgtattatgatcgggatttttgtcgttagttcgttgggcggcgtgggtttcgttgaaggtgtgacgtatgggttattagttgttggtatagttggatagtatcgttattacgatcgtttggttcggtgttgtggtatttatcggttataaatggcggatttgacgggtggtttgggtgtatcgggacgagtaaggagcgagaaagggttggatgttaatagtttaggcgagaatggttataacgcgtaataagtattggaaaaatagcggcgaggttttattttcggtattttttaatg

SEQ ID NO: 16986 - DNA, 806 bp, Artificial Sequence
  chemically treated genomic DNA (Homo sapiens) CpG-island No: 16986
cattaaaaaataccgaaaataaaacctcgccgctatttttccaatacttattacgcgttataaccattctcgcctaaactattaacatccaaccctttctcgctccttactcgtcccgatacacccaaaccacccgtcaaatccgccatttataaccgataaataccacaacaccgaaccaaacgatcgtaataacgatactatccaactataccaacaactaataacccatacgtcacaccttcaacgaaacccacgccgcccaacgaactaacgacaaaaatcccgatcataatacaaccgactataccacgaacgccgtacacaccgaaaacatcgcaaaaatcatccacccgcaacaaacgtttaaacataataacgccccacaaacccgccaaaccaactaccacgccgataatcaacgcgccgccaaccccaatataaccgcaaactaacgtcacgccgaccaaaccgacaatcgcgccaaaacacgcccccaacaataaaaacttaccacgcaacgcccattcaccgaaaatccaaccaaaaattaccgccgccgttacgaccacaatattcacaaataccaataccgcgatttcattcgccgtacccgctaacccgacgttaaaaccaaaccaaccgatataaaaaataacaatcccgataaaaaccatcgacaaattatacgatttaaacgcctctttaccgaaacccacgcgttttcctatcaaatacgcgcccaccaaaccgacgattacgacgttaatatacaccacgataccacccgcgaaatccaacgcacc

SEQ ID NO: 16987 - DNA, 806 bp, Artificial Sequence
  chemically treated genomic DNA (Homo sapiens) CpG-island No: 16987
tattgaaaaatatcggaggtgaaatttcgtcgttgtttttttagtgtttgttacgcgttatagttattttcgtttgggttgttgatatttagttttttttcgttttttgttcgtttcggtatatttagattattcgttagattcgttatttgtagtcgataaatgttataatatcggattagacgatcgtaatggcgatgttgtttagttgtattagtaattgatggtttatgcgttatatttttagcgaagtttacgtcgtttagcgagttggcggtaaaaatttcggttatgatatagtcgattatgttacgaacgtcgtgtatatcgaagatatcgtagggattatttattcgtagtaagcgtttgagtatggtaacgttttataagttcgttagattagttattacgtcgataattaacgcgtcgttaattttaatgtagtcgtaggttggcgttacgtcgattagatcggtaatcgcgttagaatacgtttttagtagtgaaggtttattacgtagcgtttatttatcgaagatttagttaagaattgtcgtcgtcgttgcgattatagtatttataaatgttagtgtcgcgattttattcgtcgtgttcgttgattcggcgttaaagttaaattaatcgatatagagaatggtagtttcggtgaagattatcggtaggttgtgcggtttaaacgtttttttatcgaagtttacgcgtttttttattagatacgcgtttattagatcggcgattgcggcgttaatgtgtattacggtgttattcgcgaaatttagcgtatt

SEQ ID NO: 16988 - DNA, 806 bp, Artificial Sequence
  chemically treated genomic DNA (Homo sapiens) CpG-island No: 16988
aatacgctaaatttcgcgaataacaccgtaatacacattaacgccgcaatcgccgatctaataaacgcgtatctaataaaaaaacgcgtaaacttcgataaaaaaacgtttaaaccgcacaacctaccgataatcttcaccgaaactaccattctctatatcgattaatttaactttaacgccgaatcaacgaacacgacgaataaaatcgcgacactaacatttataaatactataatcgcaacgacgacgacaattcttaactaaatcttcgataaataaacgctacgtaataaaccttcactactaaaaacgtattctaacgcgattaccgatctaatcgacgtaacgccaacctacgactacattaaaattaacgacgcgttaattatcgacgtaataactaatctaacgaacttataaaacgttaccatactcaaacgcttactacgaataaataatccctacgatatcttcgatatacacgacgttcgtaacataatcgactatatcataaccgaaatttttaccgccaactcgctaaacgacgtaaacttcgctaaaaatataacgcataaaccatcaattactaatacaactaaacaacatcgccattacgatcgtctaatccgatattataacatttatcgactacaaataacgaatctaacgaataatctaaatataccgaaacgaacaaaaaacgaaaaaaaactaaatatcaacaacccaaacgaaaataactataacgcgtaacaaacactaaaaaaacaacgacgaaatttcacctccgatatttttcaata

SEQ ID NO: 16989 - DNA, 624 bp, Artificial Sequence
  chemically treated genomic DNA (Homo sapiens) CpG-island No: 16989
tgtcggatgcggcgtaatcgttttattcgatttacggggtggagtattttatagcggtgtaggtttgataagacgcgttagcgtcgtattaggtaatcggttcggacgttggatgtcggatgcggcgtaatcgttttatttaatttacggggtggagtattttatagcggtgtaggtttgataagacgcgtttagcgtcgtattaggtaatcggtttgggcgttagatgtcggatgcggcgtaatcgttttattcgatttacggggtggagtattttatagcggtgtaggtttgataagacgcgttagcgtcgtattaggtaatcggttcgggcgttggatgtcggatgcggcgtgatcgttttgtttgatttacggggtgtcgtattttatagcggtgtaggtttgataagacgcgttagcgtcgtattaggtaatcggttcgggcgttggatgtcggatgcggcgtgatcgttttgtttgatttacggggtgtcgtattttacggtagtttagcgaattatcgcgttgttaattttttttttcgttttttagacgcggtattttatatttatattgtttggcgtatatattacgatcggtagtttgttgttgtaacgtagta

SEQ ID NO: 16990 - DNA, 624 bp, Artificial Sequence
  chemically treated genomic DNA (Homo sapiens) CpG-island No: 16990
tactacgttacaacaacaaactaccgatcgtaatatatacgccaaacaatataaatataaaataccgcgtctaaaaaacgaaaaaaaaaattaacaacgcgataattcgctaaactaccgtaaaatacgacaccccgtaaatcaaacaaaacgatcacgccgcatccgacatccaacgcccgaaccgattacctaatacgacgctaacgcgtcttatcaaacctacaccgctataaaatacgacaccccgtaaatcaaacaaaacgatcacgccgcatccgacatccaacgcccgaaccgattacctaatacgacgctaacgcgtcttatcaaacctacaccgctataaaatactccaccccgtaaatcgaataaaacgattacgccgcatccgacatctaacgcccaaaccgattacctaatacgacgctaaacgcgtcttatcaaacctacaccgctataaaatactccaccccgtaaattaaataaaacgattacgccgcatccgacatccaacgtccgaaccgattacctaatacgacgctaacgcgtcttatcaaacctacaccgctataaaatactccaccccgtaaatcgaataaaacgattacgccgcatccgaca

SEQ ID NO: 16991 - DNA, 624 bp, Artificial Sequence
  chemically treated genomic DNA (Homo sapiens) CpG-island No: 16991
tgttgcgttataatagtaagttgtcgatcgtggtgtatacgttagataatgtagatgtgaagtatcgcgtttggaaggcggaagagaaaattgataacgcggtagttcgttaaattgtcgtgaagtgcggtatttcgtaggttagataaggcggttacgtcgtattcgatatttaacgttcgagtcggttgtttgatgcgacgttggcgcgttttattaggtttatatcgttgtgaagtgcggtatttcgtaggttagataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggttgtttgatgcgacgttgggcgcgttttattaggtttatatcgttgtgaagtgttttatttcgtaggttggataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgata

SEQ ID NO: 16992 - DNA, 624 bp, Artificial Sequence
  chemically treated genomic DNA (Homo sapiens) CpG-island No: 16992
tatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatccaacctacgaaataaaacacttcacaacgatataaacctaataaaacgcgcccaacgtcgcatcaaacaaccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatctaacctacgaaataccgcacttcacaacgatataaacctaataaaacgcgccaacgtcgcatcaaacaaccgactcgaacgttaaatatcgaatacgacgtaaccgccttatctaacctacgaaataccgcacttcacgacaatttaacgaactaccgcgttatcaattttctcttccgccttccaaacgcgatacttcacatctacattatctaacgtatacaccacgatcgacaacttactattataacgcaaca

SEQ ID NO: 16993 - DNA, 608 bp, Artificial Sequence
  chemically treated genomic DNA (Homo sapiens) CpG-island No: 16993
tacggcgttagatatatttgtatcgttttaggttcgcgttttatatcgttaacgttagcggcggcggagaatttcgtatttatttattatatttatttcgatgagcgtgggttggggtatttggcgttggggttggcgaaagttagtaagtagtcggtggcggtgattgtgattttcggtacggcggtggtaaatttttattcggtattgattgaagtcgggttaatcggagaaaaattgatttttttaatcgtcgatcgttcgtcggagttaattgattgcggcgcgaattaggtaattcgttagtcgggaatgttcgttttttatttacgtatagtattttattgtcgcgttcgatttaggatatttcgtacgttggttggtttttattattcgattcgttttcggtaagtttaaagcgggggagttataataaagggtcgtggttgatatatgttttggtaaagtgttaaacggagttatatatataacggttcgggttatcgtgtcggagaaatacgggtggatgaaagttttttgaaggaaaaacgacggtttcgtgtaaacgagtgtgtgggttaaagaaagaataatttgggtatcgtgtg

SEQ ID NO: 16994 - DNA, 608 bp, Artificial Sequence
  chemically treated genomic DNA (Homo sapiens) CpG-island No: 16994
cacacgatacccaaattattctttctttaacccacacactcgtttacacgaaaccgtcgtttttccttcaaaaaactttcatccacccgtatttctccgacacgataacccgaaccgttatatatataactccgtttaacactttaccaaaacatatatcaaccacgaccctttattataactcccccgctttaaacttaccgaaaacgaatcgaataataaaaaccaaccaacgtacgaaatatcctaaatcgaacgcgacaataaaatactatacgtaaataaaaaacgaacattcccgactaacgaattacctaattcgcgccgcaatcaattaactccgacgaacgatcgacgattaaaaaaatcaatttttctccgattaacccgacttcaatcaataccgaataaaaatttaccaccgccgtaccgaaaatcacaatcaccgccaccgactacttactaactttcgccaaccccaacgccaaataccccaacccacgctcatcgaaataaatataataaataaatacgaaattctccgccgccgctaacgttaacgatataaaacgcgaacctaaaacgatacaaatatatctaacgccgta

SEQ ID NO: 16995 - DNA, 608 bp, Artificial Sequence
  chemically treated genomic DNA (Homo sapiens) CpG-island No: 16995
tatacggtgtttagattgttttttttttggtttatatattcgtttgtacgaaatcgtcgttttttttttaaggggtttttatttattcgtgttttttcgatacgatgattcggatcgttgtgtgtatgatttcgtttggtattttgttaaaatatgtgttaattacggttttttattgtgattttttcgttttgagtttatcgagagcgggtcgaatggtagaaattagttaacgtgcgggatattttgggtcgggcgcggtaatgaaatattgtgcgtgggtagagagcgaatattttcggttggcgaattgtttgattcgcgtcgtagttaattagtttcggcgggcgatcggcggttaagagaattagttttttttcggttaattcggttttaattagtgtcggatagagatttgttatcgtcgtgtcggaggttataattatcgttatcggttgtttgttgattttcgttagttttagcgttagatgttttaatttacgtttatcgaaatgggtgtggtgaatgaatgcggaatttttcgtcgtcgttaacgttaacggtgtagaacgcgagtttggggcgatatagatgtgtttgacgtcgtg

SEQ ID NO: 16996 - DNA, 608 bp, Artificial Sequence
  chemically treated genomic DNA (Homo sapiens) CpG-island No: 16996
cacgacgtcaaacacatctatatcgccccaaactcgcgttctacaccgttaacgttaacgacgacgaaaaattccgcattcattcaccacacccatttcgataaacgtaaattaaaacatctaacgctaaaactaacgaaaatcaacaaacaaccgataacgataattataacctccgacacgacgataacaaatctctatccgacactaattaaaaccgaattaaccgaaaaaaaactaattctcttaaccgccgatcgcccgccgaaactaattaactacgacgcgaatcaaacaattcgccaaccgaaaatattcgctctctacccacgcacaatatttcattaccgcgcccgacccaaaatatcccgcacgttaactaatttctaccattcgacccgctctcgataaactcaaaacgaaaaaatcacaataaaaaaccgtaattaacacatattttaacaaaataccaaacgaaatcatacacacaacgatccgaatcatcgtatcgaaaaaacacgaataaataaaaaccccttaaaaaaaaaacgacgatttcgtacaaacgaatatataaaccaaaaaaaaaacaatctaaacaccgtata

SEQ ID NO: 16997 - DNA, 512 bp, Artificial Sequence
  chemically treated genomic DNA (Homo sapiens) CpG-island No: 16997
ttgtagtgttaggattcgatcgtttagttgttcggtaagaagtacgttaaattattgacggcgttttgtcgcgtttaatgtgttttgttggcgtgttttattgtatagcgtatttgtttgggattattgttttaggtagattgttcgttgtagtagatcggttcgtagcgttttttttttcggcgatgtagtaaacgtcgtatcgtttagttgcgttttggcgataggtaattgtgttagtcgtagggtattttgttcgattttattgcgataacgtagggtcggcgtagtatcgtacgttttttgttgggtaagtagttttttaattgtcgtaacgttttttattttaatcggaatagtcgttagattgcgtttaagtcgggtattttttgggtgacgttttagttgatttttaagtaatagtcgcgttcggttattatgattaaaatggcgataggttttcgtaaggtataaagttagcggaatattattcggtatttgttggtgtatat

SEQ ID NO: 16998 - DNA, 512 bp, Artificial Sequence
  chemically treated genomic DNA (Homo sapiens) CpG-island No: 16998
atatacaccaacaaataccgaataatattccgctaactttataccttacgaaaacctatcgccattttaatcataataaccgaacgcgactattacttaaaaatcaactaaaacgtcacccaaaaaatacccgacttaaacgcaatctaacgactattccgattaaaataaaaaacgttacgacaattaaaaaactacttacccaacaaaaaacgtacgatactacgccgaccctacgttatcgcaataaaatcgaacaaaataccctacgactaacacaattacctatcgccaaaacgcaactaaacgatacgacgtttactacatcgccgaaaaaaaaaacgctacgaaccgatctactacaacgaacaatctacctaaaacaataatcccaaacaaatacgctatacaataaaacacgccaacaaaacacattaaacgcgacaaaacgccgtcaataatttaacgtacttcttaccgaacaactaaacgatcgaatcctaacactacaa

SEQ ID NO: 16999 - DNA, 512 bp, Artificial Sequence
  chemically treated genomic DNA (Homo sapiens) CpG-island No: 16999
atatatattagtaggtgtcggataatatttcgttgattttatattttgcggaagtttatcgttattttggttatgatgatcgggcgcggttgttgtttgaggattaattgaaacgttatttaggagatgttcgatttgagcgtagtttggcggttatttcggttgaagtgaaaagcgttacgatagttgaagaattgtttgtttagtaaaaagcgtgcgatgttgcgtcgattttgcgttgtcgtagtgaagtcgggtagaatgttttgcggttggtatagttatttgtcgttagagcgtaattgaacgatgcgacgtttgttgtatcgtcggaaggaaaaacgttgcgaatcgatttgttgtaacgggtaatttatttgaaataatggttttaggtagatacgttatataatgaagtacgttagtagaatatattaagcgcggtagaacgtcgttagtggtttgacgtgttttttgtcgggtagttggacgatcggattttggtattgtaa

SEQ ID NO: 17000 - DNA, 512 bp, Artificial Sequence
  chemically treated genomic DNA (Homo sapiens) CpG-island No: 17000
ttacaataccaaaatccgatcgtccaactacccgacaaaaaacacgtcaaaccactaacgacgttctaccgcgcttaatatattctactaacgtacttcattatataacgtatctacctaaaaccattatttcaaataaattacccgttacaacaaatcgattcgcaacgtttttccttccgacgatacaacaaacgtcgcatcgttcaattacgctctaacgacaaataactataccaaccgcaaaacattctacccgacttcactacgacaacgcaaaatcgacgcaacatcgcacgctttttactaaacaaacaattcttcaactatcgtaacgcttttcacttcaaccgaaataaccgccaaactacgctcaaatcgaacatctcctaaataacgtttcaattaatcctcaaacaacaaccgcgcccgatcatcataaccaaaataacgataaacttccgcaaaatataaaatcaacgaaatattatccgacacctactaatatatat

SEQ ID NO: 17001 - DNA, 1089 bp, Artificial Sequence
  chemically treated genomic DNA (Homo sapiens) CpG-island No: 17001
tttatatgataatgcgttagtaaaaattgttggaacgattcgggcgattagcgatcggcgagatcgtgtagttcggcgtcgattagggtgattgcgtcgttaaattttattacgtcgttgtacggttggcggcgatattgcggcgagcgtcgcgttttggcgtaggtcgtatattcgtagttttatgtcggaacgttttgtgcgtcgtcggtgtcggtgagcgtgagggttaggtttatgttatagcgttttggtgaagcggaagtggttttgttcgtagttttcgcgtagatagaaacggtgcgcgtcgtggcgttttacgttggtcgaaagttcggttatttcggtttcggtttggcgggtttttttttttgtttacgttagtaatttattgtcgacgtttagatcgcgcgtttgcggtattattattaatttttgaatttcgtcgatttagttgatatgatgtagatgaaattgtaaatgtaggtcgattatgtcgataatttcgttattaagtagcgttagatggtagcgtatgtttgggtcgcgtagattggcgttaaaatttacgcgaaacgcgtggtggttaaatttcgtttgttttagtttataaattagcgcgtaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtatagcgggcggcgcgcgttaggcgggcgttaattttattggcgtttttacggttacggttttttaggcgttggcggaggattttcggcgaaatttgtaaatagacgggtagtagcgtcgattgatagcgcgttcgcgtttgcggtagatgggcgcgtgagtcgttgattagtacgtcgaattcggcgtgtagttagagattaatttcgacgtcgacgttataatatagatcgttagcgtgttagtttataggttaatagattttgtttcgcgcgggtaaaaatttttgttcgtttaggtcgatatggtttttattttcggg

SEQ ID NO: 17002 - DNA, 1089 bp, Artificial Sequence
  chemically treated genomic DNA (Homo sapiens) CpG-island No: 17002
cccgaaaataaaaaccatatcgacctaaacgaacaaaaatttttacccgcgcgaaacaaaatctattaacctataaactaacacgctaacgatctatattataacgtcgacgtcgaaattaatctctaactacacgccgaattcgacgtactaatcaacgactcacgcgcccatctaccgcaaacgcgaacgcgctatcaatcgacgctactacccgtctatttacaaatttcgccgaaaatcctccgccaacgcctaaaaaaccgtaaccgtaaaaacgccaataaaattaacgcccgcctaacgcgcgccgcccgctatactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgattacgcgctaatttataaactaaaacaaacgaaatttaaccaccacgcgtttcgcgtaaattttaacgccaatctacgcgacccaaacatacgctaccatctaacgctacttaataacgaaattatcgacataatcgacctacatttacaatttcatctacatcatatcaactaaatcgacgaaattcaaaaattaataataataccgcaaacgcgcgatctaaacgtcgacaataaattactaacgtaaacaaaaaaaaaaacccgccaaaccgaaaccgaaataaccgaactttcgaccaacgtaaaacgccacgacgcgcaccgtttctatctacgcgaaaactacgaacaaaaccacttccgcttcaccaaaacgctataacataaacctaaccctcacgctcaccgacaccgacgacgcacaaaacgttccgacataaaactacgaatatacgacctacgccaaaacgcgacgctcgccgcaatatcgccgccaaccgtacaacgacgtaataaaatttaacgacgcaatcaccctaatcgacgccgaactacacgatctcgccgatcgctaatcgcccgaatcgttccaacaatttttactaacgcattatcatataaa

SEQ ID NO: 17003 - DNA, 1089 bp, Artificial Sequence
  chemically treated genomic DNA (Homo sapiens) CpG-island No: 17003
ttcggaagtgaaaattatatcggtttgagcgagtaggagtttttattcgcgcggggtaaaatttgttggtttgtaagttggtacgttaacggtttgtattatggcgtcggcgtcgagattgatttttggttgtacgtcggattcgacgtgttggttaacggtttacgcgtttatttgtcgtaggcgcgggcgcgttattaatcggcgttgttgttcgtttgtttataggtttcgtcggagatttttcgttagcgtttggaaaatcgtggtcgtgaaaacgttagtgaaattaacgttcgtttggcgcgcgtcgttcgttatattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggttacgcgttgatttgtgagttaaaataggcggagtttgattattacgcgtttcgcgtgggttttaacgttaatttgcgcgatttaaatatgcgttattatttggcgttgtttgatggcgaagttgtcggtatgatcggtttgtatttgtagttttatttgtattatgttaattggatcggcgaaatttaggagttggtggtaatgtcgtaggcgcgcggtttgaacgtcggtagtaagttattggcgtgggtagaagaagaagttcgttaggtcggggtcgaaatgatcgaattttcgattaacgtgaagcgttacgacgcgtatcgtttttatttgcgcgaaggttacgagtagagttattttcgttttattaaggcgttgtaatatgagtttgatttttacgtttatcggtatcggcggcgtatagggcgtttcggtatggggttgcgagtgtgcggtttgcgttagagcgcggcgttcgtcgtagtatcgtcgttaatcgtgtagcggcgtagtgaagtttaacgacgtaattattttgatcgacgtcgggttgtacgatttcgtcgatcgttggtcgttcggatcgttttagtagtttttgttgacgtattattatatgga

SEQ ID NO: 17004 - DNA, 1089 bp, Artificial Sequence
  chemically treated genomic DNA (Homo sapiens) CpG-island No: 17004
tccatataataatacgtcaacaaaaactactaaaacgatccgaacgaccaacgatcgacgaaatcgtacaacccgacgtcgatcaaaataattacgtcgttaaacttcactacgccgctacacgattaacgacgatactacgacgaacgccgcgctctaacgcaaaccgcacactcgcaaccccataccgaaacgccctatacgccgccgataccgataaacgtaaaaatcaaactcatattacaacgccttaataaaacgaaaataactctactcgtaaccttcgcgcaaataaaaacgatacgcgtcgtaacgcttcacgttaatcgaaaattcgatcatttcgaccccgacctaacgaacttcttcttctacccacgccaataacttactaccgacgttcaaaccgcgcgcctacgacattaccaccaactcctaaatttcgccgatccaattaacataatacaaataaaactacaaatacaaaccgatcataccgacaacttcgccatcaaacaacgccaaataataacgcatatttaaatcgcgcaaattaacgttaaaacccacgcgaaacgcgtaataatcaaactccgcctattttaactcacaaatcaacgcgtaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatataacgaacgacgcgcgccaaacgaacgttaatttcactaacgttttcacgaccacgattttccaaacgctaacgaaaaatctccgacgaaacctataaacaaacgaacaacaacgccgattaataacgcgcccgcgcctacgacaaataaacgcgtaaaccgttaaccaacacgtcgaatccgacgtacaaccaaaaatcaatctcgacgccgacgccataatacaaaccgttaacgtaccaacttacaaaccaacaaattttaccccgcgcgaataaaaactcctactcgctcaaaccgatataattttcacttccgaa

SEQ ID NO: 17005 - DNA, 617 bp, Artificial Sequence
  chemically treated genomic DNA (Homo sapiens) CpG-island No: 17005
agcggttaatcggcgattaatcgttattgattgcgttaaggttcgttagaatagtatttggaaggatttttgtttgatgagcgcgaaagtaaatttcggtattgttatcgttatcggtatttggttacgtaatcggtttattacgattttttatattttttgtacgtagtcgaaaggttgatcggcggattcggtagtaataattcggtttttagttttttttagttcgggagtaggttgtttaggacgtaatagtcgtcgggtatcgcgttaattagcgaattttagaatttacgaggagtattcgaaaattcgttttgtttgtttttttaggcgtcggtaaacgaatttaacgaataggattcggaatgtttggtacgtcgggtttgaagtttgatttaggtagtttttttcgaagtagtatagcgtatttagtagatttagcggtaaaacgacgattagaatcggttagaagaaggcgtatcgtcgttatagtattcggattttgaatttttatagagcggcgtagaaaattatgtaatttttcgatttattcgatagagaaagatcggatttgaaagggaagtagggggaatggtaagtagaaggaagattat

SEQ ID NO: 17006 - DNA, 617 bp, Artificial Sequence
  chemically treated genomic DNA (Homo sapiens) CpG-island No: 17006
ataatcttccttctacttaccattccccctacttccctttcaaatccgatctttctctatcgaataaatcgaaaaattacataattttctacgccgctctataaaaattcaaaatccgaatactataacgacgatacgccttcttctaaccgattctaatcgtcgttttaccgctaaatctactaaatacgctatactacttcgaaaaaaactacctaaatcaaacttcaaacccgacgtaccaaacattccgaatcctattcgttaaattcgtttaccgacgcctaaaaaaacaaacaaaacgaattttcgaatactcctcgtaaattctaaaattcgctaattaacgcgatacccgacgactattacgtcctaaacaacctactcccgaactaaaaaaaactaaaaaccgaattattactaccgaatccgccgatcaacctttcgactacgtacaaaaaatataaaaaatcgtaataaaccgattacgtaaccaaataccgataacgataacaataccgaaatttactttcgcgctcatcaaacaaaaatccttccaaatactattctaacgaaccttaacgcaatcaataacgattaatcgccgattaaccgct

SEQ ID NO: 17007 - DNA, 617 bp, Artificial Sequence
  chemically treated genomic DNA (Homo sapiens) CpG-island No: 17007
gtaattttttttttgtttgttattttttttgttttttttttaggttcggtttttttttgtcgggtaaatcggggagttatatagttttttacgtcgttttgtaggaatttaaggttcgagtgttgtagcgacggtacgtttttttttagtcggttttgatcgtcgttttgtcgttggatttgttggatgcgttgtattatttcggagagaattgtttgaattaggttttaaattcggcgtgttaggtatttcgagttttgttcgttgagttcgtttatcgacgtttgagggaataggtaaaacgggttttcgggtatttttcgtaggttttggaattcgttggttagcgcgatgttcgacggttgttacgttttaaatagtttattttcgggttgaaagaagttaggagtcgggttgttgttatcgaattcgtcggttagtttttcgattgcgtgtaggaagtataggaaatcgtgataagtcggttgcgtggttagatatcggtagcggtgataatatcgaggtttattttcgcgtttattaggtaggaatttttttagatattgttttagcgggttttagcgtaattagtagcggttaatcgtcgattggtcgtt

SEQ ID NO: 17008 - DNA, 617 bp, Artificial Sequence
  chemically treated genomic DNA (Homo sapiens) CpG-island No: 17008
aacgaccaatcgacgattaaccgctactaattacgctaaaacccgctaaaacaatatctaaaaaaattcctacctaataaacgcgaaaataaacctcgatattatcaccgctaccgatatctaaccacgcaaccgacttatcacgatttcctatacttcctacacgcaatcgaaaaactaaccgacgaattcgataacaacaacccgactcctaacttctttcaacccgaaaataaactatttaaaacgtaacaaccgtcgaacatcgcgctaaccaacgaattccaaaacctacgaaaaatacccgaaaacccgttttacctattccctcaaacgtcgataaacgaactcaacgaacaaaactcgaaatacctaacacgccgaatttaaaacctaattcaaacaattctctccgaaataatacaacgcatccaacaaatccaacgacaaaacgacgatcaaaaccgactaaaaaaaaacgtaccgtcgctacaacactcgaaccttaaattcctacaaaacgacgtaaaaaactatataactccccgatttacccgacaaaaaaaaaccgaacctaaaaaaaaaacaaaaaaaataacaaacaaaaaaaaaattac

SEQ ID NO: 17009 - DNA, 1504 bp, Artificial Sequence
  chemically treated genomic DNA (Homo sapiens) CpG-island No: 17009
gtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggatataatgcgggtgtagacgtagaataagtggggacgttataggtgtggacgtggtgcgggtgtagacgtagaataagtggggacgttataggtgtggatataatgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaataagtggggacgttataggtgtggacgtggtgcgggtgtagacgtagaaaaaaaaaaaaa

SEQ ID NO: 17010 - DNA, 1504 bp, Artificial Sequence
  chemically treated genomic DNA (Homo sapiens) CpG-island No: 17010
tttttttttttttctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcattatatccacacctataacgtccccacttattctacgtctacacccgcaccacgtccacacctataacgtccccacttattctacgtctacacccgcattatatccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccacgtccacacctataacgtccccacttattctacgtctacacccgcaccac

SEQ ID NO: 17011 - DNA, 1504 bp, Artificial Sequence
  chemically treated genomic DNA (Homo sapiens) CpG-island No: 17011
tttttttttttttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattgtgtttatatttgtgacgtttttatttgttttacgtttatattcgtattacgtttatatttgtgacgtttttatttgttttacgtttatattcgtattgtgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattacgtttatatttgtgacgtttttatttgttttacgtttatattcgtattat

SEQ ID NO: 17012 - DNA, 1504 bp, Artificial Sequence
  chemically treated genomic DNA (Homo sapiens) CpG-island No: 17012
ataatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacacaatacgaatataaacgtaaaacaaataaaaacgtcacaaatataaacgtaatacgaatataaacgtaaaacaaataaaaacgtcacaaatataaacacaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaacaaataaaaacgtcacaaatataaacgtaatacgaatataaacgtaaaaaaaaaaaaaaa

SEQ ID NO: 17013 - DNA, 607 bp, Artificial Sequence
  chemically treated genomic DNA (Homo sapiens) CpG-island No: 17013
tttattcgggtttcggttgttgatagttgcgagttcgcgcgtgtatattcgtttaacgttgggacgttatagttagggttaatgggtagagcgggattcgaggtttcgttttcgttttgtggcgttacggggacgtcgggggcgcgcgggttgtagggtcgcgtaggttttcgtttttagagtttggtttttcgcggttgttcgtttcgcgcgttttttttgttcgggttttttcgttgtcgtcgtcgttgttatattatggttttcgttattaggtagtttatgcgtttcgtgtttttttcgtttatcgtttcggtttcggttaagaagataatcgttaagtacgtgacggttatcggcggcgggttgatgggcgtcggtattgtttaggtgagcggttttttttgtacggtgtttacgcgtttggttcgttattttgaggtggaagttttggcgcgatcggtcgcgaggggttgtattcgttcgatattagggagtttttatttcgcgtttttcgggtgtagttgaaatatttcgcgtttgggtttgtgagggtttaagttttattttttttaaaatttagggttttgggtcgatttttagtttt

SEQ ID NO: 17014 - DNA, 607 bp, Artificial Sequence
  chemically treated genomic DNA (Homo sapiens) CpG-island No: 17014
aaaactaaaaatcgacccaaaaccctaaattttaaaaaaaataaaacttaaaccctcacaaacccaaacgcgaaatatttcaactacacccgaaaaacgcgaaataaaaactccctaatatcgaacgaatacaacccctcgcgaccgatcgcgccaaaacttccacctcaaaataacgaaccaaacgcgtaaacaccgtacaaaaaaaaccgctcacctaaacaataccgacgcccatcaacccgccgccgataaccgtcacgtacttaacgattatcttcttaaccgaaaccgaaacgataaacgaaaaaaacacgaaacgcataaactacctaataacgaaaaccataatataacaacgacgacgacaacgaaaaaacccgaacaaaaaaaacgcgcgaaacgaacaaccgcgaaaaaccaaactctaaaaacgaaaacctacgcgaccctacaacccgcgcgcccccgacgtccccgtaacgccacaaaacgaaaacgaaacctcgaatcccgctctacccattaaccctaactataacgtcccaacgttaaacgaatatacacgcgcgaactcgcaactatcaacaaccgaaacccgaataaa

SEQ ID NO: 17015 - DNA, 607 bp, Artificial Sequence
  chemically treated genomic DNA (Homo sapiens) CpG-island No: 17015
gaagttgaggatcggtttagaattttgaattttgaggggagtgagatttgggtttttataggtttagacgcgagatattttaattatattcgggaggcgcggggtgaaaattttttggtgtcgggcgggtgtagtttttcgcggtcggtcgcgttagagtttttattttagggtggcgggttaagcgcgtgggtatcgtgtagggagggtcgtttatttgggtaatgtcggcgtttattagttcgtcgtcgatgatcgttacgtgtttgacgattatttttttggtcgaggtcgaggcggtggacgaggaggatacggaacgtatgaattgtttggtgacgaaggttatggtgtggtagcggcggcgatagcgaggagattcgggtagggaagacgcgcgaggcgggtagtcgcggaaagttagattttgggggcggggatttacgcggttttgtagttcgcgcgttttcggcgttttcgtgacgttataaggcgggggcggggtttcgagtttcgttttgtttattggttttggttgtaacgttttagcgttgagcgggtatatacgcgcgggttcgtagttgttagtagtcggagttcgagtgag

SEQ ID NO: 17016 - DNA, 607 bp, Artificial Sequence
  chemically treated genomic DNA (Homo sapiens) CpG-island No: 17016
ctcactcgaactccgactactaacaactacgaacccgcgcgtatatacccgctcaacgctaaaacgttacaaccaaaaccaataaacaaaacgaaactcgaaaccccgcccccgccttataacgtcacgaaaacgccgaaaacgcgcgaactacaaaaccgcgtaaatccccgcccccaaaatctaactttccgcgactacccgcctcgcgcgtcttccctacccgaatctcctcgctatcgccgccgctaccacaccataaccttcgtcaccaaacaattcatacgttccgtatcctcctcgtccaccgcctcgacctcgaccaaaaaaataatcgtcaaacacgtaacgatcatcgacgacgaactaataaacgccgacattacccaaataaacgaccctccctacacgatacccacgcgcttaacccgccaccctaaaataaaaactctaacgcgaccgaccgcgaaaaactacacccgcccgacaccaaaaaattttcaccccgcgcctcccgaatataattaaaatatctcgcgtctaaacctataaaaacccaaatctcactcccctcaaaattcaaaattctaaaccgatcctcaacttc

SEQ ID NO: 17017 - DNA, 597 bp, Artificial Sequence
  chemically treated genomic DNA (Homo sapiens) CpG-island No: 17017
ttatttttcggcggttatgttttacgatcgcgcgacggcggcgtgtcggtttttgcgttacggcgcgttggtgacgttatgggcgttgcgtttcgttggtgcgtgcgtcgtgggtcgtgacgtatttgtattcgttgttgtatacgttgttttttttcgcgtttttttatttttattttattttcgtgcgtttttttttttgcgatatgacggtgatgttgagtttggcgatttcggatacgttcgtcgcggagacggttatttttttcgagggtttggtcgtggtgttggtttcgttgtttttcgtgtttttttttttacgcgcgtattttggtcgcggtgttcggtttgcgcgcggtcggcgtcgcgttttttttatttgcggggtttatttagtggcggtggcggtggcggtggcgtttttttttggttttgtttttttcgtgtatttttcgtcgtcgtttgtttatttagttcgttacgatcgtttggttagcgtggtttacgttgttattacgtcgattttgaatttttttattaatagttttcgtaataaagaggttaagggcgttttgaaaagggggtttagatggaggg

SEQ ID NO: 17018 - DNA, 597 bp, Artificial Sequence
  chemically treated genomic DNA (Homo sapiens) CpG-island No: 17018
ccctccatctaaacccccttttcaaaacgcccttaacctctttattacgaaaactattaataaaaaaattcaaaatcgacgtaataacaacgtaaaccacgctaaccaaacgatcgtaacgaactaaataaacaaacgacgacgaaaaatacacgaaaaaaacaaaaccaaaaaaaaacgccaccgccaccgccaccgccactaaataaaccccgcaaataaaaaaaacgcgacgccgaccgcgcgcaaaccgaacaccgcgaccaaaatacgcgcgtaaaaaaaaaaacacgaaaaacaacgaaaccaacaccacgaccaaaccctcgaaaaaaataaccgtctccgcgacgaacgtatccgaaatcgccaaactcaacatcaccgtcatatcgcaaaaaaaaaaacgcacgaaaataaaataaaaataaaaaaacgcgaaaaaaaacaacgtatacaacaacgaatacaaatacgtcacgacccacgacgcacgcaccaacgaaacgcaacgcccataacgtcaccaacgcgccgtaacgcaaaaaccgacacgccgccgtcgcgcgatcgtaaaacataaccgccgaaaaataa

SEQ ID NO: 17019 - DNA, 597 bp, Artificial Sequence
  chemically treated genomic DNA (Homo sapiens) CpG-island No: 17019
ttttttatttgagttttttttttagggcgtttttgatttttttgttgcgaaggttgttgatgaaagggtttaaggtcggcgtgatgatagcgtagattacgttggttaggcggtcgtagcgggttgagtaggtagacgacggcgggaaatatacggagaggatagagttaaagaaaagcgttatcgttatcgttatcgttattaggtgggtttcgtaggtggagaaggcgcggcgtcggtcgcgcgtaagtcgagtatcgcgattaggatgcgcgcgtaggaaaaggaatacgaggagtagcggggttaatattacggttaggttttcggagaagatggtcgttttcgcggcggacgtgttcgaggtcgttaagtttagtattatcgttatgtcgtaaaagaaggggcgtacgggggtggggtaggggtaggagagcgcggagaggagtagcgtgtgtagtagcgagtgtaggtgcgttacggtttacgacgtacgtattagcgaggcgtagcgtttatggcgttattagcgcgtcgtagcgtaggggtcggtacgtcgtcgtcgcgcggtcgtaggatatggtcgtcgggaggtag

SEQ ID NO: 17020 - DNA, 597 bp, Artificial Sequence
  chemically treated genomic DNA (Homo sapiens) CpG-island No: 17020
ctacctcccgacgaccatatcctacgaccgcgcgacgacgacgtaccgacccctacgctacgacgcgctaataacgccataaacgctacgcctcgctaatacgtacgtcgtaaaccgtaacgcacctacactcgctactacacacgctactcctctccgcgctctcctacccctaccccacccccgtacgccccttcttttacgacataacgataatactaaacttaacgacctcgaacacgtccgccgcgaaaacgaccatcttctccgaaaacctaaccgtaatattaaccccgctactcctcgtattccttttcctacgcgcgcatcctaatcgcgatactcgacttacgcgcgaccgacgccgcgccttctccacctacgaaacccacctaataacgataacgataacgataacgcttttctttaactctatcctctccgtatatttcccgccgtcgtctacctactcaacccgctacgaccgcctaaccaacgtaatctacgctatcatcacgccgaccttaaaccctttcatcaacaaccttcgcaacaaaaaaatcaaaaacgccctaaaaaaaaaactcaaataaaaaa

SEQ ID NO: 17021 - DNA, 574 bp, Artificial Sequence
  chemically treated genomic DNA (Homo sapiens) CpG-island No: 17021
tgttgggcgcgtggtttttttttttcgtttgttcgtggttttttcgggcggtcggtgcgcgggggtgttgcgtgtcgcgtgtgttgcgcgtttcgcgttttgtttgcggttgtgcgtgtcggtcgtcgtcggtcgacgtgggcgcgttgttcgttttcgttttcgtttttcgtcgtttttcgttcgttcgtcgtcgttttttgttgtggtttcgtttttttttgtttttcgtgtcgggcggtcgtcgtcgcggcggcgtggtttcgggggcgtgggcgtcgtgttttgggtgcggcgtttgttgcggttgcgttttttgttacgttttgttttcgtcgggtttgtgttcggcggtcgttttttttcgtttcggtcgtttagttgcgttatttttttttggatcgcgtttattttttttttttgtgtgttggtttgggggttttttggcgcggtttgtgttttcgttgggcgtcggtgttttttttgttttttggtttgtggtcggggttttttggattcgtttcggttcggggattgggttgtttcgtgtttgaagggtgttgttttttttggt

SEQ ID NO: 17022 - DNA, 574 bp, Artificial Sequence
  chemically treated genomic DNA (Homo sapiens) CpG-island No: 17022
accaaaaaaaacaacacccttcaaacacgaaacaacccaatccccgaaccgaaacgaatccaaaaaaccccgaccacaaaccaaaaaacaaaaaaaacaccgacgcccaacgaaaacacaaaccgcgccaaaaaacccccaaaccaacacacaaaaaaaaaaaataaacgcgatccaaaaaaaaataacgcaactaaacgaccgaaacgaaaaaaaacgaccgccgaacacaaacccgacgaaaacaaaacgtaacaaaaaacgcaaccgcaacaaacgccgcacccaaaacacgacgcccacgcccccgaaaccacgccgccgcgacgacgaccgcccgacacgaaaaacaaaaaaaaacgaaaccacaacaaaaaacgacgacgaacgaacgaaaaacgacgaaaaacgaaaacgaaaacgaacaacgcgcccacgtcgaccgacgacgaccgacacgcacaaccgcaaacaaaacgcgaaacgcgcaacacacgcgacacgcaacacccccgcgcaccgaccgcccgaaaaaaccacgaacaaacgaaaaaaaaaaaccacgcgcccaaca

SEQ ID NO: 17023 - DNA, 574 bp, Artificial Sequence
  chemically treated genomic DNA (Homo sapiens) CpG-island No: 17023
attaagaggagtagtattttttagatacgaagtaatttaattttcgaatcgagacgaatttagaagatttcgattatagattaaggaatagagagggtatcggcgtttaacgagagtataaatcgcgttaagagatttttaaattaatatataagagagagaaataggcgcgatttaaagaggagtggcgtagttgagcggtcggagcgaagggaggcggtcgtcggatatagattcgacgggagtagagcgtgatagagaacgtaatcgtagtagacgtcgtatttagaatacggcgtttacgttttcgaagttacgtcgtcgcgacgacgatcgttcggtacgggggatagggaagaacgaggttataatagaagacggcggcgagcgagcggggggcggcggagggcggaagcgggagcgggtaacgcgtttacgtcggtcgacgacggtcggtacgtatagtcgtaggtagagcgcgaggcgcgtaatatacgcggtacgtagtattttcgcgtatcgatcgttcgaagaagttacgaataagcggggggagagaattacgcgtttagta

SEQ ID NO: 17024 - DNA, 574 bp, Artificial Sequence
  chemically treated genomic DNA (Homo sapiens) CpG-island No: 17024
tactaaacgcgtaattctctccccccgcttattcgtaacttcttcgaacgatcgatacgcgaaaatactacgtaccgcgtatattacgcgcctcgcgctctacctacgactatacgtaccgaccgtcgtcgaccgacgtaaacgcgttacccgctcccgcttccgccctccgccgccccccgctcgctcgccgccgtcttctattataacctcgttcttccctatcccccgtaccgaacgatcgtcgtcgcgacgacgtaacttcgaaaacgtaaacgccgtattctaaatacgacgtctactacgattacgttctctatcacgctctactcccgtcgaatctatatccgacgaccgcctcccttcgctccgaccgctcaactacgccactcctctttaaatcgcgcctatttctctctcttatatattaatttaaaaatctcttaacgcgatttatactctcgttaaacgccgataccctctctattccttaatctataatcgaaatcttctaaattcgtctcgattcgaaaattaaattacttcgtatctaaaaaatactactcctcttaat

SEQ ID NO: 17025 - DNA, 1625 bp, Artificial Sequence
  chemically treated genomic DNA (Homo sapiens) CpG-island No: 17025
gcggaagatggtcggcggcgtggacggttttatcgggatttcgtttttcgattatagtagcgatattttgagtgggttgaacgagtagcggacgtagggtttgttgtgcgacgtggtgattttggtggagggtcgcgagttttttacgtatcgttcggtgttggtcgtttgtagttagtattttaagaagttgtttacgtcgggcgtcgtggtggattagtagaacgtgtacgagatcgatttcgttagcgtcgaggcgtttatcgcgtttatggatttcgtttatacggttacgtttatcgttagtatagttaacgtgggtgatatttttagcgtcgttcgtttgttggagattttcgtcgtgagttacgtgtgcgtcgattttttggatcggtagattttggcggtcgacgcgggcgtcgacgtcgggtagttggattttgtagattaaattgattagcgtaatttttttcgcgttaaggagtatttcgagtttttttagagtaattttatgaatagtttgtttttcgcggtcgtcgtcgtcgttgttagtttttcgtggttcgtttttggggcgttcgatgatgatttggatgttattaaggaggtcgtggtcgtcgttgtggtcgtcgtggtcgcgggcgattgtaacggtttagatttttatgggtcgggtttttcggtcgagcggttttcgacgggggacggggacgagggcgatagtaattcgggtttgtggttagagcgggatgaggacgtttttatcgggggttttttttcgtcgtcggtggtttcgtcggtcgttacgtagaacggttattacggtcgcggcggagaggaggaggtcgtttcgttgtcggaggcggttttcgagtcgggcgatttttcgggttttttgtcgggagcggtcgagggcgaggacggggacgggttcgacgtggacgggttggcggttagtacgttgttgtagtagatgatgttatcggtgggtcgggcgggggtcgcggcgggggatagcgacgaggagtcgcgggtcgacgataagggcgttatggattattatttgaagtattttagcggcgtttacgacggcgacgtttattcggtttggtcgtagaaggtggagaagaagattcgagttaaggttttttagaagtgttttatttgcgagaaggttatttagggcgtcggtaagttgtcgcgatatattcgtatttatacgggcgagaagttttacgagtgtaatatttgtaaggttcgttttattaggtgagttgttcgtcgcgggggaggcgtcgttttgttttttgttttagtattcgtcgtttacgatttttttcgtttttttttttgtatcgtacgtatatatgtacgtagacgtatatatatacgtacgtgtatatagatacgtatacgtatagatatatgtacgttatttatatatttatatatacgtagatatatatatacgtatttgtatatatatacgtatatgtatatatatgtatagacgcgtatgttacgtatatatgtatatatatagacgtatatacgtatacgtatattatatatatatatagatatgttatatagatatatgtagatatagatgtatattatatata

SEQ ID NO: 17026 - DNA, 1625 bp, Artificial Sequence
  chemically treated genomic DNA (Homo sapiens) CpG-island No: 17026
tatatataatatacatctatatctacatatatctatataacatatctatatatatatataatatacgtatacgtatatacgtctatatatatacatatatacgtaacatacgcgtctatacatatatatacatatacgtatatatatacaaatacgtatatatatatctacgtatatataaatatataaataacgtacatatatctatacgtatacgtatctatatacacgtacgtatatatatacgtctacgtacatatatacgtacgatacaaaaaaaaaaacgaaaaaaatcgtaaacgacgaatactaaaacaaaaaacaaaacgacgcctcccccgcgacgaacaactcacctaataaaacgaaccttacaaatattacactcgtaaaacttctcgcccgtataaatacgaatatatcgcgacaacttaccgacgccctaaataaccttctcgcaaataaaacacttctaaaaaaccttaactcgaatcttcttctccaccttctacgaccaaaccgaataaacgtcgccgtcgtaaacgccgctaaaatacttcaaataataatccataacgcccttatcgtcgacccgcgactcctcgtcgctatcccccgccgcgacccccgcccgacccaccgataacatcatctactacaacaacgtactaaccgccaacccgtccacgtcgaacccgtccccgtcctcgccctcgaccgctcccgacaaaaaacccgaaaaatcgcccgactcgaaaaccgcctccgacaacgaaacgacctcctcctctccgccgcgaccgtaataaccgttctacgtaacgaccgacgaaaccaccgacgacgaaaaaaaacccccgataaaaacgtcctcatcccgctctaaccacaaacccgaattactatcgccctcgtccccgtcccccgtcgaaaaccgctcgaccgaaaaacccgacccataaaaatctaaaccgttacaatcgcccgcgaccacgacgaccacaacgacgaccacgacctccttaataacatccaaatcatcatcgaacgccccaaaaacgaaccacgaaaaactaacaacgacgacgacgaccgcgaaaaacaaactattcataaaattactctaaaaaaactcgaaatactccttaacgcgaaaaaaattacgctaatcaatttaatctacaaaatccaactacccgacgtcgacgcccgcgtcgaccgccaaaatctaccgatccaaaaaatcgacgcacacgtaactcacgacgaaaatctccaacaaacgaacgacgctaaaaatatcacccacgttaactatactaacgataaacgtaaccgtataaacgaaatccataaacgcgataaacgcctcgacgctaacgaaatcgatctcgtacacgttctactaatccaccacgacgcccgacgtaaacaacttcttaaaatactaactacaaacgaccaacaccgaacgatacgtaaaaaactcgcgaccctccaccaaaatcaccacgtcgcacaacaaaccctacgtccgctactcgttcaacccactcaaaatatcgctactataatcgaaaaacgaaatcccgataaaaccgtccacgccgccgaccatcttccgc

SEQ ID NO: 17027 - DNA, 1625 bp, Artificial Sequence
  chemically treated genomic DNA (Homo sapiens) CpG-island No: 17027
tgtatgtggtgtgtatttgtgtttgtatgtgtttgtgtagtatgtttgtatgtgtatgtggtgtgcgtgtgcgtgtgtgcgtttgtgtgtgtgtatgtgtacgtggtatacgcgtttgtgtatgtgtgtgtatgtgcgtatatatgtgtaagtgcgtgtatgtgtgtttgcgtgtgtgtggatgtgtaggtgacgtgtatgtgtttgtgcgtgtacgtgtttgtgtgtacgtgcgtgtatgtgtgcgtttgcgtgtatgtgtgcgtgcggtgtagggagagaggcgggaggggtcgtgagcggcggatgttggggtagagagtaggacggcgtttttttcgcggcgggtagtttatttggtgaagcggattttgtagatgttgtattcgtagggtttttcgttcgtgtgggtgcggatgtgtcgcggtagtttgtcggcgttttggatgattttttcgtagatggggtatttttggaaggttttggttcggatttttttttttattttttgcgattaggtcgggtagacgtcgtcgtcgtgggcgtcgttgaagtattttaggtagtagtttatgacgtttttgtcgtcggttcgcgatttttcgtcgttgtttttcgtcgcggttttcgttcggtttatcgatgatattatttgttgtagtagcgtgttggtcgttagttcgtttacgtcgggttcgttttcgttttcgttttcggtcgttttcgataggaagttcggagagtcgttcggttcgggggtcgttttcgatagcgaggcggttttttttttttcgtcgcggtcgtagtggtcgttttgcgtggcggtcggcggggttatcggcggcggaaagagattttcggtgggggcgtttttatttcgttttggttatagattcgggttgttgtcgttttcgttttcgtttttcgtcgggggtcgttcggtcggggggttcggtttatagaagtttaagtcgttgtagtcgttcgcggttacggcggttatagcggcggttacggtttttttggtggtatttaggttattatcggacgttttaaaggcggattacgggaagttggtagcggcggcggcggtcgcggggggtaggttgtttatggggttgttttggaagaattcgaggtattttttggcgcggaggaggttgcgttgattaatttgatttataaggtttagttgttcggcgtcggcgttcgcgtcggtcgttaggatttgtcggtttaggaggtcggcgtatacgtggtttacggcggggatttttagtaggcgggcggcgttgaggatgttatttacgttggttgtgttgacggtgagcgtggtcgtgtaggcgaagtttatgagcgcggtgagcgtttcggcgttgacgaagtcgatttcgtatacgttttgttggtttattacggcgttcgacgtgaatagttttttgaagtattggttgtaggcggttagtatcgagcggtgcgtggggaattcgcggttttttattaggattattacgtcgtatagtaggttttgcgttcgttgttcgtttagtttatttaggatgtcgttgttgtggtcggggaacgggatttcgatggggtcgtttacgtcgtcggttatttttcgt

SEQ ID NO: 17028 - DNA, 1625 bp, Artificial Sequence
  chemically treated genomic DNA (Homo sapiens) CpG-island No: 17028
acgaaaaataaccgacgacgtaaacgaccccatcgaaatcccgttccccgaccacaacaacgacatcctaaataaactaaacgaacaacgaacgcaaaacctactatacgacgtaataatcctaataaaaaaccgcgaattccccacgcaccgctcgatactaaccgcctacaaccaatacttcaaaaaactattcacgtcgaacgccgtaataaaccaacaaaacgtatacgaaatcgacttcgtcaacgccgaaacgctcaccgcgctcataaacttcgcctacacgaccacgctcaccgtcaacacaaccaacgtaaataacatcctcaacgccgcccgcctactaaaaatccccgccgtaaaccacgtatacgccgacctcctaaaccgacaaatcctaacgaccgacgcgaacgccgacgccgaacaactaaaccttataaatcaaattaatcaacgcaacctcctccgcgccaaaaaatacctcgaattcttccaaaacaaccccataaacaacctaccccccgcgaccgccgccgccgctaccaacttcccgtaatccgcctttaaaacgtccgataataacctaaataccaccaaaaaaaccgtaaccgccgctataaccgccgtaaccgcgaacgactacaacgacttaaacttctataaaccgaaccccccgaccgaacgacccccgacgaaaaacgaaaacgaaaacgacaacaacccgaatctataaccaaaacgaaataaaaacgcccccaccgaaaatctctttccgccgccgataaccccgccgaccgccacgcaaaacgaccactacgaccgcgacgaaaaaaaaaaaaccgcctcgctatcgaaaacgacccccgaaccgaacgactctccgaacttcctatcgaaaacgaccgaaaacgaaaacgaaaacgaacccgacgtaaacgaactaacgaccaacacgctactacaacaaataatatcatcgataaaccgaacgaaaaccgcgacgaaaaacaacgacgaaaaatcgcgaaccgacgacaaaaacgtcataaactactacctaaaatacttcaacgacgcccacgacgacgacgtctacccgacctaatcgcaaaaaataaaaaaaaaaatccgaaccaaaaccttccaaaaataccccatctacgaaaaaatcatccaaaacgccgacaaactaccgcgacacatccgcacccacacgaacgaaaaaccctacgaatacaacatctacaaaatccgcttcaccaaataaactacccgccgcgaaaaaaacgccgtcctactctctaccccaacatccgccgctcacgacccctcccgcctctctccctacaccgcacgcacacatacacgcaaacgcacacatacacgcacgtacacacaaacacgtacacgcacaaacacatacacgtcacctacacatccacacacacgcaaacacacatacacgcacttacacatatatacgcacatacacacacatacacaaacgcgtataccacgtacacatacacacacacaaacgcacacacgcacacgcacaccacatacacatacaaacatactacacaaacacatacaaacacaaatacacaccacataca

SEQ ID NO: 17029 - DNA, 536 bp, Artificial Sequence
  chemically treated genomic DNA (Homo sapiens) CpG-island No: 17029
atcgttttcgagatgtttagtttttattttagagcgtcgcgtcggcgtcgaatgggttaacgggcggggggatacgttttcgtgcgtttgcgcggcgttttttcgtttcgttttcgtagcgtagttatatgattcgtttaatcggcgttcgtttataaaaagttgagtgttgacgttagcgttttttttcgtcgtcgtcgtcgttattttcggcgcgattcgtttttttcggttttatttgggagaatttatcgttattcgttattatggtgagtaattttgtttcgttggtgtttcggagcggcggcggggttttcgcggggtttacgttgtttagtttgggacgttggggtttttcgtgttaggaggagacgtagcggcggcggggtcggaggattcggggttggggaagcggtcgtcgttatgtttgtgcgtcgcgttgtttatcgagtttttttttcgttttcgagggcgttataattttgtttagatttggttggagttgggttgttagcggggatgggggtggggaatga

SEQ ID NO: 17030 - DNA, 536 bp, Artificial Sequence
  chemically treated genomic DNA (Homo sapiens) CpG-island No: 17030
tcattccccacccccatccccgctaacaacccaactccaaccaaatctaaacaaaattataacgccctcgaaaacgaaaaaaaaactcgataaacaacgcgacgcacaaacataacgacgaccgcttccccaaccccgaatcctccgaccccgccgccgctacgtctcctcctaacacgaaaaaccccaacgtcccaaactaaacaacgtaaaccccgcgaaaaccccgccgccgctccgaaacaccaacgaaacaaaattactcaccataataacgaataacgataaattctcccaaataaaaccgaaaaaaacgaatcgcgccgaaaataacgacgacgacgacgaaaaaaaacgctaacgtcaacactcaactttttataaacgaacgccgattaaacgaatcatataactacgctacgaaaacgaaacgaaaaaacgccgcgcaaacgcacgaaaacgtatccccccgcccgttaacccattcgacgccgacgcgacgctctaaaataaaaactaaacatctcgaaaacgat

SEQ ID NO: 17031 - DNA, 536 bp, Artificial Sequence
  chemically treated genomic DNA (Homo sapiens) CpG-island No: 17031
ttattttttatttttattttcgttaataatttagttttaattaggtttgggtaaggttatggcgttttcggaaacggagaaagggttcggtgaatagcgcggcgtatagatatggcggcggtcgtttttttagtttcgggtttttcggtttcgtcgtcgttacgtttttttttggtacggggggttttagcgttttaggttaggtagcgtaggtttcgcggaggtttcgtcgtcgtttcggggtattagcgaggtagggttatttattatggtggcggatggcggtggatttttttaggtagaatcgaaagaagcgagtcgcgtcgaggatggcggcgacgacggcggaagagaacgttgacgttaatatttagttttttataggcggacgtcggttgggcgggttatgtgattgcgttgcgaaggcggggcgaagggacgtcgcgtaagcgtacggaggcgtgttttttcgttcgttaatttattcggcgtcggcgcggcgttttagaatagaagttgggtatttcgggggcggt

SEQ ID NO: 17032 - DNA, 536 bp, Artificial Sequence
  chemically treated genomic DNA (Homo sapiens) CpG-island No: 17032
accgcccccgaaatacccaacttctattctaaaacgccgcgccgacgccgaataaattaacgaacgaaaaaacacgcctccgtacgcttacgcgacgtcccttcgccccgccttcgcaacgcaatcacataacccgcccaaccgacgtccgcctataaaaaactaaatattaacgtcaacgttctcttccgccgtcgtcgccgccatcctcgacgcgactcgcttctttcgattctacctaaaaaaatccaccgccatccgccaccataataaataaccctacctcgctaataccccgaaacgacgacgaaacctccgcgaaacctacgctacctaacctaaaacgctaaaaccccccgtaccaaaaaaaaacgtaacgacgacgaaaccgaaaaacccgaaactaaaaaaacgaccgccgccatatctatacgccgcgctattcaccgaaccctttctccgtttccgaaaacgccataaccttacccaaacctaattaaaactaaattattaacgaaaataaaaataaaaaataa

SEQ ID NO: 17033 - DNA, 558 bp, Artificial Sequence
  chemically treated genomic DNA (Homo sapiens) CpG-island No: 17033
tgcgtcgttcggggttcggtttgttgtgacgcgtgtcgtcgttcgttttttggtatcggtagttttcgtggtgtttaggtatgtttttgttcgggcgtcgtaggatgggttgttggggtgtatcgttgtgtcgttttgcgtatggtggtggttcgtatgtgtatttttggtgttattgcgatgcgtgattatttgtattcgcgcgcgatttttttggtcgttttgtgggtacgtttattgtcgcgtcgttagtattgttgttggcgtatttcggatatgtcgtgatttttatgagaaggattgtgttcgggttttggcgatgttttggcgatggtaggagttagtagtagggttcgtcggagtttgtgtcgggttgtgcgaggtggtattcgggtatcgcgagttgttttggggtgtggaaggtgtgtgggtgtgtggatggtgtgttggcgttattgtagtttgtcgtggggtgttcggagatgttttgcgggtgtgagacgtttttttttggttgtcgtgagttgtgggtatttagtattatatagagtttaggat

SEQ ID NO: 17034 - DNA, 558 bp, Artificial Sequence
  chemically treated genomic DNA (Homo sapiens) CpG-island No: 17034
atcctaaactctatataatactaaatacccacaactcacgacaaccaaaaaaaaacgtctcacacccgcaaaacatctccgaacaccccacgacaaactacaataacgccaacacaccatccacacacccacacaccttccacaccccaaaacaactcgcgatacccgaataccacctcgcacaacccgacacaaactccgacgaaccctactactaactcctaccatcgccaaaacatcgccaaaacccgaacacaatccttctcataaaaatcacgacatatccgaaatacgccaacaacaatactaacgacgcgacaataaacgtacccacaaaacgaccaaaaaaatcgcgcgcgaatacaaataatcacgcatcgcaataacaccaaaaatacacatacgaaccaccaccatacgcaaaacgacacaacgatacaccccaacaacccatcctacgacgcccgaacaaaaacatacctaaacaccacgaaaactaccgataccaaaaaacgaacgacgacacgcgtcacaacaaaccgaaccccgaacgacgca

SEQ ID NO: 17035 - DNA, 558 bp, Artificial Sequence
  chemically treated genomic DNA (Homo sapiens) CpG-island No: 17035
attttgggttttgtgtggtgttaaatatttatagtttacgataattaagagagagcgttttatattcgtaggatattttcgagtattttacgataaattgtagtagcgttagtatattatttatatatttatatattttttatattttaagataattcgcgatattcgggtattatttcgtatagttcgatataggtttcgacgaattttattattagtttttattatcgttagagtatcgttaagattcggatataattttttttatgagggttacgatatgttcgagatgcgttaataatagtgttagcggcgcggtaatgagcgtatttatagagcgattaggagggtcgcgcgcgagtgtagatgattacgtatcgtagtaatattaaggatatatatacggattattattatacgtaaagcggtataacgatgtattttaataatttattttgcgacgttcgggtaagagtatgtttggatattacgaggattatcggtgttaaaaagcgggcgacgatacgcgttataataagtcgggtttcgagcgacgta

SEQ ID NO: 17036 - DNA, 558 bp, Artificial Sequence
  chemically treated genomic DNA (Homo sapiens) CpG-island No: 17036
tacgtcgctcgaaacccgacttattataacgcgtatcgtcgcccgctttttaacaccgataatcctcgtaatatccaaacatactcttacccgaacgtcgcaaaataaattattaaaatacatcgttataccgctttacgtataataataatccgtatatatatccttaatattactacgatacgtaatcatctacactcgcgcgcgaccctcctaatcgctctataaatacgctcattaccgcgccgctaacactattattaacgcatctcgaacatatcgtaaccctcataaaaaaaattatatccgaatcttaacgatactctaacgataataaaaactaataataaaattcgtcgaaacctatatcgaactatacgaaataatacccgaatatcgcgaattatcttaaaatataaaaaatatataaatatataaataatatactaacgctactacaatttatcgtaaaatactcgaaaatatcctacgaatataaaacgctctctcttaattatcgtaaactataaatatttaacaccacacaaaacccaaaat

SEQ ID NO: 17037 - DNA, 694 bp, Artificial Sequence
  chemically treated genomic DNA (Homo sapiens) CpG-island No: 17037
ttttcgcgttgtgtcgttttcgggttttgttggggtcgtgttgttggggggtggtttggtgtcgtcgttttttgtttcgcgttttcggtcggtgttcgtttttgtttcggttttttcgttttttttttcgtttcgtttttgggtcgtgttttttcggttttgttttttcgtgtgttttttcgttttttgggtcgtgtttttttgtttgttttttttttcggtgcgtgtttcggttttgtttttgtttgcgtttcgtttttcgttttttgttgtgtttttttttttttttttttttttttttttttttttttttttttcgttcgtttttttttttcgcgtttttgttgtttttttgttttggttttttttgtttttgttttcgtgcgggcgcgcggttttcgtttttcgttttgttcgtttttcgttcgttttgcggttttcgtcgttgttgtttcgttcgtgtttttttttttgtttttttttttttttggtttcggttttcgtttttttttttttttttttttcgttcggtttcgtttttttttttttcgttttttttttttttcgttcgcgtttttttttgcgtttttttcgttcgttcgttgtttttcggtttttttttttttttttttttgcgtttgtttttttttttttttttttttttttttcggcgtttatgttgtgggggttattg

SEQ ID NO: 17038 - DNA, 694 bp, Artificial Sequence
  chemically treated genomic DNA (Homo sapiens) CpG-island No: 17038
caataacccccacaacataaacgccgaaaaaaaaaaaaaaaaaaaaaaaaaaacaaacgcaaaaaaaaaaaaaaaaaaaaaccgaaaaacaacgaacgaacgaaaaaaacgcaaaaaaaaacgcgaacgaaaaaaaaaaaaaacgaaaaaaaaaaaaacgaaaccgaacgaaaaaaaaaaaaaaaaaaaaacgaaaaccgaaaccaaaaaaaaaaaaaaacaaaaaaaaaaacacgaacgaaacaacaacgacgaaaaccgcaaaacgaacgaaaaacgaacaaaacgaaaaacgaaaaccgcgcgcccgcacgaaaacaaaaacaaaaaaaaccaaaacaaaaaaacaacaaaaacgcgaaaaaaaaaaacgaacgaaaaaaaaaaaaaaaaaaaaaaaaaaaaaaaaaaaaaaaaaaacacaacaaaaaacgaaaaacgaaacgcaaacaaaaacaaaaccgaaacacgcaccgaaaaaaaaaacaaacaaaaaaacacgacccaaaaaacgaaaaaacacacgaaaaaacaaaaccgaaaaaacacgacccaaaaacgaaacgaaaaaaaaaacgaaaaaaccgaaacaaaaacgaacaccgaccgaaaacgcgaaacaaaaaacgacgacaccaaaccaccccccaacaacacgaccccaacaaaacccgaaaacgacacaacgcgaaaa

SEQ ID NO: 17039 - DNA, 694 bp, Artificial Sequence
  chemically treated genomic DNA (Homo sapiens) CpG-island No: 17039
tagtaatttttataatatggacgtcgaggaaaagagagaaagaaagaaaaaagtagacgtagggggaggggaggaggggggtcggggggtaacgggcgggcgagagggacgtagggaggggcgcgggcgagggaggaagggggcgagaggggggggggcggaatcgagcgagagagagagaaaggaaggagcgagggtcggggttaggaggaagagagggtaaggagagagatacgagcgagatagtagcgacgaagatcgtaagacggacgaggagcggataggacggagggcggaggtcgcgcgttcgtacgaagataagggtagggagaattaggataaaaaagtaataagggcgcggagaggaaaagcgaacggagagggaaggaagaagaggaaggagggaaaggggggggaagatataataaggggcggaaaacgaaacgtaaataagggtagaatcgaaatacgtatcgaaagaaaagataggtaaaaggatacgatttagaggacgaggaagtatacgaaaaaatagagtcggagaggtacgatttaaaggcgaagcggagaaaggaacggggggatcgaggtaaaagcggatatcgatcgaaggcgcggaataaagagcggcgatattaagttattttttaataatacgattttaataaggttcgagggcgatatagcgcgagga

SEQ ID NO: 17040 - DNA, 694 bp, Artificial Sequence
  chemically treated genomic DNA (Homo sapiens) CpG-island No: 17040
tcctcgcgctatatcgccctcgaaccttattaaaatcgtattattaaaaaataacttaatatcgccgctctttattccgcgccttcgatcgatatccgcttttacctcgatccccccgttcctttctccgcttcgcctttaaatcgtacctctccgactctattttttcgtatacttcctcgtcctctaaatcgtatccttttacctatcttttctttcgatacgtatttcgattctacccttatttacgtttcgttttccgccccttattatatcttcccccccctttccctccttcctcttcttccttccctctccgttcgcttttcctctccgcgcccttattacttttttatcctaattctccctacccttatcttcgtacgaacgcgcgacctccgccctccgtcctatccgctcctcgtccgtcttacgatcttcgtcgctactatctcgctcgtatctctctccttaccctctcttcctcctaaccccgaccctcgctccttcctttctctctctctcgctcgattccgcccccccccctctcgcccccttcctccctcgcccgcgcccctccctacgtccctctcgcccgcccgttaccccccgacccccctcctcccctccccctacgtctacttttttctttctttctctcttttcctcgacgtccatattataaaaattacta

SEQ ID NO: 17041 - DNA, 545 bp, Artificial Sequence
  chemically treated genomic DNA (Homo sapiens) CpG-island No: 17041
  misc_feature (81)..(81): n is either a, c, g or t
  misc_feature (181)..(181): n is either a, c, g or t
  misc_feature (195)..(195): n is either a, c, g or t
  misc_feature (360)..(360): n is either a, c, g or t
  misc_feature (393)..(393): n is either a, c, g or t
  misc_feature (407)..(407): n is either a, c, g or t
  misc_feature (523)..(523): n is either a, c, g or t
gttttcgtattgtttttgagaagcgatattgatgagaatgggcgataacgtgaagttatttgtgaagtttcgtcgaagagnaaggggagtatcggggtgagttatttaacgaaggagtgcgatttattagttatcgcgtcgtatgcgagttaagtgtaatcgtagatcgatcgttgttagngataggggtcgaantttgagagcgtataggcgggggtaatttgcgcgacgtagtacgggtaaggagtgtttagttggatcgtgaggtaggtaagtggtatagatgtcggtgaggtttaagtggcgtatttttttcgttcgaaggtatgtaatagcgtatgtaaaaggggtgaagtgtgncgtgcgcgtttcgtgcgtaaaatatgtatttanttacgagcgaaggnattgtttcgcgtatacgtgttgtatcgtgtatcgtcgtgacgttatgcggtgtgttttgtgttatatttggatggagtgaatgtattgggttttcgttaatattaaggcgatattntgtgattagacgtgtattagat

SEQ ID NO: 17042 - DNA, 545 bp, Artificial Sequence
  chemically treated genomic DNA (Homo sapiens) CpG-island No: 17042
  misc_feature (23)..(23): n is either a, c, g or t
  misc_feature (139)..(139): n is either a, c, g or t
  misc_feature (153)..(153): n is either a, c, g or t
  misc_feature (186)..(186): n is either a, c, g or t
  misc_feature (351)..(351): n is either a, c, g or t
  misc_feature (365)..(365): n is either a, c, g or t
  misc_feature (465)..(465): n is either a, c, g or t
atctaatacacgtctaatcacanaatatcgccttaatattaacgaaaacccaatacattcactccatccaaatataacacaaaacacaccgcataacgtcacgacgatacacgatacaacacgtatacgcgaaacaatnccttcgctcgtaantaaatacatattttacgcacgaaacgcgcacgncacacttcaccccttttacatacgctattacataccttcgaacgaaaaaaatacgccacttaaacctcaccgacatctataccacttacctacctcacgatccaactaaacactccttacccgtactacgtcgcgcaaattacccccgcctatacgctctcaaanttcgacccctatcnctaacaacgatcgatctacgattacacttaactcgcatacgacgcgataactaataaatcgcactccttcgttaaataactcaccccgatactccccttnctcttcgacgaaacttcacaaataacttcacgttatcgcccattctcatcaatatcgcttctcaaaaacaatacgaaaac

SEQ ID NO: 17043 - DNA, 545 bp, Artificial Sequence
  chemically treated genomic DNA (Homo sapiens) CpG-island No: 17043
  misc_feature (23)..(23): n is either a, c, g or t
  misc_feature (139)..(139): n is either a, c, g or t
  misc_feature (153)..(153): n is either a, c, g or t
  misc_feature (186)..(186): n is either a, c, g or t
  misc_feature (351)..(351): n is either a, c, g or t
  misc_feature (365)..(365): n is either a, c, g or t
  misc_feature (465)..(465): n is either a, c, g or t
gtttgatgtacgtttggttatangatgtcgttttagtgttggcggaagtttaatgtatttattttatttaggtatgatataggatatatcgtatgacgttacgacggtatacgatgtagtacgtgtacgcggaataatnttttcgttcgtggntaggtatatgttttacgtacggaacgcgtacgntatattttattttttttgtatgcgttgttgtatattttcgagcgagaagagtacgttatttggattttatcgatatttatgttatttgtttattttacgatttaattgaatattttttgttcgtgttacgtcgcgtaggttattttcgtttatacgtttttaggnttcgatttttattnttgataacggtcgatttacggttatatttgattcgtatacggcgcgatgattagtgggtcgtattttttcgttgggtgatttatttcggtgttttttttntttttcgacggagttttataggtagttttacgttgtcgtttatttttattagtatcgttttttaggaatagtacgagagt

SEQ ID NO: 17044 - DNA, 545 bp, Artificial Sequence
  chemically treated genomic DNA (Homo sapiens) CpG-island No: 17044
  misc_feature (81)..(81): n is either a, c, g or t
  misc_feature (181)..(181): n is either a, c, g or t
  misc_feature (195)..(195): n is either a, c, g or t
  misc_feature (360)..(360): n is either a, c, g or t
  misc_feature (393)..(393): n is either a, c, g or t
  misc_feature (407)..(407): n is either a, c, g or t
  misc_feature (523)..(523): n is either a, c, g or t
actctcgtactattcctaaaaaacgatactaataaaaataaacgacaacgtaaaactacctataaaactccgtcgaaaaanaaaaaaaacaccgaaataaatcacccaacgaaaaaatacgacccactaatcatcgcgccgtatacgaatcaaatataaccgtaaatcgaccgttatcaanaataaaaatcgaancctaaaaacgtataaacgaaaataacctacgcgacgtaacacgaacaaaaaatattcaattaaatcgtaaaataaacaaataacataaatatcgataaaatccaaataacgtactcttctcgctcgaaaatatacaacaacgcatacaaaaaaaataaaatatancgtacgcgttccgtacgtaaaacatatacctanccacgaacgaaaanattattccgcgtacacgtactacatcgtataccgtcgtaacgtcatacgatatatcctatatcatacctaaataaaataaatacattaaacttccgccaacactaaaacgacatcntataaccaaacgtacatcaaac

SEQ ID NO: 17045 - DNA, 848 bp, Artificial Sequence
  chemically treated genomic DNA (Homo sapiens) CpG-island No: 17045
ggtatacgcgtcgtggtaaggtaagcgagggcgttcggtttcggtatcgtttcgcgtcggttttcgtttttttttttttcgaaaggcggttttgtgttgttgcgtaggcgcggcggttgggggtggggtttatcgcggttttcgatttcgttatcgcgagaagtcggttcgcgattttgtggtcgttttttttttttttttgtttttcggattcgggttgcggcgttagtttttttcgggtttcggtagcggtagcggttcgttcgttttagttttagcgtttttcggttattttcggtttaggttcgtagcgtcgttcgttttcggttagtttcgacgtcgtgtttgggtcgcggtcgtagttcgggttcgcgtaggcgtcgatcgttttcggttcgttttttatgggtttcgagtatagaaggtagtcgattcgttcgtcgcgttcgacggagttttagatgcgtggttcggacgaagtcggtgttgtcggcgtttattattaatttattatcgcgaggttatttttattagcgagggcgttttcgagtgagtgggtagggttagtcggagtttggggtgtacgggtaggagttttcggggaaggacggggcgaggggacgggttcgcgagagttcgagtaggggttacgggagacgggtagtgtgtacgggtaggggttttcgaggggaggatagggtagggattttcgggagcggtaggggtttcgggagcgggtagggttttcgagacggcgaaggttacggggtaggggggggtttttgagtagtgagattgggcgaggggaggtttttgtggtggaaaagatggggtgtggggtttttgaa

SEQ ID NO: 17046 - DNA, 848 bp, Artificial Sequence
  chemically treated genomic DNA (Homo sapiens) CpG-island No: 17046
ttcaaaaaccccacaccccatcttttccaccacaaaaacctcccctcgcccaatctcactactcaaaaacccccccctaccccgtaaccttcgccgtctcgaaaaccctacccgctcccgaaacccctaccgctcccgaaaatccctaccctatcctcccctcgaaaacccctacccgtacacactacccgtctcccgtaacccctactcgaactctcgcgaacccgtcccctcgccccgtccttccccgaaaactcctacccgtacaccccaaactccgactaaccctacccactcactcgaaaacgccctcgctaataaaaataacctcgcgataataaattaataataaacgccgacaacaccgacttcgtccgaaccacgcatctaaaactccgtcgaacgcgacgaacgaatcgactaccttctatactcgaaacccataaaaaacgaaccgaaaacgatcgacgcctacgcgaacccgaactacgaccgcgacccaaacacgacgtcgaaactaaccgaaaacgaacgacgctacgaacctaaaccgaaaataaccgaaaaacgctaaaactaaaacgaacgaaccgctaccgctaccgaaacccgaaaaaaactaacgccgcaacccgaatccgaaaaacaaaaaaaaaaaaaaaacgaccacaaaatcgcgaaccgacttctcgcgataacgaaatcgaaaaccgcgataaaccccacccccaaccgccgcgcctacgcaacaacacaaaaccgcctttcgaaaaaaaaaaaaacgaaaaccgacgcgaaacgataccgaaaccgaacgccctcgcttaccttaccacgacgcgtatacc

SEQ ID NO: 17047 - DNA, 848 bp, Artificial Sequence
  chemically treated genomic DNA (Homo sapiens) CpG-island No: 17047
tttaggaattttatattttattttttttattataaggattttttttcgtttaattttattgtttaaagatttttttttgtttcgtgattttcgtcgtttcgagggttttgttcgttttcgaggtttttgtcgttttcgagggtttttgttttgtttttttttcgagaatttttgttcgtgtatattattcgtttttcgtgatttttgttcggattttcgcgaattcgttttttcgtttcgttttttttcgagggtttttgttcgtgtattttaagtttcggttgattttgtttatttattcggaggcgttttcgttggtagggatggtttcgcgatggtaggttgatggtgagcgtcggtagtatcggtttcgttcgggttacgtatttggggtttcgtcgggcgcggcgggcgggtcggttgttttttatgttcggggtttatagggggcgggtcgggagcggtcggcgtttacgcgagttcgggttgcggtcgcggtttaggtacggcgtcggggttggtcgagggcgggcggcgttgcgggtttgggtcgagggtagtcgaggggcgttggggttgaggcgagcgagtcgttatcgttgtcgaggttcgaagaaggttgacgtcgtagttcgagttcgagaggtagggggaggggaggggcggttataagatcgcggatcggtttttcgcgataacgggatcgggagtcgcgatggattttatttttagtcgtcgcgtttgcgtagtagtataaggtcgtttttcggaggggaaaggggcggagatcgacgcgaggcggtgtcgggatcgggcgttttcgtttgttttattacggcgcgtgtgtt

SEQ ID NO: 17048 - DNA, 848 bp, Artificial Sequence
  chemically treated genomic DNA (Homo sapiens) CpG-island No: 17048
aacacacgcgccgtaataaaacaaacgaaaacgcccgatcccgacaccgcctcgcgtcgatctccgcccctttcccctccgaaaaacgaccttatactactacgcaaacgcgacgactaaaaataaaatccatcgcgactcccgatcccgttatcgcgaaaaaccgatccgcgatcttataaccgcccctcccctccccctacctctcgaactcgaactacgacgtcaaccttcttcgaacctcgacaacgataacgactcgctcgcctcaaccccaacgcccctcgactaccctcgacccaaacccgcaacgccgcccgccctcgaccaaccccgacgccgtacctaaaccgcgaccgcaacccgaactcgcgtaaacgccgaccgctcccgacccgccccctataaaccccgaacataaaaaacaaccgacccgcccgccgcgcccgacgaaaccccaaatacgtaacccgaacgaaaccgatactaccgacgctcaccatcaacctaccatcgcgaaaccatccctaccaacgaaaacgcctccgaataaataaacaaaatcaaccgaaacttaaaatacacgaacaaaaaccctcgaaaaaaaacgaaacgaaaaaacgaattcgcgaaaatccgaacaaaaatcacgaaaaacgaataatatacacgaacaaaaattctcgaaaaaaaaacaaaacaaaaaccctcgaaaacgacaaaaacctcgaaaacgaacaaaaccctcgaaacgacgaaaatcacgaaacaaaaaaaaatctttaaacaataaaattaaacgaaaaaaaatccttataataaaaaaaataaaatataaaattcctaaa

SEQ ID NO: 17049 - DNA, 574 bp, Artificial Sequence
  chemically treated genomic DNA (Homo sapiens) CpG-island No: 17049
tgtcgagtttacgttttatttgtatattaggattcggatgtgtagcgcgcggggtgtttgggttcgtggagtttgtatcgcgttgcgttgtaaggcgttttattgtacgtattggcggtcgttgcggcggagtaattattttttgttcgacgtcgtcgggagtttggagacgtatttggcggtcgtcgcgcgtaggaagttacggtatttagttgtattgttgtcgttgttatcgttttttttcgttttttttttttagaggaaatcgagtattcgtttttatttgcgtagggttagtattattttaaggagttaggcgtcgtcggggtaggcgtggtcgtcgcgagcgggggggggggcgttggtgtaggacggatttgattggtcggaggttcgggcggtggtcgcgcgcgtttgcgtaggaggtagtagcgcgtatcggcggcgggaggagcgcgcgcgggtgttaattggttcgggcggcggtttcgttcgcgagtggtgagcggttacgtgacgcgacggttgggggttttcggcgcgggggacgttggtgattaagatggcggcggag

SEQ ID NO: 17050 - DNA, 574 bp, Artificial Sequence
  chemically treated genomic DNA (Homo sapiens) CpG-island No: 17050
ctccgccgccatcttaatcaccaacgtcccccgcgccgaaaacccccaaccgtcgcgtcacgtaaccgctcaccactcgcgaacgaaaccgccgcccgaaccaattaacacccgcgcgcgctcctcccgccgccgatacgcgctactacctcctacgcaaacgcgcgcgaccaccgcccgaacctccgaccaatcaaatccgtcctacaccaacgcccccccccccgctcgcgacgaccacgcctaccccgacgacgcctaactccttaaaataatactaaccctacgcaaataaaaacgaatactcgatttcctctaaaaaaaaaaaacgaaaaaaaacgataacaacgacaacaatacaactaaataccgtaacttcctacgcgcgacgaccgccaaatacgtctccaaactcccgacgacgtcgaacaaaaaataattactccgccgcaacgaccgccaatacgtacaataaaacgccttacaacgcaacgcgatacaaactccacgaacccaaacaccccgcgcgctacacatccgaatcctaatatacaaataaaacgtaaactcgaca

SEQ ID NO: 17051 - DNA, 574 bp, Artificial Sequence
  chemically treated genomic DNA (Homo sapiens) CpG-island No: 17051
tttcgtcgttattttggttattagcgtttttcgcgtcgggagtttttagtcgtcgcgttacgtgatcgtttattattcgcgggcggggtcgtcgttcgggttaattagtattcgcgcgcgtttttttcgtcgtcggtgcgcgttgttgttttttgcgtaggcgcgcgcggttatcgttcgggttttcggttaattaggttcgttttatattagcgttttttttttcgttcgcggcgattacgtttatttcggcggcgtttgattttttaaagtggtattagttttgcgtaggtggggacgggtgttcggttttttttagggagggaaggcgagagggggcggtggtagcgataataatgtagttaggtgtcgtggttttttgcgcgcggcggtcgttaggtgcgtttttagattttcggcggcgtcgggtaggggatggttgtttcgtcgtaacggtcgttagtgcgtatagtgaggcgttttgtagcgtagcgcggtgtaggttttacgggtttagatatttcgcgcgttgtatattcgggttttggtgtgtagatggggcgtgggttcggta

SEQ ID NO: 17052 - DNA, 574 bp, Artificial Sequence
  chemically treated genomic DNA (Homo sapiens) CpG-island No: 17052
taccgaacccacgccccatctacacaccaaaacccgaatatacaacgcgcgaaatatctaaacccgtaaaacctacaccgcgctacgctacaaaacgcctcactatacgcactaacgaccgttacgacgaaacaaccatcccctacccgacgccgccgaaaatctaaaaacgcacctaacgaccgccgcgcgcaaaaaaccacgacacctaactacattattatcgctaccaccgccccctctcgccttccctccctaaaaaaaaccgaacacccgtccccacctacgcaaaactaataccactttaaaaaatcaaacgccgccgaaataaacgtaatcgccgcgaacgaaaaaaaaaacgctaatataaaacgaacctaattaaccgaaaacccgaacgataaccgcgcgcgcctacgcaaaaaacaacaacgcgcaccgacgacgaaaaaaacgcgcgcgaatactaattaacccgaacgacgaccccgcccgcgaataataaacgatcacgtaacgcgacgactaaaaactcccgacgcgaaaaacgctaataaccaaaataacgacgaaa

SEQ ID NO: 17053 - DNA, 548 bp, Artificial Sequence
  chemically treated genomic DNA (Homo sapiens) CpG-island No: 17053
gtaatgtggttcgcgtaggttcggagtttattaatttgttatttagtgtacgtattaggtatttgttgtatatgttattcgttgggttatttgtagcggtttagcgcgagatagttatagtgtcgtacgtgtagggtttatattcgttgggagttagtttcgagagtgtgtaattatttgtgttatcgcgtatgtttgtaatttcgttgatggttcgttgggtggtgataatatgttgtatgtcgtgtatttgagttaattagtcgagttacgtagagtatatagtaggcgtgatgttattttagtggtagtttacggttcgtaagtgttttatttttgagcggtgatattaacgttttgttagatatagttatgttcgtaaggtataagtgtggttgttttttgtcgtaagttttcggtcgttcgtagagatagtggaatcgtttcgcgagcgttagttgtaatttttttgtattgattatttaagtattttaatattttttagagcgttatatttatttgcggtagatatttgcggtattgttata

SEQ ID NO: 17054 - DNA, 548 bp, Artificial Sequence
  chemically treated genomic DNA (Homo sapiens) CpG-island No: 17054
tataacaataccgcaaatatctaccgcaaataaatataacgctctaaaaaatattaaaatacttaaataatcaatacaaaaaaattacaactaacgctcgcgaaacgattccactatctctacgaacgaccgaaaacttacgacaaaaaacaaccacacttataccttacgaacataactatatctaacaaaacgttaatatcaccgctcaaaaataaaacacttacgaaccgtaaactaccactaaaataacatcacgcctactatatactctacgtaactcgactaattaactcaaatacacgacatacaacatattatcaccacccaacgaaccatcaacgaaattacaaacatacgcgataacacaaataattacacactctcgaaactaactcccaacgaatataaaccctacacgtacgacactataactatctcgcgctaaaccgctacaaataacccaacgaataacatatacaacaaatacctaatacgtacactaaataacaaattaataaactccgaacctacgcgaaccacattac

SEQ ID NO: 17055 - DNA, 548 bp, Artificial Sequence
  chemically treated genomic DNA (Homo sapiens) CpG-island No: 17055
tgtaatagtgtcgtaaatgtttatcgtaagtgagtgtggcgttttaggaagtgttggagtgtttgggtagttaatgtagaggggttatagttgacgttcgcgaggcgattttattgtttttacgagcggtcggagatttacgataggagatagttatatttgtgttttacggatatgattatatttgatagaacgttagtgttatcgtttaagaatgaagtatttgcgagtcgtggattgttattggggtgatattacgtttgttgtatgttttgcgtgattcgattggttagtttaaatgtacgatatgtagtatattgttattatttagcggattattaacggagttataggtatacgcgatgatataggtgattgtatattttcggggttagtttttaacggatgtggattttgtacgtacgatattgtaattgtttcgcgttaggtcgttgtaggtagtttagcgagtaatatatgtagtaaatatttgatacgtgtattaaatggtaagttgatgaatttcggatttacgcgaattatattgt

SEQ ID NO: 17056 - DNA, 548 bp, Artificial Sequence
  chemically treated genomic DNA (Homo sapiens) CpG-island No: 17056
acaatataattcgcgtaaatccgaaattcatcaacttaccatttaatacacgtatcaaatatttactacatatattactcgctaaactacctacaacgacctaacgcgaaacaattacaatatcgtacgtacaaaatccacatccgttaaaaactaaccccgaaaatatacaatcacctatatcatcgcgtatacctataactccgttaataatccgctaaataataacaatatactacatatcgtacatttaaactaaccaatcgaatcacgcaaaacatacaacaaacgtaatatcaccccaataacaatccacgactcgcaaatacttcattcttaaacgataacactaacgttctatcaaatataatcatatccgtaaaacacaaatataactatctcctatcgtaaatctccgaccgctcgtaaaaacaataaaatcgcctcgcgaacgtcaactataacccctctacattaactacccaaacactccaacacttcctaaaacgccacactcacttacgataaacatttacgacactattaca

SEQ ID NO: 17057 - DNA, 618 bp, Artificial Sequence
  chemically treated genomic DNA (Homo sapiens) CpG-island No: 17057
  misc_feature (604)..(604): n is either a, c, g or t
ggatttaacggttattcgttatcgttaattgtacgttacgcgatgatttgtattgtattgtttattttggtgcgttcgcgtattgatatggttgggtgagggaagtttgtttatataatgtttaagggtttgtcgcgtcggtttattgtacgtttggcgattatttgtattttattgtttaattttcgtgcgttggtgtattatatatggggtgggtgggtgggtgggggaagcgttttttataatgtaagcggtttgtcgcgttcgtttattgtacgtttggagatgatttgtattttattgttttattcgacgtgcgcgtcgcgtatattatatggaggggcggagggagtttaaatatcgattgtttcgtatgacgttataggatttgtatgtaaagttcgattttggattattcgattatgtgtagcgttaaggttgtaatgtgcgttcggtttatttgtcggtagacgatcggtgcgtttgagtattagtggcggggtagtcggggtgattgtttatcgttgtatttaattattttagttattaggatttagtgtagtagattacgttttgacgttttcgtttacgtcgtgtcgttatngttgattaatttgt

SEQ ID NO: 17058 - DNA, 618 bp, Artificial Sequence
  chemically treated genomic DNA (Homo sapiens) CpG-island No: 17058
  misc_feature (15)..(15): n is either a, c, g or t
acaaattaatcaacnataacgacacgacgtaaacgaaaacgtcaaaacgtaatctactacactaaatcctaataactaaaataattaaatacaacgataaacaatcaccccgactaccccgccactaatactcaaacgcaccgatcgtctaccgacaaataaaccgaacgcacattacaaccttaacgctacacataatcgaataatccaaaatcgaactttacatacaaatcctataacgtcatacgaaacaatcgatatttaaactccctccgcccctccatataatatacgcgacgcgcacgtcgaataaaacaataaaatacaaatcatctccaaacgtacaataaacgaacgcgacaaaccgcttacattataaaaaacgcttcccccacccacccacccaccccatatataatacaccaacgcacgaaaattaaacaataaaatacaaataatcgccaaacgtacaataaaccgacgcgacaaacccttaaacattatataaacaaacttccctcacccaaccatatcaatacgcgaacgcaccaaaataaacaatacaatacaaatcatcgcgtaacgtacaattaacgataacgaataaccgttaaatcc

SEQ ID NO: 17059 - DNA, 618 bp, Artificial Sequence
  chemically treated genomic DNA (Homo sapiens) CpG-island No: 17059
  misc_feature (15)..(15): n is either a, c, g or t
gtaagttgattaatnatgacgatacgacgtgggcgaggacgttaggacgtggtttattatattaaattttggtaattagggtagttaggtatagcggtgagtaattatttcgattgtttcgttattgatatttaaacgtatcgatcgtttatcgataggtaagtcgaacgtatattgtagttttggcgttatatatagtcgggtggtttaaggtcgggttttatatgtaaattttgtaacgttatacggggtagtcggtatttgaatttttttcgtttttttatatagtatacgcgacgcgtacgtcgagtaaggtaataaagtataagttatttttaagcgtgtagtaggcggacgcggtaaatcgtttatattgtaaggaacgttttttttatttatttatttattttatatgtgatatattagcgtacgagggttaggtaataaagtataagtgatcgttaagcgtgtagtaggtcggcgcggtaaatttttgagtattgtgtgagtaagttttttttatttagttatattaatacgcgagcgtattagggtaagtaatatagtataagttatcgcgtagcgtgtagttagcggtggcgggtaatcgttaaattt

SEQ ID NO: 17060 - DNA, 618 bp, Artificial Sequence
  chemically treated genomic DNA (Homo sapiens) CpG-island No: 17060
  misc_feature (604)..(604): n is either a, c, g or t
aaatttaacgattacccgccaccgctaactacacgctacgcgataacttatactatattacttaccctaatacgctcgcgtattaatataactaaataaaaaaaacttactcacacaatactcaaaaatttaccgcgccgacctactacacgcttaacgatcacttatactttattacctaaccctcgtacgctaatatatcacatataaaataaataaataaataaaaaaaacgttccttacaatataaacgatttaccgcgtccgcctactacacgcttaaaaataacttatactttattaccttactcgacgtacgcgtcgcgtatactatataaaaaaacgaaaaaaattcaaataccgactaccccgtataacgttacaaaatttacatataaaacccgaccttaaaccacccgactatatataacgccaaaactacaatatacgttcgacttacctatcgataaacgatcgatacgtttaaatatcaataacgaaacaatcgaaataattactcaccgctatacctaactaccctaattaccaaaatttaatataataaaccacgtcctaacgtcctcgcccacgtcgtatcgtcatnattaatcaacttac

SEQ ID NO: 17061 - DNA, 612 bp, Artificial Sequence
  chemically treated genomic DNA (Homo sapiens) CpG-island No: 17061
ggaaatagcgtttttttcggtatattatttttcgttattatcgttgttggtacggcgaggagagtcgattttaatacgatcgatacgttgtaaatcgcgtattaacgtatcgcggcgtttacgttcgttagtgattttttgtaattttttcgggcgtagtttaattttgcgttttttaatatgaatggttagcgtgttttgcggcggtagaacgtataattgcgttagattattttttttacgcgcggtttttgtcgatggaatgttgataattttgttgtttttgtttttcgatagttgcggtagattatttatcgggaatattaatatacggtttgtttgagtgattgttagtagtatatcggaagtatttttaattattatcggcggtataatatgggtatttttcggtaaggtgattaaagttttatttgtacggttacgcgttattagatcgttaaaggtgtagacgaaatcgtaattcgtatcggaagttattagtagtttttgatcgtcgttttttattagtatatggttacggtcgttttaggcggtacgttatttgtcggtgagcggttcgtttgatacgcgtcgacgtagcgtaatcggtta

SEQ ID NO: 17062 - DNA, 612 bp, Artificial Sequence
  chemically treated genomic DNA (Homo sapiens) CpG-island No: 17062
taaccgattacgctacgtcgacgcgtatcaaacgaaccgctcaccgacaaataacgtaccgcctaaaacgaccgtaaccatatactaataaaaaacgacgatcaaaaactactaataacttccgatacgaattacgatttcgtctacacctttaacgatctaataacgcgtaaccgtacaaataaaactttaatcaccttaccgaaaaatacccatattataccgccgataataattaaaaatacttccgatatactactaacaatcactcaaacaaaccgtatattaatattcccgataaataatctaccgcaactatcgaaaaacaaaaacaacaaaattatcaacattccatcgacaaaaaccgcgcgtaaaaaaaataatctaacgcaattatacgttctaccgccgcaaaacacgctaaccattcatattaaaaaacgcaaaattaaactacgcccgaaaaaattacaaaaaatcactaacgaacgtaaacgccgcgatacgttaatacgcgatttacaacgtatcgatcgtattaaaatcgactctcctcgccgtaccaacaacgataataacgaaaaataatataccgaaaaaaacgctatttcc

SEQ ID NO: 17063 - DNA, 612 bp, Artificial Sequence
  chemically treated genomic DNA (Homo sapiens) CpG-island No: 17063
tgatcgattacgttgcgtcggcgcgtgttaggcgagtcgtttatcggtaaataacgtgtcgtttggggcgatcgtgattatatgttgatggaaagcgacgattagaaattgttgatggttttcgatgcgggttacggtttcgtttgtatttttaacgatttggtggcgcgtaatcgtgtaggtaaggttttgattattttatcggaaaatgtttatgttatgtcgtcggtggtgattgaagatgttttcgatatgttgttggtaattatttaggtaggtcgtatgttgatgttttcggtaagtgatttgtcgtagttgtcgaagggtaaaggtaataagattattaatattttatcggtagaagtcgcgcgtggagaagatggtttggcgtaattgtacgttttgtcgtcgtaaagtacgttgattatttatgttgggaaacgtaaaattaaattgcgttcggaagagttatagaaagttattggcgaacgtggacgtcgcggtacgttgatgcgcggtttgtagcgtatcgatcgtgttgagatcgatttttttcgtcgtgttagtagcggtgatagcgaagagtaatatgtcggggagggcgttgttttt

SEQ ID NO: 17064 - DNA, 612 bp, Artificial Sequence
  chemically treated genomic DNA (Homo sapiens) CpG-island No: 17064
aaaaacaacgccctccccgacatattactcttcgctatcaccgctactaacacgacgaaaaaaatcgatctcaacacgatcgatacgctacaaaccgcgcatcaacgtaccgcgacgtccacgttcgccaataactttctataactcttccgaacgcaatttaattttacgtttcccaacataaataatcaacgtactttacgacgacaaaacgtacaattacgccaaaccatcttctccacgcgcgacttctaccgataaaatattaataatcttattacctttacccttcgacaactacgacaaatcacttaccgaaaacatcaacatacgacctacctaaataattaccaacaacatatcgaaaacatcttcaatcaccaccgacgacataacataaacattttccgataaaataatcaaaaccttacctacacgattacgcgccaccaaatcgttaaaaatacaaacgaaaccgtaacccgcatcgaaaaccatcaacaatttctaatcgtcgctttccatcaacatataatcacgatcgccccaaacgacacgttatttaccgataaacgactcgcctaacacgcgccgacgcaacgtaatcgatca

SEQ ID NO: 17065 - DNA, 650 bp, Artificial Sequence
  chemically treated genomic DNA (Homo sapiens) CpG-island No: 17065
attatttgttcgtttcgtggcgagtattttcgttttgcgtcggagtataattagattgttaattatttgatttattttattttcgattcggtaatgtcgtttttgggcgtttattttattcgtatgatcgacggtagcgtgatcgtcgggttaaacgcggtgttggtttttaaacgcgaaggttatcgtaagcgcgattttttatttagcgatacgttggagattttgggttcgtcggggattcgtcgggtgttgtaaaattatttacgtttaggattgggcgagatgaaaaattcgttgtgtaaaagcggttatttgcggttggtgtaaaagtattgttttcggttttcgttaagcgatttttagttttggttcgtcggtgtgcgggcgtaggcggtatcgtcggacggtaagttgattgacgattttttgtttgttattatttcgcgtacgatttatatttgtaatgcgtttttttcggtagcgatattagtaatttttattggtgcgtatattgttagtaaggtataaacgttgttggtaagttagagtaatttcggacgtacgttgcgagcggtacgtagtgtggatgttttatacgtcgtatttaattaataatttttgaaaataggatgtagcgatgaaattta

SEQ ID NO: 17066 - DNA, 650 bp, Artificial Sequence
  chemically treated genomic DNA (Homo sapiens) CpG-island No: 17066
taaatttcatcgctacatcctattttcaaaaattattaattaaatacgacgtataaaacatccacactacgtaccgctcgcaacgtacgtccgaaattactctaacttaccaacaacgtttataccttactaacaatatacgcaccaataaaaattactaatatcgctaccgaaaaaaacgcattacaaatataaatcgtacgcgaaataataacaaacaaaaaatcgtcaatcaacttaccgtccgacgataccgcctacgcccgcacaccgacgaaccaaaactaaaaatcgcttaacgaaaaccgaaaacaatacttttacaccaaccgcaaataaccgcttttacacaacgaatttttcatctcgcccaatcctaaacgtaaataattttacaacacccgacgaatccccgacgaacccaaaatctccaacgtatcgctaaataaaaaatcgcgcttacgataaccttcgcgtttaaaaaccaacaccgcgtttaacccgacgatcacgctaccgtcgatcatacgaataaaataaacgcccaaaaacgacattaccgaatcgaaaataaaataaatcaaataattaacaatctaattatactccgacgcaaaacgaaaatactcgccacgaaacgaacaaataat

SEQ ID NO: 17067 - DNA, 650 bp, Artificial Sequence
  chemically treated genomic DNA (Homo sapiens) CpG-island No: 17067
taagttttatcgttatattttgtttttaaaggttattgattaaatgcggcgtgtaaggtatttatattacgtgtcgttcgtagcgtgcgttcggggttattttggtttgttaatagcgtttgtattttgttgataatatgcgtattaataggaattgttgatgtcgttgtcggggagggcgtattgtaggtgtggatcgtgcgcggggtggtgataaatagaaaatcgttaattagtttgtcgttcggcgatatcgtttgcgttcgtatatcggcgggttagggttggagatcgtttaacgaaagtcggggataatatttttgtattagtcgtagatagtcgtttttgtatagcgagttttttatttcgtttagttttgagcgtagatggttttgtagtattcggcgaattttcgacgagtttaaaatttttagcgtgtcgttaaatgagaagtcgcgtttgcgatagttttcgcgtttgaaagttagtatcgcgtttggttcgacggttacgttgtcgtcgattatgcgggtgagatgaacgtttaaaaacggtattgtcgggtcgggaatggggtaaattaggtggttaataatttggttatgtttcggcgtaaggcggaaatattcgttacggaacgggtagatgat

SEQ ID NO: 17068 - DNA, 650 bp, Artificial Sequence
  chemically treated genomic DNA (Homo sapiens) CpG-island No: 17068
atcatctacccgttccgtaacgaatatttccgccttacgccgaaacataaccaaattattaaccacctaatttaccccattcccgacccgacaataccgtttttaaacgttcatctcacccgcataatcgacgacaacgtaaccgtcgaaccaaacgcgatactaactttcaaacgcgaaaactatcgcaaacgcgacttctcatttaacgacacgctaaaaattttaaactcgtcgaaaattcgccgaatactacaaaaccatctacgctcaaaactaaacgaaataaaaaactcgctatacaaaaacgactatctacgactaatacaaaaatattatccccgactttcgttaaacgatctccaaccctaacccgccgatatacgaacgcaaacgatatcgccgaacgacaaactaattaacgattttctatttatcaccaccccgcgcacgatccacacctacaatacgccctccccgacaacgacatcaacaattcctattaatacgcatattatcaacaaaatacaaacgctattaacaaaccaaaataaccccgaacgcacgctacgaacgacacgtaatataaataccttacacgccgcatttaatcaataacctttaaaaacaaaatataacgataaaactta

SEQ ID NO: 17069 - DNA, 1008 bp, Artificial Sequence
  chemically treated genomic DNA (Homo sapiens) CpG-island No: 17069
acgcggcggggcgtagggcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacggacgtttaatcgcgttgggttattatatcgggtattgggagatcggtatgtagatgtaggcggcggcgaaggagattattcgtaatggcgggatttcgttcgcggttttcgttagcgattcgtgcgacgggcgttcgtagggtacgtacggtatgttcgattttttgtcgtatcgtaacgacgcggcgatcgtgtttcgtcgtttgattcgttttttgtcgacgcggcgggcggtgatcggcgtagcgatttgcgataaagggttgttcgttattatgattgcgttggtcgcgatgtacgatttgtcgattattttggtgtcgggcggggcgacgttgtcgtcgatcgtcggggaagacgcgggtaaggtgtagattatcggcgcgcgtttcgttaattacgaattttttttgtaggaggtcgtcgaattgggttgtcgcgtttgcgtttcgtcgggcggcgggtgttagtttttcggtacggcgggtatttcgtaggtggtcgcgtattgacgaagtaattgatgcgtatatcgttttgcgtcgcgaagaagatgatcgcgtgcgtatgatttcgtattcggtagagtttgagttgtattatagcgtttaagtgttttagttgtcgtggaaatttttcgtttgtttttggtaggtttgggatcggtggtaagtatattacgtcggatgcgacgtaaatgcgttttattcggtttatacggtgatgatgtggtaggtcggagtaggtgagtcgttttttaacgtgaagtttgttagttatttgtagtttatttttgtatgggttttttttttcgttaattttttgatgtttcgcg

SEQ ID NO: 17070 - DNA, 1008 bp, Artificial Sequence
  chemically treated genomic DNA (Homo sapiens) CpG-island No: 17070
cgcgaaacatcaaaaaattaacgaaaaaaaaaacccatacaaaaataaactacaaataactaacaaacttcacgttaaaaaacgactcacctactccgacctaccacatcatcaccgtataaaccgaataaaacgcatttacgtcgcatccgacgtaatatacttaccaccgatcccaaacctaccaaaaacaaacgaaaaatttccacgacaactaaaacacttaaacgctataatacaactcaaactctaccgaatacgaaatcatacgcacgcgatcatcttcttcgcgacgcaaaacgatatacgcatcaattacttcgtcaatacgcgaccacctacgaaatacccgccgtaccgaaaaactaacacccgccgcccgacgaaacgcaaacgcgacaacccaattcgacgacctcctacaaaaaaaattcgtaattaacgaaacgcgcgccgataatctacaccttacccgcgtcttccccgacgatcgacgacaacgtcgccccgcccgacaccaaaataatcgacaaatcgtacatcgcgaccaacgcaatcataataacgaacaaccctttatcgcaaatcgctacgccgatcaccgcccgccgcgtcgacaaaaaacgaatcaaacgacgaaacacgatcgccgcgtcgttacgatacgacaaaaaatcgaacataccgtacgtaccctacgaacgcccgtcgcacgaatcgctaacgaaaaccgcgaacgaaatcccgccattacgaataatctccttcgccgccgcctacatctacataccgatctcccaatacccgatataataacccaacgcgattaaacgtccgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgccctacgccccgccgcgt

SEQ ID NO: 17071 - DNA, 1008 bp, Artificial Sequence
  chemically treated genomic DNA (Homo sapiens) CpG-island No: 17071
cgcgaagtattagagaattgacggagaaaaaagtttatgtagagatgggttatagatagttgataaattttacgttggagagcgatttatttgtttcggtttattatattattatcgtgtaggtcggataagacgtatttgcgtcgtattcggcgtgatgtgtttgttatcgattttaggtttgttagagataggcgaaaagtttttacggtaattaaaatatttagacgttgtagtatagtttaaattttatcggatgcggagttatacgtacgcggttatttttttcgcgacgtagagcgatgtacgtattaattgtttcgttagtgcgcgattatttgcgaggtgttcgtcgtgtcgaggaattgatattcgtcgttcggcgaggcgtaggcgcgatagtttagttcggcggttttttgtagggagagttcgtggttggcgaaacgcgcgtcgatggtttgtattttgttcgcgtttttttcgacggtcggcggtagcgtcgtttcgttcggtattagaatagtcggtaggtcgtgtatcgcggttagcgtaattatggtggcgggtagttttttatcgtaggtcgttacgtcgattatcgttcgtcgcgtcggtagggagcggattaggcggcgaaatacgatcgtcgcgtcgttgcggtacggtagggaatcgaatatatcgtgcgtgttttgcgagcgttcgtcgtacggatcgttgacgaaggtcgcgaacgggatttcgttattgcgggtgatttttttcgtcgtcgtttgtatttgtatgtcgattttttaatgttcggtgtggtagtttagcgcgattgggcgttcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgttttgcgtttcgtcgcgt

SEQ ID NO: 17072 - DNA, 1008 bp, Artificial Sequence
  chemically treated genomic DNA (Homo sapiens) CpG-island No: 17072
acgcgacgaaacgcaaaacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgaacgcccaatcgcgctaaactaccacaccgaacattaaaaaatcgacatacaaatacaaacgacgacgaaaaaaatcacccgcaataacgaaatcccgttcgcgaccttcgtcaacgatccgtacgacgaacgctcgcaaaacacgcacgatatattcgattccctaccgtaccgcaacgacgcgacgatcgtatttcgccgcctaatccgctccctaccgacgcgacgaacgataatcgacgtaacgacctacgataaaaaactacccgccaccataattacgctaaccgcgatacacgacctaccgactattctaataccgaacgaaacgacgctaccgccgaccgtcgaaaaaaacgcgaacaaaatacaaaccatcgacgcgcgtttcgccaaccacgaactctccctacaaaaaaccgccgaactaaactatcgcgcctacgcctcgccgaacgacgaatatcaattcctcgacacgacgaacacctcgcaaataatcgcgcactaacgaaacaattaatacgtacatcgctctacgtcgcgaaaaaaataaccgcgtacgtataactccgcatccgataaaatttaaactatactacaacgtctaaatattttaattaccgtaaaaacttttcgcctatctctaacaaacctaaaatcgataacaaacacatcacgccgaatacgacgcaaatacgtcttatccgacctacacgataataatataataaaccgaaacaaataaatcgctctccaacgtaaaatttatcaactatctataacccatctctacataaacttttttctccgtcaattctctaatacttcgcg

SEQ ID NO: 17073 - DNA, 770 bp, Artificial Sequence
  chemically treated genomic DNA (Homo sapiens) CpG-island No: 17073
ggcgttcgtatattttttttgtgacggtttagcgttatgtcggaggttgattttgtggagatgggtttatggataatcgcgcgggtaagttcggacggtttcggcgtttcgtagttggtgtcgtgttagtggcgattggtatggattaaattcgcgggggtacgggcgggggtttttaaagggtcgtttttttttttttttttacggttttttaggacgcgggattgttttcgtgggggtgtttttatgttagtatcgatacgcggtttaacggggtgttgattagcgattagttttttaggttacgggagtggtagatgcgtacgttcgggaattattcgaaggtcgaggtggcgatgtagtagttttcgttttggcggtataggacgggttcgggtttgaagtcggtgagtatcgggttagtgatttttatatgttttcggttaatgggatgcggttgtcgcggcgtcgggaacggtttcgttttgcgtcgcgcggtgtttaattagttgtcggttgatggtttttacgcgggtatcggtgagtttgtagagcgatagtatgatgaatatgttcgcgtagagtattatcggtattacgtagaatagaattttgatggtggtgagtattttaatcggttgtacgttgttgttggcggaatagttgacgtacgttaggatttagtttattatcgtttcgttaatcgttaggttaatttttaggttgaataggtaggtgtttagttatagaaataagatacgttgaaatgt

SEQ ID NO: 17074 - DNA, 770 bp, Artificial Sequence
  chemically treated genomic DNA (Homo sapiens) CpG-island No: 17074
acatttcaacgtatcttatttctataactaaacacctacctattcaacctaaaaattaacctaacgattaacgaaacgataataaactaaatcctaacgtacgtcaactattccgccaacaacaacgtacaaccgattaaaatactcaccaccatcaaaattctattctacgtaataccgataatactctacgcgaacatattcatcatactatcgctctacaaactcaccgatacccgcgtaaaaaccatcaaccgacaactaattaaacaccgcgcgacgcaaaacgaaaccgttcccgacgccgcgacaaccgcatcccattaaccgaaaacatataaaaatcactaacccgatactcaccgacttcaaacccgaacccgtcctataccgccaaaacgaaaactactacatcgccacctcgaccttcgaataattcccgaacgtacgcatctaccactcccgtaacctaaaaaactaatcgctaatcaacaccccgttaaaccgcgtatcgatactaacataaaaacacccccacgaaaacaatcccgcgtcctaaaaaaccgtaaaaaaaaaaaaaaaaacgaccctttaaaaacccccgcccgtacccccgcgaatttaatccataccaatcgccactaacacgacaccaactacgaaacgccgaaaccgtccgaacttacccgcgcgattatccataaacccatctccacaaaatcaacctccgacataacgctaaaccgtcacaaaaaaaatatacgaacgcc

SEQ ID NO: 17075 - DNA, 770 bp, Artificial Sequence
  chemically treated genomic DNA (Homo sapiens) CpG-island No: 17075
atattttagcgtgttttatttttatgattaagtatttatttgtttagtttgaagattggtttggcgattggcggggcggtggtgggttggattttggcgtacgttaattatttcgttagtagtagcgtgtagtcggttgaggtgtttattattattaaaattttgttttgcgtggtgtcggtggtgttttacgcgggtatgtttattatgttgtcgttttataagtttatcgatgttcgcgtggaggttattagtcggtagttgattaagtatcgcgcggcgtagggcgaggtcgttttcgacgtcgcgatagtcgtattttattaatcggaggtatatggaaattattaattcgatatttatcggttttaaattcggattcgttttgtgtcgttagggcgaggattattatatcgttatttcgattttcgagtggttttcgggcgtgcgtatttattattttcgtgatttgaaaaattggtcgttggttagtatttcgttggatcgcgtgtcgatgttgatatgaaggtatttttacgagaatagtttcgcgttttggaaaatcgtgggaaaagaagaggggacgattttttgaaaattttcgttcgtattttcgcggatttaatttatgttagtcgttattaatacggtattaattgcggggcgtcggaatcgttcggatttattcgcgcggttatttatggatttatttttataggattagttttcggtataacgttgggtcgttatagaaaggatatgcgagcgtt

SEQ ID NO: 17076 - DNA, 770 bp, Artificial Sequence
  chemically treated genomic DNA (Homo sapiens) CpG-island No: 17076
aacgctcgcatatcctttctataacgacccaacgttataccgaaaactaatcctataaaaataaatccataaataaccgcgcgaataaatccgaacgattccgacgccccgcaattaataccgtattaataacgactaacataaattaaatccgcgaaaatacgaacgaaaattttcaaaaaatcgtcccctcttcttttcccacgattttccaaaacgcgaaactattctcgtaaaaataccttcatatcaacatcgacacgcgatccaacgaaatactaaccaacgaccaatttttcaaatcacgaaaataataaatacgcacgcccgaaaaccactcgaaaatcgaaataacgatataataatcctcgccctaacgacacaaaacgaatccgaatttaaaaccgataaatatcgaattaataatttccatatacctccgattaataaaatacgactatcgcgacgtcgaaaacgacctcgccctacgccgcgcgatacttaatcaactaccgactaataacctccacgcgaacatcgataaacttataaaacgacaacataataaacatacccgcgtaaaacaccaccgacaccacgcaaaacaaaattttaataataataaacacctcaaccgactacacgctactactaacgaaataattaacgtacgccaaaatccaacccaccaccgccccgccaatcgccaaaccaatcttcaaactaaacaaataaatacttaatcataaaaataaaacacgctaaaatat

SEQ ID NO: 17077 - DNA, 556 bp, Artificial Sequence
  chemically treated genomic DNA (Homo sapiens) CpG-island No: 17077
tatatacgaattattatatttaagtatttaattagttagtttcgcgcgtagtttggtcgttttttttaatatagtagtttaaggttattggagagtttacgatcgtatatagtttttttcggtatttgttttcgtggcgtaggcgcgtagtggagggggtcgcggggttttttgggagatgtagtttaacgatgacggtcgtggcgtaaagcgttttggggttcgtggttcgcggggtttatggggaacgcggtgtcgttggtttagatttcgtagagtttagagttttgtatgttttagttttcgtttcgttttttttcgcggaggattttgggaggtgacgtcgcgggtttcggtcgcggggttcgtttgtagagttcgcggcgtcgggaggtgagtggggtcgggtttcgggcgggagcgggaagttaagggcgggtttcgggtggttcggtcgcgttagggatgggaattcggtaggagtcgttggggaggtcgtgtgtgttttattgtattattaattatgtgataggttgcgggtgtgatagaatgtgat

SEQ ID NO: 17078 - DNA, 556 bp, Artificial Sequence
  chemically treated genomic DNA (Homo sapiens) CpG-island No: 17078
atcacattctatcacacccgcaacctatcacataattaataatacaataaaacacacacgacctccccaacgactcctaccgaattcccatccctaacgcgaccgaaccacccgaaacccgcccttaacttcccgctcccgcccgaaacccgaccccactcacctcccgacgccgcgaactctacaaacgaaccccgcgaccgaaacccgcgacgtcacctcccaaaatcctccgcgaaaaaaaacgaaacgaaaactaaaacatacaaaactctaaactctacgaaatctaaaccaacgacaccgcgttccccataaaccccgcgaaccacgaaccccaaaacgctttacgccacgaccgtcatcgttaaactacatctcccaaaaaaccccgcgaccccctccactacgcgcctacgccacgaaaacaaataccgaaaaaaactatatacgatcgtaaactctccaataaccttaaactactatattaaaaaaaacgaccaaactacgcgcgaaactaactaattaaatacttaaatataataattcgtatata

SEQ ID NO: 17079 - DNA, 556 bp, Artificial Sequence
  chemically treated genomic DNA (Homo sapiens) CpG-island No: 17079
attatattttgttatattcgtagtttgttatatagttggtaatatagtgaaatatatacggtttttttagcgatttttgtcgggtttttatttttggcgcggtcgggttattcggagttcgtttttgatttttcgttttcgttcggggttcggttttatttatttttcggcgtcgcgggttttgtaaacgggtttcgcgatcgagattcgcgacgttattttttagaatttttcgcgaggaggagcgaggcgaggattgaggtatgtaggattttgagttttgcgagatttgaattagcgatatcgcgttttttatggatttcgcgaattacgagttttagaacgttttgcgttacggtcgttatcgttgaattatattttttagagaatttcgcggttttttttattgcgcgtttgcgttacgggggtaggtatcggagagggttgtgtgcggtcgtaggttttttagtgattttgagttgttgtgttggggaaagcggttaggttgcgcgcggggttgattggttgaatgtttgggtgtggtggttcgtgtgtg

SEQ ID NO: 17080 - DNA, 556 bp, Artificial Sequence
  chemically treated genomic DNA (Homo sapiens) CpG-island No: 17080
cacacacgaaccaccacacccaaacattcaaccaatcaaccccgcgcgcaacctaaccgctttccccaacacaacaactcaaaatcactaaaaaacctacgaccgcacacaaccctctccgatacctacccccgtaacgcaaacgcgcaataaaaaaaaccgcgaaattctctaaaaaatataattcaacgataacgaccgtaacgcaaaacgttctaaaactcgtaattcgcgaaatccataaaaaacgcgatatcgctaattcaaatctcgcaaaactcaaaatcctacatacctcaatcctcgcctcgctcctcctcgcgaaaaattctaaaaaataacgtcgcgaatctcgatcgcgaaacccgtttacaaaacccgcgacgccgaaaaataaataaaaccgaaccccgaacgaaaacgaaaaatcaaaaacgaactccgaataacccgaccgcgccaaaaataaaaacccgacaaaaatcgctaaaaaaaccgtatatatttcactatattaccaactatataacaaactacgaatataacaaaatataat

SEQ ID NO: 17081 - DNA, 565 bp, Artificial Sequence
  chemically treated genomic DNA (Homo sapiens) CpG-island No: 17081
attttatcgtgacgtgttagtatcgagtcgagacgagtaagatagtttaaacgacgttagacggcgatacggaaatattagatatcgattaaggatagcggaataggaagaaggaggtttttgattatgttgggtggggacggggtttggttgttcgtgacgtgtttggtcggtggtgggggggtggcgttgcgcgggcgttgtggtttttgcggggtggggtggtttgggtgagtgtgtcgtggggtgtgtgggtgtacgtgtggtggtgtggggggtcgtgtgtagttggtgtgtagttgtggggggtgtttggggtttcgggggggggtggttgttcggtggttaaggcggcgtgtcgttgggggtggggttcggggtgttgaagtttgttagggggtaagggtgggttcgaggtttcgggtgtttgagggtgggattggtcgtggtgggatgtttcgttttagcggtcgggagtgttagcggtgtgtgcgtgggtgtgttgtgtttgtgtgatgtgtgttgagttgggtttatgggaggaggagtatggaatggtaggatt

SEQ ID NO: 17082 - DNA, 565 bp, Artificial Sequence
  chemically treated genomic DNA (Homo sapiens) CpG-island No: 17082
aatcctaccattccatactcctcctcccataaacccaactcaacacacatcacacaaacacaacacacccacgcacacaccgctaacactcccgaccgctaaaacgaaacatcccaccacgaccaatcccaccctcaaacacccgaaacctcgaacccacccttaccccctaacaaacttcaacaccccgaaccccacccccaacgacacgccgccttaaccaccgaacaaccacccccccccgaaaccccaaacaccccccacaactacacaccaactacacacgaccccccacaccaccacacgtacacccacacaccccacgacacactcacccaaaccaccccaccccgcaaaaaccacaacgcccgcgcaacgccacccccccaccaccgaccaaacacgtcacgaacaaccaaaccccgtccccacccaacataatcaaaaacctccttcttcctattccgctatccttaatcgatatctaatatttccgtatcgccgtctaacgtcgtttaaactatcttactcgtctcgactcgatactaacacgtcacgataaaat

SEQ ID NO: 17083 - DNA, 565 bp, Artificial Sequence
  chemically treated genomic DNA (Homo sapiens) CpG-island No: 17083
agttttgttattttatatttttttttttatgggtttaatttagtatatattatataaatataatatatttacgtatatatcgttagtattttcggtcgttggagcgggatattttattacgattaattttatttttaggtattcgggatttcggatttatttttattttttaataaattttaatatttcggattttatttttaacgatacgtcgttttggttatcggataattattttttttcgaagttttaggtattttttataattatatattaattatatacggttttttatattattatacgtgtatttatatattttacgatatatttatttagattattttatttcgtaaagattataacgttcgcgtaacgttatttttttattatcgattaggtacgttacgaataattagatttcgtttttatttaatatgattaaaggtttttttttttttgtttcgttgtttttggtcggtatttgatgttttcgtgtcgtcgtttgacgtcgtttgagttgttttgttcgtttcggttcggtgttggtacgttacggtgggat

SEQ ID NO: 17084 - DNA, 565 bp, Artificial Sequence
  chemically treated genomic DNA (Homo sapiens) CpG-island No: 17084
atcccaccgtaacgtaccaacaccgaaccgaaacgaacaaaacaactcaaacgacgtcaaacgacgacacgaaaacatcaaataccgaccaaaaacaacgaaacaaaaaaaaaaaaacctttaatcatattaaataaaaacgaaatctaattattcgtaacgtacctaatcgataataaaaaaataacgttacgcgaacgttataatctttacgaaataaaataatctaaataaatatatcgtaaaatatataaatacacgtataataatataaaaaaccgtatataattaatatataattataaaaaatacctaaaacttcgaaaaaaaataattatccgataaccaaaacgacgtatcgttaaaaataaaatccgaaatattaaaatttattaaaaaataaaaataaatccgaaatcccgaatacctaaaaataaaattaatcgtaataaaatatcccgctccaacgaccgaaaatactaacgatatatacgtaaatatattatatttatataatatatactaaattaaacccataaaaaaaaaaatataaaataacaaaact

SEQ ID NO: 17085 - DNA, 584 bp, Artificial Sequence
  chemically treated genomic DNA (Homo sapiens) CpG-island No: 17085
gaggcgacgcggacgtagttatcggaattcgggacgcgaagagtcgcgttacgggaatcgttatttttcggagtttcgttttttcgtcgataggcggttattggattaatgtttgggcgtaaagggttttttaggggttaattagcgtttaggtttcggtagggggcggggcgtagcgttggtcggtcgggggcgtagttgggcgggattggggagcgtttcgtttcgtcgcgggattggggtggcgcgttatttttgcggagaaggatttgatagtgtttcggagtcggggcgagtagttaaaaggttcgcggagtcgcgttgggtcgtttcggcgtagttgaatcgggggtcgcgtttgttaggtcgacgggtttggtttagtttggcgttaaggggttcgtgcgttgtggagacgcggagggtcgaggcggcgcggtttgaggtgaggaggggtcgggtgttgggtcgcgtagttggagttagagtgtcggtggtttcggacgggttatttggtattcgaggagattttttttttttttgagagtagcgttcggaatttgttagtttagtttggaaatttt

SEQ ID NO: 17086 - DNA, 584 bp, Artificial Sequence
  chemically treated genomic DNA (Homo sapiens) CpG-island No: 17086
aaaatttccaaactaaactaacaaattccgaacgctactctcaaaaaaaaaaaaaatctcctcgaataccaaataacccgtccgaaaccaccgacactctaactccaactacgcgacccaacacccgacccctcctcacctcaaaccgcgccgcctcgaccctccgcgtctccacaacgcacgaaccccttaacgccaaactaaaccaaacccgtcgacctaacaaacgcgacccccgattcaactacgccgaaacgacccaacgcgactccgcgaaccttttaactactcgccccgactccgaaacactatcaaatccttctccgcaaaaataacgcgccaccccaatcccgcgacgaaacgaaacgctccccaatcccgcccaactacgcccccgaccgaccaacgctacgccccgccccctaccgaaacctaaacgctaattaacccctaaaaaaccctttacgcccaaacattaatccaataaccgcctatcgacgaaaaaacgaaactccgaaaaataacgattcccgtaacgcgactcttcgcgtcccgaattccgataactacgtccgcgtcgcctc

SEQ ID NO: 17087 - DNA, 584 bp, Artificial Sequence
  chemically treated genomic DNA (Homo sapiens) CpG-island No: 17087
gggatttttaggttgggttgataagtttcgggcgttgtttttagggggaagggaggttttttcgagtgttagatagttcgttcgaaattatcgatattttaattttagttacgcgatttagtattcggtttttttttattttaggtcgcgtcgtttcgatttttcgcgtttttatagcgtacgaattttttggcgttaggttgggttagattcgtcggtttggtaggcgcggttttcggtttagttgcgtcggggcggtttagcgcgatttcgcgggttttttggttgttcgtttcggtttcggaatattgttagattttttttcgtagaggtagcgcgttattttagtttcgcggcggggcggggcgttttttaatttcgtttagttgcgttttcggtcggttaacgttgcgtttcgttttttatcgggatttaggcgttgattggtttttgagagattttttgcgtttaggtattggtttagtggtcgtttgtcgacgagggggcgggatttcgaggggtagcgattttcgtaacgcggtttttcgcgtttcggatttcggtggttgcgttcgcgtcgtttt

SEQ ID NO: 17088 - DNA, 584 bp, Artificial Sequence
  chemically treated genomic DNA (Homo sapiens) CpG-island No: 17088
aaaacgacgcgaacgcaaccaccgaaatccgaaacgcgaaaaaccgcgttacgaaaatcgctacccctcgaaatcccgccccctcgtcgacaaacgaccactaaaccaatacctaaacgcaaaaaatctctcaaaaaccaatcaacgcctaaatcccgataaaaaacgaaacgcaacgttaaccgaccgaaaacgcaactaaacgaaattaaaaaacgccccgccccgccgcgaaactaaaataacgcgctacctctacgaaaaaaaatctaacaatattccgaaaccgaaacgaacaaccaaaaaacccgcgaaatcgcgctaaaccgccccgacgcaactaaaccgaaaaccgcgcctaccaaaccgacgaatctaacccaacctaacgccaaaaaattcgtacgctataaaaacgcgaaaaatcgaaacgacgcgacctaaaataaaaaaaaaccgaatactaaatcgcgtaactaaaattaaaatatcgataatttcgaacgaactatctaacactcgaaaaaacctcccttccccctaaaaacaacgcccgaaacttatcaacccaacctaaaaatccc

SEQ ID NO: 17089 - DNA, 537 bp, Artificial Sequence
  chemically treated genomic DNA (Homo sapiens) CpG-island No: 17089
ttgcggcgcgcgtgttttagcgagcggttattagggagcgcggcggagagggcgtttgggtacgagtttaagtgtcgggggcgcgcggcgttggcgttggcgtaggttggtcgcgtagtcgcggtttttatttggtagttgttgaggtcgtggttgtggcgtttttcgatgtcgttgagttgtcgttttagggattttttggtgtcgcgtatcgattttagttcgatgtttttggattgtagttggcgtcggtattcggcgattttttttttggcggagcggatggtttttttgttttgttcggtcgtttcggtgagtttggcgtagcggtatttgaattatttttcggtttggtgtatattttggtttgagtggttttcgagttgggagcggattttttttagcgtcgtcgagatgtttgtttttaggtagtttttgcgttttatcgtgatgtgcgatgtttggatttgggttagaaggtcggttatttttttttcgtggttgtttcgtaggaaggttattttattttgtagcgat

SEQ ID NO: 17090 - DNA, 537 bp, Artificial Sequence
  chemically treated genomic DNA (Homo sapiens) CpG-island No: 17090
atcgctacaaaataaaataaccttcctacgaaacaaccacgaaaaaaaaataaccgaccttctaacccaaatccaaacatcgcacatcacgataaaacgcaaaaactacctaaaaacaaacatctcgacgacgctaaaaaaaatccgctcccaactcgaaaaccactcaaaccaaaatatacaccaaaccgaaaaataattcaaataccgctacgccaaactcaccgaaacgaccgaacaaaacaaaaaaaccatccgctccgccaaaaaaaaaatcgccgaataccgacgccaactacaatccaaaaacatcgaactaaaatcgatacgcgacaccaaaaaatccctaaaacgacaactcaacgacatcgaaaaacgccacaaccacgacctcaacaactaccaaataaaaaccgcgactacgcgaccaacctacgccaacgccaacgccgcgcgcccccgacacttaaactcgtacccaaacgccctctccgccgcgctccctaataaccgctcgctaaaacacgcgcgccgcaa

SEQ ID NO: 17091 - DNA, 537 bp, Artificial Sequence
  chemically treated genomic DNA (Homo sapiens) CpG-island No: 17091
gtcgttgtaggatgaggtggtttttttgcggagtaattacgaggaggaggtggtcgattttttggtttagatttaggtatcgtatattacggtggagcgtaaagattatttgaagatagatatttcgacggcgttgaaggaaattcgtttttagttcgaaagttatttagattagaatatgtattaggtcgaagagtggtttaaatgtcgttacgttaagtttatcgaggcggtcgagtagaataaggaggttattcgtttcgttaaggaagagatcgtcgagtatcggcgttagttgtagtttaagagtatcgagttagagtcggtgcgcggtattaaggagtttttggagcggtagtttagcgatatcgaggagcgttataattacgattttagtagttattaggtaggaatcgcggttgcgcggttagtttgcgttagcgttagcgtcgcgcgttttcgatatttgggttcgtgtttaggcgtttttttcgtcgcgttttttggtggtcgttcgttagagtacgcgcgtcgtag

SEQ ID NO: 17092 - DNA, 537 bp, Artificial Sequence
  chemically treated genomic DNA (Homo sapiens) CpG-island No: 17092
ctacgacgcgcgtactctaacgaacgaccaccaaaaaacgcgacgaaaaaaacgcctaaacacgaacccaaatatcgaaaacgcgcgacgctaacgctaacgcaaactaaccgcgcaaccgcgattcctacctaataactactaaaatcgtaattataacgctcctcgatatcgctaaactaccgctccaaaaactccttaataccgcgcaccgactctaactcgatactcttaaactacaactaacgccgatactcgacgatctcttccttaacgaaacgaataacctccttattctactcgaccgcctcgataaacttaacgtaacgacatttaaaccactcttcgacctaatacatattctaatctaaataactttcgaactaaaaacgaatttccttcaacgccgtcgaaatatctatcttcaaataatctttacgctccaccgtaatatacgatacctaaatctaaaccaaaaaatcgaccacctcctcctcgtaattactccgcaaaaaaaccacctcatcctacaacgac

SEQ ID NO: 17093 - DNA, 540 bp, Artificial Sequence
  chemically treated genomic DNA (Homo sapiens) CpG-island No: 17093
tttttcgttggagcgggatagtttgtagtcgtcgtcgggttcggagtcgtcgttgagtagggacgaggattggttgaagttaaggttgttttcggcggagttgagtatggtcgagttgtaagcgaggcgcggggcgagtatgttgcgtttataggaggaggatacggtgttgggcgagtcgcgggattacgattgcgagcggaagttattggacggggagtcgttgacgcggttgaagttcgagcgggtttcggttattcgtcggtaggcggacgggttgtttagcgagtttaacgtgtagtttattttggaggttttggggcgtgtggttgttatagcgttttgtcggtttcgtcgtagtttatttatagtcgcggcgttggtttcgggttagggtttcgtttcgtggaggcggcggtcgaggaggcggggattgcgggtatcggtcggggaggaggggaggggggcggttgaacggtgatttagcgttcgttttacgtgggtttaggtcgtatgggaatttggatttttttgttttgg

SEQ ID NO: 17094 - DNA, 540 bp, Artificial Sequence
  chemically treated genomic DNA (Homo sapiens) CpG-island No: 17094
ccaaaacaaaaaaatccaaattcccatacgacctaaacccacgtaaaacgaacgctaaatcaccgttcaaccgcccccctcccctcctccccgaccgatacccgcaatccccgcctcctcgaccgccgcctccacgaaacgaaaccctaacccgaaaccaacgccgcgactataaataaactacgacgaaaccgacaaaacgctataacaaccacacgccccaaaacctccaaaataaactacacgttaaactcgctaaacaacccgtccgcctaccgacgaataaccgaaacccgctcgaacttcaaccgcgtcaacgactccccgtccaataacttccgctcgcaatcgtaatcccgcgactcgcccaacaccgtatcctcctcctataaacgcaacatactcgccccgcgcctcgcttacaactcgaccatactcaactccgccgaaaacaaccttaacttcaaccaatcctcgtccctactcaacgacgactccgaacccgacgacgactacaaactatcccgctccaacgaaaaa

SEQ ID NO: 17095 - DNA, 540 bp, Artificial Sequence
  chemically treated genomic DNA (Homo sapiens) CpG-island No: 17095
ttagggtagaaaagtttaggtttttatgcggtttgggtttacgtggagcgggcgttgaattatcgtttagtcgttttttttttttttttttcgatcggtgttcgtagttttcgttttttcggtcgtcgtttttacggggcggggttttggttcgggattagcgtcgcggttataaatgggttgcggcgaggtcggtagaacgttgtgatagttatacgttttaaggtttttaagatgagttatacgttggattcgttgggtaattcgttcgtttatcggcgggtaatcgagattcgttcgagttttagtcgcgttagcggtttttcgtttagtggttttcgttcgtagtcgtggtttcgcggttcgtttagtatcgtgttttttttttataagcgtagtatgttcgtttcgcgtttcgtttatagttcggttatgtttagtttcgtcgagagtagttttgattttagttagttttcgtttttgtttaacggcggtttcggattcggcggcgattataagttgtttcgttttaacgagaag

SEQ ID NO: 17096 - DNA, 540 bp, Artificial Sequence
  chemically treated genomic DNA (Homo sapiens) CpG-island No: 17096
cttctcgttaaaacgaaacaacttataatcgccgccgaatccgaaaccgccgttaaacaaaaacgaaaactaactaaaatcaaaactactctcgacgaaactaaacataaccgaactataaacgaaacgcgaaacgaacatactacgcttataaaaaaaaaacacgatactaaacgaaccgcgaaaccacgactacgaacgaaaaccactaaacgaaaaaccgctaacgcgactaaaactcgaacgaatctcgattacccgccgataaacgaacgaattacccaacgaatccaacgtataactcatcttaaaaaccttaaaacgtataactatcacaacgttctaccgacctcgccgcaacccatttataaccgcgacgctaatcccgaaccaaaaccccgccccgtaaaaacgacgaccgaaaaaacgaaaactacgaacaccgatcgaaaaaaaaaaaaaaaaaacgactaaacgataattcaacgcccgctccacgtaaacccaaaccgcataaaaacctaaacttttctaccctaa

SEQ ID NO: 17097 - DNA, 729 bp, Artificial Sequence
  chemically treated genomic DNA (Homo sapiens) CpG-island No: 17097
attgtttttgtggtagtagttcggttattttttgatcgtggttaagttagtttacgtgttgtatcgttaaggtcggatgtaaattgagagaacgttgttagtttacgatattgtgttagagcggtacggatattatcggatagtttttttatgattttggtttgtgttgtattattaatacgggatacggaaatattcgggttaatcgtaggacgaatatcggcgttgaataggttggtttttaggaagatttgattatcggtaatggagattacgttggtcggaacgaacgtagaaacgttattcgtttgagtttcgataatcggtagtgcggttagagaatcggtttttttttttattttatttttggtgaaggttttaacgtattcggcgttaatacgtgtagtacgttttagtagacgagagtggaggtagaaaacgtcgttcgggaatgttttacgttttggcggacgacggagtagtagggagatttgacggtaagtaatagtttgtttagataggttatcgtaaatgattagcgtatttttatcgcggttacggaagtattcgtttattgcgtaatcggtatacggtgttaggtattgtagtgtagcggatttagacgcggttgttattataacgatggtgttagttagtgcgtcgtgtttttttagtttacgtattacgttagaaatggtggacgttttttggtcgatagcgatatagata

SEQ ID NO: 17098 - DNA, 729 bp, Artificial Sequence
  chemically treated genomic DNA (Homo sapiens) CpG-island No: 17098
tatctatatcgctatcgaccaaaaaacgtccaccatttctaacgtaatacgtaaactaaaaaaacacgacgcactaactaacaccatcgttataataacaaccgcgtctaaatccgctacactacaatacctaacaccgtataccgattacgcaataaacgaatacttccgtaaccgcgataaaaatacgctaatcatttacgataacctatctaaacaaactattacttaccgtcaaatctccctactactccgtcgtccgccaaaacgtaaaacattcccgaacgacgttttctacctccactctcgtctactaaaacgtactacacgtattaacgccgaatacgttaaaaccttcaccaaaaataaaataaaaaaaaaaaccgattctctaaccgcactaccgattatcgaaactcaaacgaataacgtttctacgttcgttccgaccaacgtaatctccattaccgataatcaaatcttcctaaaaaccaacctattcaacgccgatattcgtcctacgattaacccgaatatttccgtatcccgtattaataatacaacacaaaccaaaatcataaaaaaactatccgataatatccgtaccgctctaacacaatatcgtaaactaacaacgttctctcaatttacatccgaccttaacgatacaacacgtaaactaacttaaccacgatcaaaaaataaccgaactactaccacaaaaacaat

SEQ ID NO: 17099 - DNA, 729 bp, Artificial Sequence
  chemically treated genomic DNA (Homo sapiens) CpG-island No: 17099
tatttatgtcgttatcggttagaaagcgtttattatttttaacgtggtacgtaaattggaagagtacggcgtattggttaatattatcgttgtggtagtaatcgcgtttgaattcgttgtattgtaatatttggtatcgtatgtcggttgcgtaatgggcgaatattttcgtgatcgcggtgaagatgcgttgattatttacgatgatttgtttaaataggttgttgtttatcgttagatttttttgttgtttcgtcgttcgttaggacgtgaagtattttcgggcgacgttttttatttttattttcgtttgttggagcgtgttgtacgtgttaacgtcgaatacgttgaagtttttattaaaggtgaagtgaaagggaaaatcggttttttgatcgtattgtcgattatcgaaatttaggcgggtgacgtttttgcgttcgtttcgattaacgtaatttttattatcgatggttagatttttttggaaattaatttgtttaacgtcggtattcgttttgcggttaattcgggtattttcgtatttcgtgttggtggtgtagtatagattaagattatgaaaaaattgttcggtggtattcgtatcgttttggtatagtatcgtgaattggtagcgtttttttagtttgtattcgattttgacgatgtaatacgtaagttagtttgattacggttagaaagtgatcgaattgttgttatagaaatagt

SEQ ID NO: 17100 - DNA, 729 bp, Artificial Sequence
  chemically treated genomic DNA (Homo sapiens) CpG-island No: 17100
actatttctataacaacaattcgatcactttctaaccgtaatcaaactaacttacgtattacatcgtcaaaatcgaatacaaactaaaaaaacgctaccaattcacgatactataccaaaacgatacgaataccaccgaacaattttttcataatcttaatctatactacaccaccaacacgaaatacgaaaatacccgaattaaccgcaaaacgaataccgacgttaaacaaattaatttccaaaaaaatctaaccatcgataataaaaattacgttaatcgaaacgaacgcaaaaacgtcacccgcctaaatttcgataatcgacaatacgatcaaaaaaccgattttccctttcacttcacctttaataaaaacttcaacgtattcgacgttaacacgtacaacacgctccaacaaacgaaaataaaaataaaaaacgtcgcccgaaaatacttcacgtcctaacgaacgacgaaacaacaaaaaaatctaacgataaacaacaacctatttaaacaaatcatcgtaaataatcaacgcatcttcaccgcgatcacgaaaatattcgcccattacgcaaccgacatacgataccaaatattacaatacaacgaattcaaacgcgattactaccacaacgataatattaaccaatacgccgtactcttccaatttacgtaccacgttaaaaataataaacgctttctaaccgataacgacataaata

SEQ ID NO: 17101 - DNA, 709 bp, Artificial Sequence
  chemically treated genomic DNA (Homo sapiens) CpG-island No: 17101
agtttaacgcgttcggggtttttaggggttttcggttttttcggttcgagtgttcgcgtcgttgtttattcgcggtaaatttggatacgtaaattttgcgttttttggggacgttcgatgttagggttttcgttttttatgggggaagagtatttcggcgttacgttggaataagagtaatcgcgtatcgattgtttggttagattcgttgtcggaacgttagtgggaatacgtatcgtcgaatgtttggtatttgttatcgattatcgttaagtttatggtagaaacggaggttttcggttggttatttgcggcgttggatgaatgtcgtttgatgtaaatgcgttcgttaggaattcgttgcgtcggaagatgtttggcgtgatattattaatgtttggtaattacgtatacgttaattggtttgtttgtaattgttagtcgattggcgattgcgtaaggcgcgagagcgcgatttggcggtgaattttgtcgtgcgtgaagagtatttgtggtcggtagcgcgttatatgtcgggaagtttaggcgaattggatagtttgggtttattcggtagcgaaattcgtttttacggtaaaacgttgttagcgttggtggaaaaagcgtagatattgtcggaagatgttttatcgtagtcgatgtttaatttgatggatatgtcgggttatcgtaaagcgtttaaagcgat

SEQ ID NO: 17102 - DNA, 709 bp, Artificial Sequence
  chemically treated genomic DNA (Homo sapiens) CpG-island No: 17102
atcgctttaaacgctttacgataacccgacatatccatcaaattaaacatcgactacgataaaacatcttccgacaatatctacgctttttccaccaacgctaacaacgttttaccgtaaaaacgaatttcgctaccgaataaacccaaactatccaattcgcctaaacttcccgacatataacgcgctaccgaccacaaatactcttcacgcacgacaaaattcaccgccaaatcgcgctctcgcgccttacgcaatcgccaatcgactaacaattacaaacaaaccaattaacgtatacgtaattaccaaacattaataatatcacgccaaacatcttccgacgcaacgaattcctaacgaacgcatttacatcaaacgacattcatccaacgccgcaaataaccaaccgaaaacctccgtttctaccataaacttaacgataatcgataacaaataccaaacattcgacgatacgtattcccactaacgttccgacaacgaatctaaccaaacaatcgatacgcgattactcttattccaacgtaacgccgaaatactcttcccccataaaaaacgaaaaccctaacatcgaacgtccccaaaaaacgcaaaatttacgtatccaaatttaccgcgaataaacaacgacgcgaacactcgaaccgaaaaaaccgaaaacccctaaaaaccccgaacgcgttaaact

SEQ ID NO: 17103 - DNA, 709 bp, Artificial Sequence
  chemically treated genomic DNA (Homo sapiens) CpG-island No: 17103
atcgttttaaacgttttacgataattcggtatgtttattaggttaagtatcggttgcggtaaggtatttttcggtaatgtttgcgttttttttattagcgttagtagcgttttatcgtgaaagcggatttcgttatcggataaatttaggttgtttagttcgtttaaatttttcggtatataacgcgttatcgattataaatgttttttacgtacgataaagtttatcgttagatcgcgttttcgcgttttgcgtagtcgttagtcggttaatagttgtagataggttagttggcgtgtgcgtaattgttaggtattggtgatattacgttaggtatttttcggcgtaacgaatttttgacgagcgtatttgtattaggcggtatttatttagcgtcgtaggtagttagtcggaggttttcgtttttattataagtttggcggtgatcggtaatagatattagatattcggcgatgcgtatttttattgacgtttcggtagcgggtttggttaggtagtcggtgcgcgattatttttgttttagcgtaacgtcggaatattttttttttatggaaagcgaaagttttgatatcgggcgtttttaaagggcgtaggatttgcgtgtttaagtttgtcgcgggtaaatagcggcgcggatattcgagtcgggaaaatcgggggtttttaagaatttcgggcgcgttaagtt

SEQ ID NO: 17104 - DNA, 709 bp, Artificial Sequence
  chemically treated genomic DNA (Homo sapiens) CpG-island No: 17104
aacttaacgcgcccgaaattcttaaaaacccccgattttcccgactcgaatatccgcgccgctatttacccgcgacaaacttaaacacgcaaatcctacgccctttaaaaacgcccgatatcaaaactttcgctttccataaaaaaaaaatattccgacgttacgctaaaacaaaaataatcgcgcaccgactacctaaccaaacccgctaccgaaacgtcaataaaaatacgcatcgccgaatatctaatatctattaccgatcaccgccaaacttataataaaaacgaaaacctccgactaactacctacgacgctaaataaataccgcctaatacaaatacgctcgtcaaaaattcgttacgccgaaaaatacctaacgtaatatcaccaatacctaacaattacgcacacgccaactaacctatctacaactattaaccgactaacgactacgcaaaacgcgaaaacgcgatctaacgataaactttatcgtacgtaaaaaacatttataatcgataacgcgttatataccgaaaaatttaaacgaactaaacaacctaaatttatccgataacgaaatccgctttcacgataaaacgctactaacgctaataaaaaaaacgcaaacattaccgaaaaataccttaccgcaaccgatacttaacctaataaacataccgaattatcgtaaaacgtttaaaacgat

SEQ ID NO: 17105 - DNA, 757 bp, Artificial Sequence
  chemically treated genomic DNA (Homo sapiens) CpG-island No: 17105
ttgcgtttcgtttcgcgggtgttcgatttaagtcgagttcgagttcgagtttaggtaggagttttatagatagttttttttttttttattttttgtaggcgttttacgcgtgcgattttttcggttaagattcgcgggaggaggtcgtttttttttcggcgtataggcggggtttcgggcgcgtttcgcgtttttttcgcgcgtcggggcggaggagcgggcgtcgcgtatttatcgtttaggtcgggagggcgggttcggtttttcggaagaagggagtgggaaggcggttaaaggggttgaaggggcgggtcgggtcggtttgggaggggacgcggagggggcgggtcgggttgcgttcgttttagtcgcggttttatagtagcgggcggcgggattcgggatttagtttggcgacggcgatttcgacgcgggtttttaggatttttcggcgttttatttttggagtagtttttgtcgttagcgttaggtttatttcggaattttagggattttcggcgtcgaacggattcgggtcgggtgtaacggggttttcggattggagaagacgcgggtggtatcgtgcgagttttaggagtttcgggtttattgcgaggtttcggggggcgtagatttgtagagattgcggttaacgggaaggtgagttcgcggggttagtaggcggcgttgtgggggtcggggatagtatgtttggggatagaggaattaaggtttgtaagagtagtggggtttttta

SEQ ID NO: 17106 - DNA, 757 bp, Artificial Sequence
  chemically treated genomic DNA (Homo sapiens) CpG-island No: 17106
taaaaaaccccactactcttacaaaccttaattcctctatccccaaacatactatccccgacccccacaacgccgcctactaaccccgcgaactcaccttcccgttaaccgcaatctctacaaatctacgccccccgaaacctcgcaataaacccgaaactcctaaaactcgcacgataccacccgcgtcttctccaatccgaaaaccccgttacacccgacccgaatccgttcgacgccgaaaatccctaaaattccgaaataaacctaacgctaacgacaaaaactactccaaaaataaaacgccgaaaaatcctaaaaacccgcgtcgaaatcgccgtcgccaaactaaatcccgaatcccgccgcccgctactataaaaccgcgactaaaacgaacgcaacccgacccgccccctccgcgtcccctcccaaaccgacccgacccgccccttcaacccctttaaccgccttcccactcccttcttccgaaaaaccgaacccgccctcccgacctaaacgataaatacgcgacgcccgctcctccgccccgacgcgcgaaaaaaacgcgaaacgcgcccgaaaccccgcctatacgccgaaaaaaaaacgacctcctcccgcgaatcttaaccgaaaaaatcgcacgcgtaaaacgcctacaaaaaataaaaaaaaaaaaaactatctataaaactcctacctaaactcgaactcgaactcgacttaaatcgaacacccgcgaaacgaaacgcaa

SEQ ID NO: 17107 - DNA, 757 bp, Artificial Sequence
  chemically treated genomic DNA (Homo sapiens) CpG-island No: 17107
tggggagttttattatttttgtaaattttaatttttttgtttttaagtatattgttttcgatttttataacgtcgtttgttaatttcgcgggtttattttttcgttggtcgtagtttttgtaggtttgcgtttttcgaggtttcgtagtggattcggggtttttggagttcgtacggtgttattcgcgttttttttagttcggggatttcgttgtattcggttcgggttcgttcggcgtcgagagtttttgggatttcggggtggatttgacgttggcggtaggggttgttttagaggtggggcgtcgggagattttgggggttcgcgtcgagatcgtcgtcgttaagttgggtttcgggtttcgtcgttcgttgttgtagagtcgcggttggagcgaacgtagttcggttcgtttttttcgcgtttttttttaagtcggttcggttcgtttttttagtttttttggtcgtttttttatttttttttttcggggagtcgagttcgttttttcggtttaggcggtgagtgcgcggcgttcgttttttcgtttcggcgcgcgggggagacgcggggcgcgttcggggtttcgtttgtgcgtcgggaagggggcggttttttttcgcgggttttggtcgggaggatcgtacgcgtggggcgtttgtaggaagtgggaagggaagaggttgtttgtaaagtttttgtttgggttcgggttcgggttcggtttgggtcggatattcgcggagcgaagcgtaa

SEQ ID NO: 17108 - DNA, 757 bp, Artificial Sequence
  chemically treated genomic DNA (Homo sapiens) CpG-island No: 17108
ttacgcttcgctccgcgaatatccgacccaaaccgaacccgaacccgaacccaaacaaaaactttacaaacaacctcttcccttcccacttcctacaaacgccccacgcgtacgatcctcccgaccaaaacccgcgaaaaaaaaccgcccccttcccgacgcacaaacgaaaccccgaacgcgccccgcgtctcccccgcgcgccgaaacgaaaaaacgaacgccgcgcactcaccgcctaaaccgaaaaaacgaactcgactccccgaaaaaaaaaaataaaaaaacgaccaaaaaaactaaaaaaacgaaccgaaccgacttaaaaaaaaacgcgaaaaaaacgaaccgaactacgttcgctccaaccgcgactctacaacaacgaacgacgaaacccgaaacccaacttaacgacgacgatctcgacgcgaacccccaaaatctcccgacgccccacctctaaaacaacccctaccgccaacgtcaaatccaccccgaaatcccaaaaactctcgacgccgaacgaacccgaaccgaatacaacgaaatccccgaactaaaaaaaacgcgaataacaccgtacgaactccaaaaaccccgaatccactacgaaacctcgaaaaacgcaaacctacaaaaactacgaccaacgaaaaaataaacccgcgaaattaacaaacgacgttataaaaatcgaaaacaatatacttaaaaacaaaaaaattaaaatttacaaaaataataaaactcccca

SEQ ID NO: 17109 - DNA, 699 bp, Artificial Sequence
  chemically treated genomic DNA (Homo sapiens) CpG-island No: 17109
gcgggtcgttaaattacgtttttaattttgttagcgatttatttatcgtcgaaggtgttacgtttattcgtttcgtcgtttcggttacgttgcgtttttgtattagtagttgtagataaaggtagtagattgagattaagcgtggtgatggatttttttatgagcggacggggcgtttaggcgcgacgaatataattagtaataggtttattatgttataggtaattagaatttcgattagtatattttatgcgtcgatattaattatcgttgttagttaaatttatagtgacgaatcgtaaatttgcgtaatatttaaggtcgagttggttacgttcgcgcgtaatgaaaacggttttaacgtttgatttatcgttatattaaaatttatcgagaaatcggcgtaaattagcgtgatattaaatagagaaatcgtatgggaaggtgaaacggtaagagtgattttcgtcgttaggaataatatttgcgaggtgattattaacgtacgtggtttaaaaatttttagcgtaaatggcgtggagaatgaaacggttatgttgacgttagcggttagcgttataatggtggcgtatttatcgcgtttaaattttatgatttttattagtaatatcggtgacgtgttgacgaaagtgaggattatcgaaacgttgagggtggtgataataatacggttgagga

SEQ ID NO: 17110 - DNA, 699 bp, Artificial Sequence
  chemically treated genomic DNA (Homo sapiens) CpG-island No: 17110
tcctcaaccgtattattatcaccaccctcaacgtttcgataatcctcactttcgtcaacacgtcaccgatattactaataaaaatcataaaatttaaacgcgataaatacgccaccattataacgctaaccgctaacgtcaacataaccgtttcattctccacgccatttacgctaaaaatttttaaaccacgtacgttaataatcacctcgcaaatattattcctaacgacgaaaatcactcttaccgtttcaccttcccatacgatttctctatttaatatcacgctaatttacgccgatttctcgataaattttaatataacgataaatcaaacgttaaaaccgttttcattacgcgcgaacgtaaccaactcgaccttaaatattacgcaaatttacgattcgtcactataaatttaactaacaacgataattaatatcgacgcataaaatatactaatcgaaattctaattacctataacataataaacctattactaattatattcgtcgcgcctaaacgccccgtccgctcataaaaaaatccatcaccacgcttaatctcaatctactacctttatctacaactactaatacaaaaacgcaacgtaaccgaaacgacgaaacgaataaacgtaacaccttcgacgataaataaatcgctaacaaaattaaaaacgtaatttaacgacccgc

SEQ ID NO: 17111 - DNA, 699 bp, Artificial Sequence
  chemically treated genomic DNA (Homo sapiens) CpG-island No: 17111
tttttagtcgtgttgttattattatttttagcgtttcggtgatttttattttcgttaatacgttatcggtattgttgatggaaattatggggtttgagcgcggtgaatacgttattattatggcgttgatcgttggcgttagtatgatcgttttattttttacgttatttgcgttgggaatttttaagttacgtacgttgatgattatttcgtaggtgttatttttggcggcggggattatttttgtcgttttatttttttatgcggtttttttgtttggtattacgttgatttgcgtcggtttttcggtaggttttggtgtggcgatgagttaggcgttagggtcgtttttattacgcgcgggcgtagttagttcgattttaggtattgcgtaggtttgcggttcgttattgtggatttggttggtagcggtggttggtatcggcgtatggaatatgttgatcgggattttgattgtttgtagtatagtgagtttgttgttgattatgttcgtcgcgtttggacgtttcgttcgtttatggagaaatttattattacgtttgattttaatttgttgtttttgtttgtaattgttgatgtaggagcgtagcgtaatcgaagcggcgaagcggataaacgtgatattttcggcggtgagtaagtcgttggtaaagttaagagcgtggtttgacgattcgt

SEQ ID NO: 17112 - DNA, 699 bp, Artificial Sequence
  chemically treated genomic DNA (Homo sapiens) CpG-island No: 17112
acgaatcgtcaaaccacgctcttaactttaccaacgacttactcaccgccgaaaatatcacgtttatccgcttcgccgcttcgattacgctacgctcctacatcaacaattacaaacaaaaacaacaaattaaaatcaaacgtaataataaatttctccataaacgaacgaaacgtccaaacgcgacgaacataatcaacaacaaactcactatactacaaacaatcaaaatcccgatcaacatattccatacgccgataccaaccaccgctaccaaccaaatccacaataacgaaccgcaaacctacgcaatacctaaaatcgaactaactacgcccgcgcgtaataaaaacgaccctaacgcctaactcatcgccacaccaaaacctaccgaaaaaccgacgcaaatcaacgtaataccaaacaaaaaaaccgcataaaaaaataaaacgacaaaaataatccccgccgccaaaaataacacctacgaaataatcatcaacgtacgtaacttaaaaattcccaacgcaaataacgtaaaaaataaaacgatcatactaacgccaacgatcaacgccataataataacgtattcaccgcgctcaaaccccataatttccatcaacaataccgataacgtattaacgaaaataaaaatcaccgaaacgctaaaaataataataacaacacgactaaaaa

SEQ ID NO: 17113 - DNA, 652 bp, Artificial Sequence
  chemically treated genomic DNA (Homo sapiens) CpG-island No: 17113
atagacgagcgaggtaaataaggtatacgtacgagacgtaacgcgattaaataagcgcgataaagacgagtatagtagagagcgtatagaagatacgtaagtaagagcgagtatagtagtatagtagcgtagatattagtagagcgagatcgacgcggaagtcgattaagttacgcgagtagtagtatatatagcgcgaacgttcgtatagagcggaggagcgagttacgtaaggtatagaatagatataagataagagatcgagtagtacgataggagtaagcgtacgaaaagcggaagatagagtatatagtagagtagacgtcgtagatatacgaggagtagaataggagacgatagacgcgtaagaagtaaaggcgtaagagaatatcgagaacgaaggaataaatgagattacgtagtagagtgagacgaagaaggcgtaaagtaggtaggcgcgcggaaagagcgtaagggtagtaagaagtagatagaagacgagacgaattaaggttcgaagaaggaagcgagtattaggaggagcgataggaaattagcgagaggagagtaggtagagaggaatacgaataattagtagcgaagtagacgattatgataagttagtacgtaggaaaaaagaagtagatagtaa

SEQ ID NO: 17114 - DNA, 652 bp, Artificial Sequence
  chemically treated genomic DNA (Homo sapiens) CpG-island No: 17114
ttactatctacttcttttttcctacgtactaacttatcataatcgtctacttcgctactaattattcgtattcctctctacctactctcctctcgctaatttcctatcgctcctcctaatactcgcttccttcttcgaaccttaattcgtctcgtcttctatctacttcttactacccttacgctctttccgcgcgcctacctactttacgccttcttcgtctcactctactacgtaatctcatttattccttcgttctcgatattctcttacgcctttacttcttacgcgtctatcgtctcctattctactcctcgtatatctacgacgtctactctactatatactctatcttccgcttttcgtacgcttactcctatcgtactactcgatctcttatcttatatctattctataccttacgtaactcgctcctccgctctatacgaacgttcgcgctatatatactactactcgcgtaacttaatcgacttccgcgtcgatctcgctctactaatatctacgctactatactactatactcgctcttacttacgtatcttctatacgctctctactatactcgtctttatcgcgcttatttaatcgcgttacgtctcgtacgtataccttatttacctcgctcgtctat

SEQ ID NO: 17115 - DNA, 652 bp, Artificial Sequence
  chemically treated genomic DNA (Homo sapiens) CpG-island No: 17115
ttgttgtttgtttttttttttttacgtgttgatttgttatgatcgtttgtttcgttgttggttgttcgtgtttttttttgtttgtttttttttcgttggttttttgtcgttttttttggtgttcgttttttttttcggattttggttcgtttcgttttttgtttgttttttgttgtttttgcgtttttttcgcgcgtttatttgttttgcgtttttttcgttttattttgttgcgtagttttatttgttttttcgttttcggtgtttttttgcgtttttgttttttgcgcgtttgtcgttttttgttttgtttttcgtgtatttacgacgtttgttttgttgtgtgttttgtttttcgtttttcgtgcgtttgtttttgtcgtgttgttcgattttttgttttgtgtttgttttgtgttttgcgtggttcgttttttcgttttgtacgggcgttcgcgttgtgtgtgttgttgttcgcgtggtttggtcggttttcgcgtcggtttcgttttgttggtgtttgcgttgttgtgttgttgtgttcgtttttgtttgcgtgttttttgtacgttttttgttgtgttcgtttttgtcgcgtttgtttgatcgcgttgcgtttcgtgcgtgtgttttgtttgtttcgttcgtttgt

SEQ ID NO: 17116 - DNA, 652 bp, Artificial Sequence
  chemically treated genomic DNA (Homo sapiens) CpG-island No: 17116
acaaacgaacgaaacaaacaaaacacacgcacgaaacgcaacgcgatcaaacaaacgcgacaaaaacgaacacaacaaaaaacgtacaaaaaacacgcaaacaaaaacgaacacaacaacacaacaacgcaaacaccaacaaaacgaaaccgacgcgaaaaccgaccaaaccacgcgaacaacaacacacacaacgcgaacgcccgtacaaaacgaaaaaacgaaccacgcaaaacacaaaacaaacacaaaacaaaaaatcgaacaacacgacaaaaacaaacgcacgaaaaacgaaaaacaaaacacacaacaaaacaaacgtcgtaaatacacgaaaaacaaaacaaaaaacgacaaacgcgcaaaaaacaaaaacgcaaaaaaacaccgaaaacgaaaaaacaaataaaactacgcaacaaaataaaacgaaaaaaacgcaaaacaaataaacgcgcgaaaaaaacgcaaaaacaacaaaaaacaaacaaaaaacgaaacgaaccaaaatccgaaaaaaaaaacgaacaccaaaaaaaacgacaaaaaaccaacgaaaaaaaaacaaacaaaaaaaaacacgaacaaccaacaacgaaacaaacgatcataacaaatcaacacgtaaaaaaaaaaaaacaaacaacaa

SEQ ID NO: 17117 - DNA, 724 bp, Artificial Sequence
  chemically treated genomic DNA (Homo sapiens) CpG-island No: 17117
tttcgttagttgttagttcgcgtcgttcgcggttcgcgtttatttttttttttggtttttcggtttcggggtcgttcgcgggttaggtttaattcggggtagggttcgtagagggcgcgggattcggtaggggcggttatgttagtttcgtagaggggatttttagtttgcgagtcgggtcggagggtcggcgttcgtttcgcggcgattttggttcgattttttattgataagatcggagtcgggaggcgggtagaagtttggagacgttttaggggtagtgaaaaatggtggcgtttttcggaagatcgagggtgttttttggcgaggcgaggtcgttagtgaaggagttcggttggtcgggagtcggggaggttcgggggttgggggttgcggggtgggggttgaggggcgggagaaggggttgcggtagagagcgagaaaaataagatttaggtttcgaggaatcgtttttttttcggttcgacgtgcgtacgagcgtattttttttttttcgatcgtcgtttcggagtcgttttcgtagaaatgttatttagatgtttagttttttttttcgtcgaggttttcgtagggagttgcgttagcgagcgcgaagttagtagttggttcgagtttattttttagatgggtgaggggaagtcggttttgtgttttcgttttttttttcggttcgaatttttaggtttttttttacgagtagtta

SEQ ID NO: 17118 - DNA, 724 bp, Artificial Sequence
  chemically treated genomic DNA (Homo sapiens) CpG-island No: 17118
taactactcgtaaaaaaaaacctaaaaattcgaaccgaaaaaaaaaacgaaaacacaaaaccgacttcccctcacccatctaaaaaataaactcgaaccaactactaacttcgcgctcgctaacgcaactccctacgaaaacctcgacgaaaaaaaaaactaaacatctaaataacatttctacgaaaacgactccgaaacgacgatcgaaaaaaaaaaaatacgctcgtacgcacgtcgaaccgaaaaaaaaacgattcctcgaaacctaaatcttatttttctcgctctctaccgcaaccccttctcccgcccctcaacccccaccccgcaacccccaacccccgaacctccccgactcccgaccaaccgaactccttcactaacgacctcgcctcgccaaaaaacaccctcgatcttccgaaaaacgccaccatttttcactacccctaaaacgtctccaaacttctacccgcctcccgactccgatcttatcaataaaaaatcgaaccaaaatcgccgcgaaacgaacgccgaccctccgacccgactcgcaaactaaaaatcccctctacgaaactaacataaccgcccctaccgaatcccgcgccctctacgaaccctaccccgaattaaacctaacccgcgaacgaccccgaaaccgaaaaaccaaaaaaaaaaataaacgcgaaccgcgaacgacgcgaactaacaactaacgaaa

SEQ ID NO: 17119 - DNA, 724 bp, Artificial Sequence
  chemically treated genomic DNA (Homo sapiens) CpG-island No: 17119
tggttgttcgtgggaaaaggtttagaggttcgggtcgagaagaggagcgaaagtatagagtcgatttttttttatttatttgggaaatgggttcgggttaattgttgatttcgcgttcgttggcgtagttttttgcggagatttcggcggggagggaggttgaatatttggatgatatttttgcgagagcggtttcggagcggcggtcggggagggagaggtgcgttcgtgcgtacgtcgggtcgggagggaggcgatttttcggggtttgggttttgtttttttcgttttttatcgtagttttttttttcgttttttagtttttatttcgtagtttttagttttcgagttttttcggttttcgattagtcgagtttttttattggcggtttcgtttcgttagagggtattttcgatttttcggaaaacgttattattttttattgtttttggagcgtttttaggtttttgttcgtttttcgatttcgattttgttaatgaagaatcgggttaggatcgtcgcggagcggacgtcgatttttcgattcggttcgtaggttgggagttttttttgcgaggttggtatggtcgtttttatcgggtttcgcgttttttgcggattttgtttcgggttgggtttggttcgcgggcggtttcgggatcgggggattaggagggagagtagacgcgggtcgcggacggcgcggattgatagttggcgaga

SEQ ID NO: 17120 - DNA, 724 bp, Artificial Sequence
  chemically treated genomic DNA (Homo sapiens) CpG-island No: 17120
tctcgccaactatcaatccgcgccgtccgcgacccgcgtctactctccctcctaatcccccgatcccgaaaccgcccgcgaaccaaacccaacccgaaacaaaatccgcaaaaaacgcgaaacccgataaaaacgaccataccaacctcgcaaaaaaaactcccaacctacgaaccgaatcgaaaaatcgacgtccgctccgcgacgatcctaacccgattcttcattaacaaaatcgaaatcgaaaaacgaacaaaaacctaaaaacgctccaaaaacaataaaaaataataacgttttccgaaaaatcgaaaataccctctaacgaaacgaaaccgccaataaaaaaactcgactaatcgaaaaccgaaaaaactcgaaaactaaaaactacgaaataaaaactaaaaaacgaaaaaaaaaactacgataaaaaacgaaaaaaacaaaacccaaaccccgaaaaatcgcctccctcccgacccgacgtacgcacgaacgcacctctccctccccgaccgccgctccgaaaccgctctcgcaaaaatatcatccaaatattcaacctccctccccgccgaaatctccgcaaaaaactacgccaacgaacgcgaaatcaacaattaacccgaacccatttcccaaataaataaaaaaaaatcgactctatactttcgctcctcttctcgacccgaacctctaaaccttttcccacgaacaacca

SEQ ID NO: 17121 - DNA, 520 bp, Artificial Sequence
  chemically treated genomic DNA (Homo sapiens) CpG-island No: 17121
gttaacgacgttagagtcggaaatgacgataacggtgagggttttcgggcggggtttgggataggtagtttcggggttcgcggttttatatcggaaataaaatagcggttggtttggaaggaatttgagttacgagtcgcggcggtagcggggcggcggggaagcgtatgtgcgtgatggggagttcgggtaagttaggaaggtatcgcggatatgggcggtcgcgggtagggttcggttttttgtggtcgttcgggtcgcgaagtcggtgttttaaaagatgaggggcggggcgcggtcggttggggttggggaatttcgtgtgggaaattaggaggggcggttcgtttttcgggtttcgggcgcggtcgggtggagagagatttcggggagttttggttcggaaatgttgtttgttcgaagacgttttagggcgtaggtgttttgggtcgggattagtagtcgtttgaattggagtggagtaggagaaagaggaagcgttttgggttgggtttgtttg

SEQ ID NO: 17122 - DNA, 520 bp, Artificial Sequence
  chemically treated genomic DNA (Homo sapiens) CpG-island No: 17122
caaacaaacccaacccaaaacgcttcctctttctcctactccactccaattcaaacgactactaatcccgacccaaaacacctacgccctaaaacgtcttcgaacaaacaacatttccgaaccaaaactccccgaaatctctctccacccgaccgcgcccgaaacccgaaaaacgaaccgcccctcctaatttcccacacgaaattccccaaccccaaccgaccgcgccccgcccctcatcttttaaaacaccgacttcgcgacccgaacgaccacaaaaaaccgaaccctacccgcgaccgcccatatccgcgataccttcctaacttacccgaactccccatcacgcacatacgcttccccgccgccccgctaccgccgcgactcgtaactcaaattccttccaaaccaaccgctattttatttccgatataaaaccgcgaaccccgaaactacctatcccaaaccccgcccgaaaaccctcaccgttatcgtcatttccgactctaacgtcgttaac

SEQ ID NO: 17123 - DNA, 520 bp, Artificial Sequence
  chemically treated genomic DNA (Homo sapiens) CpG-island No: 17123
taagtagatttagtttaagacgtttttttttttttttattttattttagtttagacggttattaatttcggtttaaggtatttgcgttttgagacgttttcgagtaaatagtattttcggattaaggtttttcggaatttttttttattcggtcgcgttcgaagttcgagaaacgggtcgttttttttggttttttatacggggttttttagttttaatcggtcgcgtttcgttttttattttttaggatatcggtttcgcggttcgggcggttataaagggtcgggttttgttcgcggtcgtttatgttcgcggtgtttttttggtttgttcggattttttattacgtatatacgttttttcgtcgtttcgttgtcgtcgcggttcgtagtttaggttttttttagattagtcgttgttttgttttcgatgtgaaatcgcggatttcggagttgtttgttttaggtttcgttcgagaatttttatcgttgtcgttattttcggttttggcgtcgttggt

SEQ ID NO: 17124 - DNA, 520 bp, Artificial Sequence
  chemically treated genomic DNA (Homo sapiens) CpG-island No: 17124
accaacgacgccaaaaccgaaaataacgacaacgataaaaattctcgaacgaaacctaaaacaaacaactccgaaatccgcgatttcacatcgaaaacaaaacaacgactaatctaaaaaaaacctaaactacgaaccgcgacgacaacgaaacgacgaaaaaacgtatatacgtaataaaaaatccgaacaaaccaaaaaaacaccgcgaacataaacgaccgcgaacaaaacccgaccctttataaccgcccgaaccgcgaaaccgatatcctaaaaaataaaaaacgaaacgcgaccgattaaaactaaaaaaccccgtataaaaaaccaaaaaaaacgacccgtttctcgaacttcgaacgcgaccgaataaaaaaaaattccgaaaaaccttaatccgaaaatactatttactcgaaaacgtctcaaaacgcaaataccttaaaccgaaattaataaccgtctaaactaaaataaaataaaaaaaaaaaaaaacgtcttaaactaaatctactta

SEQ ID NO: 17125 - DNA, 979 bp, Artificial Sequence
  chemically treated genomic DNA (Homo sapiens) CpG-island No: 17125
ttttttgcggttcggtcgatttcgcgggtttgggtttgggcgggtatcgacggagcggttttggttgtagtttttcggcgttagcgaagataggtagggaggcggagggattggaagttttcgggcgtttagcggcggggatttcgtatttcggggtttttgtaggaatttgttcgtttggtttacggcgacgggggtgtcggagaaagtgggggtcgtagagaagatttcgtttcggttcgtttttcggaggtgggcgtagggttatcgttcggtatcgcgcgtttttcggtttggaggaaaggaaatgtagagagtcggggagttggtgcgggacggtttcggcgcgtatttttcgttcgttcggattttttttttaggcgaatgtcgttttcggcgcgtggtataagcgaggttttggagatcgtgcgtttttttcgggaggtgttattgggtcgcgggtttggagcgttcgggagttttagcggttgtcggtatttgcgcggttatttcgggtttttcgtgggaatcgcgttttttcgtttcgggggtgcgcggcgcgtttttggggtggggacgcggggtgtttggttagggttggatcgatgtagaggggggtcgtgggcgggggttacggggacgggcgtttgcggattgcggcggtttcggagtcggttggggattttgtagggggaggtttggtcggcggttattcgttttttcgttttttggcgtttagggtcgtcgttttcggttttagtttaaggtagacgcgtttttcgggaataatacgttgagggcgtttattttgcgtgttcggggttattcggtttttgttttcgggcggtaggagaggtcgagtttttacggttttcggagtagtttcgtgattagattcggattggttttggagttgaaggggttgtttgttattaaatgaatcgaaaaaattgaattttttagatttcggaatggtaga

SEQ ID NO: 17126 - DNA, 979 bp, Artificial Sequence
  chemically treated genomic DNA (Homo sapiens) CpG-island No: 17126
tctaccattccgaaatctaaaaaattcaattttttcgattcatttaataacaaacaaccccttcaactccaaaaccaatccgaatctaatcacgaaactactccgaaaaccgtaaaaactcgacctctcctaccgcccgaaaacaaaaaccgaataaccccgaacacgcaaaataaacgccctcaacgtattattcccgaaaaacgcgtctaccttaaactaaaaccgaaaacgacgaccctaaacgccaaaaaacgaaaaaacgaataaccgccgaccaaacctccccctacaaaatccccaaccgactccgaaaccgccgcaatccgcaaacgcccgtccccgtaacccccgcccacgacccccctctacatcgatccaaccctaaccaaacaccccgcgtccccaccccaaaaacgcgccgcgcacccccgaaacgaaaaaacgcgattcccacgaaaaacccgaaataaccgcgcaaataccgacaaccgctaaaactcccgaacgctccaaacccgcgacccaataacacctcccgaaaaaaacgcacgatctccaaaacctcgcttataccacgcgccgaaaacgacattcgcctaaaaaaaaaatccgaacgaacgaaaaatacgcgccgaaaccgtcccgcaccaactccccgactctctacatttcctttcctccaaaccgaaaaacgcgcgataccgaacgataaccctacgcccacctccgaaaaacgaaccgaaacgaaatcttctctacgacccccactttctccgacacccccgtcgccgtaaaccaaacgaacaaattcctacaaaaaccccgaaatacgaaatccccgccgctaaacgcccgaaaacttccaatccctccgcctccctacctatcttcgctaacgccgaaaaactacaaccaaaaccgctccgtcgatacccgcccaaacccaaacccgcgaaatcgaccgaaccgcaaaaaa

SEQ ID NO: 17127 - DNA, 979 bp, Artificial Sequence
  chemically treated genomic DNA (Homo sapiens) CpG-island No: 17127
tttgttatttcgaagtttgaaaagtttagttttttcggtttatttggtggtaaataatttttttaattttaaggttagttcgggtttggttacggggttatttcgagggtcgtggaagttcgattttttttgtcgttcgagggtagggatcgggtggtttcgggtacgtagggtgggcgtttttaacgtgttgttttcggggaacgcgtttgttttgagttagggtcgaaggcggcgattttaggcgttagagggcgggaaggcgggtggtcgtcgattaagtttttttttatagggtttttagtcgatttcgggatcgtcgtagttcgtagacgttcgttttcgtggttttcgtttacggtttttttttgtatcggtttagttttgattaggtatttcgcgtttttattttaggaacgcgtcgcgtattttcgaggcggagaggcgcggtttttacgggaggttcggggtggtcgcgtaggtgtcggtagtcgttggggttttcggacgttttaggttcgcggtttagtggtatttttcgggaggggcgtacggtttttagggtttcgtttgtattacgcgtcgggagcggtattcgtttgaagggaaggttcgagcgggcggagggtgcgcgtcggggtcgtttcgtattagtttttcggttttttgtatttttttttttttaggtcggggggcgcgcggtgtcgagcgatgattttgcgtttattttcggagagcgagtcggggcggggttttttttgcggtttttatttttttcgatattttcgtcgtcgtgagttaggcgagtaaatttttgtagaagtttcggggtgcggggttttcgtcgttgggcgttcgggggtttttagttttttcgtttttttatttgttttcgttggcgtcgggaggttgtagttagggtcgtttcgtcggtgttcgtttaggtttaagttcgcgaggtcggtcgggtcgtaaggaa

SEQ ID NO: 17128 - DNA, 979 bp, Artificial Sequence
  chemically treated genomic DNA (Homo sapiens) CpG-island No: 17128
ttccttacgacccgaccgacctcgcgaacttaaacctaaacgaacaccgacgaaacgaccctaactacaacctcccgacgccaacgaaaacaaataaaaaaacgaaaaaactaaaaacccccgaacgcccaacgacgaaaaccccgcaccccgaaacttctacaaaaatttactcgcctaactcacgacgacgaaaatatcgaaaaaaataaaaaccgcaaaaaaaaccccgccccgactcgctctccgaaaataaacgcaaaatcatcgctcgacaccgcgcgccccccgacctaaaaaaaaaaaaatacaaaaaaccgaaaaactaatacgaaacgaccccgacgcgcaccctccgcccgctcgaaccttcccttcaaacgaataccgctcccgacgcgtaatacaaacgaaaccctaaaaaccgtacgcccctcccgaaaaataccactaaaccgcgaacctaaaacgtccgaaaaccccaacgactaccgacacctacgcgaccaccccgaacctcccgtaaaaaccgcgcctctccgcctcgaaaatacgcgacgcgttcctaaaataaaaacgcgaaatacctaatcaaaactaaaccgatacaaaaaaaaaccgtaaacgaaaaccacgaaaacgaacgtctacgaactacgacgatcccgaaatcgactaaaaaccctataaaaaaaaacttaatcgacgaccacccgccttcccgccctctaacgcctaaaatcgccgccttcgaccctaactcaaaacaaacgcgttccccgaaaacaacacgttaaaaacgcccaccctacgtacccgaaaccacccgatccctaccctcgaacgacaaaaaaaatcgaacttccacgaccctcgaaataaccccgtaaccaaacccgaactaaccttaaaattaaaaaaattatttaccaccaaataaaccgaaaaaactaaacttttcaaacttcgaaataacaaa

SEQ ID NO: 17129 - DNA, 965 bp, Artificial Sequence
  chemically treated genomic DNA (Homo sapiens) CpG-island No: 17129
tttgcggatcgaaaacgtcgttcgcgcgaatgcgtttaacgcgcgttagaattttttgtttaaatgcggttttgtatttcgtcggaacgaagacgcgggtgttattggtatatatttgatcggagttgaagaagtttgttattatggcgatatcggcggcgagatcgagattcgtattatcgaaaacgattagcggtgatttatcgtttagttttatggttattttttttagggaagaggtcgtcgagttagttattatttttttgtcgttggcgatatcgtcggtaaatgatattttggtaatgttcggatgttcggttagatattgttcggttttcgcgtttacgttcggtaatacgttaaatacgtcgttcggtaggttcgtttcgttgtaaattttagttagttttaacgcggtaagcggggtaatttcgttcggtttgaaaattattgcgttgtttgtcgttagcgtcggggcggatttttatagggtaatttggatcgggtagttttatgcgttaatttttgttattacgtttagcggttcgcggcgggtatatataaaggacgttttacgtaacgggatttggttgttttttagcgtcgggattagttcggcgtagtattttagtacgttcgtatcggtaacgatatcgacggttgaggttttcgaatatgttttttcggtgtcgagggttttagttatgcgagttcgttattgcgtttacgtcgaatattaacggttcgacgtagaatacgcgaggttttatgcggttatcgagttcgatttttgtttgttggcgttttacgggtattaatttcggtcggggttgcggtttaacgtttttggcgtgtagttttagggatcgtggggggaaattcgttaaaggttgtttcggaaattttaaagggagatgaaaggcgaaagtatattgtgagtataataagcgattgttttgtttttt

SEQ ID NO: 17130 - DNA, 965 bp, Artificial Sequence
  chemically treated genomic DNA (Homo sapiens) CpG-island No: 17130
aaaaaacaaaacaatcgcttattatactcacaatatactttcgcctttcatctccctttaaaatttccgaaacaacctttaacgaatttccccccacgatccctaaaactacacgccaaaaacgttaaaccgcaaccccgaccgaaattaatacccgtaaaacgccaacaaacaaaaatcgaactcgataaccgcataaaacctcgcgtattctacgtcgaaccgttaatattcgacgtaaacgcaataacgaactcgcataactaaaaccctcgacaccgaaaaaacatattcgaaaacctcaaccgtcgatatcgttaccgatacgaacgtactaaaatactacgccgaactaatcccgacgctaaaaaacaaccaaatcccgttacgtaaaacgtcctttatatatacccgccgcgaaccgctaaacgtaataacaaaaattaacgcataaaactacccgatccaaattaccctataaaaatccgccccgacgctaacgacaaacaacgcaataattttcaaaccgaacgaaattaccccgcttaccgcgttaaaactaactaaaatttacaacgaaacgaacctaccgaacgacgtatttaacgtattaccgaacgtaaacgcgaaaaccgaacaatatctaaccgaacatccgaacattaccaaaatatcatttaccgacgatatcgccaacgacaaaaaaataataactaactcgacgacctcttccctaaaaaaaataaccataaaactaaacgataaatcaccgctaatcgttttcgataatacgaatctcgatctcgccgccgatatcgccataataacaaacttcttcaactccgatcaaatatataccaataacacccgcgtcttcgttccgacgaaatacaaaaccgcatttaaacaaaaaattctaacgcgcgttaaacgcattcgcgcgaacgacgttttcgatccgcaaa

SEQ ID NO: 17131 - DNA, 965 bp, Artificial Sequence
  chemically treated genomic DNA (Homo sapiens) CpG-island No: 17131
aaaggataaaatagtcgtttattgtgtttatagtgtattttcgttttttatttttttttggggttttcggggtaatttttaacgggtttttttttacggtttttgggattatacgttaggaacgttgggtcgtagtttcggtcgagattgatgttcgtgaagcgttagtaggtaaaaatcgggttcgatgatcgtatggagtttcgcgtattttgcgtcgggtcgttgatattcggcgtgaacgtaatgacgaattcgtataattggaattttcgatatcggaaaagtatattcggaaattttaatcgtcgatatcgttatcggtgcggacgtgttggagtattacgtcgggttgatttcggcgttggaaggtagttagatttcgttgcgtgaaacgttttttgtgtatattcgtcgcgaatcgttgggcgtagtggtagggattggcgtatggaattattcgatttagattgttttgtggaaattcgtttcggcgttggcggtaggtaacgtaatgatttttaaatcgagcgaagttatttcgtttatcgcgttaaagttggttgaaatttatagcgaagcgggtttgtcggacggcgtatttaacgtgttgtcgggcgtgggcgcggagatcgggtaatatttgatcgagtattcgggtattgttaaagtgttatttatcggcggtgtcgttagcggtaaaaaagtgatggttaattcggcggttttttttttgaaagaagtgattatggaattgggcggtaaattatcgttgatcgttttcgatgatgcggatttcgatttcgtcgtcgatatcgttatgatggtaaatttttttagtttcggttaggtgtgtattaatggtattcgcgttttcgtttcggcgaaatgtaaagtcgtatttgagtagaaaattttggcgcgcgttgagcgtattcgcgcgggcgacgttttcgattcgtaaa

SEQ ID NO: 17132 - DNA, 965 bp, Artificial Sequence
  chemically treated genomic DNA (Homo sapiens) CpG-island No: 17132
tttacgaatcgaaaacgtcgcccgcgcgaatacgctcaacgcgcgccaaaattttctactcaaatacgactttacatttcgccgaaacgaaaacgcgaataccattaatacacacctaaccgaaactaaaaaaatttaccatcataacgatatcgacgacgaaatcgaaatccgcatcatcgaaaacgatcaacgataatttaccgcccaattccataatcacttctttcaaaaaaaaaaccgccgaattaaccatcacttttttaccgctaacgacaccgccgataaataacactttaacaatacccgaatactcgatcaaatattacccgatctccgcgcccacgcccgacaacacgttaaatacgccgtccgacaaacccgcttcgctataaatttcaaccaactttaacgcgataaacgaaataacttcgctcgatttaaaaatcattacgttacctaccgccaacgccgaaacgaatttccacaaaacaatctaaatcgaataattccatacgccaatccctaccactacgcccaacgattcgcgacgaatatacacaaaaaacgtttcacgcaacgaaatctaactaccttccaacgccgaaatcaacccgacgtaatactccaacacgtccgcaccgataacgatatcgacgattaaaatttccgaatatacttttccgatatcgaaaattccaattatacgaattcgtcattacgttcacgccgaatatcaacgacccgacgcaaaatacgcgaaactccatacgatcatcgaacccgatttttacctactaacgcttcacgaacatcaatctcgaccgaaactacgacccaacgttcctaacgtataatcccaaaaaccgtaaaaaaaaacccgttaaaaattaccccgaaaaccccaaaaaaaaataaaaaacgaaaatacactataaacacaataaacgactattttatccttt

SEQ ID NO: 17133 - DNA, 807 bp, Artificial Sequence
  chemically treated genomic DNA (Homo sapiens) CpG-island No: 17133
gggtttcggcgttcgcgagcggtttttatataggtagtcgcgtttttatttttaggtagggattttcgtgcgttttcgggtatattcgtttttttatcggtattttattgcgcgaatatatgcgcgttagtcggttttcgcgcgcgttcgtttgtcgaggaagcggcggttttcggggttgggggtagggttcggtggggcgggagcgtcgcggggtcgggtttcggcgttcggggaggggacgaggggcgggcgcggggcggtgttcggtttacgtgggcgggcgggagtagttgaaggttcgttcgggaatttgggttgttttttcgcgcgcggcgttggtttaggcggcggcggcgaaggaggaggaggaggaggaggaaggcggcggtggcggcggtaaaagaggagggaggacgggggcggcgtcggattggagtcgagcggtagcgcgagttgtttagggcgttgtcgtgagttcgttcgtcgggtttttattttcgagttatattttgtcgtgtttagtattgttcgcgttcgtgtttttgcggggagcgcgtcggggttgtttttcgaatgacgggcggaaggttcgatttcgacgatggcggtatttattgcggcggttgggaggagggtaaggcgtacgggtatggtatttgtacggggtttaagggttagggcgagtattcgggtttttggtcgtacggtttcgaggtggtcggaggttatatttggtttagcggtaatatttattagggttattgggcgtagggtaagcggtacgggttgggggtggagacgaag

SEQ ID NO: 17134 - DNA, 807 bp, Artificial Sequence
  chemically treated genomic DNA (Homo sapiens) CpG-island No: 17134
cttcgtctccacccccaacccgtaccgcttaccctacgcccaataaccctaataaatattaccgctaaaccaaatataacctccgaccacctcgaaaccgtacgaccaaaaacccgaatactcgccctaacccttaaaccccgtacaaataccatacccgtacgccttaccctcctcccaaccgccgcaataaataccgccatcgtcgaaatcgaaccttccgcccgtcattcgaaaaacaaccccgacgcgctccccgcaaaaacacgaacgcgaacaatactaaacacgacaaaatataactcgaaaataaaaacccgacgaacgaactcacgacaacgccctaaacaactcgcgctaccgctcgactccaatccgacgccgcccccgtcctccctcctcttttaccgccgccaccgccgccttcctcctcctcctcctcctccttcgccgccgccgcctaaaccaacgccgcgcgcgaaaaaacaacccaaattcccgaacgaaccttcaactactcccgcccgcccacgtaaaccgaacaccgccccgcgcccgcccctcgtcccctccccgaacgccgaaacccgaccccgcgacgctcccgccccaccgaaccctacccccaaccccgaaaaccgccgcttcctcgacaaacgaacgcgcgcgaaaaccgactaacgcgcatatattcgcgcaataaaataccgataaaaaaacgaatatacccgaaaacgcacgaaaatccctacctaaaaataaaaacgcgactacctatataaaaaccgctcgcgaacgccgaaaccc

SEQ ID NO: 17135 - DNA, 807 bp, Artificial Sequence
  chemically treated genomic DNA (Homo sapiens) CpG-island No: 17135
tttcgtttttatttttagttcgtgtcgtttgttttgcgtttagtagttttggtaggtgttgtcgttgggttaggtgtagttttcgattatttcgaagtcgtgcgattaggagttcgagtattcgttttggtttttgggtttcgtgtagatgttatgttcgtgcgttttgttttttttttagtcgtcgtagtaggtgtcgttatcgtcgaagtcgaatttttcgttcgttattcggggggtagtttcggcgcgtttttcgtaggggtacggacgcgggtagtgttgggtacggtagggtgtagttcgggggtgggggttcggcgggcgagtttacgatagcgttttgggtagttcgcgttgtcgttcggttttagttcgacgtcgttttcgttttttttttttttttgtcgtcgttatcgtcgttttttttttttttttttttttttttcgtcgtcgtcgtttgggttagcgtcgcgcgcgagaggatagtttaggttttcgagcggatttttagttgttttcgttcgtttacgtgagtcgggtatcgtttcgcgttcgtttttcgtttttttttcgggcgtcgaggttcggtttcgcggcgttttcgttttatcgggttttgtttttagtttcgggagtcgtcgttttttcggtaggcgggcgcgcgcggggatcggttggcgcgtatgtgttcgcgtagtgggatgtcggtgggagggcgagtgtattcggggacgtacgagaatttttgtttggagatgaaggcgcggttgtttgtgtgggggtcgttcgcgggcgtcggagttt

SEQ ID NO: 17136 - DNA, 807 bp, Artificial Sequence
  chemically treated genomic DNA (Homo sapiens) CpG-island No: 17136
aaactccgacgcccgcgaacgacccccacacaaacaaccgcgccttcatctccaaacaaaaattctcgtacgtccccgaatacactcgccctcccaccgacatcccactacgcgaacacatacgcgccaaccgatccccgcgcgcgcccgcctaccgaaaaaacgacgactcccgaaactaaaaacaaaacccgataaaacgaaaacgccgcgaaaccgaacctcgacgcccgaaaaaaaaacgaaaaacgaacgcgaaacgatacccgactcacgtaaacgaacgaaaacaactaaaaatccgctcgaaaacctaaactatcctctcgcgcgcgacgctaacccaaacgacgacgacgaaaaaaaaaaaaaaaaaaaaaaaaaacgacgataacgacgacaaaaaaaaaaaaaaaacgaaaacgacgtcgaactaaaaccgaacgacaacgcgaactacccaaaacgctatcgtaaactcgcccgccgaacccccacccccgaactacaccctaccgtacccaacactacccgcgtccgtacccctacgaaaaacgcgccgaaactaccccccgaataacgaacgaaaaattcgacttcgacgataacgacacctactacgacgactaaaaaaaaaacaaaacgcacgaacataacatctacacgaaacccaaaaaccaaaacgaatactcgaactcctaatcgcacgacttcgaaataatcgaaaactacacctaacccaacgacaacacctaccaaaactactaaacgcaaaacaaacgacacgaactaaaaataaaaacgaaa

SEQ ID NO: 17137 - DNA, 664 bp, Artificial Sequence
  chemically treated genomic DNA (Homo sapiens) CpG-island No: 17137
ggggcgttacggggttcggtagagtttgtgtattttcgttcgttacgagggtatttggagtaacgggttgtaagacgggtacggcgtggagatttacggggacggaggtgagcggcgtaacgggcggttcggttgtttcgcgagttggtgcggtgggttttgtttcggttgcggggaagcggggaggacgtcgggcgtacgtgttcggaaattcgttaaaatatttgggggcgttttttattttcgcgttcgcgttcgttttttttagagagggcgttgggatcggattggggcgcgagggttggatttgatttcgtttttggagcgggtcgtgtatttatatttaggggagttaggcgtgaatgtatttggtcggcgttagcgttgcgttgttatcgggagggagcgtcgttcgggagggttgggttggagagaggacgttgttatttgagttcgttatattacgtttttgatttttttttttttcggtcgggtttgaaatcgttattttcgtggagttagagcgaatattttgagcgggtgaggttggcggttcgtgttgatcgttttcgggattggttttacgtggagtcgtatttcgtttttggttttttagtagtttaaagatagaagttagaatttcgtaattaggatgttggggaat

SEQ ID NO: 17138 - DNA, 664 bp, Artificial Sequence
  chemically treated genomic DNA (Homo sapiens) CpG-island No: 17138
attccccaacatcctaattacgaaattctaacttctatctttaaactactaaaaaaccaaaaacgaaatacgactccacgtaaaaccaatcccgaaaacgatcaacacgaaccgccaacctcacccgctcaaaatattcgctctaactccacgaaaataacgatttcaaacccgaccgaaaaaaaaaaaaatcaaaaacgtaatataacgaactcaaataacaacgtcctctctccaacccaaccctcccgaacgacgctccctcccgataacaacgcaacgctaacgccgaccaaatacattcacgcctaactcccctaaatataaatacacgacccgctccaaaaacgaaatcaaatccaaccctcgcgccccaatccgatcccaacgccctctctaaaaaaaacgaacgcgaacgcgaaaataaaaaacgcccccaaatattttaacgaatttccgaacacgtacgcccgacgtcctccccgcttccccgcaaccgaaacaaaacccaccgcaccaactcgcgaaacaaccgaaccgcccgttacgccgctcacctccgtccccgtaaatctccacgccgtacccgtcttacaacccgttactccaaataccctcgtaacgaacgaaaatacacaaactctaccgaaccccgtaacgcccc

SEQ ID NO: 17139 - DNA, 664 bp, Artificial Sequence
  chemically treated genomic DNA (Homo sapiens) CpG-island No: 17139
attttttaatattttagttacggggttttggtttttatttttaggttattggaggattagaagcgaaatacgattttacgtgaaattaatttcgggagcggttagtacggatcgttaattttattcgtttagggtgttcgttttaattttacgggagtggcgattttaaattcggtcgggagagggagggattaggaacgtaatgtgacgggtttaagtgatagcgttttttttttagtttaattttttcgggcggcgttttttttcggtggtagcgtagcgttggcgtcggttaggtatatttacgtttagtttttttgagtgtggatatacggttcgttttaagaacggggttagatttagttttcgcgttttagttcggttttagcgttttttttgggaaaggcgggcgcgggcgcgggggtgggaggcgtttttaggtgttttggcgggttttcggatacgtgcgttcggcgtttttttcgttttttcgtagtcggggtagagtttatcgtattagttcgcggagtagtcgagtcgttcgttacgtcgtttattttcgttttcgtaggtttttacgtcgtattcgttttgtagttcgttattttaggtattttcgtagcgagcgggggtgtataggttttgtcggatttcgtagcgtttt

SEQ ID NO: 17140 - DNA, 664 bp, Artificial Sequence
  chemically treated genomic DNA (Homo sapiens) CpG-island No: 17140
aaaacgctacgaaatccgacaaaacctatacacccccgctcgctacgaaaatacctaaaataacgaactacaaaacgaatacgacgtaaaaacctacgaaaacgaaaataaacgacgtaacgaacgactcgactactccgcgaactaatacgataaactctaccccgactacgaaaaaacgaaaaaaacgccgaacgcacgtatccgaaaacccgccaaaacacctaaaaacgcctcccacccccgcgcccgcgcccgcctttcccaaaaaaaacgctaaaaccgaactaaaacgcgaaaactaaatctaaccccgttcttaaaacgaaccgtatatccacactcaaaaaaactaaacgtaaatatacctaaccgacgccaacgctacgctaccaccgaaaaaaaacgccgcccgaaaaaattaaactaaaaaaaaaacgctatcacttaaacccgtcacattacgttcctaatccctccctctcccgaccgaatttaaaatcgccactcccgtaaaattaaaacgaacaccctaaacgaataaaattaacgatccgtactaaccgctcccgaaattaatttcacgtaaaatcgtatttcgcttctaatcctccaataacctaaaaataaaaaccaaaaccccgtaactaaaatattaaaaaat

SEQ ID NO: 17141 - DNA, 566 bp, Artificial Sequence
  chemically treated genomic DNA (Homo sapiens) CpG-island No: 17141
ggttacggcgtgcgttagagcgtgttttacggtatggttacggtgattcgtttatcgttgcgtatttcgttggtttcgttgcgtagcgagtagagtaatggtagcgtgttttacgacgtcgtagtcgtcgtcgatagttcggtcggtattcgcggcggtttcgtgtttaatttttacgtagacgttgagttagcgggtaagaagaagggcggtttttttcggaggggttttttttttggaagtatgaaatttcgtaagttcgaatttaagttttttatttcgagtaagcgtagttttgttcgtagcgacgcggttatgagtagaattagttttagcgatgttaattttacgattagttttggcgatgtagattgtgatttttgttcggtggaagattacgtggacgttattattacggaaatttatatgggcgagtggaagaacgataagcgtaacggtttcggcgttagcgagcgttttaatggtatgaagtatgaaggggagtgggtaaataataagaggtatggatatggttgtatcgtgttttttgacggttttaaagaaga

SEQ ID NO: 17142 - DNA, 566 bp, Artificial Sequence
  chemically treated genomic DNA (Homo sapiens) CpG-island No: 17142
tcttctttaaaaccgtcaaaaaacacgatacaaccatatccatacctcttattatttacccactccccttcatacttcataccattaaaacgctcgctaacgccgaaaccgttacgcttatcgttcttccactcgcccatataaatttccgtaataataacgtccacgtaatcttccaccgaacaaaaatcacaatctacatcgccaaaactaatcgtaaaattaacatcgctaaaactaattctactcataaccgcgtcgctacgaacaaaactacgcttactcgaaataaaaaacttaaattcgaacttacgaaatttcatacttccaaaaaaaaaacccctccgaaaaaaaccgcccttcttcttacccgctaactcaacgtctacgtaaaaattaaacacgaaaccgccgcgaataccgaccgaactatcgacgacgactacgacgtcgtaaaacacgctaccattactctactcgctacgcaacgaaaccaacgaaatacgcaacgataaacgaatcaccgtaaccataccgtaaaacacgctctaacgcacgccgtaacc

SEQ ID NO: 17143 - DNA, 566 bp, Artificial Sequence
  chemically treated genomic DNA (Homo sapiens) CpG-island No: 17143
ttttttttggagtcgttaggaaatacggtatagttatatttatgttttttgttatttgtttatttttttttatattttatgttattggagcgttcgttaacgtcgaagtcgttgcgtttgtcgtttttttattcgtttatgtaggttttcgtggtggtggcgtttacgtggttttttatcgggtaaaaattataatttatatcgttaaagttgatcgtggagttggtatcgttggaattaattttgtttatggtcgcgtcgttgcggatagagttgcgtttgttcgagatggaagatttggattcggatttgcgaagttttatgtttttaagaagggagttttttcggaagaggtcgtttttttttttgttcgttagtttagcgtttgcgtggaagttgagtacgaaatcgtcgcgggtgtcggtcgggttgtcggcggcggttgcggcgtcgtggagtacgttgttattgttttgttcgttgcgtagcgaggttagcgaggtacgtagcggtgagcggattatcgtggttatgtcgtagggtacgttttggcgtacgtcgtagtt

SEQ ID NO: 17144 - DNA, 566 bp, Artificial Sequence
  chemically treated genomic DNA (Homo sapiens) CpG-island No: 17144
aactacgacgtacgccaaaacgtaccctacgacataaccacgataatccgctcaccgctacgtacctcgctaacctcgctacgcaacgaacaaaacaataacaacgtactccacgacgccgcaaccgccgccgacaacccgaccgacacccgcgacgatttcgtactcaacttccacgcaaacgctaaactaacgaacaaaaaaaaaaacgacctcttccgaaaaaactcccttcttaaaaacataaaacttcgcaaatccgaatccaaatcttccatctcgaacaaacgcaactctatccgcaacgacgcgaccataaacaaaattaattccaacgataccaactccacgatcaactttaacgatataaattataatttttacccgataaaaaaccacgtaaacgccaccaccacgaaaacctacataaacgaataaaaaaacgacaaacgcaacgacttcgacgttaacgaacgctccaataacataaaatataaaaaaaaataaacaaataacaaaaaacataaatataactataccgtatttcctaacgactccaaaaaaaa

SEQ ID NO: 17145 - DNA, 504 bp, Artificial Sequence
  chemically treated genomic DNA (Homo sapiens) CpG-island No: 17145
tatagtttcgcgcgggtcgtttagttttcggattcggcggatgatgttaggcgacgggagcggtcgcggtcgggtcggggaggtcgcggtttaggggagttgggagggagggtggtttcgttaggtcgacggcgcgttcggtcgcgcggcgttgtttggagacggttttggcggcgttgtgttgttgtaaatagtcgtttttttgttattatttatagtaggattttttggttttcgggcgcggcggttggaggtaggtttgcggttcggtttttcgcgcgtttcgaattattcgttcgtcggttttattttgtttcgtttttttttaggtgtttatcgcgggtttcgattttcgggttcgaagagtggagaagggaagatcggggttgtgcggggatatgcgttttcgcgttttggaggtggttagcgcgttggggttgagtttcggtagcgtgatttcggttgttttacgtagtagggtaggagattggggggcgtggtata

SEQ ID NO: 17146 - DNA, 504 bp, Artificial Sequence
  chemically treated genomic DNA (Homo sapiens) CpG-island No: 17146
tataccacgccccccaatctcctaccctactacgtaaaacaaccgaaatcacgctaccgaaactcaaccccaacgcgctaaccacctccaaaacgcgaaaacgcatatccccgcacaaccccgatcttcccttctccactcttcgaacccgaaaatcgaaacccgcgataaacacctaaaaaaaaacgaaacaaaataaaaccgacgaacgaataattcgaaacgcgcgaaaaaccgaaccgcaaacctacctccaaccgccgcgcccgaaaaccaaaaaatcctactataaataataacaaaaaaacgactatttacaacaacacaacgccgccaaaaccgtctccaaacaacgccgcgcgaccgaacgcgccgtcgacctaacgaaaccaccctccctcccaactcccctaaaccgcgacctccccgacccgaccgcgaccgctcccgtcgcctaacatcatccgccgaatccgaaaactaaacgacccgcgcgaaactata

SEQ ID NO: 17147 - DNA, 504 bp, Artificial Sequence
  chemically treated genomic DNA (Homo sapiens) CpG-island No: 17147
tgtgttacgttttttaattttttgttttgttgcgtaggatagtcggggttacgttgtcggggtttagttttagcgcgttggttatttttagggcgcgaagacgtatgttttcgtatagtttcggtttttttttttttatttttcgggttcgggggtcggggttcgcggtgggtatttggagaggggcgaggtaggatgaggtcggcgggcggatagttcggggcgcgcggggagtcggatcgtagatttgtttttagtcgtcgcgttcgggagttaggagattttgttatagatagtaatagggaagcggttgtttatagtaatatagcgtcgttagggtcgtttttaggtaacgtcgcgcggtcgggcgcgtcgtcggtttggcgaggttatttttttttttagtttttttgggtcgcggttttttcggttcggtcgcggtcgttttcgtcgtttgatattattcgtcgggttcgggggttgagcggttcgcgcgaggttgtg

SEQ ID NO: 17148 - DNA, 504 bp, Artificial Sequence
  chemically treated genomic DNA (Homo sapiens) CpG-island No: 17148
cacaacctcgcgcgaaccgctcaacccccgaacccgacgaataatatcaaacgacgaaaacgaccgcgaccgaaccgaaaaaaccgcgacccaaaaaaactaaaaaaaaaaataacctcgccaaaccgacgacgcgcccgaccgcgcgacgttacctaaaaacgaccctaacgacgctatattactataaacaaccgcttccctattactatctataacaaaatctcctaactcccgaacgcgacgactaaaaacaaatctacgatccgactccccgcgcgccccgaactatccgcccgccgacctcatcctacctcgcccctctccaaatacccaccgcgaaccccgacccccgaacccgaaaaataaaaaaaaaaaaaccgaaactatacgaaaacatacgtcttcgcgccctaaaaataaccaacgcgctaaaactaaaccccgacaacgtaaccccgactatcctacgcaacaaaacaaaaaattaaaaaacgtaacaca

SEQ ID NO: 17149 - DNA, 732 bp, Artificial Sequence
  chemically treated genomic DNA (Homo sapiens) CpG-island No: 17149
gcgttaaggcgggggtagggagttgcgagcgttggggacgtagtcgggcggtcgtagaagcgtttaggttcgcgcgttatttttttggcgttatcgtggttgagttcgtgacgtttatatttatttataaaacgtttgttataaaagtagtggttgcggcgtttcgtattttaatcgtatttgtagcgagtatttgagaagttaagattgagtcggcggtcgcggcgtagcgaacgagtagtgatcgtgtttttatttagttttgttttatagcgtttatttgttttcgtttttcggtttttcgttcggttttgtttaatcgttacgatgatgttttcgggttttaacgtagattacgaggcgttattttttcgttgtagtagcgcgttttcggtcggggatagttttttttattattatttattcgtagattttttttttagtatgggttcgtttgttaacgcgtaggtaaggttggtttttcgtcgtcgcggggtcgggggtttggggtcgcggaggaggagatatcgggcgggacgttttagtagatgagtagggggtttttttgtgtttggagggaggttgtcgtggtcggagcggtgtcggttcgggggttcgggatttgttttgagcgtacgtacgtttgttatagtaagaattggtttttttttcgggaggtaggttcgttttgagtaatttttggtttgtattttaggacggatttttgatatt

SEQ ID NO: 17150 - DNA, 732 bp, Artificial Sequence
  chemically treated genomic DNA (Homo sapiens) CpG-island No: 17150
aatatcaaaaatccgtcctaaaatacaaaccaaaaattactcaaaacgaacctacctcccgaaaaaaaaaccaattcttactataacaaacgtacgtacgctcaaaacaaatcccgaacccccgaaccgacaccgctccgaccacgacaacctccctccaaacacaaaaaaaccccctactcatctactaaaacgtcccgcccgatatctcctcctccgcgaccccaaacccccgaccccgcgacgacgaaaaaccaaccttacctacgcgttaacaaacgaacccatactaaaaaaaaaatctacgaataaataataataaaaaaaactatccccgaccgaaaacgcgctactacaacgaaaaaataacgcctcgtaatctacgttaaaacccgaaaacatcatcgtaacgattaaacaaaaccgaacgaaaaaccgaaaaacgaaaacaaataaacgctataaaacaaaactaaataaaaacacgatcactactcgttcgctacgccgcgaccgccgactcaatcttaacttctcaaatactcgctacaaatacgattaaaatacgaaacgccgcaaccactacttttataacaaacgttttataaataaatataaacgtcacgaactcaaccacgataacgccaaaaaaataacgcgcgaacctaaacgcttctacgaccgcccgactacgtccccaacgctcgcaactccctacccccgccttaacgc

SEQ ID NO: 17151 - DNA, 732 bp, Artificial Sequence
  chemically treated genomic DNA (Homo sapiens) CpG-island No: 17151
aatgttagagattcgttttggagtgtagattagaggttgtttagaacgaatttgtttttcgaagggggaattaatttttattatggtaagcgtgcgtgcgtttagagtaagtttcgagttttcgagtcggtatcgtttcggttacggtagtttttttttaggtataagggagttttttatttatttattggagcgtttcgttcggtgttttttttttcgcgattttaagttttcggtttcgcggcgacgggaagttagttttatttgcgcgttgataggcgagtttatgttggagaaggagtttgcgggtgagtggtagtaagagaggttattttcggtcggggacgcgttgttgtagcgggaggatgacgtttcgtagtttgcgttgaagttcgagaatattatcgtggcggttaggtaaagtcgggcgaggggtcgaggggcggagataggtgggcgttgtggagtagagttgggtaggagtacggttattgttcgttcgttgcgtcgcggtcgtcggtttagttttggttttttagatgttcgttgtagatgcggttggagtacgaggcgtcgtagttattgtttttataataagcgttttatgaatgagtgtaaacgttacgggtttaattacggtggcgttagaggggtggcgcgcgggtttgggcgtttttgcggtcgttcggttgcgtttttagcgttcgtagttttttgttttcgttttggcgt

SEQ ID NO: 17152 - DNA, 732 bp, Artificial Sequence
  chemically treated genomic DNA (Homo sapiens) CpG-island No: 17152
acgccaaaacgaaaacaaaaaactacgaacgctaaaaacgcaaccgaacgaccgcaaaaacgcccaaacccgcgcgccacccctctaacgccaccgtaattaaacccgtaacgtttacactcattcataaaacgcttattataaaaacaataactacgacgcctcgtactccaaccgcatctacaacgaacatctaaaaaaccaaaactaaaccgacgaccgcgacgcaacgaacgaacaataaccgtactcctacccaactctactccacaacgcccacctatctccgcccctcgacccctcgcccgactttacctaaccgccacgataatattctcgaacttcaacgcaaactacgaaacgtcatcctcccgctacaacaacgcgtccccgaccgaaaataacctctcttactaccactcacccgcaaactccttctccaacataaactcgcctatcaacgcgcaaataaaactaacttcccgtcgccgcgaaaccgaaaacttaaaatcgcgaaaaaaaaaacaccgaacgaaacgctccaataaataaataaaaaactcccttatacctaaaaaaaaactaccgtaaccgaaacgataccgactcgaaaactcgaaacttactctaaacgcacgcacgcttaccataataaaaattaattcccccttcgaaaaacaaattcgttctaaacaacctctaatctacactccaaaacgaatctctaacatt

SEQ ID NO: 17153 - DNA, 777 bp, Artificial Sequence
  chemically treated genomic DNA (Homo sapiens) CpG-island No: 17153
gtcggtttcgtattttcgattttttttcgtcgtttaggggtcgttatatagtcggggttgatgtaattcgtttcgtcgttcgttatagtttgcgggagggacgttcggcggtcgcgacggggggcgttggcggcggcggacgttgtagcggcggcggggttggcgtcgcggcggttttcgggtcgggataggtttgggtatcgggcggagtttcgcggtcgggcggtagcggcgcggagcgggtacggcgtttgtagtcgggtttcggtttcgggggcgtcgttttttttcgtattttttgtacggtgggtgcgagggcgcgcgttgggggcgtcgggacgggcggggcggggtagggcgcggcgcgggtatttgggacggtcgttttcgtacgggcggagcgcgaggagttttagtttagtttcgcggggaggttttcgtagtttagggatttcgagtttttttcgcgtcgggcgttgtagtcgggtttttttcgcgaggcgttcggtagtttgaggtttttttttggttttcgtttcgggacgggaggtttcgttcgttttttggatagtcggggtgttttttttttttttttttcgcgtttttttttttcgttcgtttgtagggaggtgtttttttcgggcggcggggaaggcggggtgagtggggagaaaagtgttcgcggagatgggttgtgcgggtggaggtggagggtgaagggttagggaggtgcggggttggggtcggggttagattgtggagggatgataaggattt

SEQ ID NO: 17154 - DNA, 777 bp, Artificial Sequence
  chemically treated genomic DNA (Homo sapiens) CpG-island No: 17154
aaatccttatcatccctccacaatctaaccccgaccccaaccccgcacctccctaacccttcaccctccacctccacccgcacaacccatctccgcgaacacttttctccccactcaccccgccttccccgccgcccgaaaaaaacacctccctacaaacgaacgaaaaaaaaaaacgcgaaaaaaaaaaaaaaaaaacaccccgactatccaaaaaacgaacgaaacctcccgtcccgaaacgaaaaccaaaaaaaaacctcaaactaccgaacgcctcgcgaaaaaaacccgactacaacgcccgacgcgaaaaaaactcgaaatccctaaactacgaaaacctccccgcgaaactaaactaaaactcctcgcgctccgcccgtacgaaaacgaccgtcccaaatacccgcgccgcgccctaccccgccccgcccgtcccgacgcccccaacgcgcgccctcgcacccaccgtacaaaaaatacgaaaaaaaacgacgcccccgaaaccgaaacccgactacaaacgccgtacccgctccgcgccgctaccgcccgaccgcgaaactccgcccgatacccaaacctatcccgacccgaaaaccgccgcgacgccaaccccgccgccgctacaacgtccgccgccgccaacgccccccgtcgcgaccgccgaacgtccctcccgcaaactataacgaacgacgaaacgaattacatcaaccccgactatataacgacccctaaacgacgaaaaaaaatcgaaaatacgaaaccgac

SEQ ID NO: 17155 - DNA, 777 bp, Artificial Sequence
  chemically treated genomic DNA (Homo sapiens) CpG-island No: 17155
aggtttttgttatttttttataatttaatttcgattttaatttcgtatttttttggttttttattttttatttttattcgtatagtttattttcgcgggtatttttttttttatttatttcgtttttttcgtcgttcgaggagagtatttttttgtaaacggacgggggaggagagcgcgggagggagaaggagggagtatttcggttgtttagggagcggacggagtttttcgtttcggggcgggaattaaaaggaagttttaggttgtcgggcgtttcgcgggaggggttcggttgtagcgttcggcgcggggaaagttcgaggtttttgggttgcgggagttttttcgcggggttgggttggggtttttcgcgtttcgttcgtgcgggggcggtcgttttaggtgttcgcgtcgcgttttgtttcgtttcgttcgtttcggcgtttttagcgcgcgttttcgtatttatcgtgtagaaggtgcggggggaggcggcgttttcggggtcggggttcggttgtaggcgtcgtgttcgtttcgcgtcgttgtcgttcggtcgcggagtttcgttcggtgtttaggtttgtttcggttcgggagtcgtcgcggcgttagtttcgtcgtcgttgtagcgttcgtcgtcgttagcgtttttcgtcgcggtcgtcgagcgtttttttcgtaggttgtggcgggcggcgggacgggttgtattagtttcggttatatagcggtttttgggcggcggggaggggtcgggaatgcggaatcggt

SEQ ID NO: 17156 - DNA, 777 bp, Artificial Sequence
  chemically treated genomic DNA (Homo sapiens) CpG-island No: 17156
accgattccgcattcccgacccctccccgccgcccaaaaaccgctatataaccgaaactaatacaacccgtcccgccgcccgccacaacctacgaaaaaaacgctcgacgaccgcgacgaaaaacgctaacgacgacgaacgctacaacgacgacgaaactaacgccgcgacgactcccgaaccgaaacaaacctaaacaccgaacgaaactccgcgaccgaacgacaacgacgcgaaacgaacacgacgcctacaaccgaaccccgaccccgaaaacgccgcctccccccgcaccttctacacgataaatacgaaaacgcgcgctaaaaacgccgaaacgaacgaaacgaaacaaaacgcgacgcgaacacctaaaacgaccgcccccgcacgaacgaaacgcgaaaaaccccaacccaaccccgcgaaaaaactcccgcaacccaaaaacctcgaactttccccgcgccgaacgctacaaccgaacccctcccgcgaaacgcccgacaacctaaaacttccttttaattcccgccccgaaacgaaaaactccgtccgctccctaaacaaccgaaatactccctccttctccctcccgcgctctcctcccccgtccgtttacaaaaaaatactctcctcgaacgacgaaaaaaacgaaataaataaaaaaaaaaatacccgcgaaaataaactatacgaataaaaataaaaaataaaaaaccaaaaaaatacgaaattaaaatcgaaattaaattataaaaaaataacaaaaacct

SEQ ID NO: 17157 - DNA, 1128 bp, Artificial Sequence
  chemically treated genomic DNA (Homo sapiens) CpG-island No: 17157
agatttttcgtatcggcgggattttttttcgagttagcgcgtatttggaaagggggttgtaggcgaggttcgtttagggcgaggaagttcggttatcgtggagtgtcggttattttatttcgtatagaagttaaatttgttattcggttggttcgcggtagttcggttcgcggttacgcgcgaggagtggaagtttcgaagttcggcgtatttgggtaacgttcggtgttcgggagttttcggtcggtttcggtttttttttttatcggggggtcgttgtttgtgtgtgtttcggtttcgtttttcgtacggttggagtcggcgggttggggaggtgggatcgatagcgcgtttcgtagttcggtgtcgtcgttatttatttttgcgagtttcgtgaggtttttaggtcgtggttcgcggagtcgcggtttttttacggggagttttagcgtcgtttttagtagcgtcgttagtagtagtacgtagaggaggagttcggttcggtcgcggagcgtacgtatcgtttcggtttcgaggttgttttgtttgtatttttgtacgcggtcgcgaatttagtcgcgtttcgtttcgtttttttcgggggcgggattcggcgattttgaggggcgcgcggggtacggggtcgcgcggggcgggggcgcgtagttcgtatagtttttttggtttcggtttttcgcgtgggcgttcgtatagttttagggttcgcgtatttggacgttttttattttttttcgaggggtttttcggcgtttttcgattcgttttgattttgtgggcggttttttttgatttggtcgttttttcgtttttagttttcgtcgttgtcgtcgtcgtagtttttagcgaatttttgttcgcgggaagttgcggttcggcgcgtttcggttttgcgttgcgatttttgcggggttttgagggttcgacgttatttttgtttttttcgatcgcgttttaattgcgatttggatcggcggtgtcgcgcgggcgagggaggcgtagttcgacgggagagtggcgcgagttttcggatgtcgggtagatgtttggttatgtttcgaggaaggtttgttggggaggaagtttagaagtaatttttttagggttttt

SEQ ID NO: 17158 - DNA, 1128 bp, Artificial Sequence
  chemically treated genomic DNA (Homo sapiens) CpG-island No: 17158
aaaaaccctaaaaaaattacttctaaacttcctccccaacaaaccttcctcgaaacataaccaaacatctacccgacatccgaaaactcgcgccactctcccgtcgaactacgcctccctcgcccgcgcgacaccgccgatccaaatcgcaattaaaacgcgatcgaaaaaaacaaaaataacgtcgaaccctcaaaaccccgcaaaaatcgcaacgcaaaaccgaaacgcgccgaaccgcaacttcccgcgaacaaaaattcgctaaaaactacgacgacgacaacgacgaaaactaaaaacgaaaaaacgaccaaatcaaaaaaaaccgcccacaaaatcaaaacgaatcgaaaaacgccgaaaaacccctcgaaaaaaaataaaaaacgtccaaatacgcgaaccctaaaactatacgaacgcccacgcgaaaaaccgaaaccaaaaaaactatacgaactacgcgcccccgccccgcgcgaccccgtaccccgcgcgcccctcaaaatcgccgaatcccgcccccgaaaaaaacgaaacgaaacgcgactaaattcgcgaccgcgtacaaaaatacaaacaaaacaacctcgaaaccgaaacgatacgtacgctccgcgaccgaaccgaactcctcctctacgtactactactaacgacgctactaaaaacgacgctaaaactccccgtaaaaaaaccgcgactccgcgaaccacgacctaaaaacctcacgaaactcgcaaaaataaataacgacgacaccgaactacgaaacgcgctatcgatcccacctccccaacccgccgactccaaccgtacgaaaaacgaaaccgaaacacacacaaacaacgaccccccgataaaaaaaaaaaccgaaaccgaccgaaaactcccgaacaccgaacgttacccaaatacgccgaacttcgaaacttccactcctcgcgcgtaaccgcgaaccgaactaccgcgaaccaaccgaataacaaatttaacttctatacgaaataaaataaccgacactccacgataaccgaacttcctcgccctaaacgaacctcgcctacaaccccctttccaaatacgcgctaactcgaaaaaaaatcccgccgatacgaaaaatct

SEQ ID NO: 17159 - DNA, 1128 bp, Artificial Sequence
  chemically treated genomic DNA (Homo sapiens) CpG-island No: 17159
aagagttttgggggagttatttttaggttttttttttagtaaatttttttcgaggtataattaaatatttgttcggtattcgaagattcgcgttattttttcgtcgggttgcgtttttttcgttcgcgcggtatcgtcggtttaggtcgtagttggagcgcggtcggggagggtagaggtggcgtcggatttttagggtttcgtaggagtcgtagcgtagggtcggagcgcgtcgggtcgtagtttttcgcgaataggaattcgttgggggttgcgacggcgatagcggcggggattgagggcggggaggcggttagattaaagagagtcgtttatagggttaagacgggtcggggagcgtcgaggggtttttcggaggagggtgggggacgtttaggtgcgcggattttagagttgtgcgggcgtttacgcgaggagtcggggttagagaggttgtgcgagttgcgcgttttcgtttcgcgcggtttcgtgtttcgcgcgttttttaggatcgtcgggtttcgttttcggaggaggcgaggcggggcgcgattgggttcgcggtcgcgtgtagaggtgtaggtagagtagtttcggaatcgagacgatgcgtgcgtttcgcgatcgagtcgggttttttttttgcgtgttgttgttggcggcgttgttggaggcggcgttagggtttttcgtgaagaagtcgcggtttcgcggattacggtttgggagttttacgaggttcgtagaggtgagtggcggcggtatcgggttgcggagcgcgttgtcggttttatttttttagttcgtcggttttagtcgtgcggggagcgggatcgggatatatataggtagcgatttttcgatggagagaggggtcggggtcggtcggaagttttcggatatcgggcgttgtttaggtgcgtcggatttcggggtttttatttttcgcgcgtgatcgcgagtcgggttgtcgcggattagtcgggtgataagtttgatttttgtgcggagtgaggtggtcgatattttacggtggtcgggttttttcgttttgagcggatttcgtttgtagttttttttttaggtgcgcgttagttcggagaggagtttcgtcggtgcgaggaattt

SEQ ID NO: 17160 - DNA, 1128 bp, Artificial Sequence
  chemically treated genomic DNA (Homo sapiens) CpG-island No: 17160
aaattcctcgcaccgacgaaactcctctccgaactaacgcgcacctaaaaaaaaaactacaaacgaaatccgctcaaaacgaaaaaacccgaccaccgtaaaatatcgaccacctcactccgcacaaaaatcaaacttatcacccgactaatccgcgacaacccgactcgcgatcacgcgcgaaaaataaaaaccccgaaatccgacgcacctaaacaacgcccgatatccgaaaacttccgaccgaccccgacccctctctccatcgaaaaatcgctacctatatatatcccgatcccgctccccgcacgactaaaaccgacgaactaaaaaaataaaaccgacaacgcgctccgcaacccgataccgccgccactcacctctacgaacctcgtaaaactcccaaaccgtaatccgcgaaaccgcgacttcttcacgaaaaaccctaacgccgcctccaacaacgccgccaacaacaacacgcaaaaaaaaaacccgactcgatcgcgaaacgcacgcatcgtctcgattccgaaactactctacctacacctctacacgcgaccgcgaacccaatcgcgccccgcctcgcctcctccgaaaacgaaacccgacgatcctaaaaaacgcgcgaaacacgaaaccgcgcgaaacgaaaacgcgcaactcgcacaacctctctaaccccgactcctcgcgtaaacgcccgcacaactctaaaatccgcgcacctaaacgtcccccaccctcctccgaaaaacccctcgacgctccccgacccgtcttaaccctataaacgactctctttaatctaaccgcctccccgccctcaatccccgccgctatcgccgtcgcaacccccaacgaattcctattcgcgaaaaactacgacccgacgcgctccgaccctacgctacgactcctacgaaaccctaaaaatccgacgccacctctaccctccccgaccgcgctccaactacgacctaaaccgacgataccgcgcgaacgaaaaaaacgcaacccgacgaaaaaataacgcgaatcttcgaataccgaacaaatatttaattatacctcgaaaaaaatttactaaaaaaaaaacctaaaaataactcccccaaaactctt

SEQ ID NO: 17161 - DNA, 741 bp, Artificial Sequence
  chemically treated genomic DNA (Homo sapiens) CpG-island No: 17161
attatgtcgtttagcgcgtcgtgtagaatgtaggttatttttatcgatagcgtcggtgtatcgttcgtacgggaaatgatcgattgtttatttatttcgttggtaatttggtttagcgtatttggtgtaatgttaaagttatagatatttattatttgcgcggtagaagcgattatattcgtcgtttttgtcggagttagtatcggtatcgggttgtatatggtataatatacgttcggatcgatgatataggcggaaattagcgcgtagaagcgttacgaaggattttagtggatattttatcgtagtcgagagaagtacgtttgtttttcgttcgttagtagggtcggcgtggttttagaagagattagcgtatggaagttagatatcgcgttataggcgatggtgataaataggaacgggaataggttatcggtttatatcgggttagtgttatcgataaatttggttagcgtaggtatggttagcgtcgggcgtataattaaaatgtttatcgttagatcgacgatagtttcgatttttaggaaggtagagaggtagttacgcggggttagtagtaattatatcggtagtatcgtcgttataaaatcgtaatttattagtatttaggttaattgtacgtcggtaaagttaaagtacggtgtcgtaggtcggattttttgttatttagtcgttagagataatggcgaaaattaggaatattagatcgatgatcgatat

SEQ ID NO: 17162 - DNA, 741 bp, Artificial Sequence
  chemically treated genomic DNA (Homo sapiens) CpG-island No: 17162
atatcgatcatcgatctaatattcctaattttcgccattatctctaacgactaaataacaaaaaatccgacctacgacaccgtactttaactttaccgacgtacaattaacctaaatactaataaattacgattttataacgacgatactaccgatataattactactaaccccgcgtaactacctctctaccttcctaaaaatcgaaactatcgtcgatctaacgataaacattttaattatacgcccgacgctaaccatacctacgctaaccaaatttatcgataacactaacccgatataaaccgataacctattcccgttcctatttatcaccatcgcctataacgcgatatctaacttccatacgctaatctcttctaaaaccacgccgaccctactaacgaacgaaaaacaaacgtacttctctcgactacgataaaatatccactaaaatccttcgtaacgcttctacgcgctaatttccgcctatatcatcgatccgaacgtatattataccatatacaacccgataccgatactaactccgacaaaaacgacgaatataatcgcttctaccgcgcaaataataaatatctataactttaacattacaccaaatacgctaaaccaaattaccaacgaaataaataaacaatcgatcatttcccgtacgaacgatacaccgacgctatcgataaaaataacctacattctacacgacgcgctaaacgacataat

SEQ ID NO: 17163 - DNA, 741 bp, Artificial Sequence
  chemically treated genomic DNA (Homo sapiens) CpG-island No: 17163
gtgtcggttatcggtttggtatttttgattttcgttattatttttggcggttgggtggtagaaagttcgatttgcgatatcgtattttgattttatcggcgtgtagttgatttggatgttggtgggttacggttttgtggcggcggtgttgtcggtgtggttattgttggtttcgcgtgattatttttttatttttttgaaaatcgggattatcgtcggtttggcggtaggtattttgattatgcgttcgacgttgattatgtttgcgttgattaaatttgtcgatggtattggttcggtatggatcggtaatttgttttcgtttttgtttattattatcgtttgtggcgcggtgtttggtttttatgcgttgattttttttgggattacgtcgattttgttggcgagcgaagggtaggcgtgtttttttcggttacggtgggatgtttattggaatttttcgtggcgtttttgcgcgttggttttcgtttgtattatcgattcgggcgtgtattgtgttatgtatagttcgatgtcggtgttggtttcggtagggacggcggatgtggtcgtttttgtcgcgtaggtggtgagtatttgtggttttagtattatattagatacgttaaattagattgttagcgaagtgggtgaatagtcgattatttttcgtgcgggcggtgtatcgacgttgtcggtggggatggtttatattttgtacggcgcgttgggcggtatgat

SEQ ID NO: 17164 - DNA, 741 bp, Artificial Sequence
  chemically treated genomic DNA (Homo sapiens) CpG-island No: 17164
atcataccgcccaacgcgccgtacaaaatataaaccatccccaccgacaacgtcgatacaccgcccgcacgaaaaataatcgactattcacccacttcgctaacaatctaatttaacgtatctaatataatactaaaaccacaaatactcaccacctacgcgacaaaaacgaccacatccgccgtccctaccgaaaccaacaccgacatcgaactatacataacacaatacacgcccgaatcgataatacaaacgaaaaccaacgcgcaaaaacgccacgaaaaattccaataaacatcccaccgtaaccgaaaaaaacacgcctacccttcgctcgccaacaaaatcgacgtaatcccaaaaaaaatcaacgcataaaaaccaaacaccgcgccacaaacgataataataaacaaaaacgaaaacaaattaccgatccataccgaaccaataccatcgacaaatttaatcaacgcaaacataatcaacgtcgaacgcataatcaaaatacctaccgccaaaccgacgataatcccgattttcaaaaaaataaaaaaataatcacgcgaaaccaacaataaccacaccgacaacaccgccgccacaaaaccgtaacccaccaacatccaaatcaactacacgccgataaaatcaaaatacgatatcgcaaatcgaactttctaccacccaaccgccaaaaataataacgaaaatcaaaaataccaaaccgataaccgacac

SEQ ID NO: 17165 - DNA, 1261 bp, Artificial Sequence
  chemically treated genomic DNA (Homo sapiens) CpG-island No: 17165
gagttgtcgatagttaagacgtattgggaggagaaagcgtcgtcgtgagtttggttttttcgtaggttgcgtgttagttatacggcggacggggcggacggggtacgcgtttcgagaggggtcgtcgttatttattttgtgggcgggtatcgttttggtcgttttcgggggttttacgacgaagtgtacgtcggttatgagtttattgttgaatatgagcgcgtttttgtaaaggtagaggtacgggttgggggcgtgggcgcgcgcgggcgcgggggtcgcggggtacgggtttatttttcgcgtagcgtggggcggtagtatcgttagtcggggtttttttggtggttgttgtcgagtgtgggcggcgcgggcgcgggcggcggcggcgcgggcgcgggggcgttgggcgggttgcgcggttcggtttttttgtttacggcggcgtcggcgttgttgttggttaggttcgcggtcgcggcgttggcgggagcgtagagtttcgtcgttattttcgcgggcggggcggcgggggtagtttcggcgtttgtggacgtcgcgtttcgcgttttcgcgtcgcgtcggggtttcgggagcggttttgtaagtaaaagtaaggaggttaggtattgagcgacgcggtcgtgtaggtaggttaggggtagtagtatgggcggcggcggcgttgtgattcgcggggttgttattcgtttttttgttattttcgtttttgcgattttgttcgagtttagtttagcgtagttcggttaggttcggtcgcggggggcgtcgtttcgttcgttcgttcgagttcgtattcgtcgcggcgtcggtgcgttacgttgcgttagggtcgcgtttcgcgcgacgtcgttgtttcgcggtttcgtttttaggttcgatattttcgaagttgttcgagtttttgtttagtaatcggcgcgagtcgcgcgttgtgtagaggtagtcgtggaaggcggttttcggcgttggtaggcggtcgtttttagattcgtagtgttatgcgtaggtgtttgcgttcgttttttagttagcgattttttggttaggaacgtaggtggatttgtttgtttggttatttgtatttcggagtttgtttttggtcgcggtttgtgggatggtcgttgggttttttcgttcgtttagatgtttcgcgatttagtttgttacggacgttagtagttagcgtttgtagagagcgcggtttattttgttttgagggttttataggggtaggcgt

SEQ ID NO: 17166 - DNA, 1261 bp, Artificial Sequence
  chemically treated genomic DNA (Homo sapiens) CpG-island No: 17166
acgcctacccctataaaaccctcaaaacaaaataaaccgcgctctctacaaacgctaactactaacgtccgtaacaaactaaatcgcgaaacatctaaacgaacgaaaaaacccaacgaccatcccacaaaccgcgaccaaaaacaaactccgaaatacaaataaccaaacaaacaaatccacctacgttcctaaccaaaaaatcgctaactaaaaaacgaacgcaaacacctacgcataacactacgaatctaaaaacgaccgcctaccaacgccgaaaaccgccttccacgactacctctacacaacgcgcgactcgcgccgattactaaacaaaaactcgaacaacttcgaaaatatcgaacctaaaaacgaaaccgcgaaacaacgacgtcgcgcgaaacgcgaccctaacgcaacgtaacgcaccgacgccgcgacgaatacgaactcgaacgaacgaacgaaacgacgccccccgcgaccgaacctaaccgaactacgctaaactaaactcgaacaaaatcgcaaaaacgaaaataacaaaaaaacgaataacaaccccgcgaatcacaacgccgccgccgcccatactactacccctaacctacctacacgaccgcgtcgctcaatacctaacctccttacttttacttacaaaaccgctcccgaaaccccgacgcgacgcgaaaacgcgaaacgcgacgtccacaaacgccgaaactacccccgccgccccgcccgcgaaaataacgacgaaactctacgctcccgccaacgccgcgaccgcgaacctaaccaacaacaacgccgacgccgccgtaaacaaaaaaaccgaaccgcgcaacccgcccaacgcccccgcgcccgcgccgccgccgcccgcgcccgcgccgcccacactcgacaacaaccaccaaaaaaaccccgactaacgatactaccgccccacgctacgcgaaaaataaacccgtaccccgcgacccccgcgcccgcgcgcgcccacgcccccaacccgtacctctacctttacaaaaacgcgctcatattcaacaataaactcataaccgacgtacacttcgtcgtaaaacccccgaaaacgaccaaaacgatacccgcccacaaaataaataacgacgacccctctcgaaacgcgtaccccgtccgccccgtccgccgtataactaacacgcaacctacgaaaaaaccaaactcacgacgacgctttctcctcccaatacgtcttaactatcgacaactc

SEQ ID NO: 17167 - DNA, 1261 bp, Artificial Sequence
  chemically treated genomic DNA (Homo sapiens) CpG-island No: 17167
gcgtttgtttttgtaaagtttttagagtagagtggatcgcgttttttgtaagcgttggttgttggcgttcgtagtaagttaaatcgcgaagtatttgaacgaacgaggaagtttaacgattattttataggtcgcggttagaggtagatttcggaatgtaaatggttaaataagtaggtttatttgcgtttttaattaaaagatcgttaattgaagaacgggcgtaagtatttgcgtatggtattgcgggtttgggggcggtcgtttgttagcgtcgggagtcgttttttacggttgtttttgtatagcgcgcggttcgcgtcggttgttgggtagaagttcgagtagtttcgaggatgtcgggtttgggggcggggtcgcgaggtagcgacgtcgcgcggggcgcggttttgacgtagcgtgacgtatcggcgtcgcggcgggtacgggttcgggcgggcgggcgggacggcgtttttcgcggtcgggtttggtcgggttgcgttaggttgggttcgggtagggtcgtaggggcgggggtggtaggggagcgggtggtagtttcgcgggttatagcgtcgtcgtcgtttatgttgttgtttttagtttgtttgtacggtcgcgtcgtttagtgtttgatttttttgtttttgtttgtagagtcgttttcgaggtttcggcgcggcgcgagggcgcggggcgcggcgtttataggcgtcgaggttgttttcgtcgtttcgttcgcgaagatggcggcggaattttacgttttcgttagcgtcgcggtcgcggatttagttaatagtaacgtcggcgtcgtcgtgggtaggaaggtcgggtcgcgtagttcgtttagcgttttcgcgttcgcgtcgtcgtcgttcgcgttcgcgtcgtttatattcggtaataattattaggagagtttcggttggcggtgttgtcgttttacgttgcgcgagaggtgagttcgtgtttcgcggttttcgcgttcgcgcgcgtttacgtttttagttcgtgtttttatttttgtaggaacgcgtttatgtttaataatgagtttatggtcgacgtgtatttcgtcgtggggttttcgggggcgattaggacggtgttcgtttataaggtgggtagcggcggtttttttcggaacgcgtgtttcgttcgtttcgttcgtcgtgtggttgatacgtagtttgcgggagagttaggtttacggcggcgttttttttttttagtacgttttggttgtcggtagttt

SEQ ID NO: 17168 - DNA, 1261 bp, Artificial Sequence
  chemically treated genomic DNA (Homo sapiens) CpG-island No: 17168
aaactaccgacaaccaaaacgtactaaaaaaaaaaaacgccgccgtaaacctaactctcccgcaaactacgtatcaaccacacgacgaacgaaacgaacgaaacacgcgttccgaaaaaaaccgccgctacccaccttataaacgaacaccgtcctaatcgcccccgaaaaccccacgacgaaatacacgtcgaccataaactcattattaaacataaacgcgttcctacaaaaataaaaacacgaactaaaaacgtaaacgcgcgcgaacgcgaaaaccgcgaaacacgaactcacctctcgcgcaacgtaaaacgacaacaccgccaaccgaaactctcctaataattattaccgaatataaacgacgcgaacgcgaacgacgacgacgcgaacgcgaaaacgctaaacgaactacgcgacccgaccttcctacccacgacgacgccgacgttactattaactaaatccgcgaccgcgacgctaacgaaaacgtaaaattccgccgccatcttcgcgaacgaaacgacgaaaacaacctcgacgcctataaacgccgcgccccgcgccctcgcgccgcgccgaaacctcgaaaacgactctacaaacaaaaacaaaaaaatcaaacactaaacgacgcgaccgtacaaacaaactaaaaacaacaacataaacgacgacgacgctataacccgcgaaactaccacccgctcccctaccacccccgcccctacgaccctacccgaacccaacctaacgcaacccgaccaaacccgaccgcgaaaaacgccgtcccgcccgcccgcccgaacccgtacccgccgcgacgccgatacgtcacgctacgtcaaaaccgcgccccgcgcgacgtcgctacctcgcgaccccgcccccaaacccgacatcctcgaaactactcgaacttctacccaacaaccgacgcgaaccgcgcgctatacaaaaacaaccgtaaaaaacgactcccgacgctaacaaacgaccgcccccaaacccgcaataccatacgcaaatacttacgcccgttcttcaattaacgatcttttaattaaaaacgcaaataaacctacttatttaaccatttacattccgaaatctacctctaaccgcgacctataaaataatcgttaaacttcctcgttcgttcaaatacttcgcgatttaacttactacgaacgccaacaaccaacgcttacaaaaaacgcgatccactctactctaaaaactttacaaaaacaaacgc

SEQ ID NO: 17169 - DNA, 649 bp, Artificial Sequence
  chemically treated genomic DNA (Homo sapiens) CpG-island No: 17169
gtgtagatcgagggttttgcgggggtgtgtggggttagcgtggagatcgagggttttgcgggggtgtgtggggttagcgtggagatcgagggttttgcgggggtgtgtggggttagcgtggagttcgagggttttgcgggggtgtgtggggttagcgtggagatcgagggttttgcgggggtgtgtggggttagcgtgtagatcgagggttttgcgggggtgtgtggggttagcgtggagttcgagagttttgcggggatgtgtggggttagcgtggagatcgagggttttgcgggggtgtgtggggttagcgtggagatcgagggttttgcgggggtgtgtggggttagcgtggagatcgagggttttgcgggggtgtgtggggttagcgtggagttcgagagttttgcggggatgtgtggggttagcgtggagatcgagggttttgtgggggtgtgtggggttagcgtggagatcgagggttttgcgggggtgtgtggggttagcgtggagatcgagggttttgcgggggtgtgtggggttagcgtggagatcgagggttttgcgggggtgtgtggggttagcgtggggtttgagggttttgcggggggtgtgtggggttagcgtggagaatgttttatgggttgat

SEQ ID NO: 17170 - DNA, 649 bp, Artificial Sequence
  chemically treated genomic DNA (Homo sapiens) CpG-island No: 17170
atcaacccataaaacattctccacgctaaccccacacaccccccgcaaaaccctcaaaccccacgctaaccccacacacccccgcaaaaccctcgatctccacgctaaccccacacacccccgcaaaaccctcgatctccacgctaaccccacacacccccgcaaaaccctcgatctccacgctaaccccacacacccccacaaaaccctcgatctccacgctaaccccacacatccccgcaaaactctcgaactccacgctaaccccacacacccccgcaaaaccctcgatctccacgctaaccccacacacccccgcaaaaccctcgatctccacgctaaccccacacacccccgcaaaaccctcgatctccacgctaaccccacacatccccgcaaaactctcgaactccacgctaaccccacacacccccgcaaaaccctcgatctacacgctaaccccacacacccccgcaaaaccctcgatctccacgctaaccccacacacccccgcaaaaccctcgaactccacgctaaccccacacacccccgcaaaaccctcgatctccacgctaaccccacacacccccgcaaaaccctcgatctccacgctaaccccacacacccccgcaaaaccctcgatctacac

SEQ ID NO: 17171 - DNA, 649 bp, Artificial Sequence
  chemically treated genomic DNA (Homo sapiens) CpG-island No: 17171
attagtttataaagtattttttacgttgattttatatatttttcgtaggatttttagattttacgttgattttatatattttcgtaggattttcggtttttacgttgattttatatattttcgtaggattttcggtttttacgttgattttatatattttcgtaggattttcggtttttacgttgattttatatatttttataggattttcggtttttacgttgattttatatattttcgtaggattttcgggttttacgttgattttatatattttcgtaggattttcggtttttacgttgattttatatattttcgtaggattttcggtttttacgttgattttatatattttcgtaggattttcggtttttacgttgattttatatattttcgtaggattttcgggttttacgttgattttatatattttcgtaggattttcggtttgtacgttgattttatatattttcgtaggattttcggtttttacgttgattttatatattttcgtaggattttcgggttttacgttgattttatatattttcgtaggattttcggtttttacgttgattttatatattttcgtaggattttcggtttttacgttgattttatatattttcgtaggattttcggtttgtat

SEQ ID NO: 17172 - DNA, 649 bp, Artificial Sequence
  chemically treated genomic DNA (Homo sapiens) CpG-island No: 17172
atacaaaccgaaaatcctacgaaaatatataaaatcaacgtaaaaaccgaaaatcctacgaaaatatataaaatcaacgtaaaaaccgaaaatcctacgaaaatatataaaatcaacgtaaaacccgaaaatcctacgaaaatatataaaatcaacgtaaaaaccgaaaatcctacgaaaatatataaaatcaacgtacaaaccgaaaatcctacgaaaatatataaaatcaacgtaaaacccgaaaatcctacgaaaatatataaaatcaacgtaaaaaccgaaaatcctacgaaaatatataaaatcaacgtaaaaaccgaaaatcctacgaaaatatataaaatcaacgtaaaaaccgaaaatcctacgaaaatatataaaatcaacgtaaaacccgaaaatcctacgaaaatatataaaatcaacgtaaaaaccgaaaatcctataaaaatatataaaatcaacgtaaaaaccgaaaatcctacgaaaatatataaaatcaacgtaaaaaccgaaaatcctacgaaaatatataaaatcaacgtaaaaaccgaaaatcctacgaaaatatataaaatcaacgtaaaatctaaaaatcctacgaaaaatatataaaatcaacgtaaaaaatactttataaactaat

SEQ ID NO: 17173 - DNA, 610 bp, Artificial Sequence
  chemically treated genomic DNA (Homo sapiens) CpG-island No: 17173
ggtcggggtcgattcggttagtttttttttcgggcgacgtttacgtgtttgcgcggtttttttggtatcgcggcgattagcgtttcgaggcgcgcggtattcgataggtggtatttgcgagtttcgtttatttcggtcgtttcgtttatttcggtcgtttcgtttcgcgcgtttacggagtatgtttagagtcgcggttacgcgttcgttcgaaggtttttgtcgggatagggcgtcgtttcgtgtcggttttcgtagagttcgcggttttcgtttgttcgggcgtcgttatggagcgtatcgagggggcgttcgtgggtcgttgcgtcgttttattttatttgcggtcgtttacgttgtattatcgttaggtgagttcgcgttttcgcgtttttcgcgttttcgtcggcggttcggtttacgattcgcgtttcgtttattatttttcgcgttgtcggtttcgtttcggagtttcgttttcgtttttcgtcgatttttcgggcggtcgtttgttcgttcgtcggatcgcgggtttttagatttagtgagtttttaggtcggggaggggtcgcgggagggatatttgagggggtattatttatttttttaa

SEQ ID NO: 17174 - DNA, 610 bp, Artificial Sequence
  chemically treated genomic DNA (Homo sapiens) CpG-island No: 17174
ttaaaaaaataaataataccccctcaaatatccctcccgcgacccctccccgacctaaaaactcactaaatctaaaaacccgcgatccgacgaacgaacaaacgaccgcccgaaaaatcgacgaaaaacgaaaacgaaactccgaaacgaaaccgacaacgcgaaaaataataaacgaaacgcgaatcgtaaaccgaaccgccgacgaaaacgcgaaaaacgcgaaaacgcgaactcacctaacgataatacaacgtaaacgaccgcaaataaaataaaacgacgcaacgacccacgaacgccccctcgatacgctccataacgacgcccgaacaaacgaaaaccgcgaactctacgaaaaccgacacgaaacgacgccctatcccgacaaaaaccttcgaacgaacgcgtaaccgcgactctaaacatactccgtaaacgcgcgaaacgaaacgaccgaaataaacgaaacgaccgaaataaacgaaactcgcaaataccacctatcgaataccgcgcgcctcgaaacgctaatcgccgcgataccaaaaaaaccgcgcaaacacgtaaacgtcgcccgaaaaaaaaactaaccgaatcgaccccgacc

SEQ ID NO: 17175 - DNA, 610 bp, Artificial Sequence
  chemically treated genomic DNA (Homo sapiens) CpG-island No: 17175
ttgaaaggatgagtggtgtttttttagatgtttttttcgcggttttttttcggtttgggggtttattgggtttgggaattcgcgattcggcgggcggataagcggtcgttcgggagatcggcgggaggcgggggcggggtttcggggcggggtcggtagcgcggaagatggtgggcggggcgcgggtcgtgggtcgggtcgtcggcgggggcgcgggggacgcgggggcgcgggtttatttggcggtaatgtagcgtgagcggtcgtaggtagggtgaggcggcgtagcggtttacggacgttttttcgatgcgttttatggcggcgttcggataggcgggggtcgcgagttttgcgggggtcgatacggggcggcgttttgtttcgataggagttttcgggcgggcgcgtgatcgcggttttgagtatgtttcgtgggcgcgcggggcggggcggtcgaggtgggcggggcggtcgaggtgggcggggttcgtaggtgttatttgtcgggtgtcgcgcgtttcggggcgttggtcgtcgcggtgttagggaagtcgcgtaggtacgtgggcgtcgttcgggggaaggattggtcgggtcgatttcggtt

SEQ ID NO: 17176 - DNA, 610 bp, Artificial Sequence
  chemically treated genomic DNA (Homo sapiens) CpG-island No: 17176
aaccgaaatcgacccgaccaatccttcccccgaacgacgcccacgtacctacgcgacttccctaacaccgcgacgaccaacgccccgaaacgcgcgacacccgacaaataacacctacgaaccccgcccacctcgaccgccccgcccacctcgaccgccccgccccgcgcgcccacgaaacatactcaaaaccgcgatcacgcgcccgcccgaaaactcctatcgaaacaaaacgccgccccgtatcgacccccgcaaaactcgcgacccccgcctatccgaacgccgccataaaacgcatcgaaaaaacgtccgtaaaccgctacgccgcctcaccctacctacgaccgctcacgctacattaccgccaaataaacccgcgcccccgcgtcccccgcgcccccgccgacgacccgacccacgacccgcgccccgcccaccatcttccgcgctaccgaccccgccccgaaaccccgcccccgcctcccgccgatctcccgaacgaccgcttatccgcccgccgaatcgcgaattcccaaacccaataaacccccaaaccgaaaaaaaaccgcgaaaaaaacatctaaaaaaacaccactcatcctttcaa

SEQ ID NO: 17177 - DNA, 1713 bp, Artificial Sequence
  chemically treated genomic DNA (Homo sapiens) CpG-island No: 17177
cggcgtcggcgtacgtttcgtcgatttacgcggaggtgtgagcggggttttcgcggttcgcgttgatttcgaggtttcgtgttttcgtcgttcgggcgttttggggggcgcgcgtcgggtcggggcgttggtaggcgacgttttttatcgtttttaaagtttggggcgttttcggattttttttcggttttatttcgcggcgcggtttcgtttttttatgtatatgtaggtgcgcgggtgacgaatgggcgagcgagttgttagtttcgtttcgaatttgttggttgcggtgtcgggagcgcgggcgcgtagagtcgaggtcgggattcgttgtttttatcgtcgtcgtcgtcgtcgtcgggtgggagtcgggtcgggtagtcggagcgcggtcgttagcgagtcggagttgtcgtcgtttttgtacgttcgtcgtttaggttcgcgcgtcgcggcgttgcgttcgatttcgttcgcgtcgtcgtcgtcgtcgtttttgtcgttgtcgttgtttttgcgggcgttcggagggcgggcgggcgttgggaggtcggcgcggcggttgggagtcgggcgcgggcggcggcggcggggtcgggcgggcgggtcgcgggggtaatgcgggcgtagggtcgggggcgtttttttcggcggttgttgttgttgttggcgttttgggtgtaggtgagcggggcggcgggggcggcgggggtcgcggacggggtatatcgggtcgtttttaggggtcgggcgggtattgtttggggtcgtcgtggttcggaagttttcgaggttgcgcgcggcggttggggtttcgggcgggcgcggttgggtgggggcggggcggcggggtttgtttttttatttttggcgttcggttcgtcgatttcggttcgcgttttttttcgttttttcgttgttttatttttaggcggcgcggtttatgggttatttcgagttgtagttgagcgcgttgcggaacgtgaacggggagttgttgagcggcgtttgttgtgacggcgacggtcggataacgcgcgcggggggttgcggttacgacgagtgcgatacgtacgtgcgcgtgtgttttaaggagtattaggttaaggtgacgtttacggggttttgtagttacggttacggcgttacgttcgtgttgggcggtaattttttttatttgtcgtcggcgggcgttgcgggggatcgagcgcgggcgcgggttcgggtcggcggcgattaggattcgggtttcgtcgttatttttttttagttcgtttggtcggtacgtgcgttttatttttcgtgttttagttttttttttttttttcgcgtttcggtttcgcgcgtttcgcgatttttaatatttgcggtcgggtttgcgtgcgagtcgcgcgcgtttaggcggggcggggtcggtagggggcgcgtgttttggggatttggttcgcgtttggttacgtgggcgcgtcggggtttcggggttatcgggagcggggtcgcggcgggggcggggcggcggcgtttcgcgtgcgcggcggtgtgcggcgtgtgtttgcgtcgttttgcgcgtgtttgtttgggtggggaggcgaggcgaggcgtttcggtttcgggtaggtcgcggtggtatgtgcgtagcgcgtgttggggttggtttagggtaggttttgattgagtcgtttcgggttcgtggttagtttgcgtttgttttgt

SEQ ID NO: 17178 - DNA, 1713 bp, Artificial Sequence
  chemically treated genomic DNA (Homo sapiens) CpG-island No: 17178
acaaaacaaacgcaaactaaccacgaacccgaaacgactcaatcaaaacctaccctaaaccaaccccaacacgcgctacgcacataccaccgcgacctacccgaaaccgaaacgcctcgcctcgcctccccacccaaacaaacacgcgcaaaacgacgcaaacacacgccgcacaccgccgcgcacgcgaaacgccgccgccccgcccccgccgcgaccccgctcccgataaccccgaaaccccgacgcgcccacgtaaccaaacgcgaaccaaatccccaaaacacgcgccccctaccgaccccgccccgcctaaacgcgcgcgactcgcacgcaaacccgaccgcaaatattaaaaatcgcgaaacgcgcgaaaccgaaacgcgaaaaaaaaaaaaaaaactaaaacacgaaaaataaaacgcacgtaccgaccaaacgaactaaaaaaaaataacgacgaaacccgaatcctaatcgccgccgacccgaacccgcgcccgcgctcgatcccccgcaacgcccgccgacgacaaataaaaaaaattaccgcccaacacgaacgtaacgccgtaaccgtaactacaaaaccccgtaaacgtcaccttaacctaatactccttaaaacacacgcgcacgtacgtatcgcactcgtcgtaaccgcaaccccccgcgcgcgttatccgaccgtcgccgtcacaacaaacgccgctcaacaactccccgttcacgttccgcaacgcgctcaactacaactcgaaataacccataaaccgcgccgcctaaaaataaaacaacgaaaaaacgaaaaaaaacgcgaaccgaaatcgacgaaccgaacgccaaaaataaaaaaacaaaccccgccgccccgcccccacccaaccgcgcccgcccgaaaccccaaccgccgcgcgcaacctcgaaaacttccgaaccacgacgaccccaaacaatacccgcccgacccctaaaaacgacccgatataccccgtccgcgacccccgccgcccccgccgccccgctcacctacacccaaaacgccaacaacaacaacaaccgccgaaaaaaacgcccccgaccctacgcccgcattacccccgcgacccgcccgcccgaccccgccgccgccgcccgcgcccgactcccaaccgccgcgccgacctcccaacgcccgcccgccctccgaacgcccgcaaaaacaacgacaacgacaaaaacgacgacgacgacgacgcgaacgaaatcgaacgcaacgccgcgacgcgcgaacctaaacgacgaacgtacaaaaacgacgacaactccgactcgctaacgaccgcgctccgactacccgacccgactcccacccgacgacgacgacgacgacgataaaaacaacgaatcccgacctcgactctacgcgcccgcgctcccgacaccgcaaccaacaaattcgaaacgaaactaacaactcgctcgcccattcgtcacccgcgcacctacatatacataaaaaaacgaaaccgcgccgcgaaataaaaccgaaaaaaaatccgaaaacgccccaaactttaaaaacgataaaaaacgtcgcctaccaacgccccgacccgacgcgcgccccccaaaacgcccgaacgacgaaaacacgaaacctcgaaatcaacgcgaaccgcgaaaaccccgctcacacctccgcgtaaatcgacgaaacgtacgccgacgccg

SEQ ID NO: 17179 - DNA, 1713 bp, Artificial Sequence
  chemically treated genomic DNA (Homo sapiens) CpG-island No: 17179
gtagggtaggcgtaggttggttacgggttcggggcggtttagttagggtttgttttagattagttttagtacgcgttgcgtatatgttatcgcggtttgttcgggatcggggcgtttcgtttcgtttttttatttagatagatacgcgtagggcgacgtaggtatacgtcgtatatcgtcgcgtacgcgggacgtcgtcgtttcgttttcgtcgcgatttcgttttcggtggtttcggggtttcggcgcgtttacgtggttaggcgcggattaagtttttagagtacgcgttttttgtcggtttcgtttcgtttgggcgcgcgcggttcgtacgtagattcggtcgtaggtgttgggggtcgcgaagcgcgcggggtcggggcgcggagagagagggaagggttggagtacgagggatggagcgtacgtatcggttaggcgaattggaaggggatgacgacgaggttcgggttttggtcgtcgtcggttcgggttcgcgttcgcgttcggtttttcgtagcgttcgtcggcggtaggtagaaggagttgtcgtttagtacgggcgtggcgtcgtggtcgtagttgtagggtttcgtgggcgttattttggtttggtattttttaaggtatacgcgtacgtacgtgtcgtattcgtcgtggtcgtagtttttcgcgcgcgttgttcggtcgtcgtcgttatagtaggcgtcgtttagtagtttttcgtttacgtttcgtagcgcgtttagttgtagttcgaaatagtttatgggtcgcgtcgtttaaaaataaggtagcgggagagcggagggaggcgcgggtcggggtcggcgggtcgggcgttaggggtgggggaataggtttcgtcgtttcgtttttatttagtcgcgttcgttcggagttttagtcgtcgcgcgtagtttcgagggttttcgaattacggcggttttaggtagtgttcgttcggtttttaggggcggttcggtgtgtttcgttcgcgattttcgtcgttttcgtcgtttcgtttatttgtatttagagcgttagtagtagtagtagtcgtcggggaaggcgttttcggttttgcgttcgtattgttttcgcgattcgttcgttcggtttcgtcgtcgtcgttcgcgttcggtttttagtcgtcgcgtcggttttttagcgttcgttcgtttttcgagcgttcgtagaggtagcggtagcggtagaggcggcggcggcggcggcgcgggcggggtcgagcgtagcgtcgcggcgcgcgggtttgggcggcgggcgtgtaggggcggcggtagtttcggttcgttggcggtcgcgtttcggttgttcggttcggtttttattcggcggcgacggcggcggcggtgaaggtagcgggtttcggtttcggttttgcgcgttcgcgttttcggtatcgtagttaataagttcggaacgagattgatagttcgttcgtttattcgttattcgcgtatttgtatatgtatgagggggcggggtcgcgtcgcggggtggggtcgggggggggttcgggggcgttttaggttttaaaggcggtggagggcgtcgtttgttagcgtttcggttcggcgcgcgttttttagggcgttcgggcggcgggggtacggggtttcggggttagcgcgggtcgcgggggtttcgtttatattttcgcgtgagtcggcgaggcgtgcgtcggcgtcg

SEQ ID NO: 17180 - DNA, 1713 bp, Artificial Sequence
  chemically treated genomic DNA (Homo sapiens) CpG-island No: 17180
cgacgccgacgcacgcctcgccgactcacgcgaaaatataaacgaaacccccgcgacccgcgctaaccccgaaaccccgtacccccgccgcccgaacgccctaaaaaacgcgcgccgaaccgaaacgctaacaaacgacgccctccaccgcctttaaaacctaaaacgcccccgaacccccccccgaccccaccccgcgacgcgaccccgccccctcatacatatacaaatacgcgaataacgaataaacgaacgaactatcaatctcgttccgaacttattaactacgataccgaaaacgcgaacgcgcaaaaccgaaaccgaaacccgctaccttcaccgccgccgccgtcgccgccgaataaaaaccgaaccgaacaaccgaaacgcgaccgccaacgaaccgaaactaccgccgcccctacacgcccgccgcccaaacccgcgcgccgcgacgctacgctcgaccccgcccgcgccgccgccgccgccgcctctaccgctaccgctacctctacgaacgctcgaaaaacgaacgaacgctaaaaaaccgacgcgacgactaaaaaccgaacgcgaacgacgacgacgaaaccgaacgaacgaatcgcgaaaacaatacgaacgcaaaaccgaaaacgccttccccgacgactactactactactaacgctctaaatacaaataaacgaaacgacgaaaacgacgaaaatcgcgaacgaaacacaccgaaccgcccctaaaaaccgaacgaacactacctaaaaccgccgtaattcgaaaaccctcgaaactacgcgcgacgactaaaactccgaacgaacgcgactaaataaaaacgaaacgacgaaacctattcccccacccctaacgcccgacccgccgaccccgacccgcgcctccctccgctctcccgctaccttatttttaaacgacgcgacccataaactatttcgaactacaactaaacgcgctacgaaacgtaaacgaaaaactactaaacgacgcctactataacgacgacgaccgaacaacgcgcgcgaaaaactacgaccacgacgaatacgacacgtacgtacgcgtataccttaaaaaataccaaaccaaaataacgcccacgaaaccctacaactacgaccacgacgccacgcccgtactaaacgacaactccttctacctaccgccgacgaacgctacgaaaaaccgaacgcgaacgcgaacccgaaccgacgacgaccaaaacccgaacctcgtcgtcatccccttccaattcgcctaaccgatacgtacgctccatccctcgtactccaacccttccctctctctccgcgccccgaccccgcgcgcttcgcgacccccaacacctacgaccgaatctacgtacgaaccgcgcgcgcccaaacgaaacgaaaccgacaaaaaacgcgtactctaaaaacttaatccgcgcctaaccacgtaaacgcgccgaaaccccgaaaccaccgaaaacgaaatcgcgacgaaaacgaaacgacgacgtcccgcgtacgcgacgatatacgacgtatacctacgtcgccctacgcgtatctatctaaataaaaaaacgaaacgaaacgccccgatcccgaacaaaccgcgataacatatacgcaacgcgtactaaaactaatctaaaacaaaccctaactaaaccgccccgaacccgtaaccaacctacgcctaccctac

SEQ ID NO: 17181 - DNA, 715 bp, Artificial Sequence
  chemically treated genomic DNA (Homo sapiens) CpG-island No: 17181
tcgtatcgtcgtgtttttcggtttaagttttaatattcgggcgaattggcgtgttttattagttcggtagtatgaattattattcgttagatattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttatttttattttagggtataaggggcgtggttattattttttgtcgttatattacgggttttgacgattttttttacgtttt

SEQ ID NO: 17182 - DNA, 715 bp, Artificial Sequence
  chemically treated genomic DNA (Homo sapiens) CpG-island No: 17182
aaaacgtaaaaaaaatcgtcaaaacccgtaatataacgacaaaaaataataaccacgccccttataccctaaaataaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaatatctaacgaataataattcatactaccgaactaataaaacacgccaattcgcccgaatattaaaacttaaaccgaaaaacacgacgatacga

SEQ ID NO: 17183 - DNA, 715 bp, Artificial Sequence
  chemically treated genomic DNA (Homo sapiens) CpG-island No: 17183
gaaacgtggaaaggatcgttaagattcgtgatatgacggtaaaaaatgatagttacgttttttatgttttgggatggggataagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtgtttgacggataatggtttatgttatcgggttaatgaaatacgttagttcgttcggatgttgggatttgaatcgaagaatacggcggtgcgg

SEQ ID NO: 17184 - DNA, 715 bp, Artificial Sequence
  chemically treated genomic DNA (Homo sapiens) CpG-island No: 17184
ccgcaccgccgtattcttcgattcaaatcccaacatccgaacgaactaacgtatttcattaacccgataacataaaccattatccgtcaaacactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttatccccatcccaaaacataaaaaacgtaactatcattttttaccgtcatatcacgaatcttaacgatcctttccacgtttc

SEQ ID NO: 17185 - DNA, 750 bp, Artificial Sequence
  chemically treated genomic DNA (Homo sapiens) CpG-island No: 17185
cggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttatttatcggtttagttcgggtttcgtttgcgtgtgtagtattttcggcggtttaggttgtgcgtgattgtgaagcggatttattttattgggtcgtgtagttaatttttcgggtatagtgtttggtttcgtcgttgttgagaatacggaagggatttcggcggtttttgttagtggttatatacggtcgggatatatttaagaagttatttttgttgttaagggatataaatcgggattttgggtggtt

SEQ ID NO: 17186 - DNA, 750 bp, Artificial Sequence
  chemically treated genomic DNA (Homo sapiens) CpG-island No: 17186
aaccacccaaaatcccgatttatatcccttaacaacaaaaataacttcttaaatatatcccgaccgtatataaccactaacaaaaaccgccgaaatcccttccgtattctcaacaacgacgaaaccaaacactatacccgaaaaattaactacacgacccaataaaataaatccgcttcacaatcacgcacaacctaaaccgccgaaaatactacacacgcaaacgaaacccgaactaaaccgataaataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccg

SEQ ID NO: 17187 - DNA, 750 bp, Artificial Sequence
  chemically treated genomic DNA (Homo sapiens) CpG-island No: 17187
gattatttagaatttcggtttatattttttggtaataagggtagttttttgggtatatttcggtcgtgtgtggttattgataagggtcgtcggaatttttttcgtgtttttagtagcggcggggttagatattatattcggaaggttaattatacgatttagtagagtaagttcgttttataattacgtatagtttggatcgtcggaaatgttgtatacgtaggcgaaattcgggttgaatcggtgggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcg

SEQ ID NO: 17188 - DNA, 750 bp, Artificial Sequence
  chemically treated genomic DNA (Homo sapiens) CpG-island No: 17188
cgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcacccaccgattcaacccgaatttcgcctacgtatacaacatttccgacgatccaaactatacgtaattataaaacgaacttactctactaaatcgtataattaaccttccgaatataatatctaaccccgccgctactaaaaacacgaaaaaaattccgacgacccttatcaataaccacacacgaccgaaatatacccaaaaaactacccttattaccaaaaaatataaaccgaaattctaaataatc

SEQ ID NO: 17189 - DNA, 842 bp, Artificial Sequence
  chemically treated genomic DNA (Homo sapiens) CpG-island No: 17189
ggttcggttcggtttcgtttttcggaattttattagcgggttacgcgtaggagggcgtgagttttcggatgtgtaggttttgtattgtcgtggtagttttgtcggacgcggtcgtagtgtttagaggtttaggtttatatcgttcgggcgggttttttgtttggttcgggttattagatttttatagtcgggaacgttattatttcgggcgttagtttttcggtttagtcggtttatagattttcgttttttatttttttagcggggaggggcgtagaggtattacgtgacgtttcgtattcgttcggttttggttatatgtggtacgtcgttgcgttagttatagttttggttgtaggagtttagttgtcgtttttcgttagcgggcggggcggggatttggtgttaggttttcgttaattcgttttcgtcgttttagttagttgttttagttcgggttcgatcgttatggagcggtgcggggtttacgtttgtttcgtgtgaggcgtatcgttgtcgtcgtcgcggacgtcgttttcgtttgtcgaggttttcggaattttcgtcgtttttcggagtttttcgtttttggtagtttgttatcgttttttgggcgggttcgaatgcgcgttcggtgaaggtgtaggttcggcgtcgttattgtcgtagttaggagatggttcgggttacggagtcgggattggaggtaagaagggtcgatagattgatttaggtcgggtcgggtcgcgggggttgtggtcggggtcgggtgggggtgggggttcgtaagttttgcggggagtttcggggagatttttcgggttggggttgtttaattaggt

SEQ ID NO: 17190 - DNA, 842 bp, Artificial Sequence
  chemically treated genomic DNA (Homo sapiens) CpG-island No: 17190
acctaattaaacaaccccaacccgaaaaatctccccgaaactccccgcaaaacttacgaacccccacccccacccgaccccgaccacaacccccgcgacccgacccgacctaaatcaatctatcgacccttcttacctccaatcccgactccgtaacccgaaccatctcctaactacgacaataacgacgccgaacctacaccttcaccgaacgcgcattcgaacccgcccaaaaaacgataacaaactaccaaaaacgaaaaactccgaaaaacgacgaaaattccgaaaacctcgacaaacgaaaacgacgtccgcgacgacgacaacgatacgcctcacacgaaacaaacgtaaaccccgcaccgctccataacgatcgaacccgaactaaaacaactaactaaaacgacgaaaacgaattaacgaaaacctaacaccaaatccccgccccgcccgctaacgaaaaacgacaactaaactcctacaaccaaaactataactaacgcaacgacgtaccacatataaccaaaaccgaacgaatacgaaacgtcacgtaatacctctacgcccctccccgctaaaaaaataaaaaacgaaaatctataaaccgactaaaccgaaaaactaacgcccgaaataataacgttcccgactataaaaatctaataacccgaaccaaacaaaaaacccgcccgaacgatataaacctaaacctctaaacactacgaccgcgtccgacaaaactaccacgacaatacaaaacctacacatccgaaaactcacgccctcctacgcgtaacccgctaataaaattccgaaaaacgaaaccgaaccgaacc

SEQ ID NO: 17191 - DNA, 842 bp, Artificial Sequence
  chemically treated genomic DNA (Homo sapiens) CpG-island No: 17191
gtttgattgagtagttttagttcggagggttttttcgaggtttttcgtagaatttgcgggtttttatttttattcggtttcggttataattttcgcggttcggttcggtttgggttagtttgtcggttttttttatttttagtttcggtttcgtagttcgaattattttttggttgcggtagtggcggcgtcgggtttgtatttttatcggacgcgtattcgagttcgtttagggggcggtgataggttgttaagggcgaggggtttcgggaggcggcgggggtttcggaggtttcgataaacgaaggcggcgttcgcggcggcggtagcgatgcgttttatacggaataggcgtaggtttcgtatcgttttatgacggtcgggttcgggttgggatagttgattgaggcggcgggggcgggttaacgaagatttggtattagattttcgtttcgttcgttggcgggggacggtagttggatttttgtagttagggttgtgattgacgtagcggcgtgttatatgtgattaagatcgggcgggtgcggggcgttacgtgatgtttttgcgttttttttcgttgggggagtagggggcgggggtttgtgggtcggttgggtcgggaggttgacgttcggggtggtgacgttttcggttgtgggggtttgatgattcgggttaggtaaaggattcgttcgagcggtataggtttgagtttttgggtattgcggtcgcgttcggtagggttgttacggtagtatagggtttgtatattcgggagtttacgtttttttgcgcgtagttcgttagtgaggtttcgaagggcggggtcgggtcgaatt

SEQ ID NO: 17192 - DNA, 842 bp, Artificial Sequence
  chemically treated genomic DNA (Homo sapiens) CpG-island No: 17192
aattcgacccgaccccgcccttcgaaacctcactaacgaactacgcgcaaaaaaacgtaaactcccgaatatacaaaccctatactaccgtaacaaccctaccgaacgcgaccgcaatacccaaaaactcaaacctataccgctcgaacgaatcctttacctaacccgaatcatcaaacccccacaaccgaaaacgtcaccaccccgaacgtcaacctcccgacccaaccgacccacaaacccccgccccctactcccccaacgaaaaaaaacgcaaaaacatcacgtaacgccccgcacccgcccgatcttaatcacatataacacgccgctacgtcaatcacaaccctaactacaaaaatccaactaccgtcccccgccaacgaacgaaacgaaaatctaataccaaatcttcgttaacccgcccccgccgcctcaatcaactatcccaacccgaacccgaccgtcataaaacgatacgaaacctacgcctattccgtataaaacgcatcgctaccgccgccgcgaacgccgccttcgtttatcgaaacctccgaaacccccgccgcctcccgaaacccctcgcccttaacaacctatcaccgccccctaaacgaactcgaatacgcgtccgataaaaatacaaacccgacgccgccactaccgcaaccaaaaaataattcgaactacgaaaccgaaactaaaaataaaaaaaaccgacaaactaacccaaaccgaaccgaaccgcgaaaattataaccgaaaccgaataaaaataaaaacccgcaaattctacgaaaaacctcgaaaaaaccctccgaactaaaactactcaatcaaac

SEQ ID NO: 17193 - DNA, 705 bp, Artificial Sequence
  chemically treated genomic DNA (Homo sapiens) CpG-island No: 17193
ggggtatcgacggagttttaatgacggtcgtgattggtgtaggattttgttaattttaggaaggttcgtagagaagtgaggaaaacgtggtggggggtatgcgcgatttggtaggcggtgttgtcgtttgttgtatttgagaggtttgcgtatgtcgacgtacggattcgaggcggggagtatgggaagaagcggttaggagtatgatttgattattgcgattatcgttaggggaagggaggagagggtgtagaaacggggacgagggtgggggaagggtaaggaggcgttcgagttggtgcgcggagtattttgggagacgtagtttagcgggagggggaagtcgaagattgcgcgtgtttaggagcgcggagcggttcgttgagcgtagaggtgagggcggggtttttttaatcgggagggttatcgtgtggacgggggcggtggttgtagattcggggatttcggttttttagtgagatcggaagcgcggggaacgaattcgggtagtttttgcgggagcgtttagggttagagcgagaggtttgttaattattattcgttgttacgacgataggttttgggagtttcgttttcggttgtttaggcgtcgtttggatttattttggtattttggagcggaagttgtcgtttggatttttgggaagtgtatttcgggatttttcgtaggtatttgttattttg

SEQ ID NO: 17194 - DNA, 705 bp, Artificial Sequence
  chemically treated genomic DNA (Homo sapiens) CpG-island No: 17194
caaaataacaaatacctacgaaaaatcccgaaatacacttcccaaaaatccaaacgacaacttccgctccaaaataccaaaataaatccaaacgacgcctaaacaaccgaaaacgaaactcccaaaacctatcgtcgtaacaacgaataataattaacaaacctctcgctctaaccctaaacgctcccgcaaaaactacccgaattcgttccccgcgcttccgatctcactaaaaaaccgaaatccccgaatctacaaccaccgcccccgtccacacgataaccctcccgattaaaaaaaccccgccctcacctctacgctcaacgaaccgctccgcgctcctaaacacgcgcaatcttcgacttccccctcccgctaaactacgtctcccaaaatactccgcgcaccaactcgaacgcctccttacccttcccccaccctcgtccccgtttctacaccctctcctcccttcccctaacgataatcgcaataatcaaatcatactcctaaccgcttcttcccatactccccgcctcgaatccgtacgtcgacatacgcaaacctctcaaatacaacaaacgacaacaccgcctaccaaatcgcgcataccccccaccacgttttcctcacttctctacgaaccttcctaaaattaacaaaatcctacaccaatcacgaccgtcattaaaactccgtcgatacccc

SEQ ID NO: 17195 - DNA, 705 bp, Artificial Sequence
  chemically treated genomic DNA (Homo sapiens) CpG-island No: 17195
taagatggtaggtatttacggagggtttcgaaatatattttttagaagtttaggcggtaattttcgttttagggtgttaaggtaggtttagacgacgtttaggtaatcgggggcggggtttttaaagtttgtcgtcgtggtaacgagtagtgattgataagtttttcgttttagttttgggcgttttcgtaaggattgttcggattcgtttttcgcgttttcggttttattggggagtcggaattttcgagtttgtagttatcgttttcgtttatacgatagttttttcggttaagaggatttcgtttttatttttgcgtttagcgggtcgtttcgcgtttttgagtacgcgtagttttcgatttttttttttcgttggattacgttttttaggatgtttcgcgtattagttcgagcgtttttttgttttttttttattttcgttttcgtttttatatttttttttttttttttttagcggtggtcgtaatgattaggttatatttttggtcgtttttttttatgtttttcgtttcgaattcgtgcgtcggtatgcgtaagttttttaggtataatagacggtagtatcgtttattagatcgcgtatgttttttattacgttttttttatttttttacgggtttttttgagattagtaggattttgtattaattacggtcgttattagaatttcgtcggtgtttt

SEQ ID NO: 17196 - DNA, 705 bp, Artificial Sequence
  chemically treated genomic DNA (Homo sapiens) CpG-island No: 17196
aaaacaccgacgaaattctaataacgaccgtaattaatacaaaatcctactaatctcaaaaaaacccgtaaaaaaataaaaaaaacgtaataaaaaacatacgcgatctaataaacgatactaccgtctattatacctaaaaaacttacgcataccgacgcacgaattcgaaacgaaaaacataaaaaaaaacgaccaaaaatataacctaatcattacgaccaccgctaaaaaaaaaaaaaaaaaaatataaaaacgaaaacgaaaataaaaaaaaaacaaaaaaacgctcgaactaatacgcgaaacatcctaaaaaacgtaatccaacgaaaaaaaaaaatcgaaaactacgcgtactcaaaaacgcgaaacgacccgctaaacgcaaaaataaaaacgaaatcctcttaaccgaaaaaactatcgtataaacgaaaacgataactacaaactcgaaaattccgactccccaataaaaccgaaaacgcgaaaaacgaatccgaacaatccttacgaaaacgcccaaaactaaaacgaaaaacttatcaatcactactcgttaccacgacgacaaactttaaaaaccccgcccccgattacctaaacgtcgtctaaacctaccttaacaccctaaaacgaaaattaccgcctaaacttctaaaaaatatatttcgaaaccctccgtaaatacctaccatctta

SEQ ID NO: 17197 - DNA, 1119 bp, Artificial Sequence
  chemically treated genomic DNA (Homo sapiens) CpG-island No: 17197
acgggtgagcgattattcgtgtgtagcgagtgcggtcgtagttttagtcgtagttcgtatttgttgcgttattagtttacgtatatcgaggagcggtcgttcgtgtgcggcgattgtggttagggtttcgtgcgtagcgcgcgtttggaagagtatcggagagtgtatacgggcgaatagttttttcgttgcgttgagtgcggttagagttttcggtagcgttttaatttgttgtagtattagcgtatttacggcgatttttcgggttttggcgttaagttttcggttttttttggtgcgttcgagtttttcggttttttttcgtgtagcgagtgtcgcgagagtttcgcgcggcgcgtcgtgttgttggagtattaggcggtatatacgggcgataagttttttggttgcgtcgagtgcggcgagcgtttcggtcgtcgtttagtgttgttgtagtatcggcgcgtgtatagtggcgagcggtttttcgtttgtgtcgagtgcggttagagttttcggtagcgttttaatttgacgtagtatcggcgtatttatatcggggagcggtttttcgtttgcgtcgagtgtggtaaggtttttcgttagcggtttacgtttacgtagtattttcgcgtatatacgggcgagaaattttttgtttgtttcgagtgtggttagcgttttagttagcgttttaagtttacgcgttattagaggatatatatcggcgaaaagttttattattgcggtgagtgcggtttgggttttacgtaggtttcgcggtttatcgagtattagcgtatttatacgggcgaacggtttttcgtttgtttcgagtgcggttagagttttcggtagtacgttaattttatttagtatcggcgtatttatacgggtgaacggttttacgtatgttttgagtgtggtaaggtttttcgttagcggtttacgtttacgtagtatttgcgtatttatcgacgagagaagtttttcgtttgttaggattgtggtcgtcgtttttattagagtattaagtttatttagtattagcgcgtttatagcgtcgagtagttttagtcgggacgtattgtgttcgttatggttagaatatttattttt

SEQ ID NO: 17198 - DNA, 1119 bp, Artificial Sequence
  chemically treated genomic DNA (Homo sapiens) CpG-island No: 17198
aaaaataaatattctaaccataacgaacacaatacgtcccgactaaaactactcgacgctataaacgcgctaatactaaataaacttaatactctaataaaaacgacgaccacaatcctaacaaacgaaaaacttctctcgtcgataaatacgcaaatactacgtaaacgtaaaccgctaacgaaaaaccttaccacactcaaaacatacgtaaaaccgttcacccgtataaatacgccgatactaaataaaattaacgtactaccgaaaactctaaccgcactcgaaacaaacgaaaaaccgttcgcccgtataaatacgctaatactcgataaaccgcgaaacctacgtaaaacccaaaccgcactcaccgcaataataaaacttttcgccgatatatatcctctaataacgcgtaaacttaaaacgctaactaaaacgctaaccacactcgaaacaaacaaaaaatttctcgcccgtatatacgcgaaaatactacgtaaacgtaaaccgctaacgaaaaaccttaccacactcgacgcaaacgaaaaaccgctccccgatataaatacgccgatactacgtcaaattaaaacgctaccgaaaactctaaccgcactcgacacaaacgaaaaaccgctcgccactatacacgcgccgatactacaacaacactaaacgacgaccgaaacgctcgccgcactcgacgcaaccaaaaaacttatcgcccgtatataccgcctaatactccaacaacacgacgcgccgcgcgaaactctcgcgacactcgctacacgaaaaaaaaccgaaaaactcgaacgcaccaaaaaaaaccgaaaacttaacgccaaaacccgaaaaatcgccgtaaatacgctaatactacaacaaattaaaacgctaccgaaaactctaaccgcactcaacgcaacgaaaaaactattcgcccgtatacactctccgatactcttccaaacgcgcgctacgcacgaaaccctaaccacaatcgccgcacacgaacgaccgctcctcgatatacgtaaactaataacgcaacaaatacgaactacgactaaaactacgaccgcactcgctacacacgaataatcgctcacccgt

SEQ ID NO: 17199 - DNA, 1119 bp, Artificial Sequence
  chemically treated genomic DNA (Homo sapiens) CpG-island No: 17199
ggaggtaggtgttttgattatggcggatatagtgcgtttcggttggagttattcggcgttgtggacgcgttggtgttgaatgagtttggtgttttggtggaagcggcggttatagttttggtaggcgaagggtttttttcgtcggtgggtgcgtagatgttgcgtgagcgtgggtcgttggcggaaggttttgttatatttagggtatgcgtagggtcgtttattcgtgtggatgcgtcggtgttgggtgaggttggcgtgttgtcgaaagttttggtcgtattcggggtaggcgaagggtcgttcgttcgtgtggatgcgttggtgttcggtgagtcgcgagatttgcgtgaagtttaggtcgtatttatcgtagtggtagggtttttcgtcggtgtgtgttttttgatgacgcgtgagtttgaggcgttggttgaagcgttggttatattcggggtaggtaaagggtttttcgttcgtgtgtacgcggagatgttgcgtgagcgtaggtcgttggcggaaggttttgttatattcggcgtaggcgaagggtcgtttttcggtgtggatgcgtcggtgttgcgttaggttggagcgttgtcggaagttttggtcgtattcggtataggcgaagggtcgttcgttattgtgtacgcgtcggtgttgtagtagtattgagcggcggtcgaagcgttcgtcgtattcgacgtagttaaaggatttgtcgttcgtgtgtatcgtttggtgttttagtagtacggcgcgtcgcgcgaagttttcgcggtattcgttgtacggaaaggggtcgggaggttcgggcgtattaggaggggtcgggggtttagcgttagggttcgggggatcgtcgtggatgcgttggtgttgtagtagattggagcgttgtcggaagttttggtcgtatttagcgtaacggaaaggttgttcgttcgtgtgtatttttcgatgtttttttaggcgcgcgttgcgtacgaagttttggttatagtcgtcgtatacgaacggtcgtttttcggtgtgcgtaagttggtggcgtagtaggtgcgagttgcggttgaagttgcggtcgtattcgttgtatacgaatggtcgtttattcgt

SEQ ID NO: 17200 - DNA, 1119 bp, Artificial Sequence
  chemically treated genomic DNA (Homo sapiens) CpG-island No: 17200
acgaataaacgaccattcgtatacaacgaatacgaccgcaacttcaaccgcaactcgcacctactacgccaccaacttacgcacaccgaaaaacgaccgttcgtatacgacgactataaccaaaacttcgtacgcaacgcgcgcctaaaaaaacatcgaaaaatacacacgaacgaacaacctttccgttacgctaaatacgaccaaaacttccgacaacgctccaatctactacaacaccaacgcatccacgacgatcccccgaaccctaacgctaaacccccgacccctcctaatacgcccgaacctcccgacccctttccgtacaacgaataccgcgaaaacttcgcgcgacgcgccgtactactaaaacaccaaacgatacacacgaacgacaaatcctttaactacgtcgaatacgacgaacgcttcgaccgccgctcaatactactacaacaccgacgcgtacacaataacgaacgacccttcgcctataccgaatacgaccaaaacttccgacaacgctccaacctaacgcaacaccgacgcatccacaccgaaaaacgacccttcgcctacgccgaatataacaaaaccttccgccaacgacctacgctcacgcaacatctccgcgtacacacgaacgaaaaaccctttacctaccccgaatataaccaacgcttcaaccaacgcctcaaactcacgcgtcatcaaaaaacacacaccgacgaaaaaccctaccactacgataaatacgacctaaacttcacgcaaatctcgcgactcaccgaacaccaacgcatccacacgaacgaacgacccttcgcctaccccgaatacgaccaaaactttcgacaacacgccaacctcacccaacaccgacgcatccacacgaataaacgaccctacgcataccctaaatataacaaaaccttccgccaacgacccacgctcacgcaacatctacgcacccaccgacgaaaaaaacccttcgcctaccaaaactataaccgccgcttccaccaaaacaccaaactcattcaacaccaacgcgtccacaacgccgaataactccaaccgaaacgcactatatccgccataatcaaaacacctacctcc

SEQ ID NO: 17201 - DNA, 506 bp, Artificial Sequence
  chemically treated genomic DNA (Homo sapiens) CpG-island No: 17201
ggcgcgtagacgtatcgtatttttattttttcgcgtagagttcgacgtaataattcgtataacgaaaagcgatagttttcgcgtagacgaagaaaatagaagataaaggtaatatagattatattagttttataatatatagataatagaaaaagtatacgcggggatcgcgagtaacggtttaatattataggagagggtggtcgacgttatcgagtatcggaggaggcgagagtagcgtttacgacggttttagacgaaacgtagagagaacgcgcgagagttaaaaggaggaacgagtataagcggaacgcgtttaggaaagtatttataagcgcgcggcgttatttaggcgtaacgcgggcgatattttttagtatagtatttatacgtattcgtcgatcggacgcgttatatttttttcgtaggttcgaggcggagaatttaaggataagaagacgaagtaggagagacgtagataataataacggatcgcggtcggggag

SEQ ID NO: 17202 - DNA, 506 bp, Artificial Sequence
  chemically treated genomic DNA (Homo sapiens) CpG-island No: 17202
ctccccgaccgcgatccgttattattatctacgtctctcctacttcgtcttcttatccttaaattctccgcctcgaacctacgaaaaaaatataacgcgtccgatcgacgaatacgtataaatactatactaaaaaatatcgcccgcgttacgcctaaataacgccgcgcgcttataaatactttcctaaacgcgttccgcttatactcgttcctccttttaactctcgcgcgttctctctacgtttcgtctaaaaccgtcgtaaacgctactctcgcctcctccgatactcgataacgtcgaccaccctctcctataatattaaaccgttactcgcgatccccgcgtatactttttctattatctatatattataaaactaatataatctatattacctttatcttctattttcttcgtctacgcgaaaactatcgcttttcgttatacgaattattacgtcgaactctacgcgaaaaaataaaaatacgatacgtctacgcgcc

SEQ ID NO: 17203 - DNA, 506 bp, Artificial Sequence
  chemically treated genomic DNA (Homo sapiens) CpG-island No: 17203
tttttcggtcgcggttcgttgttgttgtttgcgttttttttgtttcgtttttttgtttttgggtttttcgtttcgggtttgcggggggggtgtggcgcgttcggtcggcgggtgcgtgtgggtgttgtgttggggggtgtcgttcgcgttgcgtttgggtggcgtcgcgcgtttgtgggtgtttttttgggcgcgtttcgtttgtgttcgtttttttttttagttttcgcgcgttttttttgcgtttcgtttggggtcgtcgtgggcgttgttttcgtttttttcggtgttcggtggcgtcggttatttttttttgtggtgttgggtcgttgttcgcggttttcgcgtgtgttttttttgttgtttgtgtgttgtggggttggtgtggtttatgttgtttttgttttttgtttttttcgtttgcgcgggggttgtcgtttttcgttgtgcgggttgttgcgtcgggttttgcgcgaggaggtgggagtgcggtgcgtttgcgcgtt

SEQ ID NO: 17204 - DNA, 506 bp, Artificial Sequence
  chemically treated genomic DNA (Homo sapiens) CpG-island No: 17204
aacgcgcaaacgcaccgcactcccacctcctcgcgcaaaacccgacgcaacaacccgcacaacgaaaaacgacaacccccgcgcaaacgaaaaaaacaaaaaacaaaaacaacataaaccacaccaaccccacaacacacaaacaacaaaaaaaacacacgcgaaaaccgcgaacaacgacccaacaccacaaaaaaaaataaccgacgccaccgaacaccgaaaaaaacgaaaacaacgcccacgacgaccccaaacgaaacgcaaaaaaaacgcgcgaaaactaaaaaaaaaaacgaacacaaacgaaacgcgcccaaaaaaacacccacaaacgcgcgacgccacccaaacgcaacgcgaacgacaccccccaacacaacacccacacgcacccgccgaccgaacgcgccacaccccccccgcaaacccgaaacgaaaaacccaaaaacaaaaaaacgaaacaaaaaaaacgcaaacaacaacaacgaaccgcgaccgaaaaa

SEQ ID NO: 17205 - DNA, 549 bp, Artificial Sequence
  chemically treated genomic DNA (Homo sapiens) CpG-island No: 17205
gattagggtcgaatagtgaattttatcggttggtcgttgatttgtatatcggagtatatagtaattagattattagcgatataattaatcggaatggttataatgttcgttagtacgtcgagcgttagataacgacggttagaaggttcgataatgtcgagcgttatcggaatggaaaatataatcgttggttttattatcgattcgagaattaatttagagtatagttacgcggttacgtcgtcgttcgttagttttttggcgaggaagaagtcgtttatatcgtacgttagtagtgtttcggcgaatatcgatgggttagcgtcgagtatttcgtaaatcggaataattatcggttcgagaacgtgagttagtatcggtgttagcgcggttatatcgattatcgttaggtttagtgcgtttattgttataaagtttttttcgaattgatcgtttgatttttcgatatttttatcgaatttatcgaggaaacgagtagaatcgtcgaattgcgataggattttgtttacggtagttattagtataaag

SEQ ID NO: 17206 - DNA, 549 bp, Artificial Sequence
  chemically treated genomic DNA (Homo sapiens) CpG-island No: 17206
ctttatactaataactaccgtaaacaaaatcctatcgcaattcgacgattctactcgtttcctcgataaattcgataaaaatatcgaaaaatcaaacgatcaattcgaaaaaaactttataacaataaacgcactaaacctaacgataatcgatataaccgcgctaacaccgatactaactcacgttctcgaaccgataattattccgatttacgaaatactcgacgctaacccatcgatattcgccgaaacactactaacgtacgatataaacgacttcttcctcgccaaaaaactaacgaacgacgacgtaaccgcgtaactatactctaaattaattctcgaatcgataataaaaccaacgattatattttccattccgataacgctcgacattatcgaaccttctaaccgtcgttatctaacgctcgacgtactaacgaacattataaccattccgattaattatatcgctaataatctaattactatatactccgatatacaaatcaacgaccaaccgataaaattcactattcgaccctaatc

SEQ ID NO: 17207 - DNA, 549 bp, Artificial Sequence
  chemically treated genomic DNA (Homo sapiens) CpG-island No: 17207
ttttatgttgatagttgtcgtagataggattttgtcgtagttcggcggttttgttcgttttttcggtaagttcggtaaaagtatcgaaggattaggcggttagttcgaagaaggttttatggtaatgggcgtattgggtttggcgatggtcggtatgatcgcgttggtatcggtattggtttacgttttcgggtcggtaattatttcggtttacgaaatgttcggcgttaatttatcgatgttcgtcggaatattgttggcgtgcgatatgggcggtttttttttcgttaaagagttggcgggcggcgacgtagtcgcgtggttatattttgggttaattttcgggtcgatgatggggttaacgattgtgttttttatttcggtggcgttcggtattatcgaattttttgatcgtcgttatttggcgttcggcgtgttggcgggtattgtgattatttcgattggttgtatcgttggtggtttggttgttatgtatttcggtgtgtagattaacggttagtcggtggaatttattgttcggttttgatt

SEQ ID NO: 17208 - DNA, 549 bp, Artificial Sequence
  chemically treated genomic DNA (Homo sapiens) CpG-island No: 17208
aatcaaaaccgaacaataaattccaccgactaaccgttaatctacacaccgaaatacataacaaccaaaccaccaacgatacaaccaatcgaaataatcacaatacccgccaacacgccgaacgccaaataacgacgatcaaaaaattcgataataccgaacgccaccgaaataaaaaacacaatcgttaaccccatcatcgacccgaaaattaacccaaaatataaccacgcgactacgtcgccgcccgccaactctttaacgaaaaaaaaaccgcccatatcgcacgccaacaatattccgacgaacatcgataaattaacgccgaacatttcgtaaaccgaaataattaccgacccgaaaacgtaaaccaataccgataccaacgcgatcataccgaccatcgccaaacccaatacgcccattaccataaaaccttcttcgaactaaccgcctaatccttcgatacttttaccgaacttaccgaaaaaacgaacaaaaccgccgaactacgacaaaatcctatctacgacaactatcaacataaaa

SEQ ID NO: 17209 - DNA, 770 bp, Artificial Sequence
  chemically treated genomic DNA (Homo sapiens) CpG-island No: 17209
cgcgttgggcgtttggtattagaacgattcggtattggtgaaagaatttgtcgaattgttgtggttgaaaggcgatgaatttgttatcgtcgagggtaaaacgttgtttttgaacgaagcgttatagtggtatttcgaattgatcgttaatatcgttaatattgttgagaattacgttacgtttattcgtagtgaaatattgttgtcgttggtgggcgataaagcgaagttatagtattacgtcgcgacgacgtcgattgttgatatggtgcgttttttttcggtatagtttgatgtcgaagcgttaattaatttgttgcgttcgttgacgtcgcgtttgtattttatcgttttttcgtaggcggaagtcgagaacgaagtatacgttatcgttggtgtggtgcgttacgacgtggaaggtcgcgttcgtgtcggtggtgtttttagttttttcgttgatcgcgtggaagaagagggcgaagttcgcgtatttatcgtaatataacgataattttcgtttgttagttaatttagaaatttcggtgattatgattgggtttaggtatcggtatagcgtcgtttcgcgtttttatgtagtaacgcgtcgtcgacgaagcgttaggtaaaaattggttgttttttggtaattcgtattttacggaagattttttgtattaggtggagtggtagcgttacgttaaagatggcgtgttgatacgtatcgattttgtttggtcgcgcgattaaaaagaaaaagtttacgtataaga

SEQ ID NO: 17210 - DNA, 770 bp, Artificial Sequence
  chemically treated genomic DNA (Homo sapiens) CpG-island No: 17210
tcttatacgtaaactttttctttttaatcgcgcgaccaaacaaaatcgatacgtatcaacacgccatctttaacgtaacgctaccactccacctaatacaaaaaatcttccgtaaaatacgaattaccaaaaaacaaccaatttttacctaacgcttcgtcgacgacgcgttactacataaaaacgcgaaacgacgctataccgatacctaaacccaatcataatcaccgaaatttctaaattaactaacaaacgaaaattatcgttatattacgataaatacgcgaacttcgccctcttcttccacgcgatcaacgaaaaaactaaaaacaccaccgacacgaacgcgaccttccacgtcgtaacgcaccacaccaacgataacgtatacttcgttctcgacttccgcctacgaaaaaacgataaaatacaaacgcgacgtcaacgaacgcaacaaattaattaacgcttcgacatcaaactataccgaaaaaaaacgcaccatatcaacaatcgacgtcgtcgcgacgtaatactataacttcgctttatcgcccaccaacgacaacaatatttcactacgaataaacgtaacgtaattctcaacaatattaacgatattaacgatcaattcgaaataccactataacgcttcgttcaaaaacaacgttttaccctcgacgataacaaattcatcgcctttcaaccacaacaattcgacaaattctttcaccaataccgaatcgttctaataccaaacgcccaacgcg

SEQ ID NO: 17211 - DNA, 770 bp, Artificial Sequence
  chemically treated genomic DNA (Homo sapiens) CpG-island No: 17211
ttttgtacgtaaattttttttttttgatcgcgcgattaggtaagatcgatacgtgttagtacgttatttttgacgtagcgttgttattttatttggtataggaagtttttcgtaaagtgcggattattaaagaatagttagtttttatttggcgtttcgtcggcggcgcgttgttgtataaaggcgcggaacggcgttatatcggtgtttgggtttaattataattatcggggtttttggattggttggtaggcggaagttatcgttatgttgcgataaatacgcggatttcgttttttttttttacgcggttagcgaggaagttggaggtattatcggtacgggcgcggttttttacgtcgtaacgtattatattaacggtgacgtgtatttcgttttcgattttcgtttgcgaggaggcgatggaatatagacgcggcgttagcgggcgtagtagattaattagcgtttcggtattaagttgtgtcggggagaaacgtattatgttaataatcggcgtcgtcgcggcgtaatgttgtaatttcgttttatcgtttattagcggtagtagtgttttattgcgggtaagcgtggcgtaatttttaataatgttggcggtgttgacggttagttcgaagtgttattgtagcgtttcgtttagaggtaacgttttgttttcgacggtgataggtttatcgttttttagttatagtagttcgataagtttttttattagtgtcggatcgttttgatattagacgtttagcgcg

SEQ ID NO: 17212 - DNA, 770 bp, Artificial Sequence
  chemically treated genomic DNA (Homo sapiens) CpG-island No: 17212
cgcgctaaacgtctaatatcaaaacgatccgacactaataaaaaaacttatcgaactactataactaaaaaacgataaacctatcaccgtcgaaaacaaaacgttacctctaaacgaaacgctacaataacacttcgaactaaccgtcaacaccgccaacattattaaaaattacgccacgcttacccgcaataaaacactactaccgctaataaacgataaaacgaaattacaacattacgccgcgacgacgccgattattaacataatacgtttctccccgacacaacttaataccgaaacgctaattaatctactacgcccgctaacgccgcgtctatattccatcgcctcctcgcaaacgaaaatcgaaaacgaaatacacgtcaccgttaatataatacgttacgacgtaaaaaaccgcgcccgtaccgataatacctccaacttcctcgctaaccgcgtaaaaaaaaaaaacgaaatccgcgtatttatcgcaacataacgataacttccgcctaccaaccaatccaaaaaccccgataattataattaaacccaaacaccgatataacgccgttccgcgcctttatacaacaacgcgccgccgacgaaacgccaaataaaaactaactattctttaataatccgcactttacgaaaaacttcctataccaaataaaataacaacgctacgtcaaaaataacgtactaacacgtatcgatcttacctaatcgcgcgatcaaaaaaaaaaaatttacgtacaaaa

SEQ ID NO: 17213 - DNA, 1218 bp, Artificial Sequence
  chemically treated genomic DNA (Homo sapiens) CpG-island No: 17213
ggcgttaaaatttacgcgaaacgcgtggtggttaaatttcgtttgttttagtttataaattagcgcgtaaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtatagcgggcggcgcgcgttaggcgggcgttaattttattggcgtttttacggttacggttttttaggcgttggcggaggattttcggcgaaatttgtaaatagacgggtagtagcgtcgattgatagcgcgttcgcgtttgcggtagatgggcgcgtgagtcgttgattagtacgtcgaattcggcgtgtagttagagattaatttcgacgtcgacgttataatatagatcgttagcgtgttagtttaaggttaatagattttgtttcgcgcgggtaaaaatttttgttcgtttaggggcgatatggtttttattttcggcgttgtgtatcgcgcgttatgtagcgatgcgttattagtaattgagtttgttttcgtagtcggagtttcgttagtaggtttgtttttttcggagtcggacggttttattaattaaattagtttttttattattagaatattcgtgtattttgacgttagacgtggtcgatatgaatatgattgtttttgcgatgcgttagtattaggtcggcgcgtttgttttcgttaattatttcgcgattttggagattaagcgtttgcgttggatttttagttattagttttatcgtttgcggtagcgtaaagcggttgttttggttatcggcgacgcgaaatgtcgtatcgagtaggttggcggggtagtagtcggaagagaggatatttagtaggttaagttgcgttagtttattggtcgttacgttgtcggagtgcgagtcgtcgcgtataatattcggcgcgtttattagtacgtttatgttatgtttgcgcgaggttttcgtcgtttcgaacgtggtgggaaattcggcgattacgttgttaagttggtgagatttagtaacgtgggcgtgggtggcgttatcgtggttggtaagttgtaatgtttcgcgcgcggtataggtgcggcgatggattcgcgattcggttgcgattagcgtgcggcgagcgttagttgttcggtttcgt

SEQ ID NO: 17214 - DNA, 1218 bp, Artificial Sequence
  chemically treated genomic DNA (Homo sapiens) CpG-island No: 17214
acgaaaccgaacaactaacgctcgccgcacgctaatcgcaaccgaatcgcgaatccatcgccgcacctataccgcgcgcgaaacattacaacttaccaaccacgataacgccacccacgcccacgttactaaatctcaccaacttaacaacgtaatcgccgaatttcccaccacgttcgaaacgacgaaaacctcgcgcaaacataacataaacgtactaataaacgcgccgaatattatacgcgacgactcgcactccgacaacgtaacgaccaataaactaacgcaacttaacctactaaatatcctctcttccgactactaccccgccaacctactcgatacgacatttcgcgtcgccgataaccaaaacaaccgctttacgctaccgcaaacgataaaactaataactaaaaatccaacgcaaacgcttaatctccaaaatcgcgaaataattaacgaaaacaaacgcgccgacctaatactaacgcatcgcaaaaacaatcatattcatatcgaccacgtctaacgtcaaaatacacgaatattctaataataaaaaaactaatttaattaataaaaccgtccgactccgaaaaaaacaaacctactaacgaaactccgactacgaaaacaaactcaattactaataacgcatcgctacataacgcgcgatacacaacgccgaaaataaaaaccatatcgcccctaaacgaacaaaaatttttacccgcgcgaaacaaaatctattaaccttaaactaacacgctaacgatctatattataacgtcgacgtcgaaattaatctctaactacacgccgaattcgacgtactaatcaacgactcacgcgcccatctaccgcaaacgcgaacgcgctatcaatcgacgctactacccgtctatttacaaatttcgccgaaaatcctccgccaacgcctaaaaaaccgtaaccgtaaaaacgccaataaaattaacgcccgcctaacgcgcgccgcccgctatactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgatttacgcgctaatttataaactaaaacaaacgaaatttaaccaccacgcgtttcgcgtaaattttaacgcc

SEQ ID NO: 17215 - DNA, 1218 bp, Artificial Sequence
  chemically treated genomic DNA (Homo sapiens) CpG-island No: 17215
acgaagtcgagtaattggcgttcgtcgtacgttggtcgtagtcgaatcgcgaatttatcgtcgtatttgtgtcgcgcgcgaaatattgtagtttgttagttacgatgacgttatttacgtttacgttgttgaattttattagtttggtagcgtgatcgtcgaattttttattacgttcgaagcggcggaagtttcgcgtaagtatggtatgaacgtgttgatgggcgcgtcgaatattgtgcgcggcggttcgtatttcggtaacgtggcggttagtgaattggcgtagtttggtttgttggatattttttttttcgattattatttcgttagtttgttcgatgcggtatttcgcgtcgtcgatgattagagtaatcgttttacgttgtcgtaggcggtgaagttggtgattaaaaatttagcgtaggcgtttaatttttaggatcgcggggtgattggcgagggtaaacgcgtcgatttggtgttggcgtatcgtaaggataattatatttatatcgattacgtttggcgttagggtatacgggtgttttgatgatgggaaaattgatttggttaatggggtcgttcggtttcgggaaagatagatttgttggcggaatttcgattgcgggaataaatttagttattggtggcgtatcgttatataacgcgcgatgtatagcgtcggaagtgaaaattatatcgtttttgagcgagtaggagtttttattcgcgcggggtaaaatttgttggttttaagttggtacgttaacggtttgtattatggcgtcggcgtcgagattgatttttggttgtacgtcggattcgacgtgttggttaacggtttacgcgtttatttgtcgtaggcgcgggcgcgttattaatcggcgttgttgttcgtttgtttataggtttcgtcggagatttttcgttagcgtttggaaaatcgtggtcgtgaaaacgttagtgaaattaacgttcgtttggcgcgcgtcgttcgttatattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggtttacgcgttgatttgtgagttaaaataggcggagtttgattattacgcgtttcgcgtgggttttaacgtt

SEQ ID NO: 17216 - DNA, 1218 bp, Artificial Sequence
  chemically treated genomic DNA (Homo sapiens) CpG-island No: 17216
aacgttaaaacccacgcgaaacgcgtaataatcaaactccgcctattttaactcacaaatcaacgcgtaaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatataacgaacgacgcgcgccaaacgaacgttaatttcactaacgttttcacgaccacgattttccaaacgctaacgaaaaatctccgacgaaacctataaacaaacgaacaacaacgccgattaataacgcgcccgcgcctacgacaaataaacgcgtaaaccgttaaccaacacgtcgaatccgacgtacaaccaaaaatcaatctcgacgccgacgccataatacaaaccgttaacgtaccaacttaaaaccaacaaattttaccccgcgcgaataaaaactcctactcgctcaaaaacgatataattttcacttccgacgctatacatcgcgcgttatataacgatacgccaccaataactaaatttattcccgcaatcgaaattccgccaacaaatctatctttcccgaaaccgaacgaccccattaaccaaatcaattttcccatcatcaaaacacccgtataccctaacgccaaacgtaatcgatataaatataattatccttacgatacgccaacaccaaatcgacgcgtttaccctcgccaatcaccccgcgatcctaaaaattaaacgcctacgctaaatttttaatcaccaacttcaccgcctacgacaacgtaaaacgattactctaatcatcgacgacgcgaaataccgcatcgaacaaactaacgaaataataatcgaaaaaaaaaatatccaacaaaccaaactacgccaattcactaaccgccacgttaccgaaatacgaaccgccgcgcacaatattcgacgcgcccatcaacacgttcataccatacttacgcgaaacttccgccgcttcgaacgtaataaaaaattcgacgatcacgctaccaaactaataaaattcaacaacgtaaacgtaaataacgtcatcgtaactaacaaactacaatatttcgcgcgcgacacaaatacgacgataaattcgcgattcgactacgaccaacgtacgacgaacgccaattactcgacttcgt

SEQ ID NO: 17217 - DNA, 1129 bp, Artificial Sequence
  chemically treated genomic DNA (Homo sapiens) CpG-island No: 17217
  misc_feature (1080)..(1080): n is either a, c, g or t
  misc_feature (1082)..(1082): n is either a, c, g or t
tggtattgagcgcgttggaaattgatatttagtttaacgttaacgtgttgatcggttttgacggcgtattgcgtggtgttttcggtggttattgcgatatcgcgattgtttttgcgttttttattatcgtcgcgtcgttggtacgcggtcgtatttcgattttggtggataacgtattgatttgtattattttaggttttagtgtcgatattttggttatagattacggtatcgtagttaattcggtacgttcggaattggtagaacgtttgtaggaagcgggtattaaagtggtttttattgagtggttgcgcgaacgtgcgcgtttgttgatcggtgaattatagtcgattgaatttatagatcgcgtcgttgtcgttgtgcgttatcgcgatggttcggtgatcgatgttgtgtattaggtgaaggaataagttatgtatttgttttttgaattcgttagttattatgcggtattaattttcgagttgttcgttagtcgggatgaaaggtaagtacggtaatacgtttggtttaagcgttattttgttttattggttttttttatcgtggttgcgtttgggtcgattaaagatagcgaggttatacgtcgaatttttaattatggcgtgatagttttgcgtgttttagtcgtaaaatagggttggtaaatttaggagtaggttgtattggttttcgttagcgggtcggagggtatgttgagtattgtcgtttcggttcgcgattttaagttcgatattattgagtttgaatatagttattttttcgggcggttatgggatatcgatgttttgacgttcgaaagcgaaattttttttcgtcgcgattattattggcgattcgtcgttgtttgtgtgcgaataagcgtagcggcggcgcgggaaaattataatgacgattattatcgagggggcgggacgagttagcggaggtataatttagtggagttaatagagatcgcggcgggtcggaggaaaggcgacggtcggtttaaggggtaaagcgaaaggtcgataggtcgaagtatgaaaattacgtgttcgatggtgcgtcgggttntnggaaacggattatatagaaagatacgattagatatatattagatata

SEQ ID NO: 17218 - DNA, 1129 bp, Artificial Sequence
  chemically treated genomic DNA (Homo sapiens) CpG-island No: 17218
  misc_feature (48)..(48): n is either a, c, g or t
  misc_feature (50)..(50): n is either a, c, g or t
tatatctaatatatatctaatcgtatctttctatataatccgtttccnanaacccgacgcaccatcgaacacgtaattttcatacttcgacctatcgacctttcgctttaccccttaaaccgaccgtcgcctttcctccgacccgccgcgatctctattaactccactaaattatacctccgctaactcgtcccgccccctcgataataatcgtcattataattttcccgcgccgccgctacgcttattcgcacacaaacaacgacgaatcgccaataataatcgcgacgaaaaaaaatttcgctttcgaacgtcaaaacatcgatatcccataaccgcccgaaaaaataactatattcaaactcaataatatcgaacttaaaatcgcgaaccgaaacgacaatactcaacataccctccgacccgctaacgaaaaccaatacaacctactcctaaatttaccaaccctattttacgactaaaacacgcaaaactatcacgccataattaaaaattcgacgtataacctcgctatctttaatcgacccaaacgcaaccacgataaaaaaaaccaataaaacaaaataacgcttaaaccaaacgtattaccgtacttacctttcatcccgactaacgaacaactcgaaaattaataccgcataataactaacgaattcaaaaaacaaatacataacttattccttcacctaatacacaacatcgatcaccgaaccatcgcgataacgcacaacgacaacgacgcgatctataaattcaatcgactataattcaccgatcaacaaacgcgcacgttcgcgcaaccactcaataaaaaccactttaatacccgcttcctacaaacgttctaccaattccgaacgtaccgaattaactacgataccgtaatctataaccaaaatatcgacactaaaacctaaaataatacaaatcaatacgttatccaccaaaatcgaaatacgaccgcgtaccaacgacgcgacgataataaaaaacgcaaaaacaatcgcgatatcgcaataaccaccgaaaacaccacgcaatacgccgtcaaaaccgatcaacacgttaacgttaaactaaatatcaatttccaacgcgctcaatacca

SEQ ID NO: 17219 - DNA, 1129 bp, Artificial Sequence
  chemically treated genomic DNA (Homo sapiens) CpG-island No: 17219
  misc_feature (48)..(48): n is either a, c, g or t
  misc_feature (50)..(50): n is either a, c, g or t
tgtatttggtgtgtgtttggtcgtgtttttttatgtggttcgtttttnanagttcgacgtattatcgaatacgtggtttttatatttcggtttatcggtttttcgttttgttttttagatcggtcgtcgtttttttttcggttcgtcgcggtttttgttagttttattgggttatattttcgttgattcgtttcgttttttcggtgataatcgttattatggttttttcgcgtcgtcgttgcgtttgttcgtatataggtagcggcgagtcgttagtgatagtcgcggcgggagagaatttcgttttcgggcgttaggatatcgatattttataatcgttcgagaggatgattatgtttaagtttaatggtgtcgagtttgaggtcgcgagtcggggcggtaatgtttaatatgtttttcggttcgttggcggaaattagtgtagtttgtttttgaatttgttagttttgttttgcggttaaggtacgtaaggttgttacgttatgattaaaaattcggcgtgtgatttcgttgtttttaatcggtttaggcgtaattacggtaaaggagattagtggaataggatggcgtttgagttagacgtgttgtcgtgtttgttttttatttcggttgacgagtagttcgggaattgatatcgtatggtggttggcgagtttaggaagtaggtgtatggtttatttttttatttgatgtataatatcgattatcgagttatcgcggtaacgtataacggtaacgacgcggtttgtgaatttaatcggttgtggtttatcggttagtagacgcgtacgttcgcgtagttatttaatggaaattattttaatgttcgttttttgtagacgttttgttagtttcggacgtgtcgggttaattgcgatatcgtggtttgtgattagaatatcgatattggagtttggggtgatgtaggttagtacgttatttattagagtcggaatacgatcgcgtattagcggcgcgacgatgatggaaagcgtagaggtaatcgcggtatcgtagtgattatcggaagtattacgtagtacgtcgttagagtcggttagtacgttaacgttgaattgggtgttaatttttagcgcgtttagtatta

SEQ ID NO: 17220 - DNA, 1129 bp, Artificial Sequence
  chemically treated genomic DNA (Homo sapiens) CpG-island No: 17220
  misc_feature (1080)..(1080): n is either a, c, g or t
  misc_feature (1082)..(1082): n is either a, c, g or t
taatactaaacgcgctaaaaattaacacccaattcaacgttaacgtactaaccgactctaacgacgtactacgtaatacttccgataatcactacgataccgcgattacctctacgctttccatcatcgtcgcgccgctaatacgcgatcgtattccgactctaataaataacgtactaacctacatcaccccaaactccaatatcgatattctaatcacaaaccacgatatcgcaattaacccgacacgtccgaaactaacaaaacgtctacaaaaaacgaacattaaaataatttccattaaataactacgcgaacgtacgcgtctactaaccgataaaccacaaccgattaaattcacaaaccgcgtcgttaccgttatacgttaccgcgataactcgataatcgatattatacatcaaataaaaaaataaaccatacacctacttcctaaactcgccaaccaccatacgatatcaattcccgaactactcgtcaaccgaaataaaaaacaaacacgacaacacgtctaactcaaacgccatcctattccactaatctcctttaccgtaattacgcctaaaccgattaaaaacaacgaaatcacacgccgaatttttaatcataacgtaacaaccttacgtaccttaaccgcaaaacaaaactaacaaattcaaaaacaaactacactaatttccgccaacgaaccgaaaaacatattaaacattaccgccccgactcgcgacctcaaactcgacaccattaaacttaaacataatcatcctctcgaacgattataaaatatcgatatcctaacgcccgaaaacgaaattctctcccgccgcgactatcactaacgactcgccgctacctatatacgaacaaacgcaacgacgacgcgaaaaaaccataataacgattatcaccgaaaaaacgaaacgaatcaacgaaaatataacccaataaaactaacaaaaaccgcgacgaaccgaaaaaaaaacgacgaccgatctaaaaaacaaaacgaaaaaccgataaaccgaaatataaaaaccacgtattcgataatacgtcgaactntnaaaaacgaaccacataaaaaaacacgaccaaacacacaccaaataca

SEQ ID NO: 17221 - DNA, 789 bp, Artificial Sequence
  chemically treated genomic DNA (Homo sapiens) CpG-island No: 17221
cggtaggttaattacgttaaaatatattagtatttagaacgacgttataaaggtaggcgatagaatatcgttagcgttttgtggcgtaattagttgcggatcgatggtttgtaaggtttgtattgcgttatttaagtcgttagcggtatgtattacgttaataagtagtataacggtgttaattagtattataagtttttgtatggtgtcgtttagtacgttggcgcgaaagttattaaaggcggtatataacgtaatgttgatattaaaaattagtagttcggttttataaggaatattcgtcgcggtttttagtaggcgcgtatcgtcgataaattgtacggttatcgtattaacgaacgtaattagtaaatttaaattcgttagttatattagaagacgattttggtagcgggtaaatagtatatcgtttagcgttattgtattgtagcggcgcgtaagaatcgtaaattttttgtcgagaatatcgagtgaaagttagattgtaggaagttgaattatcgttagtaatatttagtttagttcgtatttataagtagtttttggttcgtcgataaacgaattggtattgatataggtcgcggtgagcgttatcgttagtataatatcgtttatagagcggttgtcgaggaaatatttattaaggaaggtgtcggtgtttcgtttacgtatcgtataaatcgagatatcgaatattattattagataggcgattagcggtagaattattttaagttgtatcgttattttttagtgggatatcgcgat

SEQ ID NO: 17222 - DNA, 789 bp, Artificial Sequence
  chemically treated genomic DNA (Homo sapiens) CpG-island No: 17222
atcgcgatatcccactaaaaaataacgatacaacttaaaataattctaccgctaatcgcctatctaataataatattcgatatctcgatttatacgatacgtaaacgaaacaccgacaccttccttaataaatatttcctcgacaaccgctctataaacgatattatactaacgataacgctcaccgcgacctatatcaataccaattcgtttatcgacgaaccaaaaactacttataaatacgaactaaactaaatattactaacgataattcaacttcctacaatctaactttcactcgatattctcgacaaaaaatttacgattcttacgcgccgctacaatacaataacgctaaacgatatactatttacccgctaccaaaatcgtcttctaatataactaacgaatttaaatttactaattacgttcgttaatacgataaccgtacaatttatcgacgatacgcgcctactaaaaaccgcgacgaatattccttataaaaccgaactactaatttttaatatcaacattacgttatataccgcctttaataactttcgcgccaacgtactaaacgacaccatacaaaaacttataatactaattaacaccgttatactacttattaacgtaatacataccgctaacgacttaaataacgcaatacaaaccttacaaaccatcgatccgcaactaattacgccacaaaacgctaacgatattctatcgcctacctttataacgtcgttctaaatactaatatattttaacgtaattaacctaccg

SEQ ID NO: 17223 - DNA, 789 bp, Artificial Sequence
  chemically treated genomic DNA (Homo sapiens) CpG-island No: 17223
atcgcgatattttattggaggatgacgatgtagtttgaagtaattttatcgttggtcgtttatttggtggtggtgttcggtatttcggtttatgcgatgcgtaaacggagtatcggtattttttttaatgagtattttttcggtagtcgttttatgggcggtattgtgttggcgatgacgtttatcgcgatttatattagtgttagttcgtttatcggcgggttaggagttgtttataaatacgggttgggttgggtattgttggcgatgatttagttttttgtagtttggtttttattcggtattttcggtaagaagtttgcgatttttgcgcgtcgttataatgtagtgacgttgaacgatatgttgtttgttcgttattagagtcgttttttggtgtggttggcgagtttgagtttgttggttgcgttcgttggtgcgatgatcgtgtagtttatcggcggtgcgcgtttgttggaaatcgcggcgggtattttttatgaaatcgggttgttgatttttggtattagtattgcgttatatatcgtttttggtggttttcgcgttagcgtgttgaacgatattatgtaagggtttgtgatgttgattggtatcgttgtgttgtttattggcgtagtatatgtcgttggcggtttaagtaacgtagtatagattttgtaaattatcgattcgtaattggttacgttataaggcgttgacgatattttgtcgtttgtttttatgacgtcgttttgggtattggtgtgttttggcgtgattggtttgtcg

SEQ ID NO: 17224 - DNA, 789 bp, Artificial Sequence
  chemically treated genomic DNA (Homo sapiens) CpG-island No: 17224
cgacaaaccaatcacgccaaaacacaccaatacccaaaacgacgtcataaaaacaaacgacaaaatatcgtcaacgccttataacgtaaccaattacgaatcgataatttacaaaatctatactacgttacttaaaccgccaacgacatatactacgccaataaacaacacaacgataccaatcaacatcacaaacccttacataatatcgttcaacacgctaacgcgaaaaccaccaaaaacgatatataacgcaatactaataccaaaaatcaacaacccgatttcataaaaaatacccgccgcgatttccaacaaacgcgcaccgccgataaactacacgatcatcgcaccaacgaacgcaaccaacaaactcaaactcgccaaccacaccaaaaaacgactctaataacgaacaaacaacatatcgttcaacgtcactacattataacgacgcgcaaaaatcgcaaacttcttaccgaaaataccgaataaaaaccaaactacaaaaaactaaatcatcgccaacaatacccaacccaacccgtatttataaacaactcctaacccgccgataaacgaactaacactaatataaatcgcgataaacgtcatcgccaacacaataccgcccataaaacgactaccgaaaaaatactcattaaaaaaaataccgatactccgtttacgcatcgcataaaccgaaataccgaacaccaccaccaaataaacgaccaacgataaaattacttcaaactacatcgtcatcctccaataaaatatcgcgat

SEQ ID NO: 17225 - DNA, 688 bp, Artificial Sequence
  chemically treated genomic DNA (Homo sapiens) CpG-island No: 17225
cgatatcgtcgtcgttatcgtttatggtaaaggatgggcgaataatgtacgggaagtttacgttagcggtaatcgttagcgttttttttatcgtgtgtgcgatatcggaacgcgcggtttttagattaattttttttatcgttacgtcgaaacgacggcggttttttgttttattaatcgtatcggtagtggtattaattatggtgatatcgaatttttttaatacgttttgacgttttagttttagcgcgtagtttagcgtcgtttgatcgtttatcgttggtagtatcgcgttcgggcgtttttttttaataattttgcgtataattttttagtgaatcggttcgatgtaggttgtattagttattttcgggtcggttatgatggtcgtcgggttggagtttattagaatgacgcggtaattttttttacgtagggtttataacgtttgcgcgttaagtagttaatttatacgttggacgataatatcgggttcgatttcgaatcggattttgtatattttgtacgtttgggagggtttttaattcgtaatattacgggttacgagtcggttttatatcggtaagggcgttatacgtcgcggttgttttgataacggttttgtagcgcgcgtaaatgtgtcgttgttttaaatatattgttatgttagtatatttttattttgtga

SEQ ID NO: 17226 - DNA, 688 bp, Artificial Sequence
  chemically treated genomic DNA (Homo sapiens) CpG-island No: 17226
tcacaaaataaaaatatactaacataacaatatatttaaaacaacgacacatttacgcgcgctacaaaaccgttatcaaaacaaccgcgacgtataacgcccttaccgatataaaaccgactcgtaacccgtaatattacgaattaaaaaccctcccaaacgtacaaaatatacaaaatccgattcgaaatcgaacccgatattatcgtccaacgtataaattaactacttaacgcgcaaacgttataaaccctacgtaaaaaaaattaccgcgtcattctaataaactccaacccgacgaccatcataaccgacccgaaaataactaatacaacctacatcgaaccgattcactaaaaaattatacgcaaaattattaaaaaaaaacgcccgaacgcgatactaccaacgataaacgatcaaacgacgctaaactacgcgctaaaactaaaacgtcaaaacgtattaaaaaaattcgatatcaccataattaataccactaccgatacgattaataaaacaaaaaaccgccgtcgtttcgacgtaacgataaaaaaaattaatctaaaaaccgcgcgttccgatatcgcacacacgataaaaaaaacgctaacgattaccgctaacgtaaacttcccgtacattattcgcccatcctttaccataaacgataacgacgacgatatcg

SEQ ID NO: 17227 - DNA, 688 bp, Artificial Sequence
  chemically treated genomic DNA (Homo sapiens) CpG-island No: 17227
ttataaggtaaaaatatgttggtataatagtgtgtttgaagtaacggtatatttgcgcgcgttgtagaatcgttgttaaaatagtcgcggcgtgtggcgtttttgtcggtatgggatcggttcgtaattcgtagtattacgggttaaaggtttttttaaacgtatagaatatataagattcgattcggggtcgggttcgatgttatcgtttagcgtgtgagttgattatttggcgcgtaagcgttgtaagttttgcgtgaagagggttatcgcgttattttggtgaattttaattcggcgattattatgatcgattcggaaatggttgatgtaatttatatcgagtcgatttattgggaagttgtacgtaagattattgaaaaagagcgttcggacgcggtgttgttaacgatgggcggttagacggcgttgaattgcgcgttggagttggaacgttagggcgtgttggaagagttcggtgttattatgattggtgttattgtcgatgcgattgataaagtagaagatcgtcgtcgtttcgacgtagcgatgaagaaaattggtttggaaatcgcgcgtttcggtatcgtatatacgatggaagaagcgttggcggttgtcgttgacgtgggtttttcgtgtattattcgtttattttttattatgggcggtagcggcggcggtatcg

SEQ ID NO: 17228 - DNA, 688 bp, Artificial Sequence
  chemically treated genomic DNA (Homo sapiens) CpG-island No: 17228
cgataccgccgccgctaccgcccataataaaaaataaacgaataatacacgaaaaacccacgtcaacgacaaccgccaacgcttcttccatcgtatatacgataccgaaacgcgcgatttccaaaccaattttcttcatcgctacgtcgaaacgacgacgatcttctactttatcaatcgcatcgacaataacaccaatcataataacaccgaactcttccaacacgccctaacgttccaactccaacgcgcaattcaacgccgtctaaccgcccatcgttaacaacaccgcgtccgaacgctctttttcaataatcttacgtacaacttcccaataaatcgactcgatataaattacatcaaccatttccgaatcgatcataataatcgccgaattaaaattcaccaaaataacgcgataaccctcttcacgcaaaacttacaacgcttacgcgccaaataatcaactcacacgctaaacgataacatcgaacccgaccccgaatcgaatcttatatattctatacgtttaaaaaaacctttaacccgtaatactacgaattacgaaccgatcccataccgacaaaaacgccacacgccgcgactattttaacaacgattctacaacgcgcgcaaatataccgttacttcaaacacactattataccaacatatttttaccttataa

SEQ ID NO: 17229 - DNA, 592 bp, Artificial Sequence
  chemically treated genomic DNA (Homo sapiens) CpG-island No: 17229
tatttttttggcgagttggaaatttttttgttgatggcgcgcgacgagtaggacgattcgtttaatttgaaaggtttttttgtcggggcgatgggttacggatagtttatgtcgtcgttttataaataatatgcggtagattttagcggcgacgggtatattaatttgtgggattcggttgatgcgatcggtagcgtggcgaattattttaaagcgtacggttgggtgaaaggcgattaggtcgcggtaatggtaaacggttaggttttaggtttgttaaatggttttaaaattaagtatagtatttcgtagtttgtcgtcgtaggtttaacgttatagtagtcgttgggtaattattaataagttagtttgttgcgtttggatgttggtatcggttattagtattggtacggtttgtcgaatttttatattattattcgttataattatagtatttattacgtaatggcggtttggtagttaggataagtcgtggcgttggcgcgagtatagtagttatttataagaggggggcgtgagtttttttttggtaattagttttttttgattttttcgtaaatttgtagtttaa

SEQ ID NO: 17230 - DNA, 592 bp, Artificial Sequence
  chemically treated genomic DNA (Homo sapiens) CpG-island No: 17230
ttaaactacaaatttacgaaaaaatcaaaaaaaactaattaccaaaaaaaaactcacgcccccctcttataaataactactatactcgcgccaacgccacgacttatcctaactaccaaaccgccattacgtaataaatactataattataacgaataataatataaaaattcgacaaaccgtaccaatactaataaccgataccaacatccaaacgcaacaaactaacttattaataattacccaacgactactataacgttaaacctacgacgacaaactacgaaatactatacttaattttaaaaccatttaacaaacctaaaacctaaccgtttaccattaccgcgacctaatcgcctttcacccaaccgtacgctttaaaataattcgccacgctaccgatcgcatcaaccgaatcccacaaattaatatacccgtcgccgctaaaatctaccgcatattatttataaaacgacgacataaactatccgtaacccatcgccccgacaaaaaaacctttcaaattaaacgaatcgtcctactcgtcgcgcgccatcaacaaaaaaatttccaactcgccaaaaaaata

SEQ ID NO: 17231 - DNA, 592 bp, Artificial Sequence
  chemically treated genomic DNA (Homo sapiens) CpG-island No: 17231
ttgggttgtaaatttacgagaggattagaaaaaattgattattagagggaagtttacgttttttttttgtaaatagttattgtattcgcgttagcgttacggtttgttttaattgttagatcgttattgcgtaatgggtgttgtggttgtaacgggtgatggtgtagaagttcggtagatcgtattagtattggtagtcggtgttaatatttagacgtagtaggttggtttgttgatggttgtttagcggttgttgtggcgttaaatttgcggcggtaagttgcgaaatgttgtatttagttttgaagttatttggtaagtttggagtttgatcgtttgttattatcgcgatttgatcgttttttatttagtcgtgcgttttgaaatagttcgttacgttatcgatcgtattaatcggattttataggttgatatgttcgtcgtcgttgaaatttatcgtatattgtttgtaagacgacggtataaattgttcgtagtttatcgtttcggtaaaggaattttttagattgagcggatcgttttgttcgtcgcgcgttattaataggaaggtttttagttcgttagagaaata

SEQ ID NO: 17232 - DNA, 592 bp, Artificial Sequence
  chemically treated genomic DNA (Homo sapiens) CpG-island No: 17232
tatttctctaacgaactaaaaaccttcctattaataacgcgcgacgaacaaaacgatccgctcaatctaaaaaattcctttaccgaaacgataaactacgaacaatttataccgtcgtcttacaaacaatatacgataaatttcaacgacgacgaacatatcaacctataaaatccgattaatacgatcgataacgtaacgaactatttcaaaacgcacgactaaataaaaaacgatcaaatcgcgataataacaaacgatcaaactccaaacttaccaaataacttcaaaactaaatacaacatttcgcaacttaccgccgcaaatttaacgccacaacaaccgctaaacaaccatcaacaaaccaacctactacgtctaaatattaacaccgactaccaatactaatacgatctaccgaacttctacaccatcacccgttacaaccacaacacccattacgcaataacgatctaacaattaaaacaaaccgtaacgctaacgcgaatacaataactatttacaaaaaaaaaacgtaaacttccctctaataatcaattttttctaatcctctcgtaaatttacaacccaa

SEQ ID NO: 17233 - DNA, 784 bp, Artificial Sequence
  chemically treated genomic DNA (Homo sapiens) CpG-island No: 17233
cgtaacgaaggacgattttagtatattcgtacggtgattatcggttgtagtcgtttaggttttggtaatcgttatgttttcgtttttcggatcgtttttcgggtgaacggtaattagcgtcggtacgtcgaatttacgtttgtattttttacgtatttcggtgtttgggtatttcggcgtaattattattacggtgatatttttacggatttgttcgtttatttcgacgatgttgaaatcgtgcgagtagtttagcgtcgcgtcgttttttattagtggttgtacggtgcgtattatattagagtgttgtttgttcggcgttaggttaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaatggcggtttttcgttagatgtaggaaggtttttagatcgcgtaaatttatagggatagttttcgatgttgat

SEQ ID NO: 17234 - DNA, 784 bp, Artificial Sequence
  chemically treated genomic DNA (Homo sapiens) CpG-island No: 17234
atcaacatcgaaaactatccctataaatttacgcgatctaaaaaccttcctacatctaacgaaaaaccgccattttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattaacctaacgccgaacaaacaacactctaatataatacgcaccgtacaaccactaataaaaaacgacgcgacgctaaactactcgcacgatttcaacatcgtcgaaataaacgaacaaatccgtaaaaatatcaccgtaataataattacgccgaaatacccaaacaccgaaatacgtaaaaaatacaaacgtaaattcgacgtaccgacgctaattaccgttcacccgaaaaacgatccgaaaaacgaaaacataacgattaccaaaacctaaacgactacaaccgataatcaccgtacgaatatactaaaatcgtccttcgttacg

SEQ ID NO: 17235 - DNA, 784 bp, Artificial Sequence
  chemically treated genomic DNA (Homo sapiens) CpG-island No: 17235
gttaatatcgagggttgtttttgtggatttacgcgatttgaaaatttttttgtatttggcggaaagtcgttattttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattaatttgacgtcggataagtagtattttgatgtagtgcgtatcgtatagttattgatgaaagacggcgcggcgttgggttattcgtacggttttaatatcgtcgaagtgggcgagtagattcgtaaagatattatcgtagtgatggttgcgtcgaaatgtttaggtatcgaagtgcgtgaagagtataaacgtgggttcggcgtatcgacgttgattgtcgtttattcggaaaacgattcgaaaggcgaaggtatggcgattgttaaagtttgggcggttgtaatcggtggttatcgtgcgggtgtgttggaatcgtttttcgttgcg

SEQ ID NO: 17236 - DNA, 784 bp, Artificial Sequence
  chemically treated genomic DNA (Homo sapiens) CpG-island No: 17236
cgcaacgaaaaacgattccaacacacccgcacgataaccaccgattacaaccgcccaaactttaacaatcgccataccttcgcctttcgaatcgttttccgaataaacgacaatcaacgtcgatacgccgaacccacgtttatactcttcacgcacttcgatacctaaacatttcgacgcaaccatcactacgataatatctttacgaatctactcgcccacttcgacgatattaaaaccgtacgaataacccaacgccgcgccgtctttcatcaataactatacgatacgcactacatcaaaatactacttatccgacgtcaaattaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaataacgactttccgccaaatacaaaaaaattttcaaatcgcgtaaatccacaaaaacaaccctcgatattaac

SEQ ID NO: 17237 - DNA, 557 bp, Artificial Sequence
  chemically treated genomic DNA (Homo sapiens) CpG-island No: 17237
ttggcgatttgcgttagttgtttatcgtttagtttacgggagaataattgcgttagttaggcgtaaatataggtaatttgttgtgttgttagcgtggttatgattttatttgcgacgcgggaatatattcgtattgcgttattatttttacggggtcgttaaacgtcgttatttgttttattgtttcgttgtattttttaatttttattagcgtagtgtgcgtattggtcgtttgcgttagttgcgatgtatcgatgtcgatggttaatacgttggggttatcgtatttgtatagcgtattaggttcgtcgtttttatttggatcgtattatgttttttcgtgaattcgtgttacgtcgggtgtatagcggttagaaattattgtttttgttaatatttgatcgcgagcgttaaagacgcgtattatattatcgttacgaatatcgcgcgcgttggtattttgcgggttaatgaatattggttttttattcgttatcgtatattgttgacgtagcgttttcgatttatataattgcgagtgaagtcggaaattcgga

SEQ ID NO: 17238 - DNA, 557 bp, Artificial Sequence
  chemically treated genomic DNA (Homo sapiens) CpG-island No: 17238
tccgaatttccgacttcactcgcaattatataaatcgaaaacgctacgtcaacaatatacgataacgaataaaaaaccaatattcattaacccgcaaaataccaacgcgcgcgatattcgtaacgataatataatacgcgtctttaacgctcgcgatcaaatattaacaaaaacaataatttctaaccgctatacacccgacgtaacacgaattcacgaaaaaacataatacgatccaaataaaaacgacgaacctaatacgctatacaaatacgataaccccaacgtattaaccatcgacatcgatacatcgcaactaacgcaaacgaccaatacgcacactacgctaataaaaattaaaaaatacaacgaaacaataaaacaaataacgacgtttaacgaccccgtaaaaataataacgcaatacgaatatattcccgcgtcgcaaataaaatcataaccacgctaacaacacaacaaattacctatatttacgcctaactaacgcaattattctcccgtaaactaaacgataaacaactaacgcaaatcgccaa

SEQ ID NO: 17239 - DNA, 557 bp, Artificial Sequence
  chemically treated genomic DNA (Homo sapiens) CpG-island No: 17239
ttcggattttcgattttattcgtagttatgtgagtcggaaacgttgcgttagtaatatacggtagcgggtaaagagttagtatttattaattcgtaggatgttagcgcgcgcggtattcgtaacggtgatgtggtacgcgtttttaacgttcgcggttaggtgttggtaggggtagtggtttttgatcgttatgtattcggcgtggtacgaatttacgaaggggtatggtacgatttagataaaggcggcgagtttggtgcgttgtgtaaatacggtaattttaacgtgttgattatcgatatcggtatatcgtagttggcgtaggcgattagtgcgtatattacgttggtggaaattgagaagtataacggaatagtggagtaggtgacggcgtttaacggtttcgtggagatggtggcgtagtgcgaatatgttttcgcgtcgtaggtgaaattatgattacgttgatagtataatagattgtttgtgtttacgtttggttagcgtagttgttttttcgtgagttggacgatgaataattgacgtaaatcgttag

SEQ ID NO: 17240 - DNA, 557 bp, Artificial Sequence
  chemically treated genomic DNA (Homo sapiens) CpG-island No: 17240
ctaacgatttacgtcaattattcatcgtccaactcacgaaaaaacaactacgctaaccaaacgtaaacacaaacaatctattatactatcaacgtaatcataatttcacctacgacgcgaaaacatattcgcactacgccaccatctccacgaaaccgttaaacgccgtcacctactccactattccgttatacttctcaatttccaccaacgtaatatacgcactaatcgcctacgccaactacgatataccgatatcgataatcaacacgttaaaattaccgtatttacacaacgcaccaaactcgccgcctttatctaaatcgtaccataccccttcgtaaattcgtaccacgccgaatacataacgatcaaaaaccactacccctaccaacacctaaccgcgaacgttaaaaacgcgtaccacatcaccgttacgaataccgcgcgcgctaacatcctacgaattaataaatactaactctttacccgctaccgtatattactaacgcaacgtttccgactcacataactacgaataaaatcgaaaatccgaa

SEQ ID NO: 17241 - DNA, 517 bp, Artificial Sequence
  chemically treated genomic DNA (Homo sapiens) CpG-island No: 17241
ggtgtcgtgtatagggtattatcgttcgcgtgaagttaggacgttagtattaggaaaacgatttgtcggatttgatcgtttcgttcgattaatcgtttttgttgattttcgacggcgtaatcgattcgtataatttcggcgcgtgtttgcgtagtgcggacgtcgtaggcgtttatgcggtgattgtgtcgaaagatcgtttcgtatagtttaacgttacggcgaaaaaagtagtttgcggcgcggtagaaagcgtttcgttgattcgggtgattaattttgcgcgtattatgcgtatgttgtaggaagagaatatttggatcgtcggtacggtaggcgaggcggattatatattttattagagtaaaatgatcggacgtttggcgttggtgatgggtgcggaaggtgaaggtatgcgtcgtttgattcgtgaatattgcgatgagttgattagtatttcgatggttggaagcgttttttttttgaacgtttcggttgcgatcggaatttgtttatt

SEQ ID NO: 17242 - DNA, 517 bp, Artificial Sequence
  chemically treated genomic DNA (Homo sapiens) CpG-island No: 17242
aataaacaaattccgatcgcaaccgaaacgttcaaaaaaaaaacgcttccaaccatcgaaatactaatcaactcatcgcaatattcacgaatcaaacgacgcataccttcaccttccgcacccatcaccaacgccaaacgtccgatcattttactctaataaaatatataatccgcctcgcctaccgtaccgacgatccaaatattctcttcctacaacatacgcataatacgcgcaaaattaatcacccgaatcaacgaaacgctttctaccgcgccgcaaactacttttttcgccgtaacgttaaactatacgaaacgatctttcgacacaatcaccgcataaacgcctacgacgtccgcactacgcaaacacgcgccgaaattatacgaatcgattacgccgtcgaaaatcaacaaaaacgattaatcgaacgaaacgatcaaatccgacaaatcgttttcctaatactaacgtcctaacttcacgcgaacgataataccctatacacgacacc

SEQ ID NO: 17243 - DNA, 517 bp, Artificial Sequence
  chemically treated genomic DNA (Homo sapiens) CpG-island No: 17243
aataagtaaatttcggtcgtaatcgaaacgtttagggaagaaacgtttttagttatcgggatgttgattaatttatcgtaatgtttacgagttaggcgacgtatatttttatttttcgtatttattattagcgttaggcgttcggttattttgttttgatagagtgtatgattcgtttcgtttgtcgtatcgacgatttagatattttttttttgtaatatacgtatggtgcgcgtaaggttagttattcgaattagcggaacgttttttgtcgcgtcgtaggttatttttttcgtcgtagcgttgagttgtgcggagcgatttttcggtataattatcgtatgaacgtttgcggcgttcgtattacgtaggtacgcgtcgaggttgtgcggatcggttacgtcgtcgaggattagtaggaacggttgatcgagcgaagcgattagattcggtagatcgtttttttgatattgacgttttggttttacgcgggcgataatgttttatgtacggtatt

SEQ ID NO: 17244 - DNA, 517 bp, Artificial Sequence
  chemically treated genomic DNA (Homo sapiens) CpG-island No: 17244
aataccgtacataaaacattatcgcccgcgtaaaaccaaaacgtcaatatcaaaaaaacgatctaccgaatctaatcgcttcgctcgatcaaccgttcctactaatcctcgacgacgtaaccgatccgcacaacctcgacgcgtacctacgtaatacgaacgccgcaaacgttcatacgataattataccgaaaaatcgctccgcacaactcaacgctacgacgaaaaaaataacctacgacgcgacaaaaaacgttccgctaattcgaataactaaccttacgcgcaccatacgtatattacaaaaaaaaaatatctaaatcgtcgatacgacaaacgaaacgaatcatacactctatcaaaacaaaataaccgaacgcctaacgctaataataaatacgaaaaataaaaatatacgtcgcctaactcgtaaacattacgataaattaatcaacatcccgataactaaaaacgtttcttccctaaacgtttcgattacgaccgaaatttacttatt

SEQ ID NO: 17245 - DNA, 544 bp, Artificial Sequence
  chemically treated genomic DNA (Homo sapiens) CpG-island No: 17245
atttaggaagattttgttagtttacgcgtgttagacgggaagttattaggaggttaacgtaaattagcgtattagtaggagcgtaatttggtattattttcggcgagcggggatagaaagataattagtaggaatagcggattaataattattaggcgttagatcggtacgatcgttaagcgatacgtcggaagaggatttaagataaggcgtagcggaagaagtatcgattaacgaatcggttacggaagagatacggtcgatatatagcgtttgtttcgtgcgcgggaatttttcgatttattcgatagaacggggtatcggttagttaagtacgtatcggagagtcgataggtgataacgtgtacgagaaatgttcggtaatcgaggtaaagatcggggaaacggggatcggaaggattagtacgcgggaaagaagttgtagggttttttaattattaaagtgattttggaaggcggcgttttttttcgggggaaaaaaagaaaaacggatagaacggataaaaaggtttttcggggggaa

SEQ ID NO: 17246 - DNA, 544 bp, Artificial Sequence
  chemically treated genomic DNA (Homo sapiens) CpG-island No: 17246
ttccccccgaaaaacctttttatccgttctatccgtttttctttttttcccccgaaaaaaaacgccgccttccaaaatcactttaataattaaaaaaccctacaacttctttcccgcgtactaatccttccgatccccgtttccccgatctttacctcgattaccgaacatttctcgtacacgttatcacctatcgactctccgatacgtacttaactaaccgataccccgttctatcgaataaatcgaaaaattcccgcgcacgaaacaaacgctatatatcgaccgtatctcttccgtaaccgattcgttaatcgatacttcttccgctacgccttatcttaaatcctcttccgacgtatcgcttaacgatcgtaccgatctaacgcctaataattattaatccgctattcctactaattatctttctatccccgctcgccgaaaataataccaaattacgctcctactaatacgctaatttacgttaacctcctaataacttcccgtctaacacgcgtaaactaacaaaatcttcctaaat

SEQ ID NO: 17247 - DNA, 544 bp, Artificial Sequence
  chemically treated genomic DNA (Homo sapiens) CpG-island No: 17247
tttttttcggggggtttttttgttcgttttgttcgtttttttttttttttttcgggaaaaggcgtcgttttttagggttattttggtgattgggaagttttatagtttttttttcgcgtgttagttttttcggttttcgttttttcggtttttatttcggttgtcgggtatttttcgtgtacgttgttatttgtcgatttttcggtacgtgtttggttgatcgatatttcgttttgtcggatgagtcggggaattttcgcgtacgaagtaggcgttgtatgtcgatcgtatttttttcgtgatcggttcgttgatcggtatttttttcgttacgttttattttgagttttttttcggcgtatcgtttggcgatcgtatcggtttggcgtttagtggttgttggttcgttgtttttgttggttatttttttgttttcgttcgtcggggatggtgttaggttacgtttttgttggtgcgttgatttacgttggttttttgatgatttttcgtttggtacgcgtgaattggtaggatttttttgaat

SEQ ID NO: 17248 - DNA, 544 bp, Artificial Sequence
  chemically treated genomic DNA (Homo sapiens) CpG-island No: 17248
attcaaaaaaatcctaccaattcacgcgtaccaaacgaaaaatcatcaaaaaaccaacgtaaatcaacgcaccaacaaaaacgtaacctaacaccatccccgacgaacgaaaacaaaaaaataaccaacaaaaacaacgaaccaacaaccactaaacgccaaaccgatacgatcgccaaacgatacgccgaaaaaaaactcaaaataaaacgtaacgaaaaaaataccgatcaacgaaccgatcacgaaaaaaatacgatcgacatacaacgcctacttcgtacgcgaaaattccccgactcatccgacaaaacgaaatatcgatcaaccaaacacgtaccgaaaaatcgacaaataacaacgtacacgaaaaatacccgacaaccgaaataaaaaccgaaaaaacgaaaaccgaaaaaactaacacgcgaaaaaaaaactataaaacttcccaatcaccaaaataaccctaaaaaacgacgccttttcccgaaaaaaaaaaaaaaaaacgaacaaaacgaacaaaaaaaccccccgaaaaaaa

SEQ ID NO: 17249 - DNA, 903 bp, Artificial Sequence
  chemically treated genomic DNA (Homo sapiens) CpG-island No: 17249
ggtatcggtgagttcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggtttttttattttattgttatgtttcgtatcggtgttttcgtgattggttgtgtttgtagtagtagttcgtatttgtttcgtttgggttttttcgggcggtgtgagggtcgtcgttaggcgtgggtcgatttttttcgaaatatcgtcggcggaatagttggtatagtttgtacggattgaggagtggtttagggattcgtaaatagttcgatgttatttttgtgtgttttttttggtttttttg

SEQ ID NO: 17250 - DNA, 903 bp, Artificial Sequence
  chemically treated genomic DNA (Homo sapiens) CpG-island No: 17250
caaaaaaaccaaaaaaaacacacaaaaataacatcgaactatttacgaatccctaaaccactcctcaatccgtacaaactataccaactattccgccgacgatatttcgaaaaaaatcgacccacgcctaacgacgaccctcacaccgcccgaaaaaacccaaacgaaacaaatacgaactactactacaaacacaaccaatcacgaaaacaccgatacgaaacataacaataaaataaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgaactcaccgatacc

SEQ ID NO: 17251 - DNA, 903 bp, Artificial Sequence
  chemically treated genomic DNA (Homo sapiens) CpG-island No: 17251
taaagaagttaaaagaaatatataaaagtggtatcgggttatttgcgggtttttgagttattttttagttcgtatagattgtgttaattgtttcgtcggcgatatttcgagggaagtcgatttacgtttagcgacgatttttatatcgttcgaagggatttagacggggtagatacgaattgttgttgtaaatatagttaattacgaaggtatcggtgcggggtataatagtaagatgagaaagtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcggatttatcggtatt

SEQ ID NO: 17252 - DNA, 903 bp, Artificial Sequence
  chemically treated genomic DNA (Homo sapiens) CpG-island No: 17252
aataccgataaatccgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgactttctcatcttactattataccccgcaccgataccttcgtaattaactatatttacaacaacaattcgtatctaccccgtctaaatcccttcgaacgatataaaaatcgtcgctaaacgtaaatcgacttccctcgaaatatcgccgacgaaacaattaacacaatctatacgaactaaaaaataactcaaaaacccgcaaataacccgataccacttttatatatttcttttaacttcttta

SEQ ID NO: 17253 - DNA, 574 bp, Artificial Sequence
  chemically treated genomic DNA (Homo sapiens) CpG-island No: 17253
taattcggtggtttttagtattagttcggtagcgcgggttaatcgttcgtagcgacgtatcgtaggtaattgcgttattttggttttaaagttatttagcgtggttagttagcgagttaggcgcgtggttattatattatttttggtgttgttagacggtagagtttttgttagcgagtggcgatattggcgtcgagatcgtttttatcggcggagattttatagtcgttaggatggagggtgggatcgtttcgtaagcgttagttatgtaaatttaaggtagcgtcgagtatattatttatacgttgtagattattcgggtgtacgcgtagttgtggtttatcgttgaataacggtttttgttgtaataattgttggatttgtttgattagtgtcgagttatttatcgttggcgtttgatcgatgatttgacgtgtcgtttttagcgttatttgtattaggcgcgacgttattatattattaagtgtattaagggtagtttgaaattcgttgattagttgttgtattcgggtatgaattggcgtttgttgagatttcgtttttgttagatttt

SEQ ID NO: 17254 - DNA, 574 bp, Artificial Sequence
  chemically treated genomic DNA (Homo sapiens) CpG-island No: 17254
aaaatctaacaaaaacgaaatctcaacaaacgccaattcatacccgaatacaacaactaatcaacgaatttcaaactacccttaatacacttaataatataataacgtcgcgcctaatacaaataacgctaaaaacgacacgtcaaatcatcgatcaaacgccaacgataaataactcgacactaatcaaacaaatccaacaattattacaacaaaaaccgttattcaacgataaaccacaactacgcgtacacccgaataatctacaacgtataaataatatactcgacgctaccttaaatttacataactaacgcttacgaaacgatcccaccctccatcctaacgactataaaatctccgccgataaaaacgatctcgacgccaatatcgccactcgctaacaaaaactctaccgtctaacaacaccaaaaataatataataaccacgcgcctaactcgctaactaaccacgctaaataactttaaaaccaaaataacgcaattacctacgatacgtcgctacgaacgattaacccgcgctaccgaactaatactaaaaaccaccgaatta

SEQ ID NO: 17255 - DNA, 574 bp, Artificial Sequence
  chemically treated genomic DNA (Homo sapiens) CpG-island No: 17255
aaggtttggtagaggcgaagttttaataagcgttaatttatgttcggatgtagtaattggttagcgaattttaaattatttttgatgtatttgatagtgtgatagcgtcgcgtttgatgtagatggcgttggaggcggtacgttaggttatcggttagacgttaacggtggataattcggtattgattaaatagatttaatagttgttgtagtaagaatcgttatttagcggtaaattatagttgcgcgtgtattcggatgatttgtaacgtgtggatgatatgttcggcgttattttaagtttgtatggttggcgtttgcggggcgattttattttttattttggcggttgtaaagttttcgtcgatgaaggcgatttcgacgttagtgtcgttattcgttggtaagaattttgtcgtttggtagtattaggagtggtgtaatgattacgcgtttgattcgttggttaattacgttggataattttgaagttaaaatggcgtagttgtttgcggtacgtcgttacgggcgattaattcgcgttatcgggttggtgttggaagttatcggatta

SEQ ID NO: 17256 - DNA, 574 bp, Artificial Sequence
  chemically treated genomic DNA (Homo sapiens) CpG-island No: 17256
taatccgataacttccaacaccaacccgataacgcgaattaatcgcccgtaacgacgtaccgcaaacaactacgccattttaacttcaaaattatccaacgtaattaaccaacgaatcaaacgcgtaatcattacaccactcctaatactaccaaacgacaaaattcttaccaacgaataacgacactaacgtcgaaatcgccttcatcgacgaaaactttacaaccgccaaaataaaaaataaaatcgccccgcaaacgccaaccatacaaacttaaaataacgccgaacatatcatccacacgttacaaatcatccgaatacacgcgcaactataatttaccgctaaataacgattcttactacaacaactattaaatctatttaatcaataccgaattatccaccgttaacgtctaaccgataacctaacgtaccgcctccaacgccatctacatcaaacgcgacgctatcacactatcaaatacatcaaaaataatttaaaattcgctaaccaattactacatccgaacataaattaacgcttattaaaacttcgcctctaccaaacctt

SEQ ID NO: 17257 - DNA, 1117 bp, Artificial Sequence
  chemically treated genomic DNA (Homo sapiens) CpG-island No: 17257
cgaagagttggtattgttggaaattttcgatatcggtaaatcgattcgttatagtttgcgtgatgatattttcggcgcggcgcgcgttattcgttggtacgtcgaagcgatcgataaagtgtatggcgaagtggcgattattagtagttatgagttggcgatgatcgtgcgtgaatcggtcggcgtgattgtcgttatcgtgtcgtggaatttttcgttgttgttgatttgttggaaattcggttcggcgttggcggcgggaaatagcgtgattttaaaatcgtttgaaaaattatcgtttagtgcgattcgtttcgcggggttggcgaaagaagtaggtttgtcggatggtgtgttgaacgtggtgacgggttttggttatgaagtcgggtaggcgttgtcgcgttataacgatatcgacgttattgtttttatcggtttaattcgtatcgggaaatagttgttgaaagatgcgggcgatagtaatatgaaacgcgtttggttggaagcgggcggtaaaagcgttaatatcgttttcgttgattgttcggatttgtaataggcggtaagcgttatcgtagtaggtattttttataattaggggataggtgtgtatcgtcggaacgcgtttgttgttggaagagagtatcgtcgatgaatttttagttttgttaaaatagtaggcgtaaaattggtagtcgggttatttatttgatttcgtaattattatgggtattttaatcgattgcgtttacgtcgattcggtttatagttttattcgggaaggcgaaagtataagggtaattggttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgattttttcgcgcgtatcgtatgagtcgacgtttgagagtcggtttcgttttcgttaataattataacgataggcgatatgatcgtgtcgtttggcggtataagtagagcg

SEQ ID NO: 17258 - DNA, 1117 bp, Artificial Sequence
  chemically treated genomic DNA (Homo sapiens) CpG-island No: 17258
cgctctacttataccgccaaacgacacgatcatatcgcctatcgttataattattaacgaaaacgaaaccgactctcaaacgtcgactcatacgatacgcgcgaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaaccaattacccttatactttcgccttcccgaataaaactataaaccgaatcgacgtaaacgcaatcgattaaaatacccataataattacgaaatcaaataaataacccgactaccaattttacgcctactattttaacaaaactaaaaattcatcgacgatactctcttccaacaacaaacgcgttccgacgatacacacctatcccctaattataaaaaatacctactacgataacgcttaccgcctattacaaatccgaacaatcaacgaaaacgatattaacgcttttaccgcccgcttccaaccaaacgcgtttcatattactatcgcccgcatctttcaacaactatttcccgatacgaattaaaccgataaaaacaataacgtcgatatcgttataacgcgacaacgcctacccgacttcataaccaaaacccgtcaccacgttcaacacaccatccgacaaacctacttctttcgccaaccccgcgaaacgaatcgcactaaacgataatttttcaaacgattttaaaatcacgctatttcccgccgccaacgccgaaccgaatttccaacaaatcaacaacaacgaaaaattccacgacacgataacgacaatcacgccgaccgattcacgcacgatcatcgccaactcataactactaataatcgccacttcgccatacactttatcgatcgcttcgacgtaccaacgaataacgcgcgccgcgccgaaaatatcatcacgcaaactataacgaatcgatttaccgatatcgaaaatttccaacaataccaactcttcg

SEQ ID NO: 17259 - DNA, 1117 bp, Artificial Sequence
  chemically treated genomic DNA (Homo sapiens) CpG-island No: 17259
cgttttgtttatatcgttaaacggtacggttatatcgtttgtcgttgtagttattgacgaagacggaatcggtttttaggcgtcggtttatgcggtgcgcgcgggagagtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataattagttgtttttgtgttttcgttttttcgaataaagttatggatcgagtcggcgtgggcgtagtcgattaaggtgtttatggtggttgcgggattaagtggatggttcggttgttagttttgcgtttgttgttttaatagggttaagaatttatcggcgatgtttttttttagtaataggcgcgtttcggcgatgtatatttgttttttggttgtagaaaatgtttgttgcggtggcgtttgtcgtttgttgtaaattcgggtagttagcgaaaacgatgttggcgtttttgtcgttcgtttttagttagacgcgttttatgttgttgtcgttcgtattttttagtagttgtttttcggtacgggttgaatcggtaaaggtaatggcgtcgatatcgttatgacgcgatagcgtttgttcggttttatgattaaaattcgttattacgtttaatatattattcggtaagtttgtttttttcgttagtttcgcgagacgaatcgtattgagcggtgattttttagacggttttagaattacgttgtttttcgtcgttagcgtcgggtcgagtttttagtaagttagtaatagcgggaagttttacggtacgatggcggtaattacgtcgatcggtttacgtacgattatcgttagtttatggttattggtggtcgttatttcgttatatattttgtcgatcgtttcggcgtattagcgaatggcgcgcgtcgcgtcgggaatattattacgtagattgtgacgaatcggtttgtcggtgtcgagagtttttagtagtgttagtttttcg

SEQ ID NO: 17260 - DNA, 1117 bp, Artificial Sequence
  chemically treated genomic DNA (Homo sapiens) CpG-island No: 17260
cgaaaaactaacactactaaaaactctcgacaccgacaaaccgattcgtcacaatctacgtaataatattcccgacgcgacgcgcgccattcgctaatacgccgaaacgatcgacaaaatatataacgaaataacgaccaccaataaccataaactaacgataatcgtacgtaaaccgatcgacgtaattaccgccatcgtaccgtaaaacttcccgctattactaacttactaaaaactcgacccgacgctaacgacgaaaaacaacgtaattctaaaaccgtctaaaaaatcaccgctcaatacgattcgtctcgcgaaactaacgaaaaaaacaaacttaccgaataatatattaaacgtaataacgaattttaatcataaaaccgaacaaacgctatcgcgtcataacgatatcgacgccattacctttaccgattcaacccgtaccgaaaaacaactactaaaaaatacgaacgacaacaacataaaacgcgtctaactaaaaacgaacgacaaaaacgccaacatcgttttcgctaactacccgaatttacaacaaacgacaaacgccaccgcaacaaacattttctacaaccaaaaaacaaatatacatcgccgaaacgcgcctattactaaaaaaaaacatcgccgataaattcttaaccctattaaaacaacaaacgcaaaactaacaaccgaaccatccacttaatcccgcaaccaccataaacaccttaatcgactacgcccacgccgactcgatccataactttattcgaaaaaacgaaaacacaaaaacaactaattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgactctcccgcgcgcaccgcataaaccgacgcctaaaaaccgattccgtcttcgtcaataactacaacgacaaacgatataaccgtaccgtttaacgatataaacaaaacg

SEQ ID NO: 17261 - DNA, 618 bp, Artificial Sequence
  chemically treated genomic DNA (Homo sapiens) CpG-island No: 17261
gtttgaaggtgttgcgggatgtcgttttttcgcgcgtgaggttgcggttttgacggtgagttgggggcgcgttgtcgtcgtcggttagatttttttttattacggatatcggagtcggtgcgttttttatacgaatcgtggattttttttcgcgagtacgtattgttttttgcgtttacgttggttttttttttttacggacgcgcggcggttttttttttagggttaaggtcgcgttttttttttcgttcggggtttttattttttttttcgttcggttttggatttttttaggttttttcgtattttcgttcgtttcggacggtttcggtttttttttcgtttttatttttttgggtttcgttagatcggcgttttttttattttggatttttttagattttcggtttttttttttttcgtgttttttcgcgcgttttttatcgggcgtcgtgtttagggttaggatggtcggagttttaggggcgtagttcggattttcgggtcgttttttttgtcgcgtttttcggggtttcgcgttttttgggatgggttcggaaaggggtggggagtttttttaaaatataaaaatggaggttttttttgtttgatgtatat

SEQ ID NO: 17262 - DNA, 618 bp, Artificial Sequence
  chemically treated genomic DNA (Homo sapiens) CpG-island No: 17262
atatacatcaaacaaaaaaaacctccatttttatattttaaaaaaactccccacccctttccgaacccatcccaaaaaacgcgaaaccccgaaaaacgcgacaaaaaaaacgacccgaaaatccgaactacgcccctaaaactccgaccatcctaaccctaaacacgacgcccgataaaaaacgcgcgaaaaaacacgaaaaaaaaaaaaaccgaaaatctaaaaaaatccaaaataaaaaaaacgccgatctaacgaaacccaaaaaaataaaaacgaaaaaaaaaccgaaaccgtccgaaacgaacgaaaatacgaaaaaacctaaaaaaatccaaaaccgaacgaaaaaaaaaataaaaaccccgaacgaaaaaaaaaacgcgaccttaaccctaaaaaaaaaaccgccgcgcgtccgtaaaaaaaaaaaaccaacgtaaacgcaaaaaacaatacgtactcgcgaaaaaaaatccacgattcgtataaaaaacgcaccgactccgatatccgtaataaaaaaaaatctaaccgacgacgacaacgcgcccccaactcaccgtcaaaaccgcaacctcacgcgcgaaaaaacgacatcccgcaacaccttcaaac

SEQ ID NO: 17263 - DNA, 618 bp, Artificial Sequence
  chemically treated genomic DNA (Homo sapiens) CpG-island No: 17263
atgtgtattaaatagaaaaaatttttatttttatattttggggaagttttttattttttttcgggtttattttaggggacgcgagatttcgaggagcgcggtaagaagagcggttcgggggttcggattgcgtttttaggatttcggttattttggttttaggtacggcgttcggtagaaagcgcgcgggagggtacgagggggaggaaggtcggagatttgaggagatttaaggtgggagggacgtcggtttgacggggtttaagggggtaggggcggggaagggatcgaggtcgttcgaggcggacgggggtgcgggagggtttgagggggtttaaggtcgggcgaggggaagggtgggaatttcgaacgggggagagggcgcggttttggttttggggaggaggtcgtcgcgcgttcgtgaggggaggggattagcgtaaacgtaggaggtagtgcgtgttcgcggggaagagtttacgattcgtgtggaggacgtatcggtttcggtgttcgtgatgggagagggtttggtcggcgacgataacgcgtttttaatttatcgttagagtcgtagttttacgcgcgaaggaacggtatttcgtagtatttttagat

SEQ ID NO: 17264 - DNA, 618 bp, Artificial Sequence
  chemically treated genomic DNA (Homo sapiens) CpG-island No: 17264
atctaaaaatactacgaaataccgttccttcgcgcgtaaaactacgactctaacgataaattaaaaacgcgttatcgtcgccgaccaaaccctctcccatcacgaacaccgaaaccgatacgtcctccacacgaatcgtaaactcttccccgcgaacacgcactacctcctacgtttacgctaatcccctcccctcacgaacgcgcgacgacctcctccccaaaaccaaaaccgcgccctctcccccgttcgaaattcccacccttcccctcgcccgaccttaaaccccctcaaaccctcccgcacccccgtccgcctcgaacgacctcgatcccttccccgcccctacccccttaaaccccgtcaaaccgacgtccctcccaccttaaatctcctcaaatctccgaccttcctccccctcgtaccctcccgcgcgctttctaccgaacgccgtacctaaaaccaaaataaccgaaatcctaaaaacgcaatccgaacccccgaaccgctcttcttaccgcgctcctcgaaatctcgcgtcccctaaaataaacccgaaaaaaaataaaaaacttccccaaaatataaaaataaaaattttttctatttaatacacat

SEQ ID NO: 17265 - DNA, 546 bp, Artificial Sequence
  chemically treated genomic DNA (Homo sapiens) CpG-island No: 17265
gttggcgttggacgttttaataggttagtatcgatgtttgatgcgacgtttgacgcgttttattaggtttataaattttcgtatttttcgtaggtcggataaggcgtttacgtcgtattcggtaatggtgtcgattgttcgatgcgacgtttgcgcgttttattaggtttataaatagttcgaatttttcgtaggtcggataaggcgtttacgtcgtattcggtaattggtgtatgatgtttgatgcgacgtttgcgcgttttattaggtttataaattttcgtattattcgtaggtcggataaggcgtttacgttgtattcggtaattggtgtcgattgtttgatgtgacgttggcgcgttttattaggtttatatattttcgtatttttcgtaggtcggataaggcgtttacgtcgtattcggtaatggtgtcgattgtttgatgcgacgtttgcgcgttttattaggtttatagttttataacgtattgaaattgttggttttgtaggtcggataaggcgttcgcgtcgtattcggtatttta

SEQ ID NO: 17266 - DNA, 546 bp, Artificial Sequence
  chemically treated genomic DNA (Homo sapiens) CpG-island No: 17266
taaaataccgaatacgacgcgaacgccttatccgacctacaaaaccaacaatttcaatacgttataaaactataaacctaataaaacgcgcaaacgtcgcatcaaacaatcgacaccattaccgaatacgacgtaaacgccttatccgacctacgaaaaatacgaaaatatataaacctaataaaacgcgccaacgtcacatcaaacaatcgacaccaattaccgaatacaacgtaaacgccttatccgacctacgaataatacgaaaatttataaacctaataaaacgcgcaaacgtcgcatcaaacatcatacaccaattaccgaatacgacgtaaacgccttatccgacctacgaaaaattcgaactatttataaacctaataaaacgcgcaaacgtcgcatcgaacaatcgacaccattaccgaatacgacgtaaacgccttatccgacctacgaaaaatacgaaaatttataaacctaataaaacgcgtcaaacgtcgcatcaaacatcgatactaacctattaaaacgtccaacgccaac

SEQ ID NO: 17267 - DNA, 546 bp, Artificial Sequence
  chemically treated genomic DNA (Homo sapiens) CpG-island No: 17267
taaaatgtcggatgcggcgcgaacgttttattcggtttataaaattagtaattttaatacgttgtaaaattgtaggtttgataagacgcgtaagcgtcgtattaggtagtcggtattattgtcggatgcggcgtaaacgttttattcggtttacggagggtgcgggaatatgtaggtttgataagacgcgttagcgttatattaggtagtcggtattaattgtcggatgtagcgtaaacgttttattcggtttacggatggtgcgggaatttgtaggtttgataagacgcgtaagcgtcgtattaggtattatgtattaattgtcggatgcggcgtaaacgttttattcggtttacggagggttcggattatttgtaggtttgataagacgcgtaagcgtcgtatcgggtagtcggtattattgtcggatgcggcgtaaacgttttattcggtttacggagggtgcgggaatttgtaggtttgataagacgcgttaagcgtcgtattaggtatcggtgttggtttattaagacgtttagcgttagt

SEQ ID NO: 17268 - DNA, 546 bp, Artificial Sequence
  chemically treated genomic DNA (Homo sapiens) CpG-island No: 17268
actaacgctaaacgtcttaataaaccaacaccgatacctaatacgacgcttaacgcgtcttatcaaacctacaaattcccgcaccctccgtaaaccgaataaaacgtttacgccgcatccgacaataataccgactacccgatacgacgcttacgcgtcttatcaaacctacaaataatccgaaccctccgtaaaccgaataaaacgtttacgccgcatccgacaattaatacataatacctaatacgacgcttacgcgtcttatcaaacctacaaattcccgcaccatccgtaaaccgaataaaacgtttacgctacatccgacaattaataccgactacctaatataacgctaacgcgtcttatcaaacctacatattcccgcaccctccgtaaaccgaataaaacgtttacgccgcatccgacaataataccgactacctaatacgacgcttacgcgtcttatcaaacctacaattttacaacgtattaaaattactaattttataaaccgaataaaacgttcgcgccgcatccgacatttta

SEQ ID NO: 17269 - DNA, 703 bp, Artificial Sequence
  chemically treated genomic DNA (Homo sapiens) CpG-island No: 17269
  misc_feature (645)..(646): n is either a, c, g or t
  misc_feature (648)..(648): n is either a, c, g or t
  misc_feature (663)..(663): n is either a, c, g or t
  misc_feature (665)..(665): n is either a, c, g or t
  misc_feature (676)..(677): n is either a, c, g or t
  misc_feature (684)..(684): n is either a, c, g or t
  misc_feature (689)..(689): n is either a, c, g or t
  misc_feature (692)..(692): n is either a, c, g or t
  misc_feature (694)..(694): n is either a, c, g or t
  misc_feature (700)..(701): n is either a, c, g or t
ggtttaggcgatttagagacgttttaatattagattcgttggtatcgcgtagtgcgttttgttcggcgatagatttttgtagatgtagatttgtcgcgcgattaaagattattaggtttagtagcgagttgtcgtttagacggttagcgtcgtgtatcgatatataagcgattttattaacggtaaatagtttcggaataattatattttcgttttttttatttatagttagtgtttgatcggtaattttggtcggaatatcgtttattatgtagtgataggttgggataatcggaatcggtttttttatcggatcgacgtgagcgaaggtacgggaaagttttaggatattcggtagacgggattcgagaatttttttatttaggtgatcgagttttagtttcgcgtgtggtttttacggattattatagtcgcgatttttacggatttcgattatgatggaacgcgtaattacgttacggttcgttaggtttttggcgttcggcgtataacgttttataaaacgttcgttatgtttgtttagtagataatcgtttttattacggtaattttcggtgattagtacgttcgtatcggtaatgtcggtcgggtggaattgttatatttttatattttgtatcggtnnancgtcggttacggtantnagtttatgttnngattatncgttncgntncggtgnntt

SEQ ID NO: 17270 - DNA, 703 bp, Artificial Sequence
  chemically treated genomic DNA (Homo sapiens) CpG-island No: 17270
  misc_feature (3)..(4): n is either a, c, g or t
  misc_feature (10)..(10): n is either a, c, g or t
  misc_feature (12)..(12): n is either a, c, g or t
  misc_feature (15)..(15): n is either a, c, g or t
  misc_feature (20)..(20): n is either a, c, g or t
  misc_feature (27)..(28): n is either a, c, g or t
  misc_feature (39)..(39): n is either a, c, g or t
  misc_feature (41)..(41): n is either a, c, g or t
  misc_feature (56)..(56): n is either a, c, g or t
  misc_feature (58)..(59): n is either a, c, g or t
aanncaccgnancgnaacgnataatcnnaacataaactnantaccgtaaccgacgntnnaccgatacaaaatataaaaatataacaattccacccgaccgacattaccgatacgaacgtactaatcaccgaaaattaccgtaataaaaacgattatctactaaacaaacataacgaacgttttataaaacgttatacgccgaacgccaaaaacctaacgaaccgtaacgtaattacgcgttccatcataatcgaaatccgtaaaaatcgcgactataataatccgtaaaaaccacacgcgaaactaaaactcgatcacctaaataaaaaaattctcgaatcccgtctaccgaatatcctaaaactttcccgtaccttcgctcacgtcgatccgataaaaaaaccgattccgattatcccaacctatcactacataataaacgatattccgaccaaaattaccgatcaaacactaactataaataaaaaaaacgaaaatataattattccgaaactatttaccgttaataaaatcgcttatatatcgatacacgacgctaaccgtctaaacgacaactcgctactaaacctaataatctttaatcgcgcgacaaatctacatctacaaaaatctatcgccgaacaaaacgcactacgcgataccaacgaatctaatattaaaacgtctctaaatcgcctaaacc

SEQ ID NO: 17271 - DNA, 703 bp, Artificial Sequence
  chemically treated genomic DNA (Homo sapiens) CpG-island No: 17271
  misc_feature (3)..(4): n is either a, c, g or t
  misc_feature (10)..(10): n is either a, c, g or t
  misc_feature (12)..(12): n is either a, c, g or t
  misc_feature (15)..(15): n is either a, c, g or t
  misc_feature (20)..(20): n is either a, c, g or t
  misc_feature (27)..(28): n is either a, c, g or t
  misc_feature (39)..(39): n is either a, c, g or t
  misc_feature (41)..(41): n is either a, c, g or t
  misc_feature (56)..(56): n is either a, c, g or t
  misc_feature (58)..(59): n is either a, c, g or t
aanntatcgngncgnaacgngtagttnnggtatgggttnantatcgtagtcggcgntnnatcggtgtaggatatggaaatgtggtagttttattcgatcggtattgtcggtgcgggcgtattggttatcgaaggttgtcgtggtgaaggcggttatttgttgaataaatatggcgaacgttttatggagcgttatgcgtcgaacgttaaagatttggcgggtcgtgacgtggttgcgcgttttattatgatcgaaattcgtgaaggtcgcggttgtgatggttcgtgggggttatacgcgaaattgaaattcgattatttgggtaaagaagttttcgaatttcgtttgtcgggtattttggagttttttcgtattttcgtttacgtcgattcggtgaaagagtcgatttcggttattttaatttgttattatatgatgggcggtatttcgattaaagttatcggttaggtattgattgtgaatgagaaaggcgaagatgtggttgtttcgggattgtttgtcgttggtgaaatcgtttgtgtatcggtatacggcgttaatcgtttgggcggtaattcgttgttggatttggtggtttttggtcgcgcggtaggtttgtatttgtaagagtttatcgtcgagtagggcgtattgcgcgatgttagcgagtttgatgttgaagcgtttttggatcgtttgaatt

SEQ ID NO: 17272 - DNA, 703 bp, Artificial Sequence
  chemically treated genomic DNA (Homo sapiens) CpG-island No: 17272
  misc_feature (645)..(646): n is either a, c, g or t
  misc_feature (648)..(648): n is either a, c, g or t
  misc_feature (663)..(663): n is either a, c, g or t
  misc_feature (665)..(665): n is either a, c, g or t
  misc_feature (676)..(677): n is either a, c, g or t
  misc_feature (684)..(684): n is either a, c, g or t
  misc_feature (689)..(689): n is either a, c, g or t
  misc_feature (692)..(692): n is either a, c, g or t
  misc_feature (694)..(694): n is either a, c, g or t
  misc_feature (700)..(701): n is either a, c, g or t
aattcaaacgatccaaaaacgcttcaacatcaaactcgctaacatcgcgcaatacgccctactcgacgataaactcttacaaatacaaacctaccgcgcgaccaaaaaccaccaaatccaacaacgaattaccgcccaaacgattaacgccgtataccgatacacaaacgatttcaccaacgacaaacaatcccgaaacaaccacatcttcgcctttctcattcacaatcaatacctaaccgataactttaatcgaaataccgcccatcatataataacaaattaaaataaccgaaatcgactctttcaccgaatcgacgtaaacgaaaatacgaaaaaactccaaaatacccgacaaacgaaattcgaaaacttctttacccaaataatcgaatttcaatttcgcgtataacccccacgaaccatcacaaccgcgaccttcacgaatttcgatcataataaaacgcgcaaccacgtcacgacccgccaaatctttaacgttcgacgcataacgctccataaaacgttcgccatatttattcaacaaataaccgccttcaccacgacaaccttcgataaccaatacgcccgcaccgacaataccgatcgaataaaactaccacatttccatatcctacaccgatnnancgccgactacgatantnaacccataccnnaactacncgttncgncncgatanntt

SEQ ID NO: 17273 - DNA, 517 bp, Artificial Sequence
  chemically treated genomic DNA (Homo sapiens) CpG-island No: 17273
gtttcgtcgttgttagagtttttgttaggtttgcgcgcgttgtgcgacgaatttggcgcgttgttgattatcgatgaagtgatgatcggttttcgcgtagcgttagttggcgtataggattattacggcgtagtgttagatttaatttgtttcggtaaaattatcgtcggtggaatgtcggtaggcgtattcggtggtcgtcgtgatgtaatggatgcgttggtttcgacgggttcggtttattaggcgggtacgtttttcggtaattcgattgcgatggtagcgggtttcgtttgtttgaatgaagtcgcgtagtcgggcgtttacgaaacgttggatgagttgataatacgtttggtagaaggtttgttggaagcggtagaagaagtcggaatttcgttggtcgttaattacgttggcggtatgttcggtattttttttatcgacgtcgagttcgtgacgtgttattaggatgtgatggtttgtgacgtggaacgttttaagcgttttttttata

SEQ ID NO: 17274 - DNA, 517 bp, Artificial Sequence
  chemically treated genomic DNA (Homo sapiens) CpG-island No: 17274
tataaaaaaaacgcttaaaacgttccacgtcacaaaccatcacatcctaataacacgtcacgaactcgacgtcgataaaaaaaataccgaacataccgccaacgtaattaacgaccaacgaaattccgacttcttctaccgcttccaacaaaccttctaccaaacgtattatcaactcatccaacgtttcgtaaacgcccgactacgcgacttcattcaaacaaacgaaacccgctaccatcgcaatcgaattaccgaaaaacgtacccgcctaataaaccgaacccgtcgaaaccaacgcatccattacatcacgacgaccaccgaatacgcctaccgacattccaccgacgataattttaccgaaacaaattaaatctaacactacgccgtaataatcctatacgccaactaacgctacgcgaaaaccgatcatcacttcatcgataatcaacaacgcgccaaattcgtcgcacaacgcgcgcaaacctaacaaaaactctaacaacgacgaaac

SEQ ID NO: 17275 - DNA, 517 bp, Artificial Sequence
  chemically treated genomic DNA (Homo sapiens) CpG-island No: 17275
tatggaagaaacgtttaaagcgttttacgttataggttattatattttgatagtacgttacggattcggcgtcggtaaagaaaatatcgaatatgtcgttaacgtggttaacgattagcggaatttcggttttttttgtcgtttttagtagattttttgttagacgtgttgttagtttatttagcgtttcgtgaacgttcggttgcgcgattttatttagataggcgaaattcgttgttatcgtaatcgggttatcggaaagcgtattcgtttgatagatcggattcgtcggggttagcgtatttattatattacgacgattatcgaatgcgtttatcggtattttatcggcgatgattttgtcgaggtaggttaaatttggtattacgtcgtaataattttgtgcgttagttagcgttacgcggaaatcggttattattttatcgatgattagtaacgcgttaaattcgtcgtatagcgcgcgtagatttggtaggaattttggtagcggcggaat

SEQ ID NO: 17276 - DNA, 517 bp, Artificial Sequence
  chemically treated genomic DNA (Homo sapiens) CpG-island No: 17276
attccgccgctaccaaaattcctaccaaatctacgcgcgctatacgacgaatttaacgcgttactaatcatcgataaaataataaccgatttccgcgtaacgctaactaacgcacaaaattattacgacgtaataccaaatttaacctacctcgacaaaatcatcgccgataaaataccgataaacgcattcgataatcgtcgtaatataataaatacgctaaccccgacgaatccgatctatcaaacgaatacgctttccgataacccgattacgataacaacgaatttcgcctatctaaataaaatcgcgcaaccgaacgttcacgaaacgctaaataaactaacaacacgtctaacaaaaaatctactaaaaacgacaaaaaaaaccgaaattccgctaatcgttaaccacgttaacgacatattcgatattttctttaccgacgccgaatccgtaacgtactatcaaaatataataacctataacgtaaaacgctttaaacgtttcttccata

SEQ ID NO: 17277 - DNA, 566 bp, Artificial Sequence
  chemically treated genomic DNA (Homo sapiens) CpG-island No: 17277
atttagtagcggacgtagtagaaaatcgtcgaggcgtagggtttgtattttcgttatatagtgtgaacgattggttttttttatacgttcgttaaatcgcgtttgttgacgaaattgttggataacgtttatgttattgatgatttcgttaaagtcgtcgttgatattcgttaaataggcgcgtatacgacggataatcggcgtgttgtaacgttggtatattattattattattagtattatcgggaaaattattatcgttattagtgttattcgttagtcgaggttgaatatcgttattagtatcgcgtttattagcgcggtattgcgtaggatagttgttattacggttacgtttagatcgcggattattttagtgttattagtgacgcgggagattattgttcgacgggttgggttttaattcgtttaatgttggcgtatttattttttttcgtcgttttattgtgtttagttatgcgtcgtatcgcgcgttgcgtatgtttcgggatcgtggtttattgcggcgttgtgttttcggggttttgttatggtaacgttgagtt

SEQ ID NO: 17278 - DNA, 566 bp, Artificial Sequence
  chemically treated genomic DNA (Homo sapiens) CpG-island No: 17278
aactcaacgttaccataacaaaaccccgaaaacacaacgccgcaataaaccacgatcccgaaacatacgcaacgcgcgatacgacgcataactaaacacaataaaacgacgaaaaaaaataaatacgccaacattaaacgaattaaaacccaacccgtcgaacaataatctcccgcgtcactaataacactaaaataatccgcgatctaaacgtaaccgtaataacaactatcctacgcaataccgcgctaataaacgcgatactaataacgatattcaacctcgactaacgaataacactaataacgataataattttcccgataatactaataataataataatataccaacgttacaacacgccgattatccgtcgtatacgcgcctatttaacgaatatcaacgacgactttaacgaaatcatcaataacataaacgttatccaacaatttcgtcaacaaacgcgatttaacgaacgtataaaaaaaaccaatcgttcacactatataacgaaaatacaaaccctacgcctcgacgattttctactacgtccgctactaaat

SEQ ID NO: 17279 - DNA, 566 bp, Artificial Sequence
  chemically treated genomic DNA (Homo sapiens) CpG-island No: 17279
ggtttaacgttgttatggtaaaatttcgaaggtatagcgtcgtaatgggttacggtttcgggatatacgtagcgcgcgatacggcgtatagttaggtatagtgggacgacggagggaggtgggtacgttagtattaagcgagttgagatttaattcgtcggatagtgatttttcgcgttattaatgatattgaagtgattcgcgatttggacgtgatcgtagtggtaattgttttgcgtagtgtcgcgttggtgggcgcgatgttggtggcgatgtttagtttcgattggcgaatggtattggtggcgataatgattttttcggtggtgttggtggtaatggtgatatattagcgttatagtacgtcgattgttcgtcgtgtgcgcgtttatttggcggatattaacgacggttttaacgaaattattaatggtatgagcgttatttagtagtttcgttagtaggcgcgatttggcgaacgtatgggggaggttagtcgtttatattatatggcgaggatgtaaattttgcgtttcgacggttttttgttgcgttcgttgttgagt

SEQ ID NO: 17280 - DNA, 566 bp, Artificial Sequence
  chemically treated genomic DNA (Homo sapiens) CpG-island No: 17280
actcaacaacgaacgcaacaaaaaaccgtcgaaacgcaaaatttacatcctcgccatataatataaacgactaacctcccccatacgttcgccaaatcgcgcctactaacgaaactactaaataacgctcataccattaataatttcgttaaaaccgtcgttaatatccgccaaataaacgcgcacacgacgaacaatcgacgtactataacgctaatatatcaccattaccaccaacaccaccgaaaaaatcattatcgccaccaataccattcgccaatcgaaactaaacatcgccaccaacatcgcgcccaccaacgcgacactacgcaaaacaattaccactacgatcacgtccaaatcgcgaatcacttcaatatcattaataacgcgaaaaatcactatccgacgaattaaatctcaactcgcttaatactaacgtacccacctccctccgtcgtcccactatacctaactatacgccgtatcgcgcgctacgtatatcccgaaaccgtaacccattacgacgctataccttcgaaattttaccataacaacgttaaacc

SEQ ID NO: 17281 - DNA, 502 bp, Artificial Sequence
  chemically treated genomic DNA (Homo sapiens) CpG-island No: 17281
agcgtgttaggcgcgttttataggtttttattttacgatgtagcgtttgttgttttacgagatcggttattcgcgttagacgggttttgcgttcggtaattattttacgtagtcgtcgtttaaaattttgatgttgaatacgtttacgttgttagcgggtaattttcggtggtgtattgttttattcgcgtaatgattaggcggaggttttacgcgcgatggtttttagttgtgtcgttagatgtttcgttagttaggttatttgcggtagttgttgttgtttaattgtatgacgaagcgtagttagattatcgttcgtttcgtcgagataagtttgtagtgttgtcgtacgagtttgaaaaagatgtttgtcgaaacgagtatttagcgtggcgaattgtgatatcggggtataacgttgacgtagcgtagcgagttgtttttttagtttttttagtagtagggcggtttttacgataagattttaatgaaaatgataatt

SEQ ID NO: 17282 - DNA, 502 bp, Artificial Sequence
  chemically treated genomic DNA (Homo sapiens) CpG-island No: 17282
aattatcattttcattaaaatcttatcgtaaaaaccgccctactactaaaaaaactaaaaaaacaactcgctacgctacgtcaacgttataccccgatatcacaattcgccacgctaaatactcgtttcgacaaacatctttttcaaactcgtacgacaacactacaaacttatctcgacgaaacgaacgataatctaactacgcttcgtcatacaattaaacaacaacaactaccgcaaataacctaactaacgaaacatctaacgacacaactaaaaaccatcgcgcgtaaaacctccgcctaatcattacgcgaataaaacaatacaccaccgaaaattacccgctaacaacgtaaacgtattcaacatcaaaattttaaacgacgactacgtaaaataattaccgaacgcaaaacccgtctaacgcgaataaccgatctcgtaaaacaacaaacgctacatcgtaaaataaaaacctataaaacgcgcctaacacgct

SEQ ID NO: 17283 - DNA, 502 bp, Artificial Sequence
  chemically treated genomic DNA (Homo sapiens) CpG-island No: 17283
aattattatttttattgaggttttatcgtgaaaatcgttttgttgttggaaaaattggaaggatagttcgttacgttgcgttagcgttgtgtttcggtgttatagttcgttacgttaagtgttcgtttcgataggtattttttttagattcgtgcgataatattataggtttgtttcgacgaggcgggcgataatttggttgcgtttcgttatgtagttgagtagtaatagttgtcgtaagtggtttggttggcggaatatttggcggtataattggaagttatcgcgcgtgaagttttcgtttggttattgcgcgagtgggatagtgtattatcgaaaattgttcgttggtagcgtaaacgtatttagtattaggattttgagcggcggttacgtgagatggttgtcgaacgtagagttcgtttggcgcgggtgatcgatttcgtggaatagtaaacgttgtatcgtgaagtggaagtttatgaagcgcgtttggtacgtt

SEQ ID NO: 17284 - DNA, 502 bp, Artificial Sequence
  chemically treated genomic DNA (Homo sapiens) CpG-island No: 17284
aacgtaccaaacgcgcttcataaacttccacttcacgatacaacgtttactattccacgaaatcgatcacccgcgccaaacgaactctacgttcgacaaccatctcacgtaaccgccgctcaaaatcctaatactaaatacgtttacgctaccaacgaacaattttcgataatacactatcccactcgcgcaataaccaaacgaaaacttcacgcgcgataacttccaattataccgccaaatattccgccaaccaaaccacttacgacaactattactactcaactacataacgaaacgcaaccaaattatcgcccgcctcgtcgaaacaaacctataatattatcgcacgaatctaaaaaaaatacctatcgaaacgaacacttaacgtaacgaactataacaccgaaacacaacgctaacgcaacgtaacgaactatccttccaatttttccaacaacaaaacgattttcacgataaaacctcaataaaaataataatt

SEQ ID NO: 17285 - DNA, 692 bp, Artificial Sequence
  chemically treated genomic DNA (Homo sapiens) CpG-island No: 17285
atgtgatgttgtttatttcggatttcgttggcgcgaaggaattggatttgattatttcgcgtttggaagataaatttatcgcgttgttggcgatgatcggtaaatcgacgttatcgttgggtttggcggtaaaagcggtgttggatattttcgtagaacgcgaagtttgttcgatgtattttgcgtcgatttttagtatcgttaatattttgatgatgggtgacgcgttggcgatggcggttatgtaggcgcgcggatttaatgaagaagattttgttcgtttttatttagtcggggtattgggcgttcgtttgttgaataaagtgtattatttgatgcgtcgtgacgatgttattttataggtggcgttaatcgttagcgtgatggatgcgatgttggaatttagtcgtatcggtttggggttggtggcggtatgtgacgtttaataataggtataaggcgtttttatcgacggcgatttacgtcgttggttggttggcggcggcgtatttattacgttagttaatgaagcgatgacggtcggcggtattacgttgtaatcgtaaagtcgcgttatcgacgttaaagagattttgatgaagcgtaaaattattgtcgtatcggtggtggatgaaaacgggaaatttatcggcgtaataaaattgtaggatttttattaagggcggggatta

SEQ ID NO: 17286 - DNA, 692 bp, Artificial Sequence
  chemically treated genomic DNA (Homo sapiens) CpG-island No: 17286
taatccccgcccttaataaaaatcctacaattttattacgccgataaatttcccgttttcatccaccaccgatacgacaataattttacgcttcatcaaaatctctttaacgtcgataacgcgactttacgattacaacgtaataccgccgaccgtcatcgcttcattaactaacgtaataaatacgccgccgccaaccaaccaacgacgtaaatcgccgtcgataaaaacgccttatacctattattaaacgtcacataccgccaccaaccccaaaccgatacgactaaattccaacatcgcatccatcacgctaacgattaacgccacctataaaataacatcgtcacgacgcatcaaataatacactttattcaacaaacgaacgcccaataccccgactaaataaaaacgaacaaaatcttcttcattaaatccgcgcgcctacataaccgccatcgccaacgcgtcacccatcatcaaaatattaacgatactaaaaatcgacgcaaaatacatcgaacaaacttcgcgttctacgaaaatatccaacaccgcttttaccgccaaacccaacgataacgtcgatttaccgatcatcgccaacaacgcgataaatttatcttccaaacgcgaaataatcaaatccaattccttcgcgccaacgaaatccgaaataaacaacatcacat

SEQ ID NO: 17287 - DNA, 692 bp, Artificial Sequence
  chemically treated genomic DNA (Homo sapiens) CpG-island No: 17287
taattttcgtttttgatagaaattttgtagttttattgcgtcggtgagtttttcgtttttatttattatcggtgcggtagtgattttgcgttttattaggatttttttggcgtcgatggcgcgattttgcgattgtaacgtggtgtcgtcgatcgttatcgttttattgattggcgtggtgagtgcgtcgtcgttaattagttagcgacgtaaatcgtcgtcggtaaagacgttttgtatttgttgttgagcgttatatatcgttattagttttagatcggtgcggttgagttttagtatcgtatttattacgttggcggttaacgttatttgtgggatggtatcgttacggcgtattagatgatgtattttatttagtaagcgagcgtttagtgtttcggttgggtgggagcgggtaaaattttttttattaaattcgcgcgtttgtatgatcgttatcgttagcgcgttatttattattagggtattgacggtgttggaggtcggcgtaaggtgtatcgggtaggtttcgcgttttacggagatatttagtatcgtttttgtcgttaggtttagcggtgacgtcggtttgtcggttatcgttagtagcgcgatagatttattttttagacgcggaataattagatttagttttttcgcgttaacggagttcgagataaatagtattatat

SEQ ID NO: 17288 - DNA, 692 bp, Artificial Sequence
  chemically treated genomic DNA (Homo sapiens) CpG-island No: 17288
atataatactatttatctcgaactccgttaacgcgaaaaaactaaatctaattattccgcgtctaaaaaataaatctatcgcgctactaacgataaccgacaaaccgacgtcaccgctaaacctaacgacaaaaacgatactaaatatctccgtaaaacgcgaaacctacccgatacaccttacgccgacctccaacaccgtcaataccctaataataaataacgcgctaacgataacgatcatacaaacgcgcgaatttaataaaaaaaattttacccgctcccacccaaccgaaacactaaacgctcgcttactaaataaaatacatcatctaatacgccgtaacgataccatcccacaaataacgttaaccgccaacgtaataaatacgatactaaaactcaaccgcaccgatctaaaactaataacgatatataacgctcaacaacaaatacaaaacgtctttaccgacgacgatttacgtcgctaactaattaacgacgacgcactcaccacgccaatcaataaaacgataacgatcgacgacaccacgttacaatcgcaaaatcgcgccatcgacgccaaaaaaatcctaataaaacgcaaaatcactaccgcaccgataataaataaaaacgaaaaactcaccgacgcaataaaactacaaaatttctatcaaaaacgaaaatta

SEQ ID NO: 17289 - DNA, 674 bp, Artificial Sequence
  chemically treated genomic DNA (Homo sapiens) CpG-island No: 17289
tgtttatggcgggttgttggttttattattattgtgggtacgtcggtgtcggttaagtgtatcgtttcgtcgttcgtgtcgtcgttgttgaatatatttgtttgtaacggtacgttaatttttgtcgttacggtttcgatttaggcggtaagttttggcggcgtaattagcgatttgtcgtttaatattagtatcggttcgttattaatttggcgatggttagtcgcgttataattaaagtttttcgtttagtaggcggtattaagtataatggcgacgttcggcgatatcgcgcgggtggtagtttgttcgtcgcgtaattttattttttcgttggaatttgttattagttatattttcgtaggtagttcggcgtcgtgtagttcgcgtagtaacgttattagtagatagtaatcgaggcggttattaaaggttttttttattattcgttggtgagggagaatttgaaaagtggtattaaacgtgacgcgatcgtcgggacgaattttcgtttgtattatttcgttataggagcgcgtattaatgtttacgcgtatggcgttgacgttatttttttgtcggtcgtcgttaagtaggtttggaattttgtattttttacgggtggtgatgcgtatcggttgtagttggcgggtagttatgcgtacgttgttaat

SEQ ID NO: 17290 - DNA, 674 bp, Artificial Sequence
  chemically treated genomic DNA (Homo sapiens) CpG-island No: 17290
attaacaacgtacgcataactacccgccaactacaaccgatacgcatcaccacccgtaaaaaatacaaaattccaaacctacttaacgacgaccgacaaaaaaataacgtcaacgccatacgcgtaaacattaatacgcgctcctataacgaaataatacaaacgaaaattcgtcccgacgatcgcgtcacgtttaataccacttttcaaattctccctcaccaacgaataataaaaaaaacctttaataaccgcctcgattactatctactaataacgttactacgcgaactacacgacgccgaactacctacgaaaatataactaataacaaattccaacgaaaaaataaaattacgcgacgaacaaactaccacccgcgcgatatcgccgaacgtcgccattatacttaataccgcctactaaacgaaaaactttaattataacgcgactaaccatcgccaaattaataacgaaccgatactaatattaaacgacaaatcgctaattacgccgccaaaacttaccgcctaaatcgaaaccgtaacgacaaaaattaacgtaccgttacaaacaaatatattcaacaacgacgacacgaacgacgaaacgatacacttaaccgacaccgacgtacccacaataataataaaaccaacaacccgccataaaca

SEQ ID NO: 17291 - DNA, 674 bp, Artificial Sequence
  chemically treated genomic DNA (Homo sapiens) CpG-island No: 17291
gttggtaacgtacgtatggttgttcgttagttgtagtcggtgcgtattattattcgtgaagagtgtaaaattttaggtttgtttgacggcgatcggtaggggaatgacgttagcgttatgcgcgtggatattggtgcgcgtttttatgacgaagtgatgtaggcgggaattcgtttcggcgatcgcgttacgtttgatattattttttaggtttttttttattagcgagtgatggggaaagtttttgatgatcgtttcggttgttatttgttggtgacgttattgcgcgaattgtacgacgtcgaattatttgcggaagtgtggttggtggtaagttttagcgaagaggtgggattacgcggcgggtaaattgttattcgcgcggtgtcgtcggacgtcgttattgtgtttgatatcgtttgttgggcgaaaaattttgattatggcgcggttaattatcgttagattggtaacgggtcgatgttggtgttaagcgataagtcgttgattgcgtcgttaaaatttatcgtttgggtcgaaatcgtggcggtagaaattggcgtgtcgttgtaggtagatatgtttagtaacggcggtacggacggcggggcggtgtatttaatcggtatcggcgtgtttatagtggtgatggggttagtaattcgttatggata

SEQ ID NO: 17292 - DNA, 674 bp, Artificial Sequence
  chemically treated genomic DNA (Homo sapiens) CpG-island No: 17292
tatccataacgaattactaaccccatcaccactataaacacgccgataccgattaaatacaccgccccgccgtccgtaccgccgttactaaacatatctacctacaacgacacgccaatttctaccgccacgatttcgacccaaacgataaattttaacgacgcaatcaacgacttatcgcttaacaccaacatcgacccgttaccaatctaacgataattaaccgcgccataatcaaaatttttcgcccaacaaacgatatcaaacacaataacgacgtccgacgacaccgcgcgaataacaatttacccgccgcgtaatcccacctcttcgctaaaacttaccaccaaccacacttccgcaaataattcgacgtcgtacaattcgcgcaataacgtcaccaacaaataacaaccgaaacgatcatcaaaaactttccccatcactcgctaataaaaaaaaacctaaaaaataatatcaaacgtaacgcgatcgccgaaacgaattcccgcctacatcacttcgtcataaaaacgcgcaccaatatccacgcgcataacgctaacgtcattcccctaccgatcgccgtcaaacaaacctaaaattttacactcttcacgaataataatacgcaccgactacaactaacgaacaaccatacgtacgttaccaac

SEQ ID NO: 17293 - DNA, 687 bp, Artificial Sequence
  chemically treated genomic DNA (Homo sapiens) CpG-island No: 17293
taggttattgatgttcggggtcgacgaataggaagcgtattagcgtttaagttaatggttgcgcgatgaatttttttacgtgcgatgcgtcgttggcggaagttaaatttgacgaacgtggaattattgtcggttttattgattaatttgaattcgtaaattattcgcgttcgtatcgtgtgtagcggtagtgtaggcggtattttgacgtcgattttttttttagattttaatgcgttgggtaattttttcgtagttaaaggcgttgacgtcgagtaattcgtattggaaaacggtttgacgttggtattgaaaaatattgagtttcgtttgttggatagcgacggtgttattagcgcgattttggaagtttatcgatttttggttggcgatatttttttggcgcgaatatttattggtaggcgttagcgtcggattaagttgcgtcgaagtaattgttgttagcgcgaattatttttgcgaagagttttttcgttttagtagtagttatttgtaagaacgtgttttggacgtacgcgacgtttgtttttagttattttagtaaatttacggtgagtaacgtttttcggtatcgggtaaattgacgtagttcgttatttgtatggttgatgaattgatttttagttagtttttcgaattggataaaaattattttaaaggattgtt

SEQ ID NO: 17294 - DNA, 687 bp, Artificial Sequence
  chemically treated genomic DNA (Homo sapiens) CpG-island No: 17294
aacaatcctttaaaataatttttatccaattcgaaaaactaactaaaaatcaattcatcaaccatacaaataacgaactacgtcaatttacccgataccgaaaaacgttactcaccgtaaatttactaaaataactaaaaacaaacgtcgcgtacgtccaaaacacgttcttacaaataactactactaaaacgaaaaaactcttcgcaaaaataattcgcgctaacaacaattacttcgacgcaacttaatccgacgctaacgcctaccaataaatattcgcgccaaaaaaatatcgccaaccaaaaatcgataaacttccaaaatcgcgctaataacaccgtcgctatccaacaaacgaaactcaatatttttcaataccaacgtcaaaccgttttccaatacgaattactcgacgtcaacgcctttaactacgaaaaaattacccaacgcattaaaatctaaaaaaaaaatcgacgtcaaaataccgcctacactaccgctacacacgatacgaacgcgaataatttacgaattcaaattaatcaataaaaccgacaataattccacgttcgtcaaatttaacttccgccaacgacgcatcgcacgtaaaaaaattcatcgcgcaaccattaacttaaacgctaatacgcttcctattcgtcgaccccgaacatcaataaccta

SEQ ID NO: 17295 - DNA, 687 bp, Artificial Sequence
  chemically treated genomic DNA (Homo sapiens) CpG-island No: 17295
aataattttttgaggtgatttttatttagttcgaggaattggttgggggttagtttattagttatataaatggcgggttgcgttagtttgttcggtgtcgggaagcgttgtttatcgtagatttgttggagtaattggaagtagacgtcgcgtacgtttagggtacgtttttgtaggtagttgttgttggaacgggaaaatttttcgtaaaagtgattcgcgttggtaataattgtttcggcgtagtttaattcggcgttgacgtttgttagtaaatgttcgcgttagggaagtatcgttagttagggatcggtgagtttttagaatcgcgttggtagtatcgtcgttatttagtagacgaaatttaatgttttttagtattagcgttaggtcgttttttagtgcggattgttcggcgttaacgtttttggttgcgggaagattatttagcgtattgagatttaaagaagagatcggcgttagaatgtcgtttgtattatcgttgtatacggtgcgggcgcggataatttgcggatttagattggttagtgaaatcggtagtggttttacgttcgttagatttaattttcgttagcggcgtatcgtacgtgggggaatttatcgcgtagttattggtttaaacgttggtgcgttttttgttcgtcggtttcggatattagtaatttg

SEQ ID NO: 17296 - DNA, 687 bp, Artificial Sequence
  chemically treated genomic DNA (Homo sapiens) CpG-island No: 17296
caaattactaatatccgaaaccgacgaacaaaaaacgcaccaacgtttaaaccaataactacgcgataaattcccccacgtacgatacgccgctaacgaaaattaaatctaacgaacgtaaaaccactaccgatttcactaaccaatctaaatccgcaaattatccgcgcccgcaccgtatacaacgataatacaaacgacattctaacgccgatctcttctttaaatctcaatacgctaaataatcttcccgcaaccaaaaacgttaacgccgaacaatccgcactaaaaaacgacctaacgctaatactaaaaaacattaaatttcgtctactaaataacgacgatactaccaacgcgattctaaaaactcaccgatccctaactaacgatacttccctaacgcgaacatttactaacaaacgtcaacgccgaattaaactacgccgaaacaattattaccaacgcgaatcacttttacgaaaaattttcccgttccaacaacaactacctacaaaaacgtaccctaaacgtacgcgacgtctacttccaattactccaacaaatctacgataaacaacgcttcccgacaccgaacaaactaacgcaacccgccatttatataactaataaactaacccccaaccaattcctcgaactaaataaaaatcacctcaaaaaattatt

SEQ ID NO: 17297 - DNA, 510 bp, Artificial Sequence
  chemically treated genomic DNA (Homo sapiens) CpG-island No: 17297
tattatttagggcgttcgtttgttggaataaacgttggtttgggcgtagtagaaattagagttagttaatacgttgtaatcgattttggaaaaattgtattaggcgtagacgtttagttaataagaaagttattagttgtttttagcggtggtgcgtggcgagttgaagtcggaataattggcggcggcgttggtgagtatgaaaattcgcggtgagtattcgaacgagatcgtcggggtagtaatcgcgttattggaaaacgtagcgtcgttttcgcgttcggattatttgtttgttgatatcgtcggtattggcggtgacggtagtaatagtattaatatttttatcgttagtgcgtttgtcgtcgcggtttgtgggttgaaagtggcgaaatacggtaatcgtagcgtttttagtaaatttggttcgttcgatttgttggcggcgttcggtattaattttgatatgaacgtcgataaatcgcgttaggcgttggatgagttaggtgt

SEQ ID NO: 17298 - DNA, 510 bp, Artificial Sequence
  chemically treated genomic DNA (Homo sapiens) CpG-island No: 17298
acacctaactcatccaacgcctaacgcgatttatcgacgttcatatcaaaattaataccgaacgccgccaacaaatcgaacgaaccaaatttactaaaaacgctacgattaccgtatttcgccactttcaacccacaaaccgcgacgacaaacgcactaacgataaaaatattaatactattactaccgtcaccgccaataccgacgatatcaacaaacaaataatccgaacgcgaaaacgacgctacgttttccaataacgcgattactaccccgacgatctcgttcgaatactcaccgcgaattttcatactcaccaacgccgccgccaattattccgacttcaactcgccacgcaccaccgctaaaaacaactaataactttcttattaactaaacgtctacgcctaatacaatttttccaaaatcgattacaacgtattaactaactctaatttctactacgcccaaaccaacgtttattccaacaaacgaacgccctaaataata

SEQ ID NO: 17299 - DNA, 510 bp, Artificial Sequence
  chemically treated genomic DNA (Homo sapiens) CpG-island No: 17299
atatttaatttatttagcgtttggcgcgatttatcggcgtttatattaagattaatatcgaacgtcgttagtagatcggacgaattagatttattggagacgttacggttgtcgtgtttcgttatttttagtttataggtcgcggcgataaacgtattggcggtagaaatattgatattgttgttgtcgttatcgttagtatcgacgatattagtaaatagataattcgggcgcgggaacggcgttgcgttttttagtagcgcggttgttgtttcggcgatttcgttcgggtgtttatcgcgaatttttatgtttattagcgtcgtcgttagttgtttcggttttagttcgttacgtattatcgttgaaaatagttggtggtttttttgttggttaagcgtttgcgtttgatatagtttttttagaatcggttgtagcgtgttggttggttttagtttttgttgcgtttaggttagcgtttgttttagtaggcgagcgttttgggtggtg

SEQ ID NO: 17300 - DNA, 510 bp, Artificial Sequence
  chemically treated genomic DNA (Homo sapiens) CpG-island No: 17300
caccacccaaaacgctcgcctactaaaacaaacgctaacctaaacgcaacaaaaactaaaaccaaccaacacgctacaaccgattctaaaaaaactatatcaaacgcaaacgcttaaccaacaaaaaaaccaccaactattttcaacgataatacgtaacgaactaaaaccgaaacaactaacgacgacgctaataaacataaaaattcgcgataaacacccgaacgaaatcgccgaaacaacaaccgcgctactaaaaaacgcaacgccgttcccgcgcccgaattatctatttactaatatcgtcgatactaacgataacgacaacaacaatatcaatatttctaccgccaatacgtttatcgccgcgacctataaactaaaaataacgaaacacgacaaccgtaacgtctccaataaatctaattcgtccgatctactaacgacgttcgatattaatcttaatataaacgccgataaatcgcgccaaacgctaaataaattaaatat

SEQ ID NO: 17301 - DNA, 525 bp, Artificial Sequence
  chemically treated genomic DNA (Homo sapiens) CpG-island No: 17301
gtttttcgtacgttttttcgcgtcgcggtgtttgtgggtcggtttttagacgcgttcgtcggtttttgggtttttattggttggacgtgggtttgtttcgcgttcgcgcgttcgttcgttttttatttgtttttaattcggtaggaattttatattagttaggaggagaaggacggtgcgcgcgggtgcgggtttggtcggttggggtcggcgcgggggcggcgaggggcgtcgggcggcgtcggtttgcgagcgggtcgggggcgtcgcgggtcgttttgttttataaggggtcgtgtcgttttcgtcgtcgggcgggtgtcgggcggatcgcggcggtggcggcggcggttgcgattggtttaggcgttttattcggggattgggttcggcgttgttcgttcgttttaaaggtattaatatggcggaggtgagtagggaaatcgggtaggagtagtcgggttggagcgggcgttcggcggtttttcgcgattttcgagttagtttgggggattcggggttttt

SEQ ID NO: 17302 - DNA, 525 bp, Artificial Sequence
  chemically treated genomic DNA (Homo sapiens) CpG-island No: 17302
aaaaaccccgaatcccccaaactaactcgaaaatcgcgaaaaaccgccgaacgcccgctccaacccgactactcctacccgatttccctactcacctccgccatattaatacctttaaaacgaacgaacaacgccgaacccaatccccgaataaaacgcctaaaccaatcgcaaccgccgccgccaccgccgcgatccgcccgacacccgcccgacgacgaaaacgacacgaccccttataaaacaaaacgacccgcgacgcccccgacccgctcgcaaaccgacgccgcccgacgcccctcgccgcccccgcgccgaccccaaccgaccaaacccgcacccgcgcgcaccgtccttctcctcctaactaatataaaattcctaccgaattaaaaacaaataaaaaacgaacgaacgcgcgaacgcgaaacaaacccacgtccaaccaataaaaacccaaaaaccgacgaacgcgtctaaaaaccgacccacaaacaccgcgacgcgaaaaaacgtacgaaaaac

SEQ ID NO: 17303 - DNA, 525 bp, Artificial Sequence
  chemically treated genomic DNA (Homo sapiens) CpG-island No: 17303
aagagtttcggattttttaggttggttcgggggtcgcggggagtcgtcgggcgttcgttttagttcggttgtttttgttcggtttttttgtttattttcgttatattggtatttttagggcgaacgagtagcgtcgagtttagttttcggatggggcgtttgagttaatcgtagtcgtcgtcgttatcgtcgcggttcgttcggtattcgttcggcggcggaggcggtacggttttttatagggtagggcggttcgcgacgttttcggttcgttcgtaagtcgacgtcgttcggcgtttttcgtcgttttcgcgtcggttttagtcggttagattcgtattcgcgcgtatcgtttttttttttttggttggtgtaaagtttttgtcgaattggaggtaagtgggggacggacggacgcgcgggcgcgggatagatttacgtttagttagtggaggtttaagagtcggcgggcgcgtttgggaatcgatttatagatatcgcggcgcgggagggcgtgcgggaggt

SEQ ID NO: 17304 - DNA, 525 bp, Artificial Sequence
  chemically treated genomic DNA (Homo sapiens) CpG-island No: 17304
acctcccgcacgccctcccgcgccgcgatatctataaatcgattcccaaacgcgcccgccgactcttaaacctccactaactaaacgtaaatctatcccgcgcccgcgcgtccgtccgtcccccacttacctccaattcgacaaaaactttacaccaaccaaaaaaaaaaaaacgatacgcgcgaatacgaatctaaccgactaaaaccgacgcgaaaacgacgaaaaacgccgaacgacgtcgacttacgaacgaaccgaaaacgtcgcgaaccgccctaccctataaaaaaccgtaccgcctccgccgccgaacgaataccgaacgaaccgcgacgataacgacgacgactacgattaactcaaacgccccatccgaaaactaaactcgacgctactcgttcgccctaaaaataccaatataacgaaaataaacaaaaaaaccgaacaaaaacaaccgaactaaaacgaacgcccgacgactccccgcgacccccgaaccaacctaaaaaatccgaaactctt

SEQ ID NO: 17305 - DNA, 804 bp, Artificial Sequence
  chemically treated genomic DNA (Homo sapiens) CpG-island No: 17305
agttcgtagtacgtgatgggtagcgtttggtttagggggagtagacgatttagacgacggttagcggggttggcggcggcgcggggaggagggggtcggatttgggagattatcgttcgttttcgtttcgtttcggagtttattagtaggttttttacgttgatggggtttcggtatcgacggcgaatcgtttttttcgtcgggtttaggaggagattgggtaattttttcgtcggtcgttgttgatttatgttgttcggtcgggcgttttgtttttttcgtattttacgagttttttcgttttttcgcgtttagttcgagtatcgttttttacgcgtcgatttttaagggtttagtatttaaggggttcgcggtttttttcgaggcgtcgttcggttaggtcgtttcgttcgttagtaaacgcggtacggttttacgtgttcgggagttttcgacgtagacggaaaaagaggagggagattcgcggattttaagtcgttcggttcgttattttttcgtatgcgtagtatatcgtttttttttgcgtatgttcgtcgttgtcggagcgtttttacgtatcgattttttttcggcggttgtcgttcgggaaattcggatcgcggaatttacggagaggttggtaaaggaaaaggaagaggtggagtcgaattcgatattaagtttatcgatatcgtcgatttcgagggggggttcggtatttagtttttgttttttttagtgagggttaattgcgcgtttggcgtaattatggttatatgattataatttcgagtttggcgtaat

SEQ ID NO: 17306 - DNA, 804 bp, Artificial Sequence
  chemically treated genomic DNA (Homo sapiens) CpG-island No: 17306
attacgccaaactcgaaattataatcatataaccataattacgccaaacgcgcaattaaccctcactaaaaaaaacaaaaactaaataccgaaccccccctcgaaatcgacgatatcgataaacttaatatcgaattcgactccacctcttccttttcctttaccaacctctccgtaaattccgcgatccgaatttcccgaacgacaaccgccgaaaaaaaatcgatacgtaaaaacgctccgacaacgacgaacatacgcaaaaaaaaacgatatactacgcatacgaaaaaataacgaaccgaacgacttaaaatccgcgaatctccctcctctttttccgtctacgtcgaaaactcccgaacacgtaaaaccgtaccgcgtttactaacgaacgaaacgacctaaccgaacgacgcctcgaaaaaaaccgcgaaccccttaaatactaaacccttaaaaatcgacgcgtaaaaaacgatactcgaactaaacgcgaaaaaacgaaaaaactcgtaaaatacgaaaaaaacaaaacgcccgaccgaacaacataaatcaacaacgaccgacgaaaaaattacccaatctcctcctaaacccgacgaaaaaaacgattcgccgtcgataccgaaaccccatcaacgtaaaaaacctactaataaactccgaaacgaaacgaaaacgaacgataatctcccaaatccgaccccctcctccccgcgccgccgccaaccccgctaaccgtcgtctaaatcgtctactccccctaaaccaaacgctacccatcacgtactacgaact

SEQ ID NO: 17307 - DNA, 804 bp, Artificial Sequence
  chemically treated genomic DNA (Homo sapiens) CpG-island No: 17307
attacgttaagttcggaattatggttatatgattatgattacgttaagcgcgtaattaatttttattaaagggaataaaagttgggtatcgggttttttttcgaggtcgacggtatcgataagtttgatatcgaattcggttttatttttttttttttttttgttagttttttcgtggatttcgcggttcgggtttttcgggcggtagtcgtcgggagaggatcggtgcgtgggagcgtttcggtagcggcgggtatgcgtagaggggggcggtgtattgcgtatgcgggaagatggcgggtcgggcgatttgagattcgcgggtttttttttttttttttcgtttgcgtcgggagttttcgggtacgtgaggtcgtgtcgcgtttattggcgggcgggacggtttagtcgggcggcgtttcggaggaagtcgcggattttttaggtgttgggtttttggaaatcggcgcgtggggggcggtgttcgagttgagcgcgagagggcgggagagttcgtggggtgcgaggggagtaggacgttcggtcgggtagtatgagttagtagcggtcggcgaggaagttatttagtttttttttggattcgacggaggagacggttcgtcgtcggtgtcgagattttattaacgtggagggtttgttggtaagtttcgggacgggacggggacgggcggtggttttttaaattcggttttttttttttcgcgtcgtcgttaatttcgttggtcgtcgtttgggtcgtttgttttttttgggttaggcgttgtttattacgtgttgcgaatt

SEQ ID NO: 17308 - DNA, 804 bp, Artificial Sequence
  chemically treated genomic DNA (Homo sapiens) CpG-island No: 17308
aattcgcaacacgtaataaacaacgcctaacccaaaaaaaacaaacgacccaaacgacgaccaacgaaattaacgacgacgcgaaaaaaaaaaaaccgaatttaaaaaaccaccgcccgtccccgtcccgtcccgaaacttaccaacaaaccctccacgttaataaaatctcgacaccgacgacgaaccgtctcctccgtcgaatccaaaaaaaaactaaataacttcctcgccgaccgctactaactcatactacccgaccgaacgtcctactcccctcgcaccccacgaactctcccgccctctcgcgctcaactcgaacaccgccccccacgcgccgatttccaaaaacccaacacctaaaaaatccgcgacttcctccgaaacgccgcccgactaaaccgtcccgcccgccaataaacgcgacacgacctcacgtacccgaaaactcccgacgcaaacgaaaaaaaaaaaaaaaaacccgcgaatctcaaatcgcccgacccgccatcttcccgcatacgcaatacaccgcccccctctacgcatacccgccgctaccgaaacgctcccacgcaccgatcctctcccgacgactaccgcccgaaaaacccgaaccgcgaaatccacgaaaaaactaacaaaaaaaaaaaaaaaaataaaaccgaattcgatatcaaacttatcgataccgtcgacctcgaaaaaaaacccgatacccaacttttattccctttaataaaaattaattacgcgcttaacgtaatcataatcatataaccataattccgaacttaacgtaat

SEQ ID NO: 17309 - DNA, 815 bp, Artificial Sequence
  chemically treated genomic DNA (Homo sapiens) CpG-island No: 17309
cgcgcgggttcggattaatacgtcgggggagttcggtttacgttttttttggattttcgtttcgtttttttcgtggggaggggcgcgttaggcggatttggtatttttcggttgttgggtttcgtcgggagttacgcggggaggtttaggtagtcgggacgtaggtagcgttttcgtcgaggttgcgagttcgtggtcgttcgggggaggcgcgtaggttttgtcggacgtagaaggaattcgaaggaggcggggtggagggcggtgcggggtcggggaggggcgaggcgagtggcgagtggacgtcgggttcggtttcgggtaatttcgaggggcgttttttttcggggtttcggaggttttgcgatttcgcggtcgttttagtcgtttattggggataaggttcgagttaggcgttttcgcgaggcggggtttatagcgcgtttagtaggcgttttttgtcgtagggacgcgggggagcggcgtttgaatagtttcggtgggaattagcgttcgaagttggtgattcggggtgcgtagggtttaatcgggcgattttttggattttcgttagtttcgtttcgatttcgttttttttattcgttagcgagttcgtaattttcggtttcggttcgcgtttttagttttaggtttcggtttcgtttcgtttttgtttaggtatcgtttatttcgggttttgggtttttttttttttcgcggtttcgttttttgttcgtttttgattgtatttcgtttttaggcgttagtttcgtttatttgggtttttggtttcgtttaggtttttgtttttcggg

SEQ ID NO: 17310 - DNA, 815 bp, Artificial Sequence
  chemically treated genomic DNA (Homo sapiens) CpG-island No: 17310
cccgaaaaacaaaaacctaaacgaaaccaaaaacccaaataaacgaaactaacgcctaaaaacgaaatacaatcaaaaacgaacaaaaaacgaaaccgcgaaaaaaaaaaaaacccaaaacccgaaataaacgatacctaaacaaaaacgaaacgaaaccgaaacctaaaactaaaaacgcgaaccgaaaccgaaaattacgaactcgctaacgaataaaaaaaacgaaatcgaaacgaaactaacgaaaatccaaaaaatcgcccgattaaaccctacgcaccccgaatcaccaacttcgaacgctaattcccaccgaaactattcaaacgccgctcccccgcgtccctacgacaaaaaacgcctactaaacgcgctataaaccccgcctcgcgaaaacgcctaactcgaaccttatccccaataaacgactaaaacgaccgcgaaatcgcaaaacctccgaaaccccgaaaaaaaacgcccctcgaaattacccgaaaccgaacccgacgtccactcgccactcgcctcgcccctccccgaccccgcaccgccctccaccccgcctccttcgaattccttctacgtccgacaaaacctacgcgcctcccccgaacgaccacgaactcgcaacctcgacgaaaacgctacctacgtcccgactacctaaacctccccgcgtaactcccgacgaaacccaacaaccgaaaaataccaaatccgcctaacgcgcccctccccacgaaaaaaacgaaacgaaaatccaaaaaaaacgtaaaccgaactcccccgacgtattaatccgaacccgcgcg

SEQ ID NO: 17311 - DNA, 815 bp, Artificial Sequence
  chemically treated genomic DNA (Homo sapiens) CpG-island No: 17311
ttcgagggataagaatttgggcgggattagaagtttagataggcggggttggcgtttgggggcggggtatagttagaggcgggtagggggcggagtcgcgagggagaggagggtttagagttcggagtgggcggtgtttgagtaggggcggggcggggtcggggtttggagttggggacgcgggtcggggtcgggagttgcggattcgttggcgggtgggaggagcggagtcggggcgaggttggcggagatttaggggatcgttcggttgggttttgcgtatttcggattattagtttcgggcgttggtttttatcgaggttgtttaggcgtcgttttttcgcgtttttgcgataggaggcgtttgttgggcgcgttatggatttcgtttcgcggagacgtttggttcgggttttgtttttagtgagcggttggagcggtcgcggggtcgtagagttttcgggatttcgaggaagggcgtttttcggagttgttcgaggtcgggttcggcgtttattcgttattcgtttcgttttttttcggtttcgtatcgttttttatttcgtttttttcgggttttttttgcgttcggtagagtttgcgcgtttttttcggacggttacggattcgtagtttcggcgaggacgttgtttgcgtttcgattgtttggattttttcgcgtggttttcggcgaagtttagtagtcggagggtgttaggttcgtttgacgcgtttttttttacgggaagaacggggcgggggtttaggagggacgtaagtcgggttttttcggcgtgttgattcgaattcgcgcg

SEQ ID NO: 17312 - DNA, 815 bp, Artificial Sequence
  chemically treated genomic DNA (Homo sapiens) CpG-island No: 17312
cgcgcgaattcgaatcaacacgccgaaaaaacccgacttacgtccctcctaaacccccgccccgttcttcccgtaaaaaaaaacgcgtcaaacgaacctaacaccctccgactactaaacttcgccgaaaaccacgcgaaaaaatccaaacaatcgaaacgcaaacaacgtcctcgccgaaactacgaatccgtaaccgtccgaaaaaaacgcgcaaactctaccgaacgcaaaaaaaacccgaaaaaaacgaaataaaaaacgatacgaaaccgaaaaaaaacgaaacgaataacgaataaacgccgaacccgacctcgaacaactccgaaaaacgcccttcctcgaaatcccgaaaactctacgaccccgcgaccgctccaaccgctcactaaaaacaaaacccgaaccaaacgtctccgcgaaacgaaatccataacgcgcccaacaaacgcctcctatcgcaaaaacgcgaaaaaacgacgcctaaacaacctcgataaaaaccaacgcccgaaactaataatccgaaatacgcaaaacccaaccgaacgatcccctaaatctccgccaacctcgccccgactccgctcctcccacccgccaacgaatccgcaactcccgaccccgacccgcgtccccaactccaaaccccgaccccgccccgcccctactcaaacaccgcccactccgaactctaaaccctcctctccctcgcgactccgccccctacccgcctctaactataccccgcccccaaacgccaaccccgcctatctaaacttctaatcccgcccaaattcttatccctcgaa

SEQ ID NO: 17313 - DNA, 619 bp, Artificial Sequence
  chemically treated genomic DNA (Homo sapiens) CpG-island No: 17313
aggagcgcggtaagaagagcggttcgggggttcggattgcgtttttaggatttcggttattttggttttaggtacggcgttcggtagaaagcgcgcgggagggtacgagggggaggaaggtcggagatttgaggagatttaaggtgggagggacgtcggtttgacggggtttaagggggtaggggcggggaagggatcgaggtcgttcgaggcggacgggggtgcgggagggtttgagggggtttaaggtcgggcgaggggaagggtgggaatttcgaacgggggagagggcgcggttttggttttggggaggaggtcgtcgcgcgttcgtgaggggaggggattagcgtaaacgtaggaggtagtgcgtgttcgcggggaagagtttacgattcgtgtggaggacgtatcggtttcggtgttcgtgatgggagagggttttggtcggcgacgatacgcgttttttatttatcgttagagtcgtagttttacgcgcgaaggaacggtatttcgtagtatttttagataaagggttgtttcgtttcgtttgcgtagtcgttaatttttgggggtttttgttttttagttttcgtttttatagtcgagttcgttaattttg

SEQ ID NO: 17314 - DNA, 619 bp, Artificial Sequence
  chemically treated genomic DNA (Homo sapiens) CpG-island No: 17314
caaaattaacgaactcgactataaaaacgaaaactaaaaaacaaaaacccccaaaaattaacgactacgcaaacgaaacgaaacaaccctttatctaaaaatactacgaaataccgttccttcgcgcgtaaaactacgactctaacgataaataaaaaacgcgtatcgtcgccgaccaaaaccctctcccatcacgaacaccgaaaccgatacgtcctccacacgaatcgtaaactcttccccgcgaacacgcactacctcctacgtttacgctaatcccctcccctcacgaacgcgcgacgacctcctccccaaaaccaaaaccgcgccctctcccccgttcgaaattcccacccttcccctcgcccgaccttaaaccccctcaaaccctcccgcacccccgtccgcctcgaacgacctcgatcccttccccgcccctacccccttaaaccccgtcaaaccgacgtccctcccaccttaaatctcctcaaatctccgaccttcctccccctcgtaccctcccgcgcgctttctaccgaacgccgtacctaaaaccaaaataaccgaaatcctaaaaacgcaatccgaacccccgaaccgctcttcttaccgcgctcct

SEQ ID NO: 17315 - DNA, 619 bp, Artificial Sequence
  chemically treated genomic DNA (Homo sapiens) CpG-island No: 17315
taggattggcgaattcggttgtgggggcgggaattgaggggtaggagtttttagggattggcggttgcgtagacggggcggggtagttttttgtttgaaggtgttgcgggatgtcgttttttcgcgcgtgaggttgcggttttgacggtgagtggggggcgcgtgtcgtcgtcggttaggatttttttttattacggatatcggagtcggtgcgttttttatacgaatcgtggattttttttcgcgagtacgtattgttttttgcgtttacgttggttttttttttttacggacgcgcggcggttttttttttagggttaaggtcgcgttttttttttcgttcggggtttttattttttttttcgttcggttttggatttttttaggttttttcgtattttcgttcgtttcggacggtttcggtttttttttcgtttttatttttttgggtttcgttagatcggcgttttttttattttggatttttttagattttcggtttttttttttttcgtgttttttcgcgcgttttttatcgggcgtcgtgtttagggttaggatggtcggagttttaggggcgtagttcggattttcgggtcgttttttttgtcgcgttttt

SEQ ID NO: 17316 - DNA, 619 bp, Artificial Sequence
  chemically treated genomic DNA (Homo sapiens) CpG-island No: 17316
aaaaacgcgacaaaaaaaacgacccgaaaatccgaactacgcccctaaaactccgaccatcctaaccctaaacacgacgcccgataaaaaacgcgcgaaaaaacacgaaaaaaaaaaaaaccgaaaatctaaaaaaatccaaaataaaaaaaacgccgatctaacgaaacccaaaaaaataaaaacgaaaaaaaaaccgaaaccgtccgaaacgaacgaaaatacgaaaaaacctaaaaaaatccaaaaccgaacgaaaaaaaaaataaaaaccccgaacgaaaaaaaaaacgcgaccttaaccctaaaaaaaaaaccgccgcgcgtccgtaaaaaaaaaaaaccaacgtaaacgcaaaaaacaatacgtactcgcgaaaaaaaatccacgattcgtataaaaaacgcaccgactccgatatccgtaataaaaaaaaatcctaaccgacgacgacacgcgccccccactcaccgtcaaaaccgcaacctcacgcgcgaaaaaacgacatcccgcaacaccttcaaacaaaaaactaccccgccccgtctacgcaaccgccaatccctaaaaactcctacccctcaattcccgcccccacaaccgaattcgccaatccta

SEQ ID NO: 17317 - DNA, 1092 bp, Artificial Sequence
  chemically treated genomic DNA (Homo sapiens) CpG-island No: 17317
gggtacgcggcgattcggttgaattagggcgttttgtagttttcgaggcgaggaggcgtttggttttttcgtttcgtttttagaagggagaggagaggtggttttcgagtgggagttagtttaggatgcgggttgtgttacgcgcggaggttcggggattttatcgtcgttttttcgaggttcgtttcgttttttacgattcgtttttgtaatttttcgcgtgggttttcggtcgcggcgatttttgtttcgcgttattgcgcgcgttcgttcgttgatagaggtttcgagggcggtagggcggggtttcggcgtcgggggcggggtttttagcgggcgggcggggttttggcgtcgcgaggtggcggtagtagagcggcgtagaagggagggggcggttggtcgcgcggaaggagtgagttatttgatcgttgttttcgtcgttcgtcgggcgttttcgttttagttagtcgggtcgcgtcgcgttttagttttggtgagtggttcggtcgtttcgtcggttttttttcgggagggttggcgcggttagggtcgcgggtttgtgaggggaggtcggcggataggtttagtgaaggcgcgggcgggtcgggggcggttttttttgggttgggcggggcgcggggggtacgtatcggggttcgcggggggcgtcggcggtcgggattttggaagtggtcgcgacgtcggaaggggcgtttcgtcggcggtcgaattttttgtattgtcggagttgttgtttattcgcgcgcgtcgtattttattcggggcgggcgggggttgggggtcgcggggtttttgttttatttttttttttgttttcgggcgttagttcggtttttcgttcgcggttcgttcgggttgtgatatattagtatcgttttcgcggttggggtttcgtattgtttttcgtcgttttttatcgtatgtttagtttcgcgtttatttagttcggtggttgtcgcgcgtggaatcgcgtaagaaaagtcgagtttgtggttggggagagaaggttatcgtgttgagttggatttagcgaagattggttttggggatcggagagtttaggatttt

SEQ ID NO: 17318 - DNA, 1092 bp, Artificial Sequence
  chemically treated genomic DNA (Homo sapiens) CpG-island No: 17318
aaaatcctaaactctccgatccccaaaaccaatcttcgctaaatccaactcaacacgataaccttctctccccaaccacaaactcgacttttcttacgcgattccacgcgcgacaaccaccgaactaaataaacgcgaaactaaacatacgataaaaaacgacgaaaaacaatacgaaaccccaaccgcgaaaacgatactaatatatcacaacccgaacgaaccgcgaacgaaaaaccgaactaacgcccgaaaacaaaaaaaaaaataaaacaaaaaccccgcgacccccaacccccgcccgccccgaataaaatacgacgcgcgcgaataaacaacaactccgacaatacaaaaaattcgaccgccgacgaaacgccccttccgacgtcgcgaccacttccaaaatcccgaccgccgacgccccccgcgaaccccgatacgtaccccccgcgccccgcccaacccaaaaaaaaccgcccccgacccgcccgcgccttcactaaacctatccgccgacctcccctcacaaacccgcgaccctaaccgcgccaaccctcccgaaaaaaaaccgacgaaacgaccgaaccactcaccaaaactaaaacgcgacgcgacccgactaactaaaacgaaaacgcccgacgaacgacgaaaacaacgatcaaataactcactccttccgcgcgaccaaccgccccctcccttctacgccgctctactaccgccacctcgcgacgccaaaaccccgcccgcccgctaaaaaccccgcccccgacgccgaaaccccgccctaccgccctcgaaacctctatcaacgaacgaacgcgcgcaataacgcgaaacaaaaatcgccgcgaccgaaaacccacgcgaaaaattacaaaaacgaatcgtaaaaaacgaaacgaacctcgaaaaaacgacgataaaatccccgaacctccgcgcgtaacacaacccgcatcctaaactaactcccactcgaaaaccacctctcctctcccttctaaaaacgaaacgaaaaaaccaaacgcctcctcgcctcgaaaactacaaaacgccctaattcaaccgaatcgccgcgtaccc

SEQ ID NO: 17319 - DNA, 1092 bp, Artificial Sequence
  chemically treated genomic DNA (Homo sapiens) CpG-island No: 17319
ggagttttgggtttttcggtttttaaaattagttttcgttaaatttagtttagtacggtggttttttttttttagttataaattcggttttttttacgcgattttacgcgcgatagttatcgggttgagtagacgcgaggttgggtatgcggtgggaggcggcggaggataatacggggttttagtcgcgagggcggtgttgatgtgttatagttcgggcgggtcgcgggcgaggggtcgggttggcgttcgagggtagggaggggggtggggtagggatttcgcggtttttagttttcgttcgtttcgggtaaagtacggcgcgcgcgggtaaataatagtttcggtagtgtagggggttcggtcgtcgacgggacgtttttttcggcgtcgcggttatttttaggatttcggtcgtcggcgtttttcgcgggtttcgatacgtgtttttcgcgtttcgtttagtttagaaagagtcgttttcggttcgttcgcgtttttattggatttgttcgtcggtttttttttataggttcgcggttttgatcgcgttaattttttcggagaagggtcggcgggacggtcgagttatttattagagttgaggcgcggcgcggttcgattgattgaagcgagagcgttcggcgggcggcgagggtagcggttaggtgatttatttttttcgcgcggttagtcgtttttttttttttgcgtcgttttgttgtcgttatttcgcggcgttaaaatttcgttcgttcgttgaaggtttcgttttcggcgtcgaagtttcgttttgtcgttttcgaagtttttgttagcgaacgagcgcgcgtaatagcgcggggtaggggtcgtcgcggtcggaagtttacgcggggggttgtagggacgggtcgtaaggggcggggcgggtttcgaggaggcggcggtggggttttcggattttcgcgcgtggtatagttcgtattttgaattgatttttattcgaggattatttttttttttttttttgagggcggaacggaaaggttaagcgttttttcgtttcgggagttgtaggacgttttaatttagtcgagtcgtcgcgtgttt

SEQ ID NO: 17320 - DNA, 1092 bp, Artificial Sequence
  chemically treated genomic DNA (Homo sapiens) CpG-island No: 17320
aaacacgcgacgactcgactaaattaaaacgtcctacaactcccgaaacgaaaaaacgcttaacctttccgttccgccctcaaaaaaaaaaaaaaaaataatcctcgaataaaaatcaattcaaaatacgaactataccacgcgcgaaaatccgaaaaccccaccgccgcctcctcgaaacccgccccgccccttacgacccgtccctacaaccccccgcgtaaacttccgaccgcgacgacccctaccccgcgctattacgcgcgctcgttcgctaacaaaaacttcgaaaacgacaaaacgaaacttcgacgccgaaaacgaaaccttcaacgaacgaacgaaattttaacgccgcgaaataacgacaacaaaacgacgcaaaaaaaaaaaaacgactaaccgcgcgaaaaaaataaatcacctaaccgctaccctcgccgcccgccgaacgctctcgcttcaatcaatcgaaccgcgccgcgcctcaactctaataaataactcgaccgtcccgccgacccttctccgaaaaaattaacgcgatcaaaaccgcgaacctataaaaaaaaaccgacgaacaaatccaataaaaacgcgaacgaaccgaaaacgactctttctaaactaaacgaaacgcgaaaaacacgtatcgaaacccgcgaaaaacgccgacgaccgaaatcctaaaaataaccgcgacgccgaaaaaaacgtcccgtcgacgaccgaaccccctacactaccgaaactattatttacccgcgcgcgccgtactttacccgaaacgaacgaaaactaaaaaccgcgaaatccctaccccacccccctccctaccctcgaacgccaacccgacccctcgcccgcgacccgcccgaactataacacatcaacaccgccctcgcgactaaaaccccgtattatcctccgccgcctcccaccgcatacccaacctcgcgtctactcaacccgataactatcgcgcgtaaaatcgcgtaaaaaaaaccgaatttataactaaaaaaaaaaaaccaccgtactaaactaaatttaacgaaaactaattttaaaaaccgaaaaacccaaaactcc

SEQ ID NO: 17321 - DNA, 509 bp, Artificial Sequence
  chemically treated genomic DNA (Homo sapiens) CpG-island No: 17321
tattatattagttttgaaaattcggttttcgagttcgatgttattgttgcgtaaacggagtagttttttggtcgataatggtcgtcgttcgcgtattttgatcgttaagatgggttaggatggatacgatcgcggcgcgatagtgatcgttagcgtttatttcgatttcggatttcgacgtagatttaagttcgatgttttttatatttgaagagatcgttcgatttggatcgtacgaaaacgacgtttacgtagtgggcgtatttttattggttgtcggttataaaacgttgatttcggaattggtacgaagcgttgaataatatatggggacgcgaagatatttgcgtggtcgacgggtggtagttatttcgtcgataggattacgtttttttgtaagagcgcggtagtggcggcgatttatggtttaggtatatttatgttcgatagtgtgcgcgacgtattgaatttgataagttagtattatgattaatgaagttacgttggta

SEQ ID NO: 17322 - DNA, 509 bp, Artificial Sequence
  chemically treated genomic DNA (Homo sapiens) CpG-island No: 17322
taccaacgtaacttcattaatcataatactaacttatcaaattcaatacgtcgcgcacactatcgaacataaatatacctaaaccataaatcgccgccactaccgcgctcttacaaaaaaacgtaatcctatcgacgaaataactaccacccgtcgaccacgcaaatatcttcgcgtccccatatattattcaacgcttcgtaccaattccgaaatcaacgttttataaccgacaaccaataaaaatacgcccactacgtaaacgtcgttttcgtacgatccaaatcgaacgatctcttcaaatataaaaaacatcgaacttaaatctacgtcgaaatccgaaatcgaaataaacgctaacgatcactatcgcgccgcgatcgtatccatcctaacccatcttaacgatcaaaatacgcgaacgacgaccattatcgaccaaaaaactactccgtttacgcaacaataacatcgaactcgaaaaccgaattttcaaaactaatataata

SEQ ID NO: 17323 - DNA, 509 bp, Artificial Sequence
  chemically treated genomic DNA (Homo sapiens) CpG-island No: 17323
tgttagcgtggttttattaattatgatgttggtttattagatttagtacgtcgcgtatattgtcgagtataggtgtatttggattataaatcgtcgttattgtcgcgtttttgtaggaaggcgtaattttgtcggcggaatgattgttattcgtcgattacgtagatattttcgcgtttttatgtgttgtttagcgtttcgtattagtttcgggattagcgttttatgatcggtagttagtgaggatgcgtttattacgtgaacgtcgttttcgtacggtttaggtcgggcgatttttttaggtgtagagaatatcgggtttaaatttacgtcgaaattcgagatcggaataggcgttggcgattattatcgcgtcgcgatcgtgtttattttggtttattttagcgattagaatgcgcgggcgacgattattgtcggttaaggaattgtttcgtttgcgtaataatggtatcgaattcggaggtcgagtttttagaattagtatgata

SEQ ID NO: 17324 - DNA, 509 bp, Artificial Sequence
  chemically treated genomic DNA (Homo sapiens) CpG-island No: 17324
tatcatactaattctaaaaactcgacctccgaattcgataccattattacgcaaacgaaacaattccttaaccgacaataatcgtcgcccgcgcattctaatcgctaaaataaaccaaaataaacacgatcgcgacgcgataataatcgccaacgcctattccgatctcgaatttcgacgtaaatttaaacccgatattctctacacctaaaaaaatcgcccgacctaaaccgtacgaaaacgacgttcacgtaataaacgcatcctcactaactaccgatcataaaacgctaatcccgaaactaatacgaaacgctaaacaacacataaaaacgcgaaaatatctacgtaatcgacgaataacaatcattccgccgacaaaattacgccttcctacaaaaacgcgacaataacgacgatttataatccaaatacacctatactcgacaatatacgcgacgtactaaatctaataaaccaacatcataattaataaaaccacgctaaca

SEQ ID NO: 17325 - DNA, 545 bp, Artificial Sequence
  chemically treated genomic DNA (Homo sapiens) CpG-island No: 17325
cgggtgagcgtagtatattcgtttaggttatgacgttggtggaaaggcgttatcgcgttattaggtattaagtacgtagttgtttgatgttattatgtcgtattgcggtaatattttgcgattgggcgttatcggtattttcggcgcggggaaaagtattttttttgaggtttttggtatgttgttgattcgagagggattaaaggtcgcggttattgcggtcgattttagtagttcggttattggcggtagtattttcggggataaaattcgtatgaatgatttggcgcgtgtcgaagcggcgtttattcgttcggtattatttttcggttatttgggcggtgttagttagcgagcgcgggaattaatgttgttatgcgaagtagcgggttatgacgtagtgattgtcgaaacggttggcgtcgggtagtcggaaatagaagtcgttcgtatggtggattgttttatttcgttgtaaattgtcggtggcggcgatgatttgtagggtattaaaaaagggttgatggaagtggttgatttgatcg

SEQ ID NO: 17326 - DNA, 545 bp, Artificial Sequence
  chemically treated genomic DNA (Homo sapiens) CpG-island No: 17326
cgatcaaatcaaccacttccatcaacccttttttaataccctacaaatcatcgccgccaccgacaatttacaacgaaataaaacaatccaccatacgaacgacttctatttccgactacccgacgccaaccgtttcgacaatcactacgtcataacccgctacttcgcataacaacattaattcccgcgctcgctaactaacaccgcccaaataaccgaaaaataataccgaacgaataaacgccgcttcgacacgcgccaaatcattcatacgaattttatccccgaaaatactaccgccaataaccgaactactaaaatcgaccgcaataaccgcgacctttaatccctctcgaatcaacaacataccaaaaacctcaaaaaaaatacttttccccgcgccgaaaataccgataacgcccaatcgcaaaatattaccgcaatacgacataataacatcaaacaactacgtacttaatacctaataacgcgataacgcctttccaccaacgtcataacctaaacgaatatactacgctcacccg

SEQ ID NO: 17327 - DNA, 545 bp, Artificial Sequence
  chemically treated genomic DNA (Homo sapiens) CpG-island No: 17327
cgattagattagttatttttattagtttttttttaatgttttgtagattatcgtcgttatcggtaatttgtaacgagataaaatagtttattatgcgggcgatttttgttttcgattgttcgacgttaatcgtttcgataattattacgttataattcgttgtttcgtataatagtattaattttcgcgttcgttgattggtatcgtttagatgatcggaggatggtatcgggcgaataaacgtcgtttcggtacgcgttaggttatttatgcgggttttattttcgagaatgttatcgttagtgatcgggttgttgggatcgatcgtaataatcgcgatttttaatttttttcgaattaataatatgttaaaggttttaagaaaggtattttttttcgcgtcgggggtgtcggtaacgtttagtcgtagggtgttatcgtagtacggtataatggtattaagtagttgcgtatttagtgtttgatgacgcggtgacgtttttttattagcgttatggtttgggcgagtgtgttacgtttattcg

SEQ ID NO: 17328 - DNA, 545 bp, Artificial Sequence
  chemically treated genomic DNA (Homo sapiens) CpG-island No: 17328
cgaataaacgtaacacactcgcccaaaccataacgctaataaaaaaacgtcaccgcgtcatcaaacactaaatacgcaactacttaataccattataccgtactacgataacaccctacgactaaacgttaccgacacccccgacgcgaaaaaaaatacctttcttaaaacctttaacatattattaattcgaaaaaaattaaaaatcgcgattattacgatcgatcccaacaacccgatcactaacgataacattctcgaaaataaaacccgcataaataacctaacgcgtaccgaaacgacgtttattcgcccgataccatcctccgatcatctaaacgataccaatcaacgaacgcgaaaattaatactattatacgaaacaacgaattataacgtaataattatcgaaacgattaacgtcgaacaatcgaaaacaaaaatcgcccgcataataaactattttatctcgttacaaattaccgataacgacgataatctacaaaacattaaaaaaaaactaataaaaataactaatctaatcg

SEQ ID NO: 17329 - DNA, 927 bp, Artificial Sequence
  chemically treated genomic DNA (Homo sapiens) CpG-island No: 17329
gtcgtttcggtttttcgcgagaattcggagattcgaattaggtagtagaggtaggattttttcggaaacgcgtttttttcgtcgtttcgacgttttcgcggttttgttagttaagcgagagtcgacgcgggtcgcgttttcgggtcgttttcggcggcgtcggcggtcgttatttttggcgttttggtcgcggtcgttatttattttaggtcgtcgcggtttttagttttcggtttcgttaggttcggttcgcgaaggcgtttgtcgtttcgttttggttcggcgtttcggcgagttttttttttcgattagcggcgtttacggcgtagcggcggacgcgaggttacgggcggacgggcgcgcgcgggtggcgggcgggcgtggggtcgggtcgtttttgcgtttcgtcgtcgtttttttcgtcgtcgtttttcgagttcggggttttgttgtaatgtttgcgaggttgattttgagcgtttcgtttatcgttcgttcgtagtcgcgttttttttttcgtcgtcgagttcgtcgcggtttagttttttttttcgtcgttttacgttatttagttttttagttaagttttttaattttttttttttttttttttttattgttattcggttaggaggaagtcgcgcggattcgggcggtttataggagttgcggaattttttttgtttcgtggatttttttttcgtttgtttttcgggtgttttagacggggttgtaagattcggaggtagcgagaggatcgcgttttcgagagaggggttgtacggcgcgttcgggtcgtttttcgggtttttagttttgtttagtcgttcgcgatcgttgtaggcgtttggatagttttttttggggatcggggaaagcgtttttgggatttaggtcgaatgttttcgtttgggtatagtttggggg

SEQ ID NO: 17330 - DNA, 927 bp, Artificial Sequence
  chemically treated genomic DNA (Homo sapiens) CpG-island No: 17330
cccccaaactatacccaaacgaaaacattcgacctaaatcccaaaaacgctttccccgatccccaaaaaaaactatccaaacgcctacaacgatcgcgaacgactaaacaaaactaaaaacccgaaaaacgacccgaacgcgccgtacaacccctctctcgaaaacgcgatcctctcgctacctccgaatcttacaaccccgtctaaaacacccgaaaaacaaacgaaaaaaaaatccacgaaacaaaaaaaattccgcaactcctataaaccgcccgaatccgcgcgacttcctcctaaccgaataacaataaaaaaaaaaaaaaaaaaaaaattaaaaaacttaactaaaaaactaaataacgtaaaacgacgaaaaaaaaaactaaaccgcgacgaactcgacgacgaaaaaaaaaacgcgactacgaacgaacgataaacgaaacgctcaaaatcaacctcgcaaacattacaacaaaaccccgaactcgaaaaacgacgacgaaaaaaacgacgacgaaacgcaaaaacgacccgaccccacgcccgcccgccacccgcgcgcgcccgtccgcccgtaacctcgcgtccgccgctacgccgtaaacgccgctaatcgaaaaaaaaaactcgccgaaacgccgaaccaaaacgaaacgacaaacgccttcgcgaaccgaacctaacgaaaccgaaaactaaaaaccgcgacgacctaaaataaataacgaccgcgaccaaaacgccaaaaataacgaccgccgacgccgccgaaaacgacccgaaaacgcgacccgcgtcgactctcgcttaactaacaaaaccgcgaaaacgtcgaaacgacgaaaaaaacgcgtttccgaaaaaatcctacctctactacctaattcgaatctccgaattctcgcgaaaaaccgaaacgac

SEQ ID NO: 17331 - DNA, 927 bp, Artificial Sequence
  chemically treated genomic DNA (Homo sapiens) CpG-island No: 17331
tttttaggttgtgtttaaacgggagtattcggtttgggttttaagagcgtttttttcggtttttaggaggagttgtttaggcgtttgtagcggtcgcgggcggttggatagagttgggagttcgggggacggttcgggcgcgtcgtgtagtttttttttcggggacgcggttttttcgttgttttcgggttttgtagtttcgtttgggatattcggagagtaggcgagaaggaaatttacgaaatagagggggtttcgtagtttttgtgagtcgttcggattcgcgcggtttttttttgatcgggtgataatgggagggagggggagaaaagggttaagaaatttggttgaagagttgaatggcgtggggcggcgaggggagggattgggtcgcggcggattcggcggcggagggaggagcgcggttgcgggcgggcggtgagcgaggcgtttaaagttagtttcgtagatattgtagtagagtttcgaattcgggaggcggcggcggaggaggcggcggcgaggcgtagggacgattcggttttacgttcgttcgttattcgcgcgcgttcgttcgttcgtggtttcgcgttcgtcgttgcgtcgtgagcgtcgttggtcggagggaagagttcgtcggggcgtcgggttaggacggggcggtaggcgttttcgcggatcgagtttgacggagtcggaggttgggagtcgcggcggtttggggtgagtgacggtcgcggttagggcgttaggagtagcggtcgtcggcgtcgtcggaaacggttcgggagcgcggttcgcgtcggttttcgtttggttggtagggtcgcgggggcgtcggggcggcggggagggcgcgttttcggggaaattttgtttttgttgtttggttcgagttttcgggttttcgcggggggtcggggcggt

SEQ ID NO: 17332 - DNA, 927 bp, Artificial Sequence
  chemically treated genomic DNA (Homo sapiens) CpG-island No: 17332
accgccccgaccccccgcgaaaacccgaaaactcgaaccaaacaacaaaaacaaaatttccccgaaaacgcgccctccccgccgccccgacgcccccgcgaccctaccaaccaaacgaaaaccgacgcgaaccgcgctcccgaaccgtttccgacgacgccgacgaccgctactcctaacgccctaaccgcgaccgtcactcaccccaaaccgccgcgactcccaacctccgactccgtcaaactcgatccgcgaaaacgcctaccgccccgtcctaacccgacgccccgacgaactcttccctccgaccaacgacgctcacgacgcaacgacgaacgcgaaaccacgaacgaacgaacgcgcgcgaataacgaacgaacgtaaaaccgaatcgtccctacgcctcgccgccgcctcctccgccgccgcctcccgaattcgaaactctactacaatatctacgaaactaactttaaacgcctcgctcaccgcccgcccgcaaccgcgctcctccctccgccgccgaatccgccgcgacccaatccctcccctcgccgccccacgccattcaactcttcaaccaaatttcttaacccttttctccccctccctcccattatcacccgatcaaaaaaaaaccgcgcgaatccgaacgactcacaaaaactacgaaaccccctctatttcgtaaatttccttctcgcctactctccgaatatcccaaacgaaactacaaaacccgaaaacaacgaaaaaaccgcgtccccgaaaaaaaaactacacgacgcgcccgaaccgtcccccgaactcccaactctatccaaccgcccgcgaccgctacaaacgcctaaacaactcctcctaaaaaccgaaaaaaacgctcttaaaacccaaaccgaatactcccgtttaaacacaacctaaaaa

SEQ ID NO: 17333 - DNA, 563 bp, Artificial Sequence
  chemically treated genomic DNA (Homo sapiens) CpG-island No: 17333
tttttttcgatttcgtatttgtttgttttcgagggtgaacgttaagtagtagattttatttttttattaatatttgcggcgtattcggggaggaggagcgggaaacggcgagggatttgagttagggttagagcgtggggcgaggggcgtgttttcgaggtgagtgtatttttttgcgtgatgcgttggtttggttgcgttgtggtgattaagggtgcggggtagtgaggggagtttttcgattcggtttcgcggttttttttgacgtttttttcgttcggttatcgttgattcgggttgattgcgcgcgaggtttttcgggcgcgtatttttttttttttttttacgttacggattagaaaatagatttcgggaggagaggggacggggggttgaaattcggttttcgaggttattttttcggggagcggtcgggtagttttcggaggtttttcggttcgggttcgcgttattaatttttatgcgtagtagttgggtttgaggtttcgattacggggttggtttcggtttggagggattgagggtggcgaggttcgaggttt

SEQ ID NO: 17334 - DNA, 563 bp, Artificial Sequence
  chemically treated genomic DNA (Homo sapiens) CpG-island No: 17334
aaacctcgaacctcgccaccctcaatccctccaaaccgaaaccaaccccgtaatcgaaacctcaaacccaactactacgcataaaaattaataacgcgaacccgaaccgaaaaacctccgaaaactacccgaccgctccccgaaaaaataacctcgaaaaccgaatttcaaccccccgtcccctctcctcccgaaatctattttctaatccgtaacgtaaaaaaaaaaaaaaaaatacgcgcccgaaaaacctcgcgcgcaatcaacccgaatcaacgataaccgaacgaaaaaaacgtcaaaaaaaaccgcgaaaccgaatcgaaaaactcccctcactaccccgcacccttaatcaccacaacgcaaccaaaccaacgcatcacgcaaaaaaatacactcacctcgaaaacacgcccctcgccccacgctctaaccctaactcaaatccctcgccgtttcccgctcctcctccccgaatacgccgcaaatattaataaaaaaataaaatctactacttaacgttcaccctcgaaaacaaacaaatacgaaatcgaaaaaaa

SEQ ID NO: 17335 - DNA, 563 bp, Artificial Sequence
  chemically treated genomic DNA (Homo sapiens) CpG-island No: 17335
gggtttcgagtttcgttatttttagtttttttaggtcggggttaatttcgtagtcgaggttttaggtttagttgttgcgtatgggggttgatggcgcgggttcggatcggagagttttcgagggttattcgatcgtttttcgggagggtgatttcgggggtcgggttttagtttttcgtttttttttttttcggggtttgttttttgattcgtaacgtggggggaggagagggggtgcgcgttcgggaggtttcgcgcgtagttagttcgagttaacggtaatcgagcgagggaagcgttaggaagggtcgcgaagtcgggtcggggggttttttttattgtttcgtatttttagttattatagcgtagttagattagcgtattacgtagggaagtgtatttatttcgggaatacgtttttcgttttacgttttggttttggtttaagtttttcgtcgtttttcgtttttttttttcgggtgcgtcgtaggtattagtggagagatgggatttgttgtttagcgtttattttcggaagtagatagatacgaagtcgggggagg

SEQ ID NO: 17336 - DNA, 563 bp, Artificial Sequence
  chemically treated genomic DNA (Homo sapiens) CpG-island No: 17336
cctcccccgacttcgtatctatctacttccgaaaataaacgctaaacaacaaatcccatctctccactaatacctacgacgcacccgaaaaaaaaaaacgaaaaacgacgaaaaacttaaaccaaaaccaaaacgtaaaacgaaaaacgtattcccgaaataaatacacttccctacgtaatacgctaatctaactacgctataataactaaaaatacgaaacaataaaaaaaaccccccgacccgacttcgcgacccttcctaacgcttccctcgctcgattaccgttaactcgaactaactacgcgcgaaacctcccgaacgcgcaccccctctcctccccccacgttacgaatcaaaaaacaaaccccgaaaaaaaaaaaaacgaaaaactaaaacccgacccccgaaatcaccctcccgaaaaacgatcgaataaccctcgaaaactctccgatccgaacccgcgccatcaacccccatacgcaacaactaaacctaaaacctcgactacgaaattaaccccgacctaaaaaaactaaaaataacgaaactcgaaaccc

SEQ ID NO: 17337 - DNA, 630 bp, Artificial Sequence
  chemically treated genomic DNA (Homo sapiens) CpG-island No: 17337
gttgggcgtaaacgggcgttttattcggcgttaattgtgtttgacgtagttaacgttttgttattggtaaggataaaagtgaaatgttgtcgtcgcgttttagtaacgtatagtcggaatggacgatagttagtattcgattaaaattttgattgttcgtcgtaagtgtaggtttttgcggtttcggcgtttttaatttttgtatcggcgcgggcgtttgtaaaagttggcgatatattttattttgttgtttttggtagtttggttgcgtattcggttagggggtagtcggacgattgtttgatgttggcgtaggagtgtagcgcggagttatcggtttacgagttgtcggttttgtaaagtgattgcgtttcgtcgttacgcggtttttcggaatggaacgcggtgtaggttggggtttatcgtttagcggtagcggcgtttttagttgttgttgtagtacgtttagtacgttttgatagataaaattatgtattagacgcgattgatggaaacgtatttcgtgtttggcggggtgtacgttgacgtttatttgatgtgggtcgatttttagatataatataaatgtcggttgttgatcggtttttagttgttattcgtaggtcggat

SEQ ID NO: 17338 - DNA, 630 bp, Artificial Sequence
  chemically treated genomic DNA (Homo sapiens) CpG-island No: 17338
atccgacctacgaataacaactaaaaaccgatcaacaaccgacatttatattatatctaaaaatcgacccacatcaaataaacgtcaacgtacaccccgccaaacacgaaatacgtttccatcaatcgcgtctaatacataattttatctatcaaaacgtactaaacgtactacaacaacaactaaaaacgccgctaccgctaaacgataaaccccaacctacaccgcgttccattccgaaaaaccgcgtaacgacgaaacgcaatcactttacaaaaccgacaactcgtaaaccgataactccgcgctacactcctacgccaacatcaaacaatcgtccgactaccccctaaccgaatacgcaaccaaactaccaaaaacaacaaaataaaatatatcgccaacttttacaaacgcccgcgccgatacaaaaattaaaaacgccgaaaccgcaaaaacctacacttacgacgaacaatcaaaattttaatcgaatactaactatcgtccattccgactatacgttactaaaacgcgacgacaacatttcacttttatccttaccaataacaaaacgttaactacgtcaaacacaattaacgccgaataaaacgcccgtttacgcccaac

SEQ ID NO: 17339 - DNA, 630 bp, Artificial Sequence
  chemically treated genomic DNA (Homo sapiens) CpG-island No: 17339
gttcggtttgcgaatgataattgggggtcgattagtaatcggtatttgtgttgtatttggagatcgatttatattaggtggacgttaacgtgtatttcgttaaatacgaagtgcgtttttattagtcgcgtttggtgtatgattttatttattagggcgtgttgagcgtgttataatagtaattggaaacgtcgttatcgttggacgatgaattttaatttgtatcgcgttttatttcggaaaatcgcgtggcggcggggcgtaattattttgtagaatcggtagttcgtgagtcggtagtttcgcgttatatttttgcgttagtattaggtagtcgttcggttgttttttggtcgaatgcgtagttaggttattagaaatagtaaggtgaagtgtatcgttagtttttgtaaacgttcgcgtcgatgtaaaaattaaaagcgtcggaatcgtaggaatttgtatttgcggcgaatagttagagttttggtcgggtattgattatcgtttatttcgattgtgcgttgttggagcgcgacggtaatattttatttttatttttgttagtggtagaacgttggttgcgttaggtataattgacgtcgggtgaagcgttcgtttgcgtttagt

SEQ ID NO: 17340 - DNA, 630 bp, Artificial Sequence
  chemically treated genomic DNA (Homo sapiens) CpG-island No: 17340
actaaacgcaaacgaacgcttcacccgacgtcaattatacctaacgcaaccaacgttctaccactaacaaaaataaaaataaaatattaccgtcgcgctccaacaacgcacaatcgaaataaacgataatcaatacccgaccaaaactctaactattcgccgcaaatacaaattcctacgattccgacgcttttaatttttacatcgacgcgaacgtttacaaaaactaacgatacacttcaccttactatttctaataacctaactacgcattcgaccaaaaaacaaccgaacgactacctaatactaacgcaaaaatataacgcgaaactaccgactcacgaactaccgattctacaaaataattacgccccgccgccacgcgattttccgaaataaaacgcgatacaaattaaaattcatcgtccaacgataacgacgtttccaattactattataacacgctcaacacgccctaataaataaaatcatacaccaaacgcgactaataaaaacgcacttcgtatttaacgaaatacacgttaacgtccacctaatataaatcgatctccaaatacaacacaaataccgattactaatcgacccccaattatcattcgcaaaccgaac

SEQ ID NO: 17341 - DNA, 1283 bp, Artificial Sequence
  chemically treated genomic DNA (Homo sapiens) CpG-island No: 17341
tagtttcggggtttcgcgttttttttcgttttattgtttagttagttcgggcgcgtttagggtattcgtttcgcgtatttttaagtttacgcgggtttcggtttagattgtcgcgttttattcggttcgcgttatattttatcggtttatttagtaacggtttttggattcgcggttttttttttgttttttattttttagtttacgagagtcgtagcgttgcgtcgtttggagaggggttattcgtttcggaatcgacgtgagcgcggggtcggttcgtggaggcggttgagggattttttatttttagttcgttcgttcggagtcgaatttcgaatttcgttttattgattcgcgtttttagtttatttcgcgttcgcgttcgcgtttcgttattttcgtcgcgtcgtttttttttttcgttttttcgttttttcggttttttttttcgcggcgcggtttttacgcgtagtcgaattcggcgtcgtttttattagagtcgagtcggcggttttatcgaacggtcgcgtttgtcgtcgtcgtagttgtagaatttttcgtatttttttttcgtttcgttttttagttttaggcgttcgggtttttttttttttttttttttttttttttcgtttttttcgcgttttttttttttgtagttagagttcggttcgttagtcgggtcggtaggagggcggcggcggtataattatgagttttgagggcggttacggcggtagtcggtgtcgcggggcggagagcggggacgtcgagtttttttcgtaatttttttcgtcgtcgtcgtcgacgtcgtcgtcgggagagtcggtttcggttttcgcggtttcgcgttatttgtcgtcgttgttcgcgtttttcgagattttcgagcgcgtcgcggggttaagcgagtcgttaggggaggtggtttcgcggtgtaggggagcggacgagttgtcgttttcgtttttgtttttgtagttcgtcggttaggaagtggcggcggtcggcgatttcggggaaggttcgaggcgtttttcggaggcggtagtagcgaaaggcggtttcggggagtttgaggtcggcgcgggcggcgagcgcgagcggcggggcgtcggagattagttcgagacgcgttcggtgtgtagtagtcgtagtagtagtagtggcggcggcgattagcgcgttgggtattagtattagtattattagtttatttgtaagatttgtttttagggcgcggagtaggtaaggttcggcgagatttcgaagtagtcggtggt

SEQ ID NO: 17342 - DNA, 1283 bp, Artificial Sequence
  chemically treated genomic DNA (Homo sapiens) CpG-island No: 17342
accaccgactacttcgaaatctcgccgaaccttacctactccgcgccctaaaaacaaatcttacaaataaactaataatactaatactaatacccaacgcgctaatcgccgccgccactactactactacgactactacacaccgaacgcgtctcgaactaatctccgacgccccgccgctcgcgctcgccgcccgcgccgacctcaaactccccgaaaccgcctttcgctactaccgcctccgaaaaacgcctcgaaccttccccgaaatcgccgaccgccgccacttcctaaccgacgaactacaaaaacaaaaacgaaaacgacaactcgtccgctcccctacaccgcgaaaccacctcccctaacgactcgcttaaccccgcgacgcgctcgaaaatctcgaaaaacgcgaacaacgacgacaaataacgcgaaaccgcgaaaaccgaaaccgactctcccgacgacgacgtcgacgacgacgacgaaaaaaattacgaaaaaaactcgacgtccccgctctccgccccgcgacaccgactaccgccgtaaccgccctcaaaactcataattataccgccgccgccctcctaccgacccgactaacgaaccgaactctaactacaaaaaaaaaaaacgcgaaaaaaacgaaaaaaaaaaaaaaaaaaaaaaaaaaaaacccgaacgcctaaaactaaaaaacgaaacgaaaaaaaaatacgaaaaattctacaactacgacgacgacaaacgcgaccgttcgataaaaccgccgactcgactctaataaaaacgacgccgaattcgactacgcgtaaaaaccgcgccgcgaaaaaaaaaaccgaaaaaacgaaaaaacgaaaaaaaaaaacgacgcgacgaaaataacgaaacgcgaacgcgaacgcgaaataaactaaaaacgcgaatcaataaaacgaaattcgaaattcgactccgaacgaacgaactaaaaataaaaaatccctcaaccgcctccacgaaccgaccccgcgctcacgtcgattccgaaacgaataacccctctccaaacgacgcaacgctacgactctcgtaaactaaaaaataaaaaacaaaaaaaaaaccgcgaatccaaaaaccgttactaaataaaccgataaaatataacgcgaaccgaataaaacgcgacaatctaaaccgaaacccgcgtaaacttaaaaatacgcgaaacgaataccctaaacgcgcccgaactaactaaacaataaaacgaaaaaaaacgcgaaaccccgaaacta

SEQ ID NO: 17343 - DNA, 1283 bp, Artificial Sequence
  chemically treated genomic DNA (Homo sapiens) CpG-island No: 17343
gttatcggttgtttcggggtttcgtcgggttttatttgtttcgcgttttggaagtagattttgtagatgggttggtggtgttggtgttggtgtttagcgcgttggtcgtcgtcgttattgttgttgttgcggttgttgtatatcgagcgcgtttcgggttggttttcggcgtttcgtcgttcgcgttcgtcgttcgcgtcggttttagatttttcggggtcgtttttcgttgttgtcgttttcgggaggcgtttcggatttttttcggagtcgtcggtcgtcgttattttttggtcggcgggttgtaggggtaggggcggaggcggtagttcgttcgtttttttgtatcgcggggttattttttttagcggttcgtttggtttcgcggcgcgttcgggggtttcgggggacgcgggtagcggcggtaggtagcgcggggtcgcggggatcggggtcggttttttcggcggcggcgtcggcggcggcggcgggggaggttgcgggggaggttcggcgttttcgtttttcgtttcgcgatatcgattgtcgtcgtggtcgtttttaaagtttatggttgtgtcgtcgtcgtttttttgtcggttcggttggcgggtcgggttttggttgtagggaaagagagcgcggagggggcgggagggagaggggaaaaggagggagggggttcggacgtttggggttagggggcgggacggggaggggatgcggaaggttttgtagttgcggcggcggtaggcgcggtcgttcggtggagtcgtcggttcggttttgatggaggcggcgtcgaattcggttgcgcgtgagagtcgcgtcgcggaagggggggtcggagaagcgagggggcgggagggaggagcggcgcggcgggggtgacggggcgcgggcgcgggcgcggggtgggttgggggcgcggattagtgggacggagttcggggttcggtttcgagcgggcgggttggaagtgggggattttttagtcgtttttacgggtcggtttcgcgtttacgtcggtttcggggcggatgatttttttttaaacggcgtagcgttgcggttttcgtgagttgggaagtagggggtaggggagaggtcgcgggtttagaaatcgttattggatgggtcggtgggatgtggcgcgggtcgggtggggcgcgatagtttgagtcgagattcgcgtgggtttaagggtgcgcgaggcgggtgttttgggcgcgttcgaattggttgagtagtggagcgggaaagggcgcgggatttcgggattg

SEQ ID NO: 17344 - DNA, 1283 bp, Artificial Sequence
  chemically treated genomic DNA (Homo sapiens) CpG-island No: 17344
caatcccgaaatcccgcgccctttcccgctccactactcaaccaattcgaacgcgcccaaaacacccgcctcgcgcacccttaaacccacgcgaatctcgactcaaactatcgcgccccacccgacccgcgccacatcccaccgacccatccaataacgatttctaaacccgcgacctctcccctaccccctacttcccaactcacgaaaaccgcaacgctacgccgtttaaaaaaaaatcatccgccccgaaaccgacgtaaacgcgaaaccgacccgtaaaaacgactaaaaaatcccccacttccaacccgcccgctcgaaaccgaaccccgaactccgtcccactaatccgcgcccccaacccaccccgcgcccgcgcccgcgccccgtcacccccgccgcgccgctcctccctcccgccccctcgcttctccgacccccccttccgcgacgcgactctcacgcgcaaccgaattcgacgccgcctccatcaaaaccgaaccgacgactccaccgaacgaccgcgcctaccgccgccgcaactacaaaaccttccgcatcccctccccgtcccgccccctaaccccaaacgtccgaaccccctccctccttttcccctctccctcccgccccctccgcgctctctttccctacaaccaaaacccgacccgccaaccgaaccgacaaaaaaacgacgacgacacaaccataaactttaaaaacgaccacgacgacaatcgatatcgcgaaacgaaaaacgaaaacgccgaacctcccccgcaacctcccccgccgccgccgccgacgccgccgccgaaaaaaccgaccccgatccccgcgaccccgcgctacctaccgccgctacccgcgtcccccgaaacccccgaacgcgccgcgaaaccaaacgaaccgctaaaaaaaataaccccgcgatacaaaaaaacgaacgaactaccgcctccgcccctacccctacaacccgccgaccaaaaaataacgacgaccgacgactccgaaaaaaatccgaaacgcctcccgaaaacgacaacaacgaaaaacgaccccgaaaaatctaaaaccgacgcgaacgacgaacgcgaacgacgaaacgccgaaaaccaacccgaaacgcgctcgatatacaacaaccgcaacaacaacaataacgacgacgaccaacgcgctaaacaccaacaccaacaccaccaacccatctacaaaatctacttccaaaacgcgaaacaaataaaacccgacgaaaccccgaaacaaccgataac

SEQ ID NO: 17345 - DNA, 1131 bp, Artificial Sequence
  chemically treated genomic DNA (Homo sapiens) CpG-island No: 17345
aattaaatcgaacgtttttgtagttttttcgttagttttgcgggagtttattcgtttaacgcggtttcgttttttttttaggtttcgtttatcgtcgagtttaggttcggtttttgacgaagttcgtcggaaattatcgaagttttttttttttttttttttttttcgttttttgtttttttttttttttttattcgggttttttcggtcgtgattttttttttttttttttttttttttttattgaaattaagatggaggttcgcggtagtcgtcggcgttcgtgatttcggaggtttcgtcggttacgggttttcgttttcgcgattgcgcgttcgggaggcgcgtgttgttgttcgcgtttcggtcggcgttcgggaggtcgtggtttcgcgttttcgtttttcggttagttcgcggttatcgggcggagttttcgtttatgtgggcgcgttttttgggtcgagtcgtcgtcgtcgtttttcgtcgtttcggggttttgcgttcgcgcgtcgggcgcgggtagttgggtgttcggcgtcgttaggttcggcgcggagcgggcggtacgcggcgttaggggcgcggggttcgaggcgggcgcggtcgcgggcgtcgtcgtagttatgagcggtagtagcggcggagtcgtcgttttcgtcgcgtttttcggtttcgtcgcggcggttagcgcggttggttcgggttgcgggggcggtgtcggcgagggggtagaggaggcggttaaggatttggtcgatatcgcggttttttttcgattcggtgagtgtaattgcggtcggttcgtttagcggcgttgttttaagcgttcggtcgattcgtcgcggagttgtcgagtttcggttatcgcgcgttggtgtcggtcgttcgttcgtcggggttcgtaggtttttcgttgggatattggtttatgcgcgggggtgtcggttaaattcggtgttcgttgtcggtagcggcggcggatttggcgaatgtataattgttttttgagttttttgttagggagatttcggtagcgatcgaacggataggtgggcggattgttcgcgagtagacggtataacggggagtatattaattaaaaaaggatagagtaagaaaagaaacgaa

SEQ ID NO: 17346 - DNA, 1131 bp, Artificial Sequence
  chemically treated genomic DNA (Homo sapiens) CpG-island No: 17346
ttcgtttcttttcttactctatccttttttaattaatatactccccgttataccgtctactcgcgaacaatccgcccacctatccgttcgatcgctaccgaaatctccctaacaaaaaactcaaaaaacaattatacattcgccaaatccgccgccgctaccgacaacgaacaccgaatttaaccgacacccccgcgcataaaccaatatcccaacgaaaaacctacgaaccccgacgaacgaacgaccgacaccaacgcgcgataaccgaaactcgacaactccgcgacgaatcgaccgaacgcttaaaacaacgccgctaaacgaaccgaccgcaattacactcaccgaatcgaaaaaaaaccgcgatatcgaccaaatccttaaccgcctcctctaccccctcgccgacaccgcccccgcaacccgaaccaaccgcgctaaccgccgcgacgaaaccgaaaaacgcgacgaaaacgacgactccgccgctactaccgctcataactacgacgacgcccgcgaccgcgcccgcctcgaaccccgcgcccctaacgccgcgtaccgcccgctccgcgccgaacctaacgacgccgaacacccaactacccgcgcccgacgcgcgaacgcaaaaccccgaaacgacgaaaaacgacgacgacgactcgacccaaaaaacgcgcccacataaacgaaaactccgcccgataaccgcgaactaaccgaaaaacgaaaacgcgaaaccacgacctcccgaacgccgaccgaaacgcgaacaacaacacgcgcctcccgaacgcgcaatcgcgaaaacgaaaacccgtaaccgacgaaacctccgaaatcacgaacgccgacgactaccgcgaacctccatcttaatttcaataaaaaaaaaaaaaaaaaaaaaaaaaaaatcacgaccgaaaaaacccgaataaaaaaaaaaaaaaaaacaaaaaacgaaaaaaaaaaaaaaaaaaaaaaaacttcgataatttccgacgaacttcgtcaaaaaccgaacctaaactcgacgataaacgaaacctaaaaaaaaaacgaaaccgcgttaaacgaataaactcccgcaaaactaacgaaaaaactacaaaaacgttcgatttaatt

SEQ ID NO: 17347 - DNA, 1131 bp, Artificial Sequence
  chemically treated genomic DNA (Homo sapiens) CpG-island No: 17347
ttcgtttttttttttgttttgtttttttttggttggtgtgtttttcgttgtgtcgtttgttcgcgggtagttcgtttatttattcgttcggtcgttgtcgggatttttttaatagggggtttaggaggtagttgtgtattcgttaagttcgtcgtcgttgtcggtagcggatatcggatttggtcggtattttcgcgtatgaattagtgttttagcgagaagtttgcgggtttcgacggacggacggtcggtattagcgcgcggtggtcggagttcggtagtttcgcggcgggtcggtcgagcgtttggggtagcgtcgttgggcgggtcggtcgtagttgtatttatcggatcggaagaaggtcgcgatgtcggttaggtttttggtcgttttttttgttttttcgtcggtatcgttttcgtagttcgagttagtcgcgttggtcgtcgcggcggggtcggaggacgcggcgggggcggcggtttcgtcgttgttgtcgtttatggttgcggcggcgttcgcggtcgcgttcgtttcgggtttcgcgtttttagcgtcgcgtgtcgttcgtttcgcgtcgggtttggcggcgtcgagtatttagttgttcgcgttcggcgcgcggacgtagagtttcggggcggcggggggcggcggcggcggttcggtttaaggagcgcgtttatatagacgaggatttcgttcggtagtcgcgagttggtcgaggggcggaggcgcggagttacggtttttcgggcgtcggtcggagcgcgggtagtagtacgcgtttttcggacgcgtagtcgcgagggcgggggttcgtggtcggcgagattttcgggattacgggcgtcggcggttgtcgcgagtttttattttgattttaatggggaaggaaggaggggggagggggaaattacggtcgagggaattcgggtgaaaggaaaagggagaatagggaacggagaggaaggaaaaaaaagaggggtttcggtaattttcggcgaatttcgttaagggtcgagtttgggttcggcggtgggcggagtttgggggaggggcggggtcgcgttgggcggatgggttttcgtagggttggcggggaggttgtaggaacgttcggtttggtt

SEQ ID NO: 17348 - DNA, 1131 bp, Artificial Sequence
  chemically treated genomic DNA (Homo sapiens) CpG-island No: 17348
aaccaaaccgaacgttcctacaacctccccgccaaccctacgaaaacccatccgcccaacgcgaccccgcccctcccccaaactccgcccaccgccgaacccaaactcgacccttaacgaaattcgccgaaaattaccgaaacccctcttttttttccttcctctccgttccctattctcccttttcctttcacccgaattccctcgaccgtaatttccccctcccccctccttccttccccattaaaatcaaaataaaaactcgcgacaaccgccgacgcccgtaatcccgaaaatctcgccgaccacgaacccccgccctcgcgactacgcgtccgaaaaacgcgtactactacccgcgctccgaccgacgcccgaaaaaccgtaactccgcgcctccgcccctcgaccaactcgcgactaccgaacgaaatcctcgtctatataaacgcgctccttaaaccgaaccgccgccgccgccccccgccgccccgaaactctacgtccgcgcgccgaacgcgaacaactaaatactcgacgccgccaaacccgacgcgaaacgaacgacacgcgacgctaaaaacgcgaaacccgaaacgaacgcgaccgcgaacgccgccgcaaccataaacgacaacaacgacgaaaccgccgcccccgccgcgtcctccgaccccgccgcgacgaccaacgcgactaactcgaactacgaaaacgataccgacgaaaaaacaaaaaaaacgaccaaaaacctaaccgacatcgcgaccttcttccgatccgataaatacaactacgaccgacccgcccaacgacgctaccccaaacgctcgaccgacccgccgcgaaactaccgaactccgaccaccgcgcgctaataccgaccgtccgtccgtcgaaacccgcaaacttctcgctaaaacactaattcatacgcgaaaataccgaccaaatccgatatccgctaccgacaacgacgacgaacttaacgaatacacaactacctcctaaaccccctattaaaaaaatcccgacaacgaccgaacgaataaataaacgaactacccgcgaacaaacgacacaacgaaaaacacaccaaccaaaaaaaaacaaaacaaaaaaaaaaacgaa

SEQ ID NO: 17349 - DNA, 656 bp, Artificial Sequence
  chemically treated genomic DNA (Homo sapiens) CpG-island No: 17349
tcgcggggggaaatagtattggtttttcgtttttattagtcggtttttcgcgattgtgttttttaattaacgggttttcgatgaaaagtgttaaggaggtcgtcggattcgtttaagtggaatttttaagatgtttttcggggagtagttttaggaacgcgtttggattttaggagtagtttttcgtttcgttgtcgagtttcggaggttttcgtagttttggggttcgcgatttcgatagcgcgcggaggtttcgtttttttagggttcgttttttttttgttcggtttttgattggttgttcggcgcgttagtcggtatttattttcgttttacgtttttttcgttttttttagttcgttttagggaagcgagttcgggcgtcggcgggcggtcgtcgcgtttgatagattattgtagaattacgggtcgaaggatttagacgttcgattcgtagacgcggtacggtatgagcggcgataaggagttttacgcgggataagggagcgggagtcggtattggcgttttcgatagtaggtgagtttgggagtcgagagcggaggcgggggacggggggtagcgacgtaagagaattagttaaggacgggtagagggattagtagagtaagttaaggggatagtagttatttttcgg

SEQ ID NO: 17350 - DNA, 656 bp, Artificial Sequence
  chemically treated genomic DNA (Homo sapiens) CpG-island No: 17350
ccgaaaaataactactatccccttaacttactctactaatccctctacccgtccttaactaattctcttacgtcgctaccccccgtcccccgcctccgctctcgactcccaaactcacctactatcgaaaacgccaataccgactcccgctcccttatcccgcgtaaaactccttatcgccgctcataccgtaccgcgtctacgaatcgaacgtctaaatccttcgacccgtaattctacaataatctatcaaacgcgacgaccgcccgccgacgcccgaactcgcttccctaaaacgaactaaaaaaaacgaaaaaaacgtaaaacgaaaataaataccgactaacgcgccgaacaaccaatcaaaaaccgaacaaaaaaaaaacgaaccctaaaaaaacgaaacctccgcgcgctatcgaaatcgcgaaccccaaaactacgaaaacctccgaaactcgacaacgaaacgaaaaactactcctaaaatccaaacgcgttcctaaaactactccccgaaaaacatcttaaaaattccacttaaacgaatccgacgacctccttaacacttttcatcgaaaacccgttaattaaaaaacacaatcgcgaaaaaccgactaataaaaacgaaaaaccaatactatttccccccgcga

SEQ ID NO: 17351 - DNA, 656 bp, Artificial Sequence
  chemically treated genomic DNA (Homo sapiens) CpG-island No: 17351
tcgaggagtggttgttgtttttttggtttgttttgttgatttttttgttcgtttttgattggtttttttgcgtcgttgtttttcgtttttcgttttcgttttcggtttttaggtttatttgttgtcgggagcgttagtatcgattttcgtttttttgtttcgcgtggggttttttgtcgtcgtttatgtcgtgtcgcgtttgcggatcgggcgtttgggtttttcggttcgtggttttgtagtggtttgttagacgcgacggtcgttcgtcggcgttcgggttcgtttttttgaggcgggttggggagggcgggggaggcgtagggcggggatgggtatcgattgacgcgtcgggtagttaattagaggtcgggtaggggaggagcgggttttagaggggcggggttttcgcgcgttgtcggggtcgcgggttttagaattgcggagattttcgaggttcggtagcggggcgggaagttatttttggggtttaggcgcgtttttgaggttgtttttcgggaaatattttgggaattttatttgggcggattcggcgatttttttggtattttttatcgaaggttcgttgattgggaagtataatcgcggagggtcggttgatgagggcgaggaattagtgttgttttttttcgcgg

SEQ ID NO: 17352 - DNA, 656 bp, Artificial Sequence
  chemically treated genomic DNA (Homo sapiens) CpG-island No: 17352
ccgcgaaaaaaaacaacactaattcctcgccctcatcaaccgaccctccgcgattatacttcccaatcaacgaaccttcgataaaaaataccaaaaaaatcgccgaatccgcccaaataaaattcccaaaatatttcccgaaaaacaacctcaaaaacgcgcctaaaccccaaaaataacttcccgccccgctaccgaacctcgaaaatctccgcaattctaaaacccgcgaccccgacaacgcgcgaaaaccccgcccctctaaaacccgctcctcccctacccgacctctaattaactacccgacgcgtcaatcgatacccatccccgccctacgcctcccccgccctccccaacccgcctcaaaaaaacgaacccgaacgccgacgaacgaccgtcgcgtctaacaaaccactacaaaaccacgaaccgaaaaacccaaacgcccgatccgcaaacgcgacacgacataaacgacgacaaaaaaccccacgcgaaacaaaaaaacgaaaatcgatactaacgctcccgacaacaaataaacctaaaaaccgaaaacgaaaacgaaaaacgaaaaacaacgacgcaaaaaaaccaatcaaaaacgaacaaaaaaatcaacaaaacaaaccaaaaaaacaacaaccactcctcga

SEQ ID NO: 17353 - DNA, 871 bp, Artificial Sequence
  chemically treated genomic DNA (Homo sapiens) CpG-island No: 17353
gtaatcgtttgttcgattcggagttgtattcggatagcgtttttagtatgtggtcggataatcgtatcgttcgtgacgcgtattatttttatcggtatgatcgttacggtaggttgatagagaaaatcgattttatttcggaaggggttattcgtacggatgatgagcgtatttatcggtattattacgatagttagtatcggttggtgtattatacgcggatataatatgtagagtcgttggtcgaaagtcgttatttttacgattcgttgggtcgtagggtggtaaaacgggtatggcggcgtgaacgggatttgacgggttggatgtcgttgttacggaaatcgtaagtgatttggtacggttgggacggcgatcgtttgatttacgatatagaacgatagaattcgtatttagacgatttattagtcggggagttttacgttatttattagggtcgaaatcgttatcggtgagttggcgaaaacgtagcgtcgtagtttggcggatgttttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtgtatacgtcggcgcgaaaaatttatttgtattattgcgattatcgcggtttgtcgttggcgtttattagtacggaaggggtaatagcgtggtgcgtagaatatgatgaatggggtaatttgttgaatgaagagaattcgtattagttgtagtagtttattcggttgtcggggtagtagtatg

SEQ ID NO: 17354 - DNA, 871 bp, Artificial Sequence
  chemically treated genomic DNA (Homo sapiens) CpG-island No: 17354
catactactaccccgacaaccgaataaactactacaactaatacgaattctcttcattcaacaaattaccccattcatcatattctacgcaccacgctattaccccttccgtactaataaacgccaacgacaaaccgcgataatcgcaataatacaaataaatttttcgcgccgacgtatacaccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaaaacatccgccaaactacgacgctacgttttcgccaactcaccgataacgatttcgaccctaataaataacgtaaaactccccgactaataaatcgtctaaatacgaattctatcgttctatatcgtaaatcaaacgatcgccgtcccaaccgtaccaaatcacttacgatttccgtaacaacgacatccaacccgtcaaatcccgttcacgccgccatacccgttttaccaccctacgacccaacgaatcgtaaaaataacgactttcgaccaacgactctacatattatatccgcgtataatacaccaaccgatactaactatcgtaataataccgataaatacgctcatcatccgtacgaataaccccttccgaaataaaatcgattttctctatcaacctaccgtaacgatcataccgataaaaataatacgcgtcacgaacgatacgattatccgaccacatactaaaaacgctatccgaatacaactccgaatcgaacaaacgattac

SEQ ID NO: 17355 - DNA, 871 bp, Artificial Sequence
  chemically treated genomic DNA (Homo sapiens) CpG-island No: 17355
tatattgttgtttcggtagtcggataagttgttgtagttgatgcgggttttttttatttagtaggttgttttatttattatattttgcgtattacgttgttgtttttttcgtgttgatgagcgttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagggtattcgttaggttgcggcgttgcgttttcgttagtttatcggtggcggtttcgattttgatgagtggcgtgaagtttttcggttgataaatcgtttggatgcgggttttgtcgttttgtatcgtaggttaggcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttgtatattgtgttcgcgtgtagtgtattagtcggtgttgattgtcgtaatggtatcggtgggtgcgtttattattcgtgcggataatttttttcgggatgaggtcggttttttttgttagtttgtcgtgacggttatatcggtaaagatagtgcgcgttacgggcgatacggttattcggttatatgttgagggcgttgttcgggtgtagtttcgggtcgggtaggcggttat

SEQ ID NO: 17356 - DNA, 871 bp, Artificial Sequence
  chemically treated genomic DNA (Homo sapiens) CpG-island No: 17356
ataaccgcctacccgacccgaaactacacccgaacaacgccctcaacatataaccgaataaccgtatcgcccgtaacgcgcactatctttaccgatataaccgtcacgacaaactaacaaaaaaaaccgacctcatcccgaaaaaaattatccgcacgaataataaacgcacccaccgataccattacgacaatcaacaccgactaatacactacacgcgaacacaatatacaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgcctaacctacgatacaaaacgacaaaacccgcatccaaacgatttatcaaccgaaaaacttcacgccactcatcaaaatcgaaaccgccaccgataaactaacgaaaacgcaacgccgcaacctaacgaatacccttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacgctcatcaacacgaaaaaaacaacaacgtaatacgcaaaatataataaataaaacaacctactaaataaaaaaaacccgcatcaactacaacaacttatccgactaccgaaacaacaatata

SEQ ID NO: 17357 - DNA, 1054 bp, Artificial Sequence
  chemically treated genomic DNA (Homo sapiens) CpG-island No: 17357
ttacgggttttcgttcggtttttatagcggtagcggatcgaattaggaaagtaattttcgttcggtttttttcgggttttaggtttaggaaggtcgggtcgtggggttttttcgggttttacgtaggggcggtggggcggggcgtagtgacgtaaagaggagtgacgcgacgacgtagcgcgacgcggtgacgtacgtttttttgttggtttagtagcgatagtagcggtcgtggaggtggcgttggggattgttttttttcggaggtcggagcggagtcgcgtttgattgaggcgggtagtaagcggttttttcgttttttttttttttttttcgcgtttttttcgtcgttattagtcgttaaacgttaatcgtcgtttttggggaggagtcgcggttcgcggggtcggagttaggtttgcgttcggatattagtcggagtcggagcgagagtcggggtttcggcgttttcgtttttttttcgtttcggttagcgttcgtcgggttttcgcgcgtcgcgttatggattcggacgagggttataattacgagttcgacgaggacgaggagtgtagtgaggaggatagcggcgtcgaggaggaggaggacgaagacgacgacgagtcggacgatgatattttggatttgggcgaggtggagttggtggagttcgggttgggcgtcggcggggagcgggacggattgttgtgcggggagacgggcggtggcggcggtagcgttttggggttcggcggtggcggcggcggcggcggcggcggtggtggtggcgggtcggggtatgagtaggaggaggattatcgttacgaggtgtttacggtcgagtagattttataatatatggtggaatgtattcgggaggttaacgaggttatttaggtgagggtggtcgtcgcgttagttggatcgggttcgacgggggagcggatttaggcggtacgcgcggtttcgagggataggtttgggtttggtgcgtagtttagttcggtgtttttcggttttgtttttttcgttgtttttgttggggatagagggt

SEQ ID NO: 17358 - DNA, 1054 bp, Artificial Sequence
  chemically treated genomic DNA (Homo sapiens) CpG-island No: 17358
accctctatccccaacaaaaacaacgaaaaaaacaaaaccgaaaaacaccgaactaaactacgcaccaaacccaaacctatccctcgaaaccgcgcgtaccgcctaaatccgctcccccgtcgaacccgatccaactaacgcgacgaccaccctcacctaaataacctcgttaacctcccgaatacattccaccatatattataaaatctactcgaccgtaaacacctcgtaacgataatcctcctcctactcataccccgacccgccaccaccaccgccgccgccgccgccgccgccaccgccgaaccccaaaacgctaccgccgccaccgcccgtctccccgcacaacaatccgtcccgctccccgccgacgcccaacccgaactccaccaactccacctcgcccaaatccaaaatatcatcgtccgactcgtcgtcgtcttcgtcctcctcctcctcgacgccgctatcctcctcactacactcctcgtcctcgtcgaactcgtaattataaccctcgtccgaatccataacgcgacgcgcgaaaacccgacgaacgctaaccgaaacgaaaaaaaaacgaaaacgccgaaaccccgactctcgctccgactccgactaatatccgaacgcaaacctaactccgaccccgcgaaccgcgactcctccccaaaaacgacgattaacgtttaacgactaataacgacgaaaaaaacgcgaaaaaaaaaaaaaaaaaacgaaaaaaccgcttactacccgcctcaatcaaacgcgactccgctccgacctccgaaaaaaaacaatccccaacgccacctccacgaccgctactatcgctactaaaccaacaaaaaaacgtacgtcaccgcgtcgcgctacgtcgtcgcgtcactcctctttacgtcactacgccccgccccaccgcccctacgtaaaacccgaaaaaaccccacgacccgaccttcctaaacctaaaacccgaaaaaaaccgaacgaaaattactttcctaattcgatccgctaccgctataaaaaccgaacgaaaacccgtaa

SEQ ID NO: 17359 - DNA, 1054 bp, Artificial Sequence
  chemically treated genomic DNA (Homo sapiens) CpG-island No: 17359
attttttatttttagtagaggtagcggagaagataaggtcgggaggtatcgggttaggttgcgtattaggtttaggtttgtttttcgggatcgcgcgtgtcgtttgaattcgttttttcgtcgggttcggtttagttggcgcggcggttatttttatttggatgatttcgttgatttttcggatatattttattatgtgttgtagaatttgttcggtcgtgagtatttcgtagcggtaattttttttttgtttatgtttcggttcgttattattatcgtcgtcgtcgtcgtcgtcgttatcgtcgggttttagagcgttgtcgtcgttatcgttcgttttttcgtatagtagttcgtttcgtttttcgtcgacgtttagttcgggttttattagttttatttcgtttagatttagggtattatcgttcggttcgtcgtcgttttcgtttttttttttttcggcgtcgttgttttttttattgtatttttcgttttcgtcgaattcgtagttgtagttttcgttcgagtttatggcgcgacgcgcgggggttcggcggacgttggtcgaggcggggagagggcggggacgtcgaggtttcggttttcgtttcggtttcggttgatgttcggacgtaggtttggtttcggtttcgcgagtcgcggtttttttttaggagcggcggttggcgtttgacggttggtggcggcggggagggcgcggaggagggagggagggagcgagggggtcgtttgttgttcgttttagttagacgcggtttcgtttcggttttcgagagaaaatagtttttaacgttatttttacggtcgttgttatcgttattgagttaataaaggggcgtgcgttatcgcgtcgcgttgcgtcgtcgcgttatttttttttgcgttattgcgtttcgttttatcgtttttgcgtggagttcggggagattttacggttcggtttttttgggtttgggattcgaggggagtcgagcgggaattgtttttttggttcgattcgttgtcgttgtgagggtcgagcggaaattcgtag

SEQ ID NO: 17360 - DNA, 1054 bp, Artificial Sequence
  chemically treated genomic DNA (Homo sapiens) CpG-island No: 17360
ctacgaatttccgctcgaccctcacaacgacaacgaatcgaaccaaaaaaacaattcccgctcgactcccctcgaatcccaaacccaaaaaaaccgaaccgtaaaatctccccgaactccacgcaaaaacgataaaacgaaacgcaataacgcaaaaaaaaataacgcgacgacgcaacgcgacgcgataacgcacgcccctttattaactcaataacgataacaacgaccgtaaaaataacgttaaaaactattttctctcgaaaaccgaaacgaaaccgcgtctaactaaaacgaacaacaaacgaccccctcgctccctccctccctcctccgcgccctccccgccgccaccaaccgtcaaacgccaaccgccgctcctaaaaaaaaaccgcgactcgcgaaaccgaaaccaaacctacgtccgaacatcaaccgaaaccgaaacgaaaaccgaaacctcgacgtccccgccctctccccgcctcgaccaacgtccgccgaacccccgcgcgtcgcgccataaactcgaacgaaaactacaactacgaattcgacgaaaacgaaaaatacaataaaaaaaacaacgacgccgaaaaaaaaaaaaacgaaaacgacgacgaaccgaacgataataccctaaatctaaacgaaataaaactaataaaacccgaactaaacgtcgacgaaaaacgaaacgaactactatacgaaaaaacgaacgataacgacgacaacgctctaaaacccgacgataacgacgacgacgacgacgacgataataataacgaaccgaaacataaacaaaaaaaaaattaccgctacgaaatactcacgaccgaacaaattctacaacacataataaaatatatccgaaaaatcaacgaaatcatccaaataaaaataaccgccgcgccaactaaaccgaacccgacgaaaaaacgaattcaaacgacacgcgcgatcccgaaaaacaaacctaaacctaatacgcaacctaacccgatacctcccgaccttatcttctccgctacctctactaaaaataaaaaat

SEQ ID NO: 17361 - DNA, 917 bp, Artificial Sequence
  chemically treated genomic DNA (Homo sapiens) CpG-island No: 17361
gttggttcggtttttggttgttttagatcgcgttgttttttagtttcgaggtagagagttgtttcggtgttatagttaaataagttcggcgtcgcgtagtttttgatacgcgcggaagggttcggttttgttttggttgtcgtcgttttgttattagtacggcgttgtattgggggcggggagtttgatgggagacgcgcgcggcgttgaggaggcggcggttcgggagagggagcgggagagggattgggcgcgggaggcgggaggcggggggatagaagggaggtttcgtcgtcggcggcgttcgtttttttcgttggggagtagttgttgtagtaggagtagagtaggagacgcgtagtcgtcgtcgtcgtcgtcgggggatgtggtcggcgtttgtttttagtcgcgtcgttttttgagtattagtcgtcgttgtagtcgtcgtcgtcgtttagtcgtgcggtgttaggtcgcgtttttttcgggcgttcgtcggttcgtatgtcgaggggtttcggggcgtagttgcgcgttcggcgtcgttttcgggttttttcggtttcgttatgggttgttgtagtttcgtttttttcgtcgcgtaggtgaggggttttcgtttttcggtcgttcgttcggatgtttttcgtgcgtcgcgtcgcgcggcgggcgttcgtcgttcgatatttttcgttgtttttagttttttttgagcgtatcgtgtagtttaaagatttttatttcgttttttcgttcgtcgggtttcgtcgatgttcgtgcgttggtttcgcggttgtcgatttaaaggcgtttttgcgcggcgtttagtgcgtttttagtttttttcggttttttttttagtcggttttttttttttagttatatttgagttgttcgtttcgttcgtttgtaggtag

SEQ ID NO: 17362 - DNA, 917 bp, Artificial Sequence
  chemically treated genomic DNA (Homo sapiens) CpG-island No: 17362
ctacctacaaacgaacgaaacgaacaactcaaatataactaaaaaaaaaaaaccgactaaaaaaaaaaccgaaaaaaactaaaaacgcactaaacgccgcgcaaaaacgcctttaaatcgacaaccgcgaaaccaacgcacgaacatcgacgaaacccgacgaacgaaaaaacgaaataaaaatctttaaactacacgatacgctcaaaaaaaactaaaaacaacgaaaaatatcgaacgacgaacgcccgccgcgcgacgcgacgcacgaaaaacatccgaacgaacgaccgaaaaacgaaaacccctcacctacgcgacgaaaaaaacgaaactacaacaacccataacgaaaccgaaaaaacccgaaaacgacgccgaacgcgcaactacgccccgaaacccctcgacatacgaaccgacgaacgcccgaaaaaaacgcgacctaacaccgcacgactaaacgacgacgacgactacaacgacgactaatactcaaaaaacgacgcgactaaaaacaaacgccgaccacatcccccgacgacgacgacgacgactacgcgtctcctactctactcctactacaacaactactccccaacgaaaaaaacgaacgccgccgacgacgaaacctcccttctatccccccgcctcccgcctcccgcgcccaatccctctcccgctccctctcccgaaccgccgcctcctcaacgccgcgcgcgtctcccatcaaactccccgcccccaatacaacgccgtactaataacaaaacgacgacaaccaaaacaaaaccgaacccttccgcgcgtatcaaaaactacgcgacgccgaacttatttaactataacaccgaaacaactctctacctcgaaactaaaaaacaacgcgatctaaaacaaccaaaaaccgaaccaac

SEQ ID NO: 17363 - DNA, 917 bp, Artificial Sequence
  chemically treated genomic DNA (Homo sapiens) CpG-island No: 17363
ttatttgtaggcgggcgggacgggtagtttaggtgtgattgggaggagggggtcgattggggaaggggtcgggaagagttgagggcgtattaggcgtcgcgtagaggcgtttttgagtcggtagtcgcggagttagcgtacgggtatcggcgggattcggcggacggaaaggcggagtgggggtttttggattgtacggtgcgtttaggggaggttggggatagcgagaggtatcgggcggcgggcgttcgtcgcgcgacgcggcgtacgggaggtattcgggcgggcggtcgggaggcgggagttttttatttgcgcggcggaggaggcggagttgtagtagtttatggcggggtcgaaggagttcggaggcggcgtcgggcgcgtagttacgtttcggagtttttcggtatgcgagtcggcgggcgttcggggagggcgcggtttggtatcgtacggttaggcggcggcggcggttgtagcggcggttggtatttaagaggcggcgcggttagaggtaggcgtcggttatatttttcggcggcggcggcggcggttacgcgttttttgttttgtttttgttgtagtagttgttttttagcggaaggggcgggcgtcgtcgacgacggagttttttttttgttttttcgtttttcgtttttcgcgtttagtttttttttcgttttttttttcgggtcgtcgtttttttagcgtcgcgcgcgttttttattagatttttcgtttttagtgtagcgtcgtgttggtggtagggcggcggtagttagaataaggtcgggttttttcgcgcgtgttagaggttgcgcggcgtcgggtttatttagttgtggtatcgaggtagttttttgtttcgaggttggagggtaacgcggtttgaggtagttaaagatcgggttaat

SEQ ID NO: 17364 - DNA, 917 bp, Artificial Sequence
  chemically treated genomic DNA (Homo sapiens) CpG-island No: 17364
attaacccgatctttaactacctcaaaccgcgttaccctccaacctcgaaacaaaaaactacctcgataccacaactaaataaacccgacgccgcgcaacctctaacacgcgcgaaaaaacccgaccttattctaactaccgccgccctaccaccaacacgacgctacactaaaaacgaaaaatctaataaaaaacgcgcgcgacgctaaaaaaacgacgacccgaaaaaaaaaacgaaaaaaaaactaaacgcgaaaaacgaaaaacgaaaaaacaaaaaaaaaactccgtcgtcgacgacgcccgccccttccgctaaaaaacaactactacaacaaaaacaaaacaaaaaacgcgtaaccgccgccgccgccgccgaaaaatataaccgacgcctacctctaaccgcgccgcctcttaaataccaaccgccgctacaaccgccgccgccgcctaaccgtacgataccaaaccgcgccctccccgaacgcccgccgactcgcataccgaaaaactccgaaacgtaactacgcgcccgacgccgcctccgaactccttcgaccccgccataaactactacaactccgcctcctccgccgcgcaaataaaaaactcccgcctcccgaccgcccgcccgaatacctcccgtacgccgcgtcgcgcgacgaacgcccgccgcccgatacctctcgctatccccaacctcccctaaacgcaccgtacaatccaaaaacccccactccgcctttccgtccgccgaatcccgccgatacccgtacgctaactccgcgactaccgactcaaaaacgcctctacgcgacgcctaatacgccctcaactcttcccgaccccttccccaatcgaccccctcctcccaatcacacctaaactacccgtcccgcccgcctacaaataa

SEQ ID NO: 17365 - DNA, 672 bp, Artificial Sequence
  chemically treated genomic DNA (Homo sapiens) CpG-island No: 17365
acgaaacgttagtagatttacgcgagaattatatatatttggggttggcgtcgttggacgtcgcggttttacggagatttagggtttaagtagagttaaggagcggcggtaatcgcgggggttattcggaagatcgcggagtttcggttttaggcgtcgtcgcggttgttaggttcgcgtattttttagttgcggtgagcgcgttgtttttatttcggtgttttatttttttcgcgttagttgtagacgtatttttttgttttcgggcgttttttttcgttttttttttttttttttttcgtttttagttttagttcggtacggcgtttttattattttttcgaagaacgtggtcgttatagtcgtttcgtgatcggttggatataattgtagcgtcgcgggatcgtacgtcggtttgcgcgagattacgtttttttatcgcgcgggtaataagtttcgtttcgtataggttacgtttttcgcgtatagtttaagttcgcggttatatttttatcgcgcgggcgttacgtttcgtttcgtatagggttcgtttttaggtatattttgagttcgcggttacgttttttatatcgttcgttcgcgttgttatgttttgggttagtagttttcgtagtttttttgtttttaaattatagattgggggagggggtt

SEQ ID NO: 17366 - DNA, 672 bp, Artificial Sequence
  chemically treated genomic DNA (Homo sapiens) CpG-island No: 17366
aaccccctcccccaatctataatttaaaaacaaaaaaactacgaaaactactaacccaaaacataacaacgcgaacgaacgatataaaaaacgtaaccgcgaactcaaaatatacctaaaaacgaaccctatacgaaacgaaacgtaacgcccgcgcgataaaaatataaccgcgaacttaaactatacgcgaaaaacgtaacctatacgaaacgaaacttattacccgcgcgataaaaaaacgtaatctcgcgcaaaccgacgtacgatcccgcgacgctacaattatatccaaccgatcacgaaacgactataacgaccacgttcttcgaaaaaataataaaaacgccgtaccgaactaaaactaaaaacgaaaaaaaaaaaaaaaaaaaacgaaaaaaaacgcccgaaaacaaaaaaatacgtctacaactaacgcgaaaaaaataaaacaccgaaataaaaacaacgcgctcaccgcaactaaaaaatacgcgaacctaacaaccgcgacgacgcctaaaaccgaaactccgcgatcttccgaataacccccgcgattaccgccgctccttaactctacttaaaccctaaatctccgtaaaaccgcgacgtccaacgacgccaaccccaaatatatataattctcgcgtaaatctactaacgtttcgt

SEQ ID NO: 17367 - DNA, 672 bp, Artificial Sequence
  chemically treated genomic DNA (Homo sapiens) CpG-island No: 17367
gatttttttttttaatttgtaatttaaaaataaaaaagttgcggggattgttggtttagggtatgatagcgcgggcgggcggtgtagagggcgtggtcgcgagtttagggtgtgtttgggagcgagttttgtgcggggcgggacgtagcgttcgcgcggtgggggtgtggtcgcgagtttgggttgtgcgcggagggcgtggtttgtgcggggcgggatttattgttcgcgcggtgagggagcgtggtttcgcgtaagtcggcgtgcggtttcgcggcgttgtagttgtgtttagtcggttacggggcggttatggcggttacgtttttcggagaggtggtgaaggcgtcgtgtcgagttgggattgaggacgaagaggaggaggaggaggggcggagggagacgttcgaggatagggaggtgcgtttgtagttggcgcggaagaggtgaggtatcgggataagggtagcgcgtttatcgtagttggaaggtgcgcgggtttggtagtcgcgacggcgtttaaggtcggggtttcgcggtttttcgagtggttttcgcggttgtcgtcgttttttggttttgtttgggttttgggttttcgtgaagtcgcggcgtttagcggcgttagttttaggtgtgtgtggttttcgcgtggatttgttggcgtttcgt

SEQ ID NO: 17368 - DNA, 672 bp, Artificial Sequence
  chemically treated genomic DNA (Homo sapiens) CpG-island No: 17368
acgaaacgccaacaaatccacgcgaaaaccacacacacctaaaactaacgccgctaaacgccgcgacttcacgaaaacccaaaacccaaacaaaaccaaaaaacgacgacaaccgcgaaaaccactcgaaaaaccgcgaaaccccgaccttaaacgccgtcgcgactaccaaacccgcgcaccttccaactacgataaacgcgctacccttatcccgatacctcacctcttccgcgccaactacaaacgcacctccctatcctcgaacgtctccctccgcccctcctcctcctcctcttcgtcctcaatcccaactcgacacgacgccttcaccacctctccgaaaaacgtaaccgccataaccgccccgtaaccgactaaacacaactacaacgccgcgaaaccgcacgccgacttacgcgaaaccacgctccctcaccgcgcgaacaataaatcccgccccgcacaaaccacgccctccgcgcacaacccaaactcgcgaccacacccccaccgcgcgaacgctacgtcccgccccgcacaaaactcgctcccaaacacaccctaaactcgcgaccacgccctctacaccgcccgcccgcgctatcataccctaaaccaacaatccccgcaacttttttatttttaaattacaaattaaaaaaaaaaatc

SEQ ID NO: 17369 - DNA, 545 bp, Artificial Sequence
  chemically treated genomic DNA (Homo sapiens) CpG-island No: 17369
tttcgtgtcggatttggtcgttttttttttcgtttttatattaaagttcggagattttatgtgtcgtttttagcgataagggattcggagtagcgacgattttagatttatcggttggacggggattaggattggggtggggtagggaagttgttatttttagggaacggcggcgatcgttatagcgtaggtcgcggattcgatcgcggtaggcgaagtggggtggggggagtggaaattagggagggtggggaagagggtaatacgtaagcgttaagggttaggtgtcgcggtggatgtcgggatacggagttttcggtagagaaagaaattggttaaatgagagaaagcgaattattaattttaggatgattcgcgtacgatttggttgttacgaaggttcggaggagggcgtttgcgggcggggtataacgagaagttatcggaagcggaagttaggtatggcgttcggggttcgggagtttgggtaatatagttttgtgtttattgggtgaagaggttgatttagggcggggaaaggagga

SEQ ID NO: 17370 - DNA, 545 bp, Artificial Sequence
  chemically treated genomic DNA (Homo sapiens) CpG-island No: 17370
tcctcctttccccgccctaaatcaacctcttcacccaataaacacaaaactatattacccaaactcccgaaccccgaacgccatacctaacttccgcttccgataacttctcgttataccccgcccgcaaacgccctcctccgaaccttcgtaacaaccaaatcgtacgcgaatcatcctaaaattaataattcgctttctctcatttaaccaatttctttctctaccgaaaactccgtatcccgacatccaccgcgacacctaacccttaacgcttacgtattaccctcttccccaccctccctaatttccactccccccaccccacttcgcctaccgcgatcgaatccgcgacctacgctataacgatcgccgccgttccctaaaaataacaacttccctaccccaccccaatcctaatccccgtccaaccgataaatctaaaatcgtcgctactccgaatcccttatcgctaaaaacgacacataaaatctccgaactttaatataaaaacgaaaaaaaaaacgaccaaatccgacacgaaa

SEQ ID NO: 17371 - DNA, 545 bp, Artificial Sequence
  chemically treated genomic DNA (Homo sapiens) CpG-island No: 17371
ttttttttttttcgttttaagttagtttttttatttagtgagtataaaattgtattgtttagattttcgggtttcgaacgttatatttggttttcgttttcggtggtttttcgttgtgtttcgttcgtaagcgttttttttcgggttttcgtgatagttaggtcgtgcgcgggttattttgggattggtagttcgtttttttttatttagttagtttttttttttatcggggatttcgtgtttcggtatttatcgcggtatttgatttttggcgtttgcgtgttgtttttttttttattttttttaatttttattttttttattttatttcgtttgtcgcggtcgggttcgcggtttgcgttgtagcggtcgtcgtcgttttttggaagtagtaatttttttattttattttagttttggttttcgtttagtcggtgagtttgaagtcgtcgttgtttcgagttttttgtcgttgggagcggtatatggggttttcggattttgatgtgggggcgggggaggaagcgattaggttcggtacgaag

SEQ ID NO: 17372 - DNA, 545 bp, Artificial Sequence
  chemically treated genomic DNA (Homo sapiens) CpG-island No: 17372
cttcgtaccgaacctaatcgcttcctcccccgcccccacatcaaaatccgaaaaccccatataccgctcccaacgacaaaaaactcgaaacaacgacgacttcaaactcaccgactaaacgaaaaccaaaactaaaataaaataaaaaaattactacttccaaaaaacgacgacgaccgctacaacgcaaaccgcgaacccgaccgcgacaaacgaaataaaataaaaaaaataaaaattaaaaaaaataaaaaaaaaaacaacacgcaaacgccaaaaatcaaataccgcgataaataccgaaacacgaaatccccgataaaaaaaaaaactaactaaataaaaaaaaacgaactaccaatcccaaaataacccgcgcacgacctaactatcacgaaaacccgaaaaaaaacgcttacgaacgaaacacaacgaaaaaccaccgaaaacgaaaaccaaatataacgttcgaaacccgaaaatctaaacaatacaattttatactcactaaataaaaaaactaacttaaaacgaaaaaaaaaaaa

SEQ ID NO: 17373 - DNA, 762 bp, Artificial Sequence
  chemically treated genomic DNA (Homo sapiens) CpG-island No: 17373
tttagcgtttaagcgcgcgtatagacgtgaacgtcgttagaggggggagggggtggggcgatgtttaagtgtttacgtattcgtagtgcgacgtacgtaggcgtagtacggtttttcgggcgatagcggtggcggtttttcggggtgttcggtttttttttatttaggtcggtttcggttcgattcgtttttagaaatttattgtttggggttgcggattttttcgtcgtgttttataaaagtaaagtttggggatttggggggagtcggaagtatcgtttcgagatttttaaatattatcggggaaacggaagtggtcgtcggtggtaggtttgggggagatcggaagtgacggttcgtggggaagtcgggggcggagtcgcggggtggtgggtgtgtgtgtgtgtgtgtgtgtgtgtgtgtgtgtgtttggttgtgggttagttgtgtcgttttgttggaatatcgtgggaaggtagtagacgcgggtagttagttagtaggttcgtcgtttcgtgagtgtcgtttcgggtttatagtgagttaggagggttcgatgggcgtggcgcgcgtgcgcgaaattatttttttcgtagagtgtggggcgattatcgttttcgcgttgttttaggatttttcgatttttggggcgtttgttttgtcgtgatcggtgatgatattagtttttggtttcgtgttttttttttaatttgattggttttttgtttattgtgattggcgtcgtggagttttttttatttt

SEQ ID NO: 17374 - DNA, 762 bp, Artificial Sequence
  chemically treated genomic DNA (Homo sapiens) CpG-island No: 17374
aaaataaaaaaaactccacgacgccaatcacaataaacaaaaaaccaatcaaattaaaaaaaaaacacgaaaccaaaaactaatatcatcaccgatcacgacaaaacaaacgccccaaaaatcgaaaaatcctaaaacaacgcgaaaacgataatcgccccacactctacgaaaaaaataatttcgcgcacgcgcgccacgcccatcgaaccctcctaactcactataaacccgaaacgacactcacgaaacgacgaacctactaactaactacccgcgtctactaccttcccacgatattccaacaaaacgacacaactaacccacaaccaaacacacacacacacacacacacacacacacacacacccaccaccccgcgactccgcccccgacttccccacgaaccgtcacttccgatctcccccaaacctaccaccgacgaccacttccgtttccccgataatatttaaaaatctcgaaacgatacttccgactccccccaaatccccaaactttacttttataaaacacgacgaaaaaatccgcaaccccaaacaataaatttctaaaaacgaatcgaaccgaaaccgacctaaataaaaaaaaaccgaacaccccgaaaaaccgccaccgctatcgcccgaaaaaccgtactacgcctacgtacgtcgcactacgaatacgtaaacacttaaacatcgccccaccccctcccccctctaacgacgttcacgtctatacgcgcgcttaaacgctaaa

SEQ ID NO: 17375 - DNA, 762 bp, Artificial Sequence
  chemically treated genomic DNA (Homo sapiens) CpG-island No: 17375
gaggtgggaggggttttacgacgttaattataataagtagggagttagttagattaggaaggaagtacgagattagagattagtgttattatcggttacggtaggataagcgttttagaggtcggaaaattttgggataacgcgaaagcggtggtcgttttatattttgcggagaaagtggtttcgcgtacgcgcgttacgtttatcgaatttttttaatttattatagattcgaaacggtatttacggggcgacggatttgttagttgattgttcgcgtttattgtttttttacggtgttttagtagaacggtataattaatttatagttaaatatatatatatatatatatatatatatatatatatttattatttcgcggtttcgttttcgatttttttacggatcgttattttcggttttttttaaatttgttatcgacggttattttcgttttttcgatagtatttggggatttcgaagcgatattttcggttttttttaggtttttaagttttatttttgtggggtacgacgagaaagttcgtagttttaaatagtgagtttttgagggcgagtcgggtcggggtcggtttaggtgggagggagtcgagtatttcgaggagtcgttatcgttgtcgttcgggggatcgtattacgtttgcgtgcgtcgtattacggatgcgtggatatttaagtatcgttttatttttttttttttttggcggcgtttacgtttgtgcgcgcgtttgagcgttaga

SEQ ID NO: 17376 - DNA, 762 bp, Artificial Sequence
  chemically treated genomic DNA (Homo sapiens) CpG-island No: 17376
tctaacgctcaaacgcgcgcacaaacgtaaacgccgccaaaaaaaaaaaaaaataaaacgatacttaaatatccacgcatccgtaatacgacgcacgcaaacgtaatacgatcccccgaacgacaacgataacgactcctcgaaatactcgactccctcccacctaaaccgaccccgacccgactcgccctcaaaaactcactatttaaaactacgaactttctcgtcgtaccccacaaaaataaaacttaaaaacctaaaaaaaaccgaaaatatcgcttcgaaatccccaaatactatcgaaaaaacgaaaataaccgtcgataacaaatttaaaaaaaaccgaaaataacgatccgtaaaaaaatcgaaaacgaaaccgcgaaataataaatatatatatatatatatatatatatatatatatatttaactataaattaattataccgttctactaaaacaccgtaaaaaaacaataaacgcgaacaatcaactaacaaatccgtcgccccgtaaataccgtttcgaatctataataaattaaaaaaattcgataaacgtaacgcgcgtacgcgaaaccactttctccgcaaaatataaaacgaccaccgctttcgcgttatcccaaaattttccgacctctaaaacgcttatcctaccgtaaccgataataacactaatctctaatctcgtacttccttcctaatctaactaactccctacttattataattaacgtcgtaaaacccctcccacctc

SEQ ID NO: 17377 - DNA, 870 bp, Artificial Sequence
  chemically treated genomic DNA (Homo sapiens) CpG-island No: 17377
ggttttttattcgttttacgattttttgtcgttcgtgtttatttttacgttcgttttcgtagtgtagttttttttttttttcggtgtaagtaaaagtcggtttggaggtttttattatagcgttttgtattttatattcgtgttttttcggtttttaattcgtatttattttagaaatagtattattttttttttttcggttcggttcggttttcgtaggggttaaaagtcgttatttttttagaagttttaagtttttaggatcgtatttttaagagcgcgtcggttcgtgttttcgtaggcgtttcgttgaaggggtaggggttaggttgggagacgacgaaggaataggcgtttttgacgagcgggacgtagttttcggacgtcgaggggttggcgttttcgtaggacggtttttattatttttattgtttcgtcggttatcggggtcgggcgttttttggcggcggggatttttagggtcgttcggttacgttgcgtagttttttgtatcgggcggggggcgtttacgggtcgggtattttcgagttgttgttcgagggcgtcgagacggtgattttagtgttggattcggttaggagataagggtacgggtttttttggtatacgagcgtggggttcggcggtttggtgtagtttcggaggggcgagagggtgtacgttaatattagttatttcgatatggtggatttcgcgagagggaagattttttttggggtcgtgatggtggggtgagggaatatgagtgcgtggtgcgagtgcgtgaatattgggggttcggacgtttaggattttatggtagtgggaaaaatgtaggagattgtttggaaattgattttgaatttgatg

SEQ ID NO: 17378 - DNA, 870 bp, Artificial Sequence
  chemically treated genomic DNA (Homo sapiens) CpG-island No: 17378
catcaaattcaaaatcaatttccaaacaatctcctacatttttcccactaccataaaatcctaaacgtccgaacccccaatattcacgcactcgcaccacgcactcatattccctcaccccaccatcacgaccccaaaaaaaatcttccctctcgcgaaatccaccatatcgaaataactaatattaacgtacaccctctcgcccctccgaaactacaccaaaccgccgaaccccacgctcgtataccaaaaaaacccgtacccttatctcctaaccgaatccaacactaaaatcaccgtctcgacgccctcgaacaacaactcgaaaatacccgacccgtaaacgccccccgcccgatacaaaaaactacgcaacgtaaccgaacgaccctaaaaatccccgccgccaaaaaacgcccgaccccgataaccgacgaaacaataaaaataataaaaaccgtcctacgaaaacgccaacccctcgacgtccgaaaactacgtcccgctcgtcaaaaacgcctattccttcgtcgtctcccaacctaacccctaccccttcaacgaaacgcctacgaaaacacgaaccgacgcgctcttaaaaatacgatcctaaaaacttaaaacttctaaaaaaataacgacttttaacccctacgaaaaccgaaccgaaccgaaaaaaaaaaaataatactatttctaaaataaatacgaattaaaaaccgaaaaaacacgaatataaaatacaaaacgctataataaaaacctccaaaccgacttttacttacaccgaaaaaaaaaaaaaactacactacgaaaacgaacgtaaaaataaacacgaacgacaaaaaatcgtaaaacgaataaaaaacc

SEQ ID NO: 17379 - DNA, 870 bp, Artificial Sequence
  chemically treated genomic DNA (Homo sapiens) CpG-island No: 17379
tattaggtttaaaattaatttttaaatagttttttatattttttttattgttatggggttttgggcgttcgggtttttaatatttacgtattcgtattacgtatttatatttttttattttattattacggttttaaagaaggttttttttttcgcgaagtttattatatcggggtgattgatgttgacgtatattttttcgttttttcggagttgtattaggtcgtcgaattttacgttcgtgtattagagaggttcgtatttttgttttttggtcgggtttagtattggagttatcgtttcggcgttttcgagtagtagttcgggagtgttcggttcgtaggcgtttttcgttcggtatagagagttgcgtagcgtgatcgagcggttttgggggttttcgtcgttagggggcgttcggtttcggtagtcgacgagatagtagaggtaatagaggtcgttttgcgggagcgttagtttttcggcgttcgagaattgcgtttcgttcgttagaaacgtttgttttttcgtcgttttttagtttagtttttgtttttttagcggagcgtttgcggagatacgggtcgacgcgtttttgggaatgcgattttaaaggtttgggatttttggggaagtggcggtttttagtttttgcgggagtcgagtcgggtcgggggaggagggatggtgttgtttttgggatgagtgcgagttgggggtcgagggaatacggatgtggggtgtagaacgttgtagtggggatttttaggtcggtttttgtttgtatcggagggaagaagaaattatattgcggggacgagcgtaagagtgggtacgagcgataaaaggtcgtgaagcgggtgggaaatt

SEQ ID NO: 17380 - DNA, 870 bp, Artificial Sequence
  chemically treated genomic DNA (Homo sapiens) CpG-island No: 17380
aatttcccacccgcttcacgaccttttatcgctcgtacccactcttacgctcgtccccgcaatataatttcttcttccctccgatacaaacaaaaaccgacctaaaaatccccactacaacgttctacaccccacatccgtattccctcgacccccaactcgcactcatcccaaaaacaacaccatccctcctcccccgacccgactcgactcccgcaaaaactaaaaaccgccacttccccaaaaatcccaaacctttaaaatcgcattcccaaaaacgcgtcgacccgtatctccgcaaacgctccgctaaaaaaacaaaaactaaactaaaaaacgacgaaaaaacaaacgtttctaacgaacgaaacgcaattctcgaacgccgaaaaactaacgctcccgcaaaacgacctctattacctctactatctcgtcgactaccgaaaccgaacgccccctaacgacgaaaacccccaaaaccgctcgatcacgctacgcaactctctataccgaacgaaaaacgcctacgaaccgaacactcccgaactactactcgaaaacgccgaaacgataactccaatactaaacccgaccaaaaaacaaaaatacgaacctctctaatacacgaacgtaaaattcgacgacctaatacaactccgaaaaaacgaaaaaatatacgtcaacatcaatcaccccgatataataaacttcgcgaaaaaaaaaaccttctttaaaaccgtaataataaaataaaaaaatataaatacgtaatacgaatacgtaaatattaaaaacccgaacgcccaaaaccccataacaataaaaaaaatataaaaaactatttaaaaattaattttaaacctaata

SEQ ID NO: 17381 - DNA, 619 bp, Artificial Sequence
  chemically treated genomic DNA (Homo sapiens) CpG-island No: 17381
cgaagtttattttgattaagtcgttgtgttcgaggtgtagttcgggtgagtttaaataagtcggcgaaagagttgcgcgttagatttttgagttgattgtattcgatgtcgagaaatttgaggttgcggtagttttggaagatgcgtacgggtataaattggatggcgttggttcgtatatgtagcgtggtgagtttcgtagttcgtggaagaggtcgcggcgagcgtttgtagtttgttgtacgagaggtttacgttgcgtaggttgggtatgggtcggaaggtggtgttgggtagttgggtgatttggttggaatttagcgtgagttttttaattcggcgtagtttttgaaaggcgtttttttgtacggagtagatgtgattgtgatttagatagagttacgtgagttgtattaatttcgtgaattggtcggcgcgtagtttcgagaggttgttgtagcgtagggataagtttagtaggtcggataggttgtggggcgtttcggtgaggttgagcgtttcgtagtatagtagtcgtttttcgtatcggtatagttgcgggtattcgttgggggcggcgggtagtatttgaaagtaggtttttagtagatataagatt

SEQ ID NO: 17382 - DNA, 619 bp, Artificial Sequence
  chemically treated genomic DNA (Homo sapiens) CpG-island No: 17382
aatcttatatctactaaaaacctactttcaaatactacccgccgcccccaacgaatacccgcaactataccgatacgaaaaacgactactatactacgaaacgctcaacctcaccgaaacgccccacaacctatccgacctactaaacttatccctacgctacaacaacctctcgaaactacgcgccgaccaattcacgaaattaatacaactcacgtaactctatctaaatcacaatcacatctactccgtacaaaaaaacgcctttcaaaaactacgccgaattaaaaaactcacgctaaattccaaccaaatcacccaactacccaacaccaccttccgacccatacccaacctacgcaacgtaaacctctcgtacaacaaactacaaacgctcgccgcgacctcttccacgaactacgaaactcaccacgctacatatacgaaccaacgccatccaatttatacccgtacgcatcttccaaaactaccgcaacctcaaatttctcgacatcgaatacaatcaactcaaaaatctaacgcgcaactctttcgccgacttatttaaactcacccgaactacacctcgaacacaacgacttaatcaaaataaacttcg

SEQ ID NO: 17383 - DNA, 619 bp, Artificial Sequence
  chemically treated genomic DNA (Homo sapiens) CpG-island No: 17383
ggttttgtgtttgttgggggtttgtttttagatgttgttcgtcgtttttagcgggtgttcgtagttgtgtcggtgcgaggggcggttgttgtattgcgaggcgtttaattttatcgaggcgttttataatttgttcggtttgttgggtttgtttttgcgttataatagtttttcggagttgcgcgtcggttagtttacggggttaatgtagtttacgtggttttatttggattataattatatttgtttcgtgtagggggacgttttttagaaattgcgtcgagttaaggaatttacgttgagttttaattagattatttaattgtttaatattatttttcggtttatgtttaatttgcgtagcgtggatttttcgtataataagttgtaggcgttcgtcgcgattttttttacgggttgcggaatttattacgttgtatatgcgggttaacgttatttagtttgtgttcgtgcgtattttttaggattgtcgtagttttaagtttttcgatatcggatataattagtttaagagtttggcgcgtaattttttcgtcggtttgtttaagtttattcgagttgtatttcgagtataacgatttggttaaggtgaatttcg

SEQ ID NO: 17384 - DNA, 619 bp, Artificial Sequence
  chemically treated genomic DNA (Homo sapiens) CpG-island No: 17384
cgaaattcaccttaaccaaatcgttatactcgaaatacaactcgaataaacttaaacaaaccgacgaaaaaattacgcgccaaactcttaaactaattatatccgatatcgaaaaacttaaaactacgacaatcctaaaaaatacgcacgaacacaaactaaataacgttaacccgcatatacaacgtaataaattccgcaacccgtaaaaaaaatcgcgacgaacgcctacaacttattatacgaaaaatccacgctacgcaaattaaacataaaccgaaaaataatattaaacaattaaataatctaattaaaactcaacgtaaattccttaactcgacgcaatttctaaaaaacgtccccctacacgaaacaaatataattataatccaaataaaaccacgtaaactacattaaccccgtaaactaaccgacgcgcaactccgaaaaactattataacgcaaaaacaaacccaacaaaccgaacaaattataaaacgcctcgataaaattaaacgcctcgcaatacaacaaccgcccctcgcaccgacacaactacgaacacccgctaaaaacgacgaacaacatctaaaaacaaacccccaacaaacacaaaacc

SEQ ID NO: 17385 - DNA, 553 bp, Artificial Sequence
  chemically treated genomic DNA (Homo sapiens) CpG-island No: 17385
gcggtcggcggatttggtaggcgtataatgttttattttgttgttcggttcggggttgtaagggcggtcggtaaggcggggaggcgatttttaggattcgtaagttttttaattacgtgtcggagttcgagtttcgtttttttgtcgtttttttttttttttgtagttcggattgtgacgttgtggggggaaaaaattttaaattcggggttcgcgattttttaggatttgatagtttggttaatgttcgttattggaaacgattattgatcggcgttattttttatttcgcggaaatagtttgttattcgcgtttcgggtagttgtagagagcgggtttatttatgttttgcgggcggcgggcggcgggcggcgggcggtggggaggtgcggacggcggcgcggggagcggcgagcggcgttcgggttttttttttttattaggtagtgtgcggcgcgagtttgtataggtatttattgtttattgagtgtcgtaagttgtttacgattgtgcgtttttttcgagtattttagatatgggtagattgaaaag

SEQ ID NO: 17386 - DNA, 553 bp, Artificial Sequence
  chemically treated genomic DNA (Homo sapiens) CpG-island No: 17386
cttttcaatctacccatatctaaaatactcgaaaaaaacgcacaatcgtaaacaacttacgacactcaataaacaataaatacctatacaaactcgcgccgcacactacctaataaaaaaaaaaaacccgaacgccgctcgccgctccccgcgccgccgtccgcacctccccaccgcccgccgcccgccgcccgccgcccgcaaaacataaataaacccgctctctacaactacccgaaacgcgaataacaaactatttccgcgaaataaaaaataacgccgatcaataatcgtttccaataacgaacattaaccaaactatcaaatcctaaaaaatcgcgaaccccgaatttaaaattttttccccccacaacgtcacaatccgaactacaaaaaaaaaaaaaaacgacaaaaaaacgaaactcgaactccgacacgtaattaaaaaacttacgaatcctaaaaatcgcctccccgccttaccgaccgcccttacaaccccgaaccgaacaacaaaataaaacattatacgcctaccaaatccgccgaccgc

SEQ ID NO: 17387 - DNA, 553 bp, Artificial Sequence
  chemically treated genomic DNA (Homo sapiens) CpG-island No: 17387
ttttttaatttgtttatgtttgaggtgttcggggaagacgtataatcgtgagtagtttacgatatttagtgagtagtaggtgtttgtgtaagttcgcgtcgtatattgtttggtggagggaaggagttcgggcgtcgttcgtcgtttttcgcgtcgtcgttcgtatttttttatcgttcgtcgttcgtcgttcgtcgttcgtaaagtatgagtgagttcgttttttgtagttgttcggggcgcgaatggtaggttgttttcgcggagtaaaaggtggcgtcggttagtggtcgtttttaatgacggatattaattagattgttagattttggggagtcgcgagtttcgagtttggagttttttttttttataacgttatagttcgaattgtagagggaaaggaaggcggtaggaaggcgaagttcgggtttcggtacgtagttgggaaatttgcgggttttagaagtcgttttttcgttttgtcggtcgtttttgtagtttcgagtcgagtagtaaagtgagatattgtgcgtttgttagattcgtcggtcgt

SEQ ID NO: 17388 - DNA, 553 bp, Artificial Sequence
  chemically treated genomic DNA (Homo sapiens) CpG-island No: 17388
acgaccgacgaatctaacaaacgcacaatatctcactttactactcgactcgaaactacaaaaacgaccgacaaaacgaaaaaacgacttctaaaacccgcaaatttcccaactacgtaccgaaacccgaacttcgccttcctaccgccttcctttccctctacaattcgaactataacgttataaaaaaaaaaaactccaaactcgaaactcgcgactccccaaaatctaacaatctaattaatatccgtcattaaaaacgaccactaaccgacgccaccttttactccgcgaaaacaacctaccattcgcgccccgaacaactacaaaaaacgaactcactcatactttacgaacgacgaacgacgaacgacgaacgataaaaaaatacgaacgacgacgcgaaaaacgacgaacgacgcccgaactccttccctccaccaaacaatatacgacgcgaacttacacaaacacctactactcactaaatatcgtaaactactcacgattatacgtcttccccgaacacctcaaacataaacaaattaaaaaa

SEQ ID NO: 17389 - DNA, 703 bp, Artificial Sequence
  chemically treated genomic DNA (Homo sapiens) CpG-island No: 17389
  misc_feature (641)..(641): n is either a, c, g or t
  misc_feature (670)..(671): n is either a, c, g or t
  misc_feature (678)..(678): n is either a, c, g or t
  misc_feature (681)..(681): n is either a, c, g or t
  misc_feature (687)..(687): n is either a, c, g or t
  misc_feature (693)..(693): n is either a, c, g or t
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgatagcgtttatattcgacgataattatacgttggtagttttcgatatatggtgtatacggagaagtatattcgtattattagtgtgacgattgcggcggttatttatttagttatcggttcgtttgagatgacgtgtaattgcgtacgcgatattcggagataatgggttgattaagtttatttttatttntcgggtaaataaaggggcgtgcgttattnnatttttntgnttcgtnttatanttaacggttg

SEQ ID NO: 17390 - DNA, 703 bp, Artificial Sequence
  chemically treated genomic DNA (Homo sapiens) CpG-island No: 17390
  misc_feature (11)..(11): n is either a, c, g or t
  misc_feature (17)..(17): n is either a, c, g or t
  misc_feature (23)..(23): n is either a, c, g or t
  misc_feature (26)..(26): n is either a, c, g or t
  misc_feature (33)..(34): n is either a, c, g or t
  misc_feature (63)..(63): n is either a, c, g or t
caaccgttaantataanacgaancanaaaaatnnaataacgcacgcccctttatttacccganaaataaaaataaacttaatcaacccattatctccgaatatcgcgtacgcaattacacgtcatctcaaacgaaccgataactaaataaataaccgccgcaatcgtcacactaataatacgaatatacttctccgtatacaccatatatcgaaaactaccaacgtataattatcgtcgaatataaacgctatcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 17391 - DNA, 703 bp, Artificial Sequence
  chemically treated genomic DNA (Homo sapiens) CpG-island No: 17391
  misc_feature (11)..(11): n is either a, c, g or t
  misc_feature (17)..(17): n is either a, c, g or t
  misc_feature (23)..(23): n is either a, c, g or t
  misc_feature (26)..(26): n is either a, c, g or t
  misc_feature (33)..(34): n is either a, c, g or t
  misc_feature (63)..(63): n is either a, c, g or t
tagtcgttgantatggnacgggntanaaaagtnngatagcgtacgtttttttatttgttcggnggatgggagtaagtttagttagtttattgttttcgggtgtcgcgtgcgtagttgtacgttattttagacgaatcgatgattggatggatggtcgtcgtagtcgttatattgatgatacggatgtgttttttcgtatatattatgtatcgagagttgttaacgtatggttatcgtcgggtatgggcgttgtcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 17392 - DNA, 703 bp, Artificial Sequence
  chemically treated genomic DNA (Homo sapiens) CpG-island No: 17392
  misc_feature (641)..(641): n is either a, c, g or t
  misc_feature (670)..(671): n is either a, c, g or t
  misc_feature (678)..(678): n is either a, c, g or t
  misc_feature (681)..(681): n is either a, c, g or t
  misc_feature (687)..(687): n is either a, c, g or t
  misc_feature (693)..(693): n is either a, c, g or t
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgacaacgcccatacccgacgataaccatacgttaacaactctcgatacataatatatacgaaaaaacacatccgtatcatcaatataacgactacgacgaccatccatccaatcatcgattcgtctaaaataacgtacaactacgcacgcgacacccgaaaacaataaactaactaaacttactcccatccnccgaacaaataaaaaaacgtacgctatcnnacttttntancccgtnccatantcaacgacta

SEQ ID NO: 17393 - DNA, 655 bp, Artificial Sequence
  chemically treated genomic DNA (Homo sapiens) CpG-island No: 17393
  misc_feature (92)..(92): n is either a, c, g or t
gggagcgtatgcggggtgggggtgtcgtcggggggtcgcgcgggatattcggcggggtgggggggattggggttttcgtgggcgtttattanggttcggcgcgttatcgtaagtttttcggtagtggtttaatttcgcgtggagtgtggttttagaagtcggggcgcgcggatatttgtcgggtttcgggggagtttgggttgttttaggcgtcgcgcgcgtatcgtcgttgggttttgggcgtttattcggttttttttcgcggggagcggtttttttgttttcgacgggcggcgcgagtttcggattcggtgcgcgcgttaaggcggtcgggcggttttgggtgatatgagcgtggttcggcgtttcggggattcgcgttttttcggtgttcgcggttttcgggggtagatggtcgggagtttgtattttggagttcggtcgtcgtcggagaggttttgggatagcgtagggtcgggggttttgggtttaaaatttttttaggagcggagggagggcgttttgtgtgggggtttttgcgcggttttgatggtcgagcggtgtgatttttggtaagtcgtttttttgataagtttttttgtagttagtggtaatgtttatattcgttgggttgtcggaaagatttaatgttgcg

SEQ ID NO: 17394 - DNA, 655 bp, Artificial Sequence
  chemically treated genomic DNA (Homo sapiens) CpG-island No: 17394
  misc_feature (564)..(564): n is either a, c, g or t
cgcaacattaaatctttccgacaacccaacgaatataaacattaccactaactacaaaaaaacttatcaaaaaaacgacttaccaaaaatcacaccgctcgaccatcaaaaccgcgcaaaaacccccacacaaaacgccctccctccgctcctaaaaaaattttaaacccaaaacccccgaccctacgctatcccaaaacctctccgacgacgaccgaactccaaaatacaaactcccgaccatctacccccgaaaaccgcgaacaccgaaaaaacgcgaatccccgaaacgccgaaccacgctcatatcacccaaaaccgcccgaccgccttaacgcgcgcaccgaatccgaaactcgcgccgcccgtcgaaaacaaaaaaaccgctccccgcgaaaaaaaaccgaataaacgcccaaaacccaacgacgatacgcgcgcgacgcctaaaacaacccaaactcccccgaaacccgacaaatatccgcgcgccccgacttctaaaaccacactccacgcgaaattaaaccactaccgaaaaacttacgataacgcgccgaaccntaataaacgcccacgaaaaccccaatcccccccaccccgccgaatatcccgcgcgaccccccgacgacacccccaccccgcatacgctccc

SEQ ID NO: 17395 - DNA, 655 bp, Artificial Sequence
  chemically treated genomic DNA (Homo sapiens) CpG-island No: 17395
  misc_feature (564)..(564): n is either a, c, g or t
cgtagtattagattttttcgataatttagcgggtgtagatattgttattgattgtaaaggagtttgttaggggagcgatttgttaaaggttatatcgttcggttattagaatcgcgtagaagtttttatataaagcgtttttttttcgtttttggagaggttttaaatttaggattttcggttttgcgttgttttaaggttttttcgacggcggtcgggttttagggtgtaggttttcggttatttattttcgggagtcgcggatatcgagggagcgcgagttttcgagacgtcgggttacgtttatgttatttaagatcgttcggtcgttttggcgcgcgtatcgggttcggagttcgcgtcgttcgtcgagggtagaggggtcgtttttcgcgggggagagtcgggtgggcgtttaggatttagcggcggtacgcgcgcgacgtttgaggtagtttagattttttcggagttcggtaggtgttcgcgcgtttcggtttttgaggttatattttacgcggggttgggttattgtcgggggatttgcggtggcgcgtcggattntggtgggcgtttacggggattttagttttttttatttcgtcgagtgtttcgcgcggtttttcggcgatatttttatttcgtatgcgttttt

SEQ ID NO: 17396 - DNA, 655 bp, Artificial Sequence
  chemically treated genomic DNA (Homo sapiens) CpG-island No: 17396
  misc_feature (92)..(92): n is either a, c, g or t
aaaaacgcatacgaaataaaaatatcgccgaaaaaccgcgcgaaacactcgacgaaataaaaaaaactaaaatccccgtaaacgcccaccanaatccgacgcgccaccgcaaatcccccgacaataacccaaccccgcgtaaaatataacctcaaaaaccgaaacgcgcgaacacctaccgaactccgaaaaaatctaaactacctcaaacgtcgcgcgcgtaccgccgctaaatcctaaacgcccacccgactctcccccgcgaaaaacgacccctctaccctcgacgaacgacgcgaactccgaacccgatacgcgcgccaaaacgaccgaacgatcttaaataacataaacgtaacccgacgtctcgaaaactcgcgctccctcgatatccgcgactcccgaaaataaataaccgaaaacctacaccctaaaacccgaccgccgtcgaaaaaaccttaaaacaacgcaaaaccgaaaatcctaaatttaaaacctctccaaaaacgaaaaaaaaacgctttatataaaaacttctacgcgattctaataaccgaacgatataacctttaacaaatcgctcccctaacaaactcctttacaatcaataacaatatctacacccgctaaattatcgaaaaaatctaatactacg

SEQ ID NO: 17397 - DNA, 662 bp, Artificial Sequence
  chemically treated genomic DNA (Homo sapiens) CpG-island No: 17397
cggttatttaattattttagcgagaggcgtcgggatttttgagtttgggtttatcgcgttggggttggtcgggagagtcgcggacgttcgtcgttatgacgtggggtatataagacgaattcggcgtttcgagggttcggcgcgttagggagtgtttgcgttggtcggggagtttgtttgcggcgttcggcgttggtttcgcggcgttgtttttcgttaggtttcgtttcgttgggtttagtggggtttttagcgtagtgagggttttcggtttcgcggcgtttttgttgtgttttttcgttgttcgttggttttcgcgcggaggggggatttcgttattttgacgtaaggagttcggggttgagcggcggaggcggcgaatagcgcgcgtttttaattattcgggagacggagttttatgttattagttttttatttggcggcgttttcggtagaggcggtgaaggcgcggttttttttggcggtttttaggagttataagtgggcgtacgggcgcggttttaagtcggggtatatcggatatatttattcgcggttatatttacgcgttttttatcgataatatatatagatatttacgtacgtagtggggggtacgtatagttatttttatatggttacgaaagtagttggaatttagg

SEQ ID NO: 17398 - DNA, 662 bp, Artificial Sequence
  chemically treated genomic DNA (Homo sapiens) CpG-island No: 17398
cctaaattccaactactttcgtaaccatataaaaataactatacgtaccccccactacgtacgtaaatatctatatatattatcgataaaaaacgcgtaaatataaccgcgaataaatatatccgatataccccgacttaaaaccgcgcccgtacgcccacttataactcctaaaaaccgccaaaaaaaaccgcgccttcaccgcctctaccgaaaacgccgccaaataaaaaactaataacataaaactccgtctcccgaataattaaaaacgcgcgctattcgccgcctccgccgctcaaccccgaactccttacgtcaaaataacgaaatcccccctccgcgcgaaaaccaacgaacaacgaaaaaacacaacaaaaacgccgcgaaaccgaaaaccctcactacgctaaaaaccccactaaacccaacgaaacgaaacctaacgaaaaacaacgccgcgaaaccaacgccgaacgccgcaaacaaactccccgaccaacgcaaacactccctaacgcgccgaaccctcgaaacgccgaattcgtcttatataccccacgtcataacgacgaacgtccgcgactctcccgaccaaccccaacgcgataaacccaaactcaaaaatcccgacgcctctcgctaaaataattaaataaccg

SEQ ID NO: 17399 - DNA, 662 bp, Artificial Sequence
  chemically treated genomic DNA (Homo sapiens) CpG-island No: 17399
tttggattttagttgttttcgtggttatgtgggggtggttgtgcgtgttttttattgcgtgcgtgggtgtttgtgtgtgttatcggtggggggcgcgtgagtgtggtcgcgggtgggtgtgttcgatgtgtttcggtttgggatcgcgttcgtgcgtttatttgtggtttttgggagtcgttagggggaatcgcgtttttatcgtttttgtcgaggacgtcgttagataggaggttgatgatatgaggtttcgtttttcgagtgattggaagcgcgcgttgttcgtcgttttcgtcgtttagtttcggattttttacgttagggtagcggggtttttttttcgcgcgggagttagcgaatagcgagagagtatagtagaggcgtcgcggagtcgggggtttttattgcgttaggagttttattaaatttagcggagcggagtttggcgggaggtagcgtcgcggagttagcgtcggacgtcgtaagtagatttttcggttagcgtaagtattttttggcgcgtcggattttcggggcgtcggattcgttttgtgtgttttacgttatgacggcgggcgttcgcggttttttcgattagttttagcgcggtgggtttaggtttagaggtttcggcgtttttcgttgaagtagttgggtagtcg

SEQ ID NO: 17400 - DNA, 662 bp, Artificial Sequence
  chemically treated genomic DNA (Homo sapiens) CpG-island No: 17400
cgactacccaactacttcaacgaaaaacgccgaaacctctaaacctaaacccaccgcgctaaaactaatcgaaaaaaccgcgaacgcccgccgtcataacgtaaaacacacaaaacgaatccgacgccccgaaaatccgacgcgccaaaaaatacttacgctaaccgaaaaatctacttacgacgtccgacgctaactccgcgacgctacctcccgccaaactccgctccgctaaatttaataaaactcctaacgcaataaaaacccccgactccgcgacgcctctactatactctctcgctattcgctaactcccgcgcgaaaaaaaaaccccgctaccctaacgtaaaaaatccgaaactaaacgacgaaaacgacgaacaacgcgcgcttccaatcactcgaaaaacgaaacctcatatcatcaacctcctatctaacgacgtcctcgacaaaaacgataaaaacgcgattccccctaacgactcccaaaaaccacaaataaacgcacgaacgcgatcccaaaccgaaacacatcgaacacacccacccgcgaccacactcacgcgccccccaccgataacacacacaaacacccacgcacgcaataaaaaacacgcacaaccacccccacataaccacgaaaacaactaaaatccaaa

SEQ ID NO: 17401 - DNA, 658 bp, Artificial Sequence
  chemically treated genomic DNA (Homo sapiens) CpG-island No: 17401
agcgcgattttaaattgttgatagtttttggttagcgatatcgggattaagttttgttacgatttttattgatgtttatttggtttatagcgcggatgtgttagaggttgtgttgttttgtgtgcggagcggcggtggcgtattatggggggtgcgttttgtcgcgttcgcggatgtggatgttttcgatcgtgcgtgcgggggggggggagacggggggtcgttgcgtggggggtcggcgcggatggcggtggggcggattcgggtttcggatgcgtcggtcggcgtcggcggcgtggttgcgcgggcgtcggtgcgggtcgtgggtcggcggcgtggcggaggcggcgtgcggcgtgggttggcggtggcgcgtgcggtggggggcgtggttcgggtttcgcgttcgtcgggcgcgtttggggcgcgtcgttcggcggggggcgtgtttgcggcggcgcgcgcgcggcgcggggggggcgtgcggcgtttttgattaattaaataatatatgtgtaattataggttacgacgggggcgttcggttgggtcggttcggcgttcggggttgtgcgggacgagtgtatgaggaggaaatatataaaaaaaataaaaaaaaaatggggtaggataggggtgggggacgcggtgtgcggtt

SEQ ID NO: 17402 - DNA, 658 bp, Artificial Sequence
  chemically treated genomic DNA (Homo sapiens) CpG-island No: 17402
aaccgcacaccgcgtcccccacccctatcctaccccattttttttttattttttttatatatttcctcctcatacactcgtcccgcacaaccccgaacgccgaaccgacccaaccgaacgcccccgtcgtaacctataattacacatatattatttaattaatcaaaaacgccgcacgccccccccgcgccgcgcgcgcgccgccgcaaacacgccccccgccgaacgacgcgccccaaacgcgcccgacgaacgcgaaacccgaaccacgccccccaccgcacgcgccaccgccaacccacgccgcacgccgcctccgccacgccgccgacccacgacccgcaccgacgcccgcgcaaccacgccgccgacgccgaccgacgcatccgaaacccgaatccgccccaccgccatccgcgccgaccccccacgcaacgaccccccgtctcccccccccccgcacgcacgatcgaaaacatccacatccgcgaacgcgacaaaacgcaccccccataatacgccaccgccgctccgcacacaaaacaacacaacctctaacacatccgcgctataaaccaaataaacatcaataaaaatcgtaacaaaacttaatcccgatatcgctaaccaaaaactatcaacaatttaaaatcgcgct

SEQ ID NO: 17403 - DNA, 658 bp, Artificial Sequence
  chemically treated genomic DNA (Homo sapiens) CpG-island No: 17403
agtcgtatatcgcgttttttatttttgttttattttattttttttttattttttttatatattttttttttatgtattcgtttcgtatagtttcgggcgtcgggtcggtttagtcgggcgttttcgtcgtggtttgtggttatatatatgttatttggttagttaaaggcgtcgtacgtttttttcgcgtcgcgcgcgcgtcgtcgtaggtacgtttttcgtcgggcggcgcgttttaggcgcgttcgacgggcgcggagttcgggttacgttttttatcgtacgcgttatcgttagtttacgtcgtacgtcgttttcgttacgtcgtcggtttacggttcgtatcggcgttcgcgtagttacgtcgtcgacgtcggtcggcgtattcgggattcgggttcgttttatcgttattcgcgtcgattttttacgtaacgatttttcgtttttttttttttcgtacgtacgatcggggatatttatattcgcgaacgcgatagagcgtattttttatgatgcgttatcgtcgtttcgtatatagagtagtatagtttttggtatattcgcgttgtgggttaaataggtattagtaggaatcgtggtagaatttaatttcgatatcgttaattaggggttgttagtagtttggggtcgcgtt

SEQ ID NO: 17404 - DNA, 658 bp, Artificial Sequence
  chemically treated genomic DNA (Homo sapiens) CpG-island No: 17404
aacgcgaccccaaactactaacaacccctaattaacgatatcgaaattaaattctaccacgattcctactaatacctatttaacccacaacgcgaatataccaaaaactatactactctatatacgaaacgacgataacgcatcataaaaaatacgctctatcgcgttcgcgaatataaatatccccgatcgtacgtacgaaaaaaaaaaaaacgaaaaatcgttacgtaaaaaatcgacgcgaataacgataaaacgaacccgaatcccgaatacgccgaccgacgtcgacgacgtaactacgcgaacgccgatacgaaccgtaaaccgacgacgtaacgaaaacgacgtacgacgtaaactaacgataacgcgtacgataaaaaacgtaacccgaactccgcgcccgtcgaacgcgcctaaaacgcgccgcccgacgaaaaacgtacctacgacgacgcgcgcgcgacgcgaaaaaaacgtacgacgcctttaactaaccaaataacatatatataaccacaaaccacgacgaaaacgcccgactaaaccgacccgacgcccgaaactatacgaaacgaatacataaaaaaaaaatatataaaaaaaataaaaaaaaaataaaataaaacaaaaataaaaaacgcgatatacgact

SEQ ID NO: 17405 - DNA, 574 bp, Artificial Sequence
  chemically treated genomic DNA (Homo sapiens) CpG-island No: 17405
  misc_feature (96)..(96): n is either a, c, g or t
  misc_feature (100)..(100): n is either a, c, g or t
  misc_feature (380)..(380): n is either a, c, g or t
gttgtttttaggttcgcggtagaattcgtggttcggtcgattatggcgtggtattttatagtgatatttcgcgtattaatgcgtatttcgagtggnaagnaggggcgcgtatattgtcgtttagtgtgggaggcgtttttcgtatttcggcgttttttttgcgtttttttattttttattttgcggttgtgtcggttcgtcggtgttattcgtggttatttcgttgggtttttggtggtcggcggggttcggttttaaggttgtttcggttgcggagggttttaaaaggttttttcgtaatgagggttcggtttgtttttaagcggtttttcgaaataattaggtcgttgtcgttggaatttttataagtttcgtttgtnggagtttatttaattttattcggaattatcgggaggaatatatttttataggagggggacggggtaattttaaaatttcgcggttattacggggggttaattaaatatcggtaacgaaggcgaaagtcgaagttgaaaagcgtcgtaaaatatgaagaagttatcggaaagattaaaaatgttatggggacgtt

SEQ ID NO: 17406 - DNA, 574 bp, Artificial Sequence
  chemically treated genomic DNA (Homo sapiens) CpG-island No: 17406
  misc_feature (195)..(195): n is either a, c, g or t
  misc_feature (475)..(475): n is either a, c, g or t
  misc_feature (479)..(479): n is either a, c, g or t
aacgtccccataacatttttaatctttccgataacttcttcatattttacgacgcttttcaacttcgactttcgccttcgttaccgatatttaattaaccccccgtaataaccgcgaaattttaaaattaccccgtccccctcctataaaaatatattcctcccgataattccgaataaaattaaataaactccnacaaacgaaacttataaaaattccaacgacaacgacctaattatttcgaaaaaccgcttaaaaacaaaccgaaccctcattacgaaaaaaccttttaaaaccctccgcaaccgaaacaaccttaaaaccgaaccccgccgaccaccaaaaacccaacgaaataaccacgaataacaccgacgaaccgacacaaccgcaaaataaaaaataaaaaaacgcaaaaaaaacgccgaaatacgaaaaacgcctcccacactaaacgacaatatacgcgcccctncttnccactcgaaatacgcattaatacgcgaaatatcactataaaataccacgccataatcgaccgaaccacgaattctaccgcgaacctaaaaacaac

SEQ ID NO: 17407 - DNA, 574 bp, Artificial Sequence
  chemically treated genomic DNA (Homo sapiens) CpG-island No: 17407
  misc_feature (195)..(195): n is either a, c, g or t
  misc_feature (475)..(475): n is either a, c, g or t
  misc_feature (479)..(479): n is either a, c, g or t
ggcgtttttatggtatttttggttttttcggtggtttttttatattttgcggcgttttttaatttcgattttcgttttcgttgtcgatgtttggttggtttttcgtggtggtcgcgggattttaaagttgtttcgttttttttttatgggaatatatttttttcggtggtttcgggtgaaattggatgagttttngtaagcggaatttgtgaaaattttaacggtagcggtttagttatttcgggaaatcgtttgaaggtaaatcgggtttttattacgggaaaattttttgaaatttttcgtaatcggggtagttttggaatcgggtttcgtcggttattaagggtttaacgggataattacggatggtatcgacggatcgatatagtcgtaggataaagagtggagaggcgtagaggaaacgtcgagatacgaggggcgttttttatattaggcgataatatacgcgtttttntttnttattcggagtgcgtattggtgcgcgaagtgttattgtaaagtgttacgttatggtcgatcgaattacgggttttgtcgcggatttggaaatagt

SEQ ID NO: 17408 - DNA, 574 bp, Artificial Sequence
  chemically treated genomic DNA (Homo sapiens) CpG-island No: 17408
  misc_feature (96)..(96): n is either a, c, g or t
  misc_feature (100)..(100): n is either a, c, g or t
  misc_feature (380)..(380): n is either a, c, g or t
actatttccaaatccgcgacaaaacccgtaattcgatcgaccataacgtaacactttacaataacacttcgcgcaccaatacgcactccgaataanaaanaaaaacgcgtatattatcgcctaatataaaaaacgcccctcgtatctcgacgtttcctctacgcctctccactctttatcctacgactatatcgatccgtcgataccatccgtaattatcccgttaaacccttaataaccgacgaaacccgattccaaaactaccccgattacgaaaaatttcaaaaaattttcccgtaataaaaacccgatttaccttcaaacgatttcccgaaataactaaaccgctaccgttaaaattttcacaaattccgcttacnaaaactcatccaatttcacccgaaaccaccgaaaaaaatatattcccataaaaaaaaaacgaaacaactttaaaatcccgcgaccaccacgaaaaaccaaccaaacatcgacaacgaaaacgaaaatcgaaattaaaaaacgccgcaaaatataaaaaaaccaccgaaaaaaccaaaaataccataaaaacgcc

SEQ ID NO: 17409 - DNA, 602 bp, Artificial Sequence
  chemically treated genomic DNA (Homo sapiens) CpG-island No: 17409
tgcggatgggagagattgagcgcggaaataacgggtattaggatggggggatgaaggggtagtaaaagtaggtggtaggttcggaagaatgggcggtgggagtacgtagaatcggtagatacggagttgtaggagataggcgtgaattacgtcggataggggacggtattatgaataaggtcgtaaagtggatatagcgcgtttttgtttgatagagaagagaggtacgttcgtacgacggagggtattacgagtttttaggggaggtgcgagtgggtagcgcgcgagtcgtagttagaaaaatgattttaggcgaattgacgtatagggaggttgtcgggtcgtttgtgcgggtaaaaagcgcggcgacgtttgttataacgcgatacgggcgacgtagttatatgattacgggcgatcgaggggttagagggtgtgttatagcgagaatagtttgtagcgttggagaggttgggcgtgcgtttgatcgtgatagatttgtcggtgttggttgtaaattaggtcgtgggttggatttattgggtcgaatttaggtcgacgggtgggggtaggtcgttgtttgcgatgatcggttatggggt

SEQ ID NO: 17410 - DNA, 602 bp, Artificial Sequence
  chemically treated genomic DNA (Homo sapiens) CpG-island No: 17410
accccataaccgatcatcgcaaacaacgacctacccccacccgtcgacctaaattcgacccaataaatccaacccacgacctaatttacaaccaacaccgacaaatctatcacgatcaaacgcacgcccaacctctccaacgctacaaactattctcgctataacacaccctctaacccctcgatcgcccgtaatcatataactacgtcgcccgtatcgcgttataacaaacgtcgccgcgctttttacccgcacaaacgacccgacaacctccctatacgtcaattcgcctaaaatcatttttctaactacgactcgcgcgctacccactcgcacctcccctaaaaactcgtaataccctccgtcgtacgaacgtacctctcttctctatcaaacaaaaacgcgctatatccactttacgaccttattcataataccgtcccctatccgacgtaattcacgcctatctcctacaactccgtatctaccgattctacgtactcccaccgcccattcttccgaacctaccacctacttttactaccccttcatccccccatcctaatacccgttatttccgcgctcaatctctcccatccgca

SEQ ID NO: 17411 - DNA, 602 bp, Artificial Sequence
  chemically treated genomic DNA (Homo sapiens) CpG-island No: 17411
attttatggtcggttatcgtaagtagcggtttgtttttattcgtcggtttaggttcggtttagtgggtttagtttacggtttggtttgtagttagtatcgataagtttgttacggttaagcgtacgtttagtttttttagcgttgtaggttattttcgttgtggtatattttttggtttttcggtcgttcgtaattatatggttgcgtcgttcgtatcgcgttgtggtaaacgtcgtcgcgttttttgttcgtataggcggttcggtagtttttttgtacgttagttcgtttggggttatttttttagttgcggttcgcgcgttgtttattcgtattttttttaaaggttcgtagtatttttcgtcgtacgaacgtgttttttttttttgttaggtaagggcgcgttgtatttattttgcggttttatttataatgtcgttttttgttcggcgtggtttacgtttgttttttgtaatttcgtatttatcgattttacgtgtttttatcgtttattttttcgaatttgttatttgtttttattgtttttttatttttttattttaatgttcgttgttttcgcgtttagttttttttattcgta

SEQ ID NO: 17412 - DNA, 602 bp, Artificial Sequence
  chemically treated genomic DNA (Homo sapiens) CpG-island No: 17412
tacgaataaaaaaaactaaacgcgaaaacaacgaacattaaaataaaaaaataaaaaaacaataaaaacaaataacaaattcgaaaaaataaacgataaaaacacgtaaaatcgataaatacgaaattacaaaaaacaaacgtaaaccacgccgaacaaaaaacgacattataaataaaaccgcaaaataaatacaacgcgcccttacctaacaaaaaaaaaaaacacgttcgtacgacgaaaaatactacgaacctttaaaaaaaatacgaataaacaacgcgcgaaccgcaactaaaaaaataaccccaaacgaactaacgtacaaaaaaactaccgaaccgcctatacgaacaaaaaacgcgacgacgtttaccacaacgcgatacgaacgacgcaaccatataattacgaacgaccgaaaaaccaaaaaatataccacaacgaaaataacctacaacgctaaaaaaactaaacgtacgcttaaccgtaacaaacttatcgatactaactacaaaccaaaccgtaaactaaacccactaaaccgaacctaaaccgacgaataaaaacaaaccgctacttacgataaccgaccataaaat

SEQ ID NO: 17413 - DNA, 913 bp, Artificial Sequence
  chemically treated genomic DNA (Homo sapiens) CpG-island No: 17413
agggtcgcgaaagaggtcgggatcggagcggggtaggtcgtgtggttcgtattttagcgttatagtttagtttcgtattggttttatcgtaggggggatggggttggaacgggcgttcgttttcgggtatcggcgtcgtcggttaaggtagggtaaaaattaacgttgtcgttggcgggaggtagtggaagggattcgtttcgtaagtaagatttcgggagttttagtcgtcgtcgtttcgttttcgagcgcgttatttttaggtttcggttttttaggcgtcgtttttaggttttcgcgggttttcgtttttcgtcgattcggttgagcgtaggacggtcgttattttgacggtttcgatttcgtcggtttcgtagtcgtcgtacggggttcgcgtacgttcgttttattttttgtcgtcgtcgaagttgttgtaggttcgatcgtcgtaggtgtcgaagttcgttatttgtcgttttcgtttcgagaggaattagggtgagcgaggaaggatttcgtaatataattttttttcgtcgtcgtcgggttgttcgtcgcgtcgtttgatcgtaaatttttttggacgtaaggtacgggtagcggtcgtcgaacgtacgtacggacgttgcgcgtagcgttacgttttgggtttaacgtagttgtttgtttcgtgcgtttgtagtttacgtggtgcggcgagttttagttggacgtttgttcgtttacgcggtttattatgtgttggttttggggtgcgttcgtggttgttttttattttcgtcgtattacgttcgtgcgcgtcggttttttcgttcgtcggcgggaggtgatttggagagttggggggaattttttttttagttcgtttgggaacgttgtttttcggtttttatatatggcggggatttcggag

SEQ ID NO: 17414 - DNA, 913 bp, Artificial Sequence
  chemically treated genomic DNA (Homo sapiens) CpG-island No: 17414
ctccgaaatccccgccatatataaaaaccgaaaaacaacgttcccaaacgaactaaaaaaaaaattccccccaactctccaaatcacctcccgccgacgaacgaaaaaaccgacgcgcacgaacgtaatacgacgaaaataaaaaacaaccacgaacgcaccccaaaaccaacacataataaaccgcgtaaacgaacaaacgtccaactaaaactcgccgcaccacgtaaactacaaacgcacgaaacaaacaactacgttaaacccaaaacgtaacgctacgcgcaacgtccgtacgtacgttcgacgaccgctacccgtaccttacgtccaaaaaaatttacgatcaaacgacgcgacgaacaacccgacgacgacgaaaaaaaattatattacgaaatccttcctcgctcaccctaattcctctcgaaacgaaaacgacaaataacgaacttcgacacctacgacgatcgaacctacaacaacttcgacgacgacaaaaaataaaacgaacgtacgcgaaccccgtacgacgactacgaaaccgacgaaatcgaaaccgtcaaaataacgaccgtcctacgctcaaccgaatcgacgaaaaacgaaaacccgcgaaaacctaaaaacgacgcctaaaaaaccgaaacctaaaaataacgcgctcgaaaacgaaacgacgacgactaaaactcccgaaatcttacttacgaaacgaatcccttccactacctcccgccaacgacaacgttaatttttaccctaccttaaccgacgacgccgatacccgaaaacgaacgcccgttccaaccccatcccccctacgataaaaccaatacgaaactaaactataacgctaaaatacgaaccacacgacctaccccgctccgatcccgacctctttcgcgaccct

SEQ ID NO: 17415 - DNA, 913 bp, Artificial Sequence
  chemically treated genomic DNA (Homo sapiens) CpG-island No: 17415
tttcgaggttttcgttatgtatggaggtcgaaaggtagcgtttttaggcgaattggagagggagttttttttagttttttaggttatttttcgtcgacggacggaaaggtcggcgcgtacgggcgtggtgcggcggggataggaggtagttacgggcgtattttagggttagtatataatgggtcgcgtaggcgggtaggcgtttagttgggattcgtcgtattacgtgggttgtagacgtacggggtaggtagttgcgttgggtttagggcgtggcgttgcgcgtagcgttcgtgcgtgcgttcgacggtcgttgttcgtgttttgcgtttaaggggatttgcgattaggcggcgcggcggatagttcggcggcggcgaaggggagttatattgcggggttttttttcgtttattttggtttttttcggagcggagacggtaaatggcggatttcgatatttacgacgatcgggtttatagtagtttcggcggcggtagagggtgaggcgggcgtgcgcgggtttcgtacggcggttgcgggatcggcggagtcgaggtcgttagggtggcggtcgttttgcgtttagtcgggtcggcgggaggcgggagttcgcggaggtttaggagcggcgtttggagggtcggggtttggaaatggcgcgttcggagacggggcggcggcggttggggttttcggggttttgtttgcggggcggattttttttattgtttttcgttaacgataacgttggtttttgttttgttttggtcggcggcgtcgatgttcggagacgagcgttcgttttagttttattttttttacggtaggattagtgcggggttgagttgtggcgttggggtacgggttatacggtttgtttcgtttcggtttcggtttttttcgcggtttt

SEQ ID NO: 17416 - DNA, 913 bp, Artificial Sequence
  chemically treated genomic DNA (Homo sapiens) CpG-island No: 17416
aaaaccgcgaaaaaaaccgaaaccgaaacgaaacaaaccgtataacccgtaccccaacgccacaactcaaccccgcactaatcctaccgtaaaaaaaataaaactaaaacgaacgctcgtctccgaacatcgacgccgccgaccaaaacaaaacaaaaaccaacgttatcgttaacgaaaaacaataaaaaaaatccgccccgcaaacaaaaccccgaaaaccccaaccgccgccgccccgtctccgaacgcgccatttccaaaccccgaccctccaaacgccgctcctaaacctccgcgaactcccgcctcccgccgacccgactaaacgcaaaacgaccgccaccctaacgacctcgactccgccgatcccgcaaccgccgtacgaaacccgcgcacgcccgcctcaccctctaccgccgccgaaactactataaacccgatcgtcgtaaatatcgaaatccgccatttaccgtctccgctccgaaaaaaaccaaaataaacgaaaaaaaaccccgcaatataactccccttcgccgccgccgaactatccgccgcgccgcctaatcgcaaatccccttaaacgcaaaacacgaacaacgaccgtcgaacgcacgcacgaacgctacgcgcaacgccacgccctaaacccaacgcaactacctaccccgtacgtctacaacccacgtaatacgacgaatcccaactaaacgcctacccgcctacgcgacccattatatactaaccctaaaatacgcccgtaactacctcctatccccgccgcaccacgcccgtacgcgccgacctttccgtccgtcgacgaaaaataacctaaaaaactaaaaaaaactccctctccaattcgcctaaaaacgctacctttcgacctccatacataacgaaaacctcgaaa

SEQ ID NO: 17417 - DNA, 507 bp, Artificial Sequence
  chemically treated genomic DNA (Homo sapiens) CpG-island No: 17417
gggacggtgagaaacgggaatcgagtaagcgtagaaataaatagatgttaatggaggcgtgaaggttattgcgtttttatttttcgaattgtcgtaaagagttttagtgtcgtgtttttttcggtaggggaggaattggttaggcggcggcggcggcgaagcggcggcggcggttgtaggggagtagcggtagtggcggcgacggcgaggaggtgttcggtttgcgtagcgtagaaacgttcgtagttttagagaaggagtttttgtgggattaaattaggtattttgaatttacgtcggtttagttgggtcgagtttaggcgttgtcgtacgtatagttttggtggcggtgatagatattgtttttgattttaggggtttattaggtcgacgtttgaggcgtagatcgttggttttcgacgtattattttttacgttttatatttttgtttttttttttgggttagtgattttcggattttggaagagaagagggtggttaatgat

SEQ ID NO: 17418 - DNA, 507 bp, Artificial Sequence
  chemically treated genomic DNA (Homo sapiens) CpG-island No: 17418
atcattaaccaccctcttctcttccaaaatccgaaaatcactaacccaaaaaaaaaaacaaaaatataaaacgtaaaaaataatacgtcgaaaaccaacgatctacgcctcaaacgtcgacctaataaacccctaaaatcaaaaacaatatctatcaccgccaccaaaactatacgtacgacaacgcctaaactcgacccaactaaaccgacgtaaattcaaaatacctaatttaatcccacaaaaactccttctctaaaactacgaacgtttctacgctacgcaaaccgaacacctcctcgccgtcgccgccactaccgctactcccctacaaccgccgccgccgcttcgccgccgccgccgcctaaccaattcctcccctaccgaaaaaaacacgacactaaaactctttacgacaattcgaaaaataaaaacgcaataaccttcacgcctccattaacatctatttatttctacgcttactcgattcccgtttctcaccgtccc

SEQ ID NO: 17419 - DNA, 507 bp, Artificial Sequence
  chemically treated genomic DNA (Homo sapiens) CpG-island No: 17419
attattagttattttttttttttttagggttcgggaattattgatttaggaaggaagatagaaatgtaaggcgtaaagagtaatgcgtcgagagttagcgatttgcgttttagacgtcggtttaataggtttttagagttaagaatagtgtttgttatcgttattaaaattgtacgtgcggtagcgtttggattcggtttagttaagtcggcgtgggtttagaatgtttaatttggttttataagaattttttttttgaagttgcgggcgtttttacgttgcgtaaatcgaatattttttcgtcgtcgtcgttattgtcgttgtttttttatagtcgtcgtcgtcgtttcgtcgtcgtcgtcgtttaattaattttttttttatcgaggagagtacgatattagggttttttacgatagttcggaaagtgagagcgtagtagtttttacgtttttattaatatttgtttgtttttgcgtttgttcgattttcgttttttatcgtttt

SEQ ID NO: 17420 - DNA, 507 bp, Artificial Sequence
  chemically treated genomic DNA (Homo sapiens) CpG-island No: 17420
aaaacgataaaaaacgaaaatcgaacaaacgcaaaaacaaacaaatattaataaaaacgtaaaaactactacgctctcactttccgaactatcgtaaaaaaccctaatatcgtactctcctcgataaaaaaaaaattaattaaacgacgacgacgacgaaacgacgacgacgactataaaaaaacaacgacaataacgacgacgacgaaaaaatattcgatttacgcaacgtaaaaacgcccgcaacttcaaaaaaaaaattcttataaaaccaaattaaacattctaaacccacgccgacttaactaaaccgaatccaaacgctaccgcacgtacaattttaataacgataacaaacactattcttaactctaaaaacctattaaaccgacgtctaaaacgcaaatcgctaactctcgacgcattactctttacgccttacatttctatcttccttcctaaatcaataattcccgaaccctaaaaaaaaaaaaaataactaataat

SEQ ID NO: 17421 - DNA, 1158 bp, Artificial Sequence
  chemically treated genomic DNA (Homo sapiens) CpG-island No: 17421
acgcggggggatttcggagtatagttttcgtatttttttacgattttcgatttttgattttcggattaggacggtaagggagtgcggcgattaaggttgggagatcgcggagagaaggcgcgcggtatttgtttgtttagcgcgtttcggacgtttttttgttcggcgtcggttttgggtggcgcgggcgttcgttcgtagttgtagttttttaggaggtatatgtcgcgggcggtagttttgttcgttttcgaagtagaagagtatattttggtagagggcgaattatttttcgtgttagcggttcgtttcggtcgtttttttatttaggaagtcgcgtttggtgttttttttgcgcgttagaaaggttaggtatagggcgtgtttttcgttgtagcgtacgtttttttgtatggtgcgggtgcggagggtttacgggtggtcgtcggttttatttttgtttcgcggttatggtttagttggttttttcgagggcgcgatcgtttaggtttcggtcggcgaagggcgttttttttttttacgtcgcgcgtagggtatttcgttcgttttcgggaggtcgcggcgcgcgtggtaggggcgcgggttggggcgaggtacgtttttcgttttaattattattttttcggtcgagttttcggagttttttaagtttttaacgttcgcgtggagcgcggtttcgcgaggcgttcgagtcggtcgtcgtttcgtttaaagttgcgggagtcgagttttcgcggcgggttggggcggtagtcggggaaggattgttttcgggtaacgcgtttcgggagatagaaggtaaaacgttacgtgggagtttagttgtaatcggtttggagatcgatttaaagggtaaagtcggcgcggcgtcggcggtggcgtagttcgtttgtttcggttcgcgtttttttttcgttcgtttcgttcgggtcgttgtttttgttcgggcgtcgtcgggatggggcggattagggaggtggaggcgttcggtcgtattatatattcgtttatacgcgttcgtatattcgcgtataacgcgcgtatatatatacgtatatttatatatacgtagattagtatatttatttagatttataatgtatatatttagacgtataaaaatatatttataaatgt

SEQ ID NO: 17422 - DNA, 1158 bp, Artificial Sequence
  chemically treated genomic DNA (Homo sapiens) CpG-island No: 17422
acatttataaatatatttttatacgtctaaatatatacattataaatctaaataaatatactaatctacgtatatataaatatacgtatatatatacgcgcgttatacgcgaatatacgaacgcgtataaacgaatatataatacgaccgaacgcctccacctccctaatccgccccatcccgacgacgcccgaacaaaaacaacgacccgaacgaaacgaacgaaaaaaaaacgcgaaccgaaacaaacgaactacgccaccgccgacgccgcgccgactttaccctttaaatcgatctccaaaccgattacaactaaactcccacgtaacgttttaccttctatctcccgaaacgcgttacccgaaaacaatccttccccgactaccgccccaacccgccgcgaaaactcgactcccgcaactttaaacgaaacgacgaccgactcgaacgcctcgcgaaaccgcgctccacgcgaacgttaaaaacttaaaaaactccgaaaactcgaccgaaaaaataataattaaaacgaaaaacgtacctcgccccaacccgcgcccctaccacgcgcgccgcgacctcccgaaaacgaacgaaataccctacgcgcgacgtaaaaaaaaaaaacgcccttcgccgaccgaaacctaaacgatcgcgccctcgaaaaaaccaactaaaccataaccgcgaaacaaaaataaaaccgacgaccacccgtaaaccctccgcacccgcaccatacaaaaaaacgtacgctacaacgaaaaacacgccctatacctaacctttctaacgcgcaaaaaaaacaccaaacgcgacttcctaaataaaaaaacgaccgaaacgaaccgctaacacgaaaaataattcgccctctaccaaaatatactcttctacttcgaaaacgaacaaaactaccgcccgcgacatatacctcctaaaaaactacaactacgaacgaacgcccgcgccacccaaaaccgacgccgaacaaaaaaacgtccgaaacgcgctaaacaaacaaataccgcgcgccttctctccgcgatctcccaaccttaatcgccgcactcccttaccgtcctaatccgaaaatcaaaaatcgaaaatcgtaaaaaaatacgaaaactatactccgaaatccccccgcgt

SEQ ID NO: 17423 - DNA, 1158 bp, Artificial Sequence
  chemically treated genomic DNA (Homo sapiens) CpG-island No: 17423
gtatttgtgagtgtatttttgtgcgtttgagtgtgtgtattgtggatttgggtgaatgtattggtttgcgtgtgtgtgggtgtgcgtgtgtgtgtgcgcgcgttgtgcgcgagtgtgcgagcgcgtgtgagcgggtgtgtggtgcggtcgggcgtttttatttttttgattcgttttatttcggcggcgttcgagtagaggtagcggttcgggcggggcgggcgagggagggacgcgagtcggggtaagcgggttgcgttatcgtcggcgtcgcgtcgattttgttttttaaatcggtttttaagtcgattatagttgagtttttacgtgacgttttattttttgtttttcggagcgcgttgttcgaggatagttttttttcggttgtcgttttagttcgtcgcgggggttcggttttcgtaattttgggcgaagcggcggtcggttcgggcgtttcgcggggtcgcgttttacgcgggcgttgggggtttggggggtttcgggggttcggtcgggagggtggtggttagggcggagagcgtgtttcgttttagttcgcgtttttgttacgcgcgtcgcggtttttcgaaagcgggcggggtgttttgcgcgcggcgtggggaaagggggcgtttttcgtcggtcgggatttgagcggtcgcgttttcgagggagttagttgggttatggtcgcgaggtaggggtgagatcggcggttattcgtgagtttttcgtattcgtattatgtagaagagcgtgcgttataacgaggggtacgttttgtatttggtttttttggcgcgtaaggagggtattaagcgcggttttttgagtaagaagacggtcgaggcgagtcgttggtacgagaagtggttcgttttttattagaatgtgtttttttatttcgagggcgagtagagttgtcgttcgcggtatgtattttttggagggttgtagttgcgaacgaacgttcgcgttatttagggtcggcgtcgggtagggaggcgttcgagacgcgttggataagtaggtatcgcgcgtttttttttcgcggttttttagttttgatcgtcgtatttttttgtcgttttaattcggggattaggggtcgggggtcgtgaaagagtgcggggattatgtttcgaaattttttcgcgt

SEQ ID NO: 17424 - DNA, 1158 bp, Artificial Sequence
  chemically treated genomic DNA (Homo sapiens) CpG-island No: 17424
acgcgaaaaaatttcgaaacataatccccgcactctttcacgacccccgacccctaatccccgaattaaaacgacaaaaaaatacgacgatcaaaactaaaaaaccgcgaaaaaaaaacgcgcgatacctacttatccaacgcgtctcgaacgcctccctacccgacgccgaccctaaataacgcgaacgttcgttcgcaactacaaccctccaaaaaatacataccgcgaacgacaactctactcgccctcgaaataaaaaaacacattctaataaaaaacgaaccacttctcgtaccaacgactcgcctcgaccgtcttcttactcaaaaaaccgcgcttaataccctccttacgcgccaaaaaaaccaaatacaaaacgtacccctcgttataacgcacgctcttctacataatacgaatacgaaaaactcacgaataaccgccgatctcacccctacctcgcgaccataacccaactaactccctcgaaaacgcgaccgctcaaatcccgaccgacgaaaaacgccccctttccccacgccgcgcgcaaaacaccccgcccgctttcgaaaaaccgcgacgcgcgtaacaaaaacgcgaactaaaacgaaacacgctctccgccctaaccaccaccctcccgaccgaacccccgaaaccccccaaacccccaacgcccgcgtaaaacgcgaccccgcgaaacgcccgaaccgaccgccgcttcgcccaaaattacgaaaaccgaacccccgcgacgaactaaaacgacaaccgaaaaaaaactatcctcgaacaacgcgctccgaaaaacaaaaaataaaacgtcacgtaaaaactcaactataatcgacttaaaaaccgatttaaaaaacaaaatcgacgcgacgccgacgataacgcaacccgcttaccccgactcgcgtccctccctcgcccgccccgcccgaaccgctacctctactcgaacgccgccgaaataaaacgaatcaaaaaaataaaaacgcccgaccgcaccacacacccgctcacacgcgctcgcacactcgcgcacaacgcgcgcacacacacacgcacacccacacacacgcaaaccaatacattcacccaaatccacaatacacacactcaaacgcacaaaaatacactcacaaatac

SEQ ID NO: 17425 - DNA, 583 bp, Artificial Sequence
  chemically treated genomic DNA (Homo sapiens) CpG-island No: 17425
cgtcgaatttgcggtcgattagtcgtttcgcgttaaatacggtgttttgcgggtttagcgttatttggtttttggtcgtattttcgatgagtcgttcggtgttcgtgaaggttacgtagttgggggtggtgcggttgttttggtcgttggcgatgatttttattttgtcgtgttggaatatttttacgtaggagtaggtggtgtttaggtcgatgtcgatcgtcgcggttttggttatgtcggtgttttgttttgtgggtttcgttttgagattgggggttggaaacggcggacgggattcgcgataagagtttagtttttcggaacgtcggaaatttaatacgtcggtgtttgtagtcgtataggttcgttttggaaagttttgggatcgcgggagttattttcgaaagacgaagcggattttcgtagtagttttttaggttggtcgtttttcggatcgcgcgtttttcggtttttataagtcgtcgtggagattcgtttttttttttttgagttaattattaagttcgatgaggttgttaggtcgggaatattttaggggtttcgtttttcgttttgtttt

SEQ ID NO: 17426 - DNA, 583 bp, Artificial Sequence
  chemically treated genomic DNA (Homo sapiens) CpG-island No: 17426
aaaacaaaacgaaaaacgaaacccctaaaatattcccgacctaacaacctcatcgaacttaataattaactcaaaaaaaaaaaaacgaatctccacgacgacttataaaaaccgaaaaacgcgcgatccgaaaaacgaccaacctaaaaaactactacgaaaatccgcttcgtctttcgaaaataactcccgcgatcccaaaactttccaaaacgaacctatacgactacaaacaccgacgtattaaatttccgacgttccgaaaaactaaactcttatcgcgaatcccgtccgccgtttccaacccccaatctcaaaacgaaacccacaaaacaaaacaccgacataaccaaaaccgcgacgatcgacatcgacctaaacaccacctactcctacgtaaaaatattccaacacgacaaaataaaaatcatcgccaacgaccaaaacaaccgcaccacccccaactacgtaaccttcacgaacaccgaacgactcatcgaaaatacgaccaaaaaccaaataacgctaaacccgcaaaacaccgtatttaacgcgaaacgactaatcgaccgcaaattcgacg

SEQ ID NO: 17427 - DNA, 583 bp, Artificial Sequence
  chemically treated genomic DNA (Homo sapiens) CpG-island No: 17427
ggggtaggacgggaggcgaaatttttggaatattttcgatttggtagttttatcgagtttggtgattggtttagaaggggaaaggcgggtttttacgacgatttataaaagtcgaggggcgcgcggttcggaaaacggttagtttgaggagttgttgcgagggttcgtttcgtttttcgagagtgattttcgcggttttaaggttttttagagcgaatttgtgcggttgtaggtatcggcgtgttgagttttcggcgtttcgaaggattgagtttttgtcgcggatttcgttcgtcgtttttagtttttagttttagagcggagtttatagagtagggtatcggtatggttaaagtcgcggcgatcggtatcgatttgggtattatttatttttgcgtgggggtgttttaatacggtaaggtggagattatcgttaacgattagggtaatcgtattatttttagttacgtggtttttacggatatcgagcggtttatcggggatgcggttaagaattaggtggcgttgaattcgtagaatatcgtgtttgacgcgaagcggttgatcggtcgtaagttcggcg

SEQ ID NO: 17428 - DNA, 583 bp, Artificial Sequence
  chemically treated genomic DNA (Homo sapiens) CpG-island No: 17428
cgccgaacttacgaccgatcaaccgcttcgcgtcaaacacgatattctacgaattcaacgccacctaattcttaaccgcatccccgataaaccgctcgatatccgtaaaaaccacgtaactaaaaataatacgattaccctaatcgttaacgataatctccaccttaccgtattaaaacacccccacgcaaaaataaataatacccaaatcgataccgatcgccgcgactttaaccataccgataccctactctataaactccgctctaaaactaaaaactaaaaacgacgaacgaaatccgcgacaaaaactcaatccttcgaaacgccgaaaactcaacacgccgatacctacaaccgcacaaattcgctctaaaaaaccttaaaaccgcgaaaatcactctcgaaaaacgaaacgaaccctcgcaacaactcctcaaactaaccgttttccgaaccgcgcgcccctcgacttttataaatcgtcgtaaaaacccgcctttccccttctaaaccaatcaccaaactcgataaaactaccaaatcgaaaatattccaaaaatttcgcctcccgtcctacccc

SEQ ID NO: 17429 - DNA, 595 bp, Artificial Sequence
  chemically treated genomic DNA (Homo sapiens) CpG-island No: 17429
cgtcgaatttgcggtcgattagtcgtttcgcgttaaatacggtgttttgcgggtttagcgttatttggtttttggtcgtattttcgatgagtcgttcggtgttcgtgaaggttacgtagttgggggtggtgcggttgttttggtcgttggcgatgatttttattttgtcgtgttggaatatttttacgtaggagtaggtggtgtttaggtcgatgtcgatcgtcgcggttttggttatgtcggttttttgttttttgtcggttcggttttgagattgggggttggaaacggaatattggattcgcgagaagagttcggttttttcggacgtcggaaattcgacgcgtcggtgtttgtagtcgtataggttcgttttgggaagttttgggataacgggagttattttcgaaaaaggtagtggattgtcgtagtagttttttaggttagtcgttattcggatcgtttgtttttgggtttttataagtcgttacggagattcgtttttttttttttgagttaattatcgagttcgatgaggttgttaggtcgggaatattttaggggtttcgtttttcgttttgttttttagtttttt

SEQ ID NO: 17430 - DNA, 595 bp, Artificial Sequence
  chemically treated genomic DNA (Homo sapiens) CpG-island No: 17430
aaaaaactaaaaaacaaaacgaaaaacgaaacccctaaaatattcccgacctaacaacctcatcgaactcgataattaactcaaaaaaaaaaaaacgaatctccgtaacgacttataaaaacccaaaaacaaacgatccgaataacgactaacctaaaaaactactacgacaatccactacctttttcgaaaataactcccgttatcccaaaacttcccaaaacgaacctatacgactacaaacaccgacgcgtcgaatttccgacgtccgaaaaaaccgaactcttctcgcgaatccaatattccgtttccaacccccaatctcaaaaccgaaccgacaaaaaacaaaaaaccgacataaccaaaaccgcgacgatcgacatcgacctaaacaccacctactcctacgtaaaaatattccaacacgacaaaataaaaatcatcgccaacgaccaaaacaaccgcaccacccccaactacgtaaccttcacgaacaccgaacgactcatcgaaaatacgaccaaaaaccaaataacgctaaacccgcaaaacaccgtatttaacgcgaaacgactaatcgaccgcaaattcgacg

SEQ ID NO: 17431 - DNA, 595 bp, Artificial Sequence
  chemically treated genomic DNA (Homo sapiens) CpG-island No: 17431
ggaaggttggggggtaggacgggaggcgaaatttttggaatattttcgatttggtagttttatcgagttcggtgattggtttagaagggaaaaggcgggttttcgtgacgatttataaaagtttaggggtaagcggttcggataacggttagtttgaggagttgttgcgatagtttattatttttttcgagagtgattttcgttgttttaaggttttttagagcgaatttgtgcggttgtaggtatcggcgcgtcgagttttcggcgttcggaaggatcgagtttttttcgcggatttagtgtttcgtttttagtttttaattttagagtcgagtcgatagagagtagggaatcggtatggttaaagtcgcggcgatcggtatcgatttgggtattatttatttttgcgtgggggtgttttaatacggtaaggtggagattatcgttaacgattagggtaatcgtattatttttagttacgtggtttttacggatatcgagcggtttatcggggatgcggttaagaattaggtggcgttgaattcgtagaatatcgtgtttgacgcgaagcggttgatcggtcgtaagttcggcg

SEQ ID NO: 17432 - DNA, 595 bp, Artificial Sequence
  chemically treated genomic DNA (Homo sapiens) CpG-island No: 17432
cgccgaacttacgaccgatcaaccgcttcgcgtcaaacacgatattctacgaattcaacgccacctaattcttaaccgcatccccgataaaccgctcgatatccgtaaaaaccacgtaactaaaaataatacgattaccctaatcgttaacgataatctccaccttaccgtattaaaacacccccacgcaaaaataaataatacccaaatcgataccgatcgccgcgactttaaccataccgattccctactctctatcgactcgactctaaaattaaaaactaaaaacgaaacactaaatccgcgaaaaaaactcgatccttccgaacgccgaaaactcgacgcgccgatacctacaaccgcacaaattcgctctaaaaaaccttaaaacaacgaaaatcactctcgaaaaaaataataaactatcgcaacaactcctcaaactaaccgttatccgaaccgcttacccctaaacttttataaatcgtcacgaaaacccgccttttcccttctaaaccaatcaccgaactcgataaaactaccaaatcgaaaatattccaaaaatttcgcctcccgtcctaccccccaaccttcc

SEQ ID NO: 17433 - DNA, 569 bp, Artificial Sequence
  chemically treated genomic DNA (Homo sapiens) CpG-island No: 17433
gtcgttttcgttattcggtcgaggattcgtataaggtgttcgtggcggcgtttgacgggagcgtcgtgtttaggggtgttttttcgttttgcgttcgcgtttagcgtttcgcgtttcgcgttgtttttcgtgagatcggcgggcggcgagtcgcgcggttttcggggtagtgtcggatacggcgggcgcgtattcgtaggcggggtacggtcgttttcgttaggattcgtaggttcggaaacgttttttgttataaaggggggaatacgtgggcgtcggttgtcggggcggcgattttagggaattagggttatttggagagtcgtttatcgtttttgttcgttcgattttttcgttcgggtcgttcggtcggtttagtcgcggtcggcgtttggttgtgaggtggattttcggtttagtttgattatttttttttagtacgtatacgcggttcgaattcgtatttaattagacgtcgattcgtttttgagagttttttatatttttcgaagtttcgcgatggtggatagttttttttttttaggaattttttattgatattgtttttt

SEQ ID NO: 17434 - DNA, 569 bp, Artificial Sequence
  chemically treated genomic DNA (Homo sapiens) CpG-island No: 17434
aaaaaacaatatcaataaaaaattcctaaaaaaaaaaaactatccaccatcgcgaaacttcgaaaaatataaaaaactctcaaaaacgaatcgacgtctaattaaatacgaattcgaaccgcgtatacgtactaaaaaaaaataatcaaactaaaccgaaaatccacctcacaaccaaacgccgaccgcgactaaaccgaccgaacgacccgaacgaaaaaatcgaacgaacaaaaacgataaacgactctccaaataaccctaattccctaaaatcgccgccccgacaaccgacgcccacgtattcccccctttataacaaaaaacgtttccgaacctacgaatcctaacgaaaacgaccgtaccccgcctacgaatacgcgcccgccgtatccgacactaccccgaaaaccgcgcgactcgccgcccgccgatctcacgaaaaacaacgcgaaacgcgaaacgctaaacgcgaacgcaaaacgaaaaaacacccctaaacacgacgctcccgtcaaacgccgccacgaacaccttatacgaatcctcgaccgaataacgaaaacgac

SEQ ID NO: 17435 - DNA, 569 bp, Artificial Sequence
  chemically treated genomic DNA (Homo sapiens) CpG-island No: 17435
gaggggtagtgttagtggggagtttttggggaagaggaattatttattatcgcggggtttcggggagtgtggaaggtttttaggagcgggtcggcgtttggttggatgcgggttcgagtcgcgtgtacgtattggagggagatggttagattgggtcgggaatttattttatagttaggcgtcggtcgcggttggatcggtcgagcggttcgggcggaggagtcgagcgggtagagacggtgggcggttttttaggtgattttagttttttaagatcgtcgtttcggtagtcggcgtttacgtgtttttttttttgtgatagggagcgttttcgggtttgcgggttttggcgggggcggtcgtgtttcgtttgcgagtgcgcgttcgtcgtgttcgatattgtttcgggggtcgcgcggttcgtcgttcgtcggttttacgaggaatagcgcggggcgcggggcgttgggcgcggacgtaggacgagaggatatttttgagtacgacgttttcgttaggcgtcgttacgggtattttgtgcgggttttcggtcgggtggcgagggcggt

SEQ ID NO: 17436 - DNA, 569 bp, Artificial Sequence
  chemically treated genomic DNA (Homo sapiens) CpG-island No: 17436
accgccctcgccacccgaccgaaaacccgcacaaaatacccgtaacgacgcctaacgaaaacgtcgtactcaaaaatatcctctcgtcctacgtccgcgcccaacgccccgcgccccgcgctattcctcgtaaaaccgacgaacgacgaaccgcgcgacccccgaaacaatatcgaacacgacgaacgcgcactcgcaaacgaaacacgaccgcccccgccaaaacccgcaaacccgaaaacgctccctatcacaaaaaaaaaaacacgtaaacgccgactaccgaaacgacgatcttaaaaaactaaaatcacctaaaaaaccgcccaccgtctctacccgctcgactcctccgcccgaaccgctcgaccgatccaaccgcgaccgacgcctaactataaaataaattcccgacccaatctaaccatctccctccaatacgtacacgcgactcgaacccgcatccaaccaaacgccgacccgctcctaaaaaccttccacactccccgaaaccccgcgataataaataattcctcttccccaaaaactccccactaacactacccctc

SEQ ID NO: 17437 - DNA, 566 bp, Artificial Sequence
  chemically treated genomic DNA (Homo sapiens) CpG-island No: 17437
  misc_feature (230)..(231): n is either a, c, g or t
tttttgcgcgcgcgtcggcgggttttttatttttcgaggcgttcgttggtttgcgttttggcggggacgtgggcggggcgggcgttatttaatgttggtgttattttttcggtgtagcggttggcgatcggtcgcggaggtgcgtgtagggttcgcgtcgtcgtcggtatttttatcgttaataatttagtttattgttattgttatagttatacgaggttttttatcgnntggttcgtcgttgcggtttcggattcgcgttttacgtttcgtagttcgcggcgttattagtttagtatgtattaggtgcgtgtagttttcgcgtcggtcgaggatgcgagacgttgggttaaggtttcggggatcggagtaggttgacgggaagcgaggaaaaggcgaagaggagaaacgtttcgtttcggggtaaggggaggtcgttttttttttgagcgtttttcggtttgggtatcgtttttttgatttttcgttacggtttcgtgcggtcgtcggggttggttggggaaagaagttagtttagaggagcgagaaggggttaaggggtttta

SEQ ID NO: 17438 - DNA, 566 bp, Artificial Sequence
  chemically treated genomic DNA (Homo sapiens) CpG-island No: 17438
  misc_feature (336)..(337): n is either a, c, g or t
taaaaccccttaaccccttctcgctcctctaaactaacttctttccccaaccaaccccgacgaccgcacgaaaccgtaacgaaaaatcaaaaaaacgatacccaaaccgaaaaacgctcaaaaaaaaaacgacctccccttaccccgaaacgaaacgtttctcctcttcgccttttcctcgcttcccgtcaacctactccgatccccgaaaccttaacccaacgtctcgcatcctcgaccgacgcgaaaactacacgcacctaatacatactaaactaataacgccgcgaactacgaaacgtaaaacgcgaatccgaaaccgcaacgacgaaccanncgataaaaaacctcgtataactataacaataacaataaactaaattattaacgataaaaataccgacgacgacgcgaaccctacacgcacctccgcgaccgatcgccaaccgctacaccgaaaaaataacaccaacattaaataacgcccgccccgcccacgtccccgccaaaacgcaaaccaacgaacgcctcgaaaaataaaaaacccgccgacgcgcgcgcaaaaa

SEQ ID NO: 17439 - DNA, 566 bp, Artificial Sequence
  chemically treated genomic DNA (Homo sapiens) CpG-island No: 17439
  misc_feature (336)..(337): n is either a, c, g or t
taggattttttggttttttttcgtttttttggattggtttttttttttagttagtttcggcggtcgtacggagtcgtggcggggagttagagaagcggtgtttaggtcggggggcgtttagaggaaaggcggtttttttttgtttcgggacggggcgtttttttttttcgtttttttttcgtttttcgttagtttgtttcggttttcggggttttggtttagcgtttcgtattttcggtcggcgcgggggttgtacgtatttggtgtatgttgggttggtggcgtcgcgggttgcggggcgtggagcgcggattcgggatcgtagcggcgagttanncggtggggggtttcgtgtggttgtggtagtggtagtgggttgagttgttggcggtggagatatcggcggcggcgcgggttttgtacgtattttcgcggtcgatcgttagtcgttgtatcggggaggtggtattagtattaaatagcgttcgtttcgtttacgttttcgttagggcgtaggttagcggacgtttcggagggtaggaaattcgtcggcgcgcgcgtaggga

SEQ ID NO: 17440 - DNA, 566 bp, Artificial Sequence
  chemically treated genomic DNA (Homo sapiens) CpG-island No: 17440
  misc_feature (230)..(231): n is either a, c, g or t
tccctacgcgcgcgccgacgaatttcctaccctccgaaacgtccgctaacctacgccctaacgaaaacgtaaacgaaacgaacgctatttaatactaataccacctccccgatacaacgactaacgatcgaccgcgaaaatacgtacaaaacccgcgccgccgccgatatctccaccgccaacaactcaacccactaccactaccacaaccacacgaaaccccccaccgnntaactcgccgctacgatcccgaatccgcgctccacgccccgcaacccgcgacgccaccaacccaacatacaccaaatacgtacaacccccgcgccgaccgaaaatacgaaacgctaaaccaaaaccccgaaaaccgaaacaaactaacgaaaaacgaaaaaaaaacgaaaaaaaaaaacgccccgtcccgaaacaaaaaaaaaccgcctttcctctaaacgccccccgacctaaacaccgcttctctaactccccgccacgactccgtacgaccgccgaaactaactaaaaaaaaaaaccaatccaaaaaaacgaaaaaaaaccaaaaaatccta

SEQ ID NO: 17441 - DNA, 606 bp, Artificial Sequence
  chemically treated genomic DNA (Homo sapiens) CpG-island No: 17441
tcgtcgttggtgcggggcgtaggttgcgatggaagtcgttggttagggcggggagttaagttggggcgattgggggggtttgggggagttagcggggcgggatcgagcggggcggagagtggtaggaggaggcgaattttcgcgtttcggcgaattttatcgggttgaagtttttgttgtcgttttttttttgcgtgcggagttgggttttgcgtgcgtcgtttttggaaagtcggttttagttatatttttgggcgttgttgcggcgtttttttcgcgttttttacggtatttgatacgcggaggcggcgtcgagggtgggtgcggttattattatttttggcgtggggtgtcggtcgttattattttcgcgtgcgtacgtatagtcgcgtttgttaggttagcgaggcggacgtttgggttattattcgtagtcgagttcgggcgcgtatcgtatttcgttgcgtatcggcggttttgtggtttttttgggcgcgtttgcggtcgcgaagggggttttttttttataagggaagtcggtagtttcgggggtggttttttcgtttgcgcgtttttttttatatgttgatgtataggatttttaag

SEQ ID NO: 17442 - DNA, 606 bp, Artificial Sequence
  chemically treated genomic DNA (Homo sapiens) CpG-island No: 17442
cttaaaaatcctatacatcaacatataaaaaaaaacgcgcaaacgaaaaaaccacccccgaaactaccgacttcccttataaaaaaaaaacccccttcgcgaccgcaaacgcgcccaaaaaaaccacaaaaccgccgatacgcaacgaaatacgatacgcgcccgaactcgactacgaataataacccaaacgtccgcctcgctaacctaacaaacgcgactatacgtacgcacgcgaaaataataacgaccgacaccccacgccaaaaataataataaccgcacccaccctcgacgccgcctccgcgtatcaaataccgtaaaaaacgcgaaaaaaacgccgcaacaacgcccaaaaatataactaaaaccgactttccaaaaacgacgcacgcaaaacccaactccgcacgcaaaaaaaaaacgacaacaaaaacttcaacccgataaaattcgccgaaacgcgaaaattcgcctcctcctaccactctccgccccgctcgatcccgccccgctaactcccccaaacccccccaatcgccccaacttaactccccgccctaaccaacgacttccatcgcaacctacgccccgcaccaacgacga

SEQ ID NO: 17443 - DNA, 606 bp, Artificial Sequence
  chemically treated genomic DNA (Homo sapiens) CpG-island No: 17443
tttgaaaattttatgtattagtatgtaggaaagggcgcgtaggcggggaagttattttcgaagttgtcggttttttttataaagggagggtttttttcgcgatcgtaagcgcgtttaggaagattatagagtcgtcggtgcgtagcgaggtgcgatacgcgttcgggttcggttgcgggtggtggtttaagcgttcgtttcgttggtttggtaggcgcgattgtgcgtgcgtacgcgagggtggtggcggtcggtattttacgttaagggtggtggtggtcgtatttattttcggcgtcgttttcgcgtgttaggtgtcgtgagaagcgcgggaggagcgtcgtagtagcgtttagggatatgattggagtcgattttttagaagcggcgtacgtaaagtttagtttcgtacgtaaaggggaggcgatagtagaaattttaattcgataaagttcgtcggagcgcggagattcgtttttttttgttatttttcgtttcgttcggtttcgtttcgttagtttttttaggtttttttagtcgttttagtttggtttttcgttttggttaacggtttttatcgtagtttgcgtttcgtattagcggcgg

SEQ ID NO: 17444 - DNA, 606 bp, Artificial Sequence
  chemically treated genomic DNA (Homo sapiens) CpG-island No: 17444
ccgccgctaatacgaaacgcaaactacgataaaaaccgttaaccaaaacgaaaaaccaaactaaaacgactaaaaaaacctaaaaaaactaacgaaacgaaaccgaacgaaacgaaaaataacaaaaaaaaacgaatctccgcgctccgacgaactttatcgaattaaaatttctactatcgcctcccctttacgtacgaaactaaactttacgtacgccgcttctaaaaaatcgactccaatcatatccctaaacgctactacgacgctcctcccgcgcttctcacgacacctaacacgcgaaaacgacgccgaaaataaatacgaccaccaccacccttaacgtaaaataccgaccgccaccaccctcgcgtacgcacgcacaatcgcgcctaccaaaccaacgaaacgaacgcttaaaccaccacccgcaaccgaacccgaacgcgtatcgcacctcgctacgcaccgacgactctataatcttcctaaacgcgcttacgatcgcgaaaaaaaccctccctttataaaaaaaaccgacaacttcgaaaataacttccccgcctacgcgccctttcctacatactaatacataaaattttcaaa

SEQ ID NO: 17445 - DNA, 819 bp, Artificial Sequence
  chemically treated genomic DNA (Homo sapiens) CpG-island No: 17445
gtagtttagcggattagcgaggggtattcgcggttcggggagcgcgttcgttcggtaaatattaattcggttgtttcgggtttttcgtttcggttcgtcgcgcggtatcgatcgaaattcggcggttttgttttattggtcgtcgtcgttttttttttcggcgggattaatgttttgtcggttcgacgagagaggggtcggtcgttttagggtttgggtgcggtttcgttcgttttttcggggataaggtcgttatcgtaggcgcgggcgaggaagggtttattcggttaggagcgtagcggattgtattgcggcgtcgtcgtcgggtttcgcgtttatttgagttggggacggcgtagtttcggcgattagagcggggaagagtcgagtaaggttgagaaaggggcggtttttcggtagacgtcgagaaatggcgtttataacgagtttatcggttttaattttcggaggatttcgatttttcgttcgtttattttttaaagtttttttttagtttcgttttttagggcggagcgtttcgtttttaaacgggcgatgatatcgtttcggaaattggtcggcgcggcgattggagagaaatcggcgaggtcgggttcggtcgggttggaattagcgttagtagtcgggcgttcgcggttggtttaaaggggcgttgtcgaaatttagttttcgttgcggtttttcgttcgcggaggaggcgttcgttcgtagatagattttagttagttttattacgaaggaggttggtggagttggttgttagatttatttatttattcgtttaagagattaaatttt

SEQ ID NO: 17446 - DNA, 819 bp, Artificial Sequence
  chemically treated genomic DNA (Homo sapiens) CpG-island No: 17446
aaaatttaatctcttaaacgaataaataaataaatctaacaaccaactccaccaacctccttcgtaataaaactaactaaaatctatctacgaacgaacgcctcctccgcgaacgaaaaaccgcaacgaaaactaaatttcgacaacgcccctttaaaccaaccgcgaacgcccgactactaacgctaattccaacccgaccgaacccgacctcgccgatttctctccaatcgccgcgccgaccaatttccgaaacgatatcatcgcccgtttaaaaacgaaacgctccgccctaaaaaacgaaactaaaaaaaaactttaaaaaataaacgaacgaaaaatcgaaatcctccgaaaattaaaaccgataaactcgttataaacgccatttctcgacgtctaccgaaaaaccgcccctttctcaaccttactcgactcttccccgctctaatcgccgaaactacgccgtccccaactcaaataaacgcgaaacccgacgacgacgccgcaatacaatccgctacgctcctaaccgaataaacccttcctcgcccgcgcctacgataacgaccttatccccgaaaaaacgaacgaaaccgcacccaaaccctaaaacgaccgacccctctctcgtcgaaccgacaaaacattaatcccgccgaaaaaaaaaacgacgacgaccaataaaacaaaaccgccgaatttcgatcgataccgcgcgacgaaccgaaacgaaaaacccgaaacaaccgaattaatatttaccgaacgaacgcgctccccgaaccgcgaatacccctcgctaatccgctaaactac

SEQ ID NO: 17447 - DNA, 819 bp, Artificial Sequence
  chemically treated genomic DNA (Homo sapiens) CpG-island No: 17447
aggatttaattttttgaacgaatggatgaatgaatttagtagttagttttattagtttttttcgtgataggattaattggggtttgtttgcggacgggcgtttttttcgcgggcggagggtcgtagcgggaattgggtttcggtagcgtttttttaaattagtcgcggacgttcggttgttggcgttagttttagttcggtcgggttcggtttcgtcggtttttttttagtcgtcgcgtcggttaattttcggggcggtgttatcgttcgtttaagagcggagcgtttcgttttggggggcggagttgggagggagttttaaggggtggacgggcgggaggtcggggtttttcggggattagagtcggtgggttcgttgtgggcgttatttttcggcgtttatcgaggagtcgttttttttttagttttgttcggttttttttcgttttggtcgtcggggttgcgtcgtttttagtttaggtaagcgcgaggttcggcggcggcgtcgtagtatagttcgttgcgtttttagtcgagtggattttttttcgttcgcgtttgcggtagcggttttgttttcggggaggcgggcggggtcgtatttagattttagggcggtcggtttttttttcgtcgggtcggtagggtattaatttcgtcggagggaggggcggcggcggttaatgaggtagggtcgtcgagtttcggtcgatatcgcgcgacgggtcggggcggagggttcggggtagtcgggttaatgtttgtcgagcggacgcgtttttcgagtcgcgggtatttttcgttggttcgttgggttgt

SEQ ID NO: 17448 - DNA, 819 bp, Artificial Sequence
  chemically treated genomic DNA (Homo sapiens) CpG-island No: 17448
acaacccaacgaaccaacgaaaaatacccgcgactcgaaaaacgcgtccgctcgacaaacattaacccgactaccccgaaccctccgccccgacccgtcgcgcgatatcgaccgaaactcgacgaccctacctcattaaccgccgccgcccctccctccgacgaaattaataccctaccgacccgacgaaaaaaaaaccgaccgccctaaaatctaaatacgaccccgcccgcctccccgaaaacaaaaccgctaccgcaaacgcgaacgaaaaaaaatccactcgactaaaaacgcaacgaactatactacgacgccgccgccgaacctcgcgcttacctaaactaaaaacgacgcaaccccgacgaccaaaacgaaaaaaaaccgaacaaaactaaaaaaaaaacgactcctcgataaacgccgaaaaataacgcccacaacgaacccaccgactctaatccccgaaaaaccccgacctcccgcccgtccaccccttaaaactccctcccaactccgccccccaaaacgaaacgctccgctcttaaacgaacgataacaccgccccgaaaattaaccgacgcgacgactaaaaaaaaaccgacgaaaccgaacccgaccgaactaaaactaacgccaacaaccgaacgtccgcgactaatttaaaaaaacgctaccgaaacccaattcccgctacgaccctccgcccgcgaaaaaaacgcccgtccgcaaacaaaccccaattaatcctatcacgaaaaaaactaataaaactaactactaaattcattcatccattcgttcaaaaaattaaatcct

SEQ ID NO: 17449 - DNA, 779 bp, Artificial Sequence
  chemically treated genomic DNA (Homo sapiens) CpG-island No: 17449
aggacgagggcgtggaggagatttcgggtagggatcgggtttaggggttcgggtcggggtttaatatttattcgatgggtgcgggttcgacggcgggtgtgggagtaggggcggcgggggtcgggaggaggagtggggataggtcgcgtagggggtgttcgggattttcgtttaagtttgggaaagaggtacgcgggggcggcgcgttggggtcggtgataggcgttcgtttttatttgtcgggtagtgtttcgtcgtcgagtcgcgcgcgtcgtttttcgaggtggaattgtcgtggtttacggcgtaggcggcgttgaaggtagcggttagtagttttatagggtcggcggcggggcgggtgcgggggtcgggtcgggggttacgtcggggttttgggttgggtcgggggcgattagcgggttgcggagcggggtcgtagcgcgcgcggttcgatcggagttgtagtcgtcgtcgttatcgttgtcgagtaatttcgcgggcggcgcgattttggaggttttcgggttgttacggtaacgagggaggcgggaggggcggcgcggcgggggcgaggtcgggcggcggcgggcggggttcggttggtcgtattcggtttttcgagcgtcgattgcgggttggggtttgtcgcgggcgcgttttttttttttcgcgtcgtcgtgtttcgattcggagaggggtagagttgcggaggttttggagttgcgtttttgtttgtttcgtttattttttacggcgggggaagtttggaaggggcg

SEQ ID NO: 17450 - DNA, 779 bp, Artificial Sequence
  chemically treated genomic DNA (Homo sapiens) CpG-island No: 17450
cgccccttccaaacttcccccgccgtaaaaaataaacgaaacaaacaaaaacgcaactccaaaacctccgcaactctacccctctccgaatcgaaacacgacgacgcgaaaaaaaaaaaacgcgcccgcgacaaaccccaacccgcaatcgacgctcgaaaaaccgaatacgaccaaccgaaccccgcccgccgccgcccgacctcgcccccgccgcgccgcccctcccgcctccctcgttaccgtaacaacccgaaaacctccaaaatcgcgccgcccgcgaaattactcgacaacgataacgacgacgactacaactccgatcgaaccgcgcgcgctacgaccccgctccgcaacccgctaatcgcccccgacccaacccaaaaccccgacgtaacccccgacccgacccccgcacccgccccgccgccgaccctataaaactactaaccgctaccttcaacgccgcctacgccgtaaaccacgacaattccacctcgaaaaacgacgcgcgcgactcgacgacgaaacactacccgacaaataaaaacgaacgcctatcaccgaccccaacgcgccgcccccgcgtacctctttcccaaacttaaacgaaaatcccgaacaccccctacgcgacctatccccactcctcctcccgacccccgccgcccctactcccacacccgccgtcgaacccgcacccatcgaataaatattaaaccccgacccgaacccctaaacccgatccctacccgaaatctcctccacgccctcgtcct

SEQ ID NO: 17451 - DNA, 779 bp, Artificial Sequence
  chemically treated genomic DNA (Homo sapiens) CpG-island No: 17451
cgttttttttaggtttttttcgtcgtgaggagtgggcggggtaggtaaaggcgtagttttagggttttcgtagttttgttttttttcgggtcggggtacggcggcgcgggggaggaaaggcgcgttcgcggtaggttttagttcgtagtcggcgttcggggggtcgggtgcggttagtcggatttcgttcgtcgtcgttcggtttcgttttcgtcgcgtcgtttttttcgtttttttcgttgtcgtggtaattcgggagtttttagggtcgcgtcgttcgcggagttgttcggtagcggtggcggcggcggttgtagtttcggtcgagtcgcgcgcgttgcgatttcgtttcgtagttcgttagtcgttttcgatttagtttagggtttcggcgtggttttcgattcggttttcgtattcgtttcgtcgtcgattttatggagttgttggtcgttgtttttagcgtcgtttgcgtcgtggattacgatagttttatttcggaaagcgacgcgcgcgattcggcggcgggatattgttcggtaggtgaggacgggcgtttgttatcggttttagcgcgtcgttttcgcgtgttttttttttaagtttagacgggggtttcgggtattttttgcgcggtttatttttattttttttttcggttttcgtcgtttttatttttatattcgtcgtcgggttcgtatttatcgggtgggtgttgagtttcggttcgggtttttggattcggtttttgttcggagttttttttacgttttcgtttt

SEQ ID NO: 17452 - DNA, 779 bp, Artificial Sequence
  chemically treated genomic DNA (Homo sapiens) CpG-island No: 17452
aaaacgaaaacgtaaaaaaaactccgaacaaaaaccgaatccaaaaacccgaaccgaaactcaacacccacccgataaatacgaacccgacgacgaatataaaaataaaaacgacgaaaaccgaaaaaaaaaataaaaataaaccgcgcaaaaaatacccgaaacccccgtctaaacttaaaaaaaaaacacgcgaaaacgacgcgctaaaaccgataacaaacgcccgtcctcacctaccgaacaatatcccgccgccgaatcgcgcgcgtcgctttccgaaataaaactatcgtaatccacgacgcaaacgacgctaaaaacaacgaccaacaactccataaaatcgacgacgaaacgaatacgaaaaccgaatcgaaaaccacgccgaaaccctaaactaaatcgaaaacgactaacgaactacgaaacgaaatcgcaacgcgcgcgactcgaccgaaactacaaccgccgccgccaccgctaccgaacaactccgcgaacgacgcgaccctaaaaactcccgaattaccacgacaacgaaaaaaacgaaaaaaacgacgcgacgaaaacgaaaccgaacgacgacgaacgaaatccgactaaccgcacccgaccccccgaacgccgactacgaactaaaacctaccgcgaacgcgcctttcctcccccgcgccgccgtaccccgacccgaaaaaaaacaaaactacgaaaaccctaaaactacgcctttacctaccccgcccactcctcacgacgaaaaaaacctaaaaaaaacg

SEQ ID NO: 17453 - DNA, 775 bp, Artificial Sequence
  chemically treated genomic DNA (Homo sapiens) CpG-island No: 17453
cgttcgttttcgtagttaaatttagattaagcgttaattgttttgcggcgttggatcgcgttagattcgtattaggatcgattatgttagcgtcgagttcgatagttttacgtttattttggcgtaagtcgcgtgtcgttgataatagtaattacggcgatgttttgttttacgttcgttgatgatgcgcgcgtttcgcgttcgagcgtacgtcggtttagcgtcgatagttgcgcggtttaggtgtcgcgtggggtaaagtaggtgtttcgcgtttaggcggtttcgcggttggttgtttttcgagtcggtcgcgttttttttagcgaggcgtggcggggaggcgtagtgaggttgggttcgtggcggttttttgaggagggtcgagaaggggtcgggggtgttaggggaacgggcgttggggtagcggtttcggtggatgttaagggtttcgggatcgggagagtttattacgtttgtttgttcggttgagaatcgttatggtaattttcgtttttttaaagtatcgggggttagggcgcgcgtcgtggagttttaggttgtttcggagaggcgcgggcgtcgaggttatcgtttttttttggggttaattttaacgcgtggcgaaaagatggagggataaggggtgttcggcggttcgcgtttgttgggggcgtagtagtcgcggagttaggttagtcgtttttttaggttttaggtcgtggttttgttgagtagtttttatatttagacggttgatgtggaaaataaaggg

SEQ ID NO: 17454 - DNA, 775 bp, Artificial Sequence
  chemically treated genomic DNA (Homo sapiens) CpG-island No: 17454
ccctttattttccacatcaaccgtctaaatataaaaactactcaacaaaaccacgacctaaaacctaaaaaaacgactaacctaactccgcgactactacgcccccaacaaacgcgaaccgccgaacaccccttatccctccatcttttcgccacgcgttaaaattaaccccaaaaaaaaacgataacctcgacgcccgcgcctctccgaaacaacctaaaactccacgacgcgcgccctaacccccgatactttaaaaaaacgaaaattaccataacgattctcaaccgaacaaacaaacgtaataaactctcccgatcccgaaacccttaacatccaccgaaaccgctaccccaacgcccgttcccctaacacccccgaccccttctcgaccctcctcaaaaaaccgccacgaacccaacctcactacgcctccccgccacgcctcgctaaaaaaaacgcgaccgactcgaaaaacaaccaaccgcgaaaccgcctaaacgcgaaacacctactttaccccacgcgacacctaaaccgcgcaactatcgacgctaaaccgacgtacgctcgaacgcgaaacgcgcgcatcatcaacgaacgtaaaacaaaacatcgccgtaattactattatcaacgacacgcgacttacgccaaaataaacgtaaaactatcgaactcgacgctaacataatcgatcctaatacgaatctaacgcgatccaacgccgcaaaacaattaacgcttaatctaaatttaactacgaaaacgaacg

SEQ ID NO: 17455 - DNA, 775 bp, Artificial Sequence
  chemically treated genomic DNA (Homo sapiens) CpG-island No: 17455
ttttttattttttatattaatcgtttgggtgtgggggttgtttaataggattacgatttaaaatttggaaagacggttggtttgatttcgcggttgttgcgtttttagtaggcgcggatcgtcgggtattttttgtttttttattttttcgttacgcgttgaggttgattttagggagaggcggtgatttcggcgttcgcgttttttcgggatagtttggggttttacggcgcgcgttttggttttcggtattttagggagacggggattattatggcgatttttagtcgagtaggtaggcgtggtggattttttcgatttcgaagtttttagtatttatcggggtcgttgttttagcgttcgtttttttagtattttcggttttttttcggttttttttagggaatcgttacgggtttagttttattacgttttttcgttacgtttcgttgggaggagcgcggtcggttcgggaggtagttagtcgcggagtcgtttggacgcgaggtatttgttttgttttacgcggtatttaggtcgcgtagttgtcggcgttgggtcggcgtgcgttcgggcgcggggcgcgcgtattattaacgggcgtggggtagggtatcgtcgtggttattgttgttagcgatacgcggtttgcgttagagtgagcgtagggttgtcgagttcggcgttggtatggtcggttttagtacgagtttagcgcggtttagcgtcgtaaagtagttggcgtttagtttggatttggttgcggaggcggacg

SEQ ID NO: 17456 - DNA, 775 bp, Artificial Sequence
  chemically treated genomic DNA (Homo sapiens) CpG-island No: 17456
cgtccgcctccgcaaccaaatccaaactaaacgccaactactttacgacgctaaaccgcgctaaactcgtactaaaaccgaccataccaacgccgaactcgacaaccctacgctcactctaacgcaaaccgcgtatcgctaacaacaataaccacgacgataccctaccccacgcccgttaataatacgcgcgccccgcgcccgaacgcacgccgacccaacgccgacaactacgcgacctaaataccgcgtaaaacaaaacaaatacctcgcgtccaaacgactccgcgactaactacctcccgaaccgaccgcgctcctcccaacgaaacgtaacgaaaaaacgtaataaaactaaacccgtaacgattccctaaaaaaaaccgaaaaaaaaccgaaaatactaaaaaaacgaacgctaaaacaacgaccccgataaatactaaaaacttcgaaatcgaaaaaatccaccacgcctacctactcgactaaaaatcgccataataatccccgtctccctaaaataccgaaaaccaaaacgcgcgccgtaaaaccccaaactatcccgaaaaaacgcgaacgccgaaatcaccgcctctccctaaaatcaacctcaacgcgtaacgaaaaaataaaaaaacaaaaaatacccgacgatccgcgcctactaaaaacgcaacaaccgcgaaatcaaaccaaccgtctttccaaattttaaatcgtaatcctattaaacaacccccacacccaaacgattaatataaaaaataaaaaa

SEQ ID NO: 17457 - DNA, 649 bp, Artificial Sequence
  chemically treated genomic DNA (Homo sapiens) CpG-island No: 17457
aaagttcgcgttaggtagtttattttaaaaattcgtcgagtcggtttggtgcgtgtacggggcgggcgcggagggcggggggcgggtatcggcgcgggtgtgtgggcgagaatacgtcggtaggtacgttcgcgtcgagtttcgggcggtttattgcgtttcggttaatggggacgcgcgtcgtagtttttgttttgattttagttcgtattttgatttcgcgtgcgtttcgttttttgttttcgtatttcgaggatttgtttatgaggtcgtttgggcggcgggtagcggggtgggatttcgcgtcggggagaggtagtttgcgtagggtcgaggggcggtcggagtcgggtttcgggattgttgcgggggacggtagttgtttatagcgtcggtgttttcgtatcggcgtcgtgtttttggaacgagggtaggatcgcgggtagcgtcgggttagcgcggagtttttttacgttgtgcgtttttgcgttttttttcgggttaggtggggataatttttcggtttttagcggttgcgtttcgggcgtgggcgatgcgtttttttcggtgggacgtagttgatttgatcgtttgggagaagtagtgtaagggaattgatttagggttgcgttatttttttttttttttt

SEQ ID NO: 17458 - DNA, 649 bp, Artificial Sequence
  chemically treated genomic DNA (Homo sapiens) CpG-island No: 17458
aaaaaaaaaaaaaaaataacgcaaccctaaatcaattcccttacactacttctcccaaacgatcaaatcaactacgtcccaccgaaaaaaacgcatcgcccacgcccgaaacgcaaccgctaaaaaccgaaaaattatccccacctaacccgaaaaaaaacgcaaaaacgcacaacgtaaaaaaactccgcgctaacccgacgctacccgcgatcctaccctcgttccaaaaacacgacgccgatacgaaaacaccgacgctataaacaactaccgtcccccgcaacaatcccgaaacccgactccgaccgcccctcgaccctacgcaaactacctctccccgacgcgaaatcccaccccgctacccgccgcccaaacgacctcataaacaaatcctcgaaatacgaaaacaaaaaacgaaacgcacgcgaaatcaaaatacgaactaaaatcaaaacaaaaactacgacgcgcgtccccattaaccgaaacgcaataaaccgcccgaaactcgacgcgaacgtacctaccgacgtattctcgcccacacacccgcgccgatacccgccccccgccctccgcgcccgccccgtacacgcaccaaaccgactcgacgaatttttaaaataaactacctaacgcgaacttt

SEQ ID NO: 17459 - DNA, 649 bp, Artificial Sequence
  chemically treated genomic DNA (Homo sapiens) CpG-island No: 17459
gagagggaaggaagagtagcgtagttttagattaatttttttgtattgttttttttagacggttaagttagttgcgttttatcgaaaagggcgtatcgtttacgttcgaaacgtagtcgttgggggtcgagaaattatttttatttggttcgaggggaaacgtaggagcgtatagcgtggaggggtttcgcgttggttcggcgttgttcgcggttttgttttcgttttaagggtacggcgtcggtacgaggatatcgacgttgtgggtaattgtcgtttttcgtagtaatttcggagttcggtttcggtcgtttttcggttttgcgtaggttgttttttttcgacgcggagttttatttcgttattcgtcgtttagacgattttataaataagttttcgaagtgcggaggtaggaggcggggcgtacgcggggttaggatgcgggttagggttagggtagaggttgcggcgcgcgtttttattggtcgggacgtagtgagtcgttcggagttcggcgcgggcgtgtttgtcggcgtgttttcgtttatatattcgcgtcggtgttcgtttttcgtttttcgcgttcgtttcgtgtacgtattaagtcggttcgacgagtttttaaagtgggttgtttggcgcggatttt

SEQ ID NO: 17460 - DNA, 649 bp, Artificial Sequence
  chemically treated genomic DNA (Homo sapiens) CpG-island No: 17460
aaaatccgcgccaaacaacccactttaaaaactcgtcgaaccgacttaatacgtacacgaaacgaacgcgaaaaacgaaaaacgaacaccgacgcgaatatataaacgaaaacacgccgacaaacacgcccgcgccgaactccgaacgactcactacgtcccgaccaataaaaacgcgcgccgcaacctctaccctaaccctaacccgcatcctaaccccgcgtacgccccgcctcctacctccgcacttcgaaaacttatttataaaatcgtctaaacgacgaataacgaaataaaactccgcgtcgaaaaaaaacaacctacgcaaaaccgaaaaacgaccgaaaccgaactccgaaattactacgaaaaacgacaattacccacaacgtcgatatcctcgtaccgacgccgtacccttaaaacgaaaacaaaaccgcgaacaacgccgaaccaacgcgaaacccctccacgctatacgctcctacgtttcccctcgaaccaaataaaaataatttctcgacccccaacgactacgtttcgaacgtaaacgatacgcccttttcgataaaacgcaactaacttaaccgtctaaaaaaaacaatacaaaaaaattaatctaaaactacgctactcttccttccctctc

SEQ ID NO: 17461 - DNA, 595 bp, Artificial Sequence
  chemically treated genomic DNA (Homo sapiens) CpG-island No: 17461
cgcggcgcggttcgcgggatgttgggggtcgggtttttttcgagcgtcgtggtttttttgtttcggcgcggcgggtcgggtggggttaggttttgggagcgcgcgtcggattttagcgtcgggtcggcggaggggcggggtcgggtacgtgttttcgggtcgttttttttttcgttacgtgattcgtttagggtagggtcggggttgggttgggggtcgcgagtttaggcgtttgagatttattgattggtcgcgggtagggttgataggcggtggggcggttcggtttttggcggagtcggcggcgggcggggacgcggcgttgggaggacgcggcggcgttgggaacggacgtttgggcgtttcgaggcgtcgggatgtggagcgggtaggttcgcgcgcgttcgcggtttcgcgttgggtttgggtcgcggtcgtttttcgggacgggaggatttcgggggttttcgtcgggtttgcgtcgttattcggaggtgttgtgcgttttcgttttgtttgtaggcgagtcgatttgtagttaggagatttcgggggaggggtcgggggtgtttttcggggtgtagggtgcgaaggg

SEQ ID NO: 17462 - DNA, 595 bp, Artificial Sequence
  chemically treated genomic DNA (Homo sapiens) CpG-island No: 17462
cccttcgcaccctacaccccgaaaaacacccccgacccctcccccgaaatctcctaactacaaatcgactcgcctacaaacaaaacgaaaacgcacaacacctccgaataacgacgcaaacccgacgaaaacccccgaaatcctcccgtcccgaaaaacgaccgcgacccaaacccaacgcgaaaccgcgaacgcgcgcgaacctacccgctccacatcccgacgcctcgaaacgcccaaacgtccgttcccaacgccgccgcgtcctcccaacgccgcgtccccgcccgccgccgactccgccaaaaaccgaaccgccccaccgcctatcaaccctacccgcgaccaatcaataaatctcaaacgcctaaactcgcgacccccaacccaaccccgaccctaccctaaacgaatcacgtaacgaaaaaaaaaacgacccgaaaacacgtacccgaccccgcccctccgccgacccgacgctaaaatccgacgcgcgctcccaaaacctaaccccacccgacccgccgcgccgaaacaaaaaaaccacgacgctcgaaaaaaacccgacccccaacatcccgcgaaccgcgccgcg

SEQ ID NO: 17463 - DNA, 595 bp, Artificial Sequence
  chemically treated genomic DNA (Homo sapiens) CpG-island No: 17463
tttttcgtattttgtatttcgagagatattttcgatttttttttcggagttttttggttgtaagtcggttcgtttgtaggtagggcgggggcgtatagtattttcgggtggcggcgtagattcggcggggattttcgaaattttttcgtttcgggaggcgatcgcggtttagatttagcgcgggatcgcgagcgcgcgcggatttattcgttttatatttcggcgtttcggggcgtttaggcgttcgtttttagcgtcgtcgcgtttttttagcgtcgcgttttcgttcgtcgtcgatttcgttaggggtcgagtcgttttatcgtttgttagttttgttcgcggttagttagtaggttttagacgtttgggttcgcggtttttagtttagtttcgattttgttttgggcgggttacgtggcggaggggggagcggttcgaggatacgtgttcggtttcgttttttcgtcggttcggcgttgggattcggcgcgcgtttttaaggtttggttttattcggttcgtcgcgtcgggatagggagattacggcgttcggagggaattcggtttttaatatttcgcgggtcgcgtcgcg

SEQ ID NO: 17464 - DNA, 595 bp, Artificial Sequence
  chemically treated genomic DNA (Homo sapiens) CpG-island No: 17464
cgcgacgcgacccgcgaaatattaaaaaccgaattccctccgaacgccgtaatctccctatcccgacgcgacgaaccgaataaaaccaaaccttaaaaacgcgcgccgaatcccaacgccgaaccgacgaaaaaacgaaaccgaacacgtatcctcgaaccgctcccccctccgccacgtaacccgcccaaaacaaaatcgaaactaaactaaaaaccgcgaacccaaacgtctaaaacctactaactaaccgcgaacaaaactaacaaacgataaaacgactcgacccctaacgaaatcgacgacgaacgaaaacgcgacgctaaaaaaacgcgacgacgctaaaaacgaacgcctaaacgccccgaaacgccgaaatataaaacgaataaatccgcgcgcgctcgcgatcccgcgctaaatctaaaccgcgatcgcctcccgaaacgaaaaaatttcgaaaatccccgccgaatctacgccgccacccgaaaatactatacgcccccgccctacctacaaacgaaccgacttacaaccaaaaaactccgaaaaaaaaatcgaaaatatctctcgaaatacaaaatacgaaaaa

SEQ ID NO: 17465 - DNA, 883 bp, Artificial Sequence
  chemically treated genomic DNA (Homo sapiens) CpG-island No: 17465
gacgcgcggttggaagttttttaggtttcgttgtttatagatcgggatttcgttttcggttttcgagggcgtggcgaggcgttgcgggacgtttaataggtgcgtgttgtgtttttaggtttcgcgtttcgggtggagttaagagtttggaagtcggtagttcgggaaaagggggcgggacggtgtttcggggtagggttgggtggcggtcgttgttttttcgggaggggcgggtcgtttcgacgtcgttttttttggcggttaatggagatcgaggtttcgcgtttggattggagcggacgcgggggttagttagttttgggggtcggggtttggtcgggggcgggggggtaggcgaggcgaggcgggcgtcgttcgcgcggttataaggcggggagttttttgcgtcgcgagtcgggaggcgtacgttcgttcgtacggcggtcgcggcggtagggcggggtcggagtagcgggcggcggcggaggcggcgttcgggagcgtttttcgtttttttcggggttttgttcggatttcggttatcgtttgggatttttaggattcgtgcgtgtagtatgggcggcgtcggggagtcgggatcgcgggagggattcgcgtagtcgggggcgtcgttgtttattttttgttgggagtagattcgcgcgtacgattagttcggcgataagtggttggttatcgagcgtcgcgtttacgatattagtcgttgggtatagcggtatttagggggtagtcgttttatcggttattacggcgttgaggacgttacggtaaggaagttataaggaagttatttatcggcgggtggagtttggagttcggtcgtgggcgtgatgtttcgttttatttgtggggttttagtatt

SEQ ID NO: 17466 - DNA, 883 bp, Artificial Sequence
  chemically treated genomic DNA (Homo sapiens) CpG-island No: 17466
aatactaaaaccccacaaataaaacgaaacatcacgcccacgaccgaactccaaactccacccgccgataaataacttccttataacttccttaccgtaacgtcctcaacgccgtaataaccgataaaacgactaccccctaaataccgctatacccaacgactaatatcgtaaacgcgacgctcgataaccaaccacttatcgccgaactaatcgtacgcgcgaatctactcccaacaaaaaataaacaacgacgcccccgactacgcgaatccctcccgcgatcccgactccccgacgccgcccatactacacgcacgaatcctaaaaatcccaaacgataaccgaaatccgaacaaaaccccgaaaaaaacgaaaaacgctcccgaacgccgcctccgccgccgcccgctactccgaccccgccctaccgccgcgaccgccgtacgaacgaacgtacgcctcccgactcgcgacgcaaaaaactccccgccttataaccgcgcgaacgacgcccgcctcgcctcgcctacccccccgcccccgaccaaaccccgacccccaaaactaactaacccccgcgtccgctccaatccaaacgcgaaacctcgatctccattaaccgccaaaaaaaacgacgtcgaaacgacccgcccctcccgaaaaaacaacgaccgccacccaaccctaccccgaaacaccgtcccgcccccttttcccgaactaccgacttccaaactcttaactccacccgaaacgcgaaacctaaaaacacaacacgcacctattaaacgtcccgcaacgcctcgccacgccctcgaaaaccgaaaacgaaatcccgatctataaacaacgaaacctaaaaaacttccaaccgcgcgtc

SEQ ID NO: 17467 - DNA, 883 bp, Artificial Sequence
  chemically treated genomic DNA (Homo sapiens) CpG-island No: 17467
gatgttaaggttttataggtggagcgggatattacgtttacgatcgagttttaggttttattcgtcggtgggtggtttttttatggtttttttatcgtggcgtttttagcgtcgtggtggtcgatgaggcggttgttttttgggtgtcgttgtgtttagcggttgatgtcgtagacgcggcgttcgatgattagttatttgtcgtcgggttggtcgtgcgcgcggatttgtttttagtagaaggtgggtagcggcgttttcggttgcgcgggtttttttcgcggtttcggtttttcgacgtcgtttatgttgtacgtacgagttttggggattttaggcggtggtcgaggttcgagtaagatttcgagggaagcgaagagcgttttcgggcgtcgttttcgtcgtcgttcgttgtttcggtttcgttttgtcgtcgcggtcgtcgtacgagcgagcgtgcgtttttcggttcgcggcgtagggaatttttcgttttataatcgcgcggacggcgttcgtttcgtttcgtttgttttttcgttttcggttaggtttcggtttttaaggttggttgattttcgcgttcgttttaatttaggcgcggggtttcggtttttattggtcgttagggagggcggcgtcgaggcggttcgtttttttcgggaggatagcggtcgttatttagttttgtttcggggtatcgtttcgtttttttttttcgggttgtcggtttttaggtttttgattttattcggagcgcggggtttggggatataatacgtatttgttgggcgtttcgtagcgtttcgttacgttttcgggaatcggaggcggagtttcggtttgtgagtagcggggtttggggggtttttagtcgcgcgtt

SEQ ID NO: 17468 - DNA, 883 bp, Artificial Sequence
  chemically treated genomic DNA (Homo sapiens) CpG-island No: 17468
aacgcgcgactaaaaaccccccaaaccccgctactcacaaaccgaaactccgcctccgattcccgaaaacgtaacgaaacgctacgaaacgcccaacaaatacgtattatatccccaaaccccgcgctccgaataaaatcaaaaacctaaaaaccgacaacccgaaaaaaaaaaacgaaacgataccccgaaacaaaactaaataacgaccgctatcctcccgaaaaaaacgaaccgcctcgacgccgccctccctaacgaccaataaaaaccgaaaccccgcgcctaaattaaaacgaacgcgaaaatcaaccaaccttaaaaaccgaaacctaaccgaaaacgaaaaaacaaacgaaacgaaacgaacgccgtccgcgcgattataaaacgaaaaattccctacgccgcgaaccgaaaaacgcacgctcgctcgtacgacgaccgcgacgacaaaacgaaaccgaaacaacgaacgacgacgaaaacgacgcccgaaaacgctcttcgcttccctcgaaatcttactcgaacctcgaccaccgcctaaaatccccaaaactcgtacgtacaacataaacgacgtcgaaaaaccgaaaccgcgaaaaaaacccgcgcaaccgaaaacgccgctacccaccttctactaaaaacaaatccgcgcgcacgaccaacccgacgacaaataactaatcatcgaacgccgcgtctacgacatcaaccgctaaacacaacgacacccaaaaaacaaccgcctcatcgaccaccacgacgctaaaaacgccacgataaaaaaaccataaaaaaaccacccaccgacgaataaaacctaaaactcgatcgtaaacgtaatatcccgctccacctataaaaccttaacatc

SEQ ID NO: 17469 - DNA, 597 bp, Artificial Sequence
  chemically treated genomic DNA (Homo sapiens) CpG-island No: 17469
tttcgcgttttaggttgcgtttttatttttagtttttacgtttggcgtacgtagttacgtattatggcgtttcgtaggtagtcgaagatttcggttgcggttcgaggttcgacggcggtatgtacggtttgcgtaggttgtagggtagttcgtcggggtcgcgcgagtagaattcgtagagttttgtcggtttatagtgcgttttgtcgtcggtaatggcgtaggtgtcgttgagttggcgttcgatgggaaagtggtggaagcgtatatcgtgtacgagcgatatatatagtcgtttagcgagcgtaggtattggcgtacgaggaagagttcgttcgttatgttcgttagttttaggtgtttttcggtttcggtacgcgagatgttgtcgtagaagaagggtaggtgcgtcgcggggtttggtatcgtttttgggtttttcgaaatttgcgggtttatagagggtcggaggtacgttagggtttttttgaatttggtgcgttgggtttaaagacggcgcgagagacgttaagtggagggtattagtgtcgtagattgagttcgttaagggggtagagtttgttttgtgttagagtt

SEQ ID NO: 17470 - DNA, 597 bp, Artificial Sequence
  chemically treated genomic DNA (Homo sapiens) CpG-island No: 17470
aactctaacacaaaacaaactctacccccttaacgaactcaatctacgacactaataccctccacttaacgtctctcgcgccgtctttaaacccaacgcaccaaattcaaaaaaaccctaacgtacctccgaccctctataaacccgcaaatttcgaaaaacccaaaaacgataccaaaccccgcgacgcacctacccttcttctacgacaacatctcgcgtaccgaaaccgaaaaacacctaaaactaacgaacataacgaacgaactcttcctcgtacgccaatacctacgctcgctaaacgactatatatatcgctcgtacacgatatacgcttccaccactttcccatcgaacgccaactcaacgacacctacgccattaccgacgacaaaacgcactataaaccgacaaaactctacgaattctactcgcgcgaccccgacgaactaccctacaacctacgcaaaccgtacataccgccgtcgaacctcgaaccgcaaccgaaatcttcgactacctacgaaacgccataatacgtaactacgtacgccaaacgtaaaaactaaaaataaaaacgcaacctaaaacgcgaaa

SEQ ID NO: 17471 - DNA, 597 bp, Artificial Sequence
  chemically treated genomic DNA (Homo sapiens) CpG-island No: 17471
gattttggtatagagtaggttttgtttttttggcgagtttagtttgcggtattgatgttttttatttggcgtttttcgcgtcgtttttgggtttaacgtattaggtttaggaaggttttgacgtgttttcgattttttgtgaattcgtaggtttcgggaggtttaggggcgatgttagatttcgcggcgtatttgttttttttttacggtagtatttcgcgtgtcgaggtcgaggagtatttgaagttggcgggtatggcggacgggttttttttcgtgcgttagtgtttgcgttcgttgggcggttatgtgtgtcgttcgtgtacgatgtgcgtttttattatttttttatcgagcgttagtttaacggtatttacgttattgtcggcggtaaagcgtattgtggatcggtagagttttgcgagttttattcgcgcgatttcgacgggttgttttgtaatttgcgtaagtcgtgtatatcgtcgtcgggtttcgagtcgtagtcggggttttcgattgtttgcgagacgttatggtgcgtgattacgtgcgttagacgtggaagttggaggtgagagcgtagtttggggcgcgggg

SEQ ID NO: 17472 - DNA, 597 bp, Artificial Sequence
  chemically treated genomic DNA (Homo sapiens) CpG-island No: 17472
ccccgcgccccaaactacgctctcacctccaacttccacgtctaacgcacgtaatcacgcaccataacgtctcgcaaacaatcgaaaaccccgactacgactcgaaacccgacgacgatatacacgacttacgcaaattacaaaacaacccgtcgaaatcgcgcgaataaaactcgcaaaactctaccgatccacaatacgctttaccgccgacaataacgtaaataccgttaaactaacgctcgataaaaaaataataaaaacgcacatcgtacacgaacgacacacataaccgcccaacgaacgcaaacactaacgcacgaaaaaaaacccgtccgccatacccgccaacttcaaatactcctcgacctcgacacgcgaaatactaccgtaaaaaaaaaacaaatacgccgcgaaatctaacatcgcccctaaacctcccgaaacctacgaattcacaaaaaatcgaaaacacgtcaaaaccttcctaaacctaatacgttaaacccaaaaacgacgcgaaaaacgccaaataaaaaacatcaataccgcaaactaaactcgccaaaaaaacaaaacctactctataccaaaatc

SEQ ID NO: 17473 - DNA, 594 bp, Artificial Sequence
  chemically treated genomic DNA (Homo sapiens) CpG-island No: 17473
gcggaggaagatcgtcggggttttgtagttaacggagcggtcgttcgatttcgggacgtttatttttcggtcggtttttcggatgggtttgtagcgatatatatatatttttttgggatttgtttttcggtatttttttcgcgcgattttattttcggttttaagtaggtttaggtagaagtattatttcgtcggtagtcgttttttggatatgtttttcgttgggaattcgagttttatatttttgttttatcgtcgtttcggtttttgtttagtattatttttttatttgttttgcgtatttttcgcgagtttcggggtttttagttgacgatcgtttttatttttttttttttcgtttgtcgcggttttttataaacggggttaaattgttcgttgtaacgataatcgttattggttagagtcgtttacgcgcggtaagtggtcgtttatttgagttcgcgttgttttatgggagttttagtttttttttttagagatcgttgagatattgggggaatgcggtggtagaatatacgtcgatttagcggttgtaaagtttaggttttgttttggagttggagtgtttttggt

SEQ ID NO: 17474 - DNA, 594 bp, Artificial Sequence
  chemically treated genomic DNA (Homo sapiens) CpG-island No: 17474
accaaaaacactccaactccaaaacaaaacctaaactttacaaccgctaaatcgacgtatattctaccaccgcattcccccaatatctcaacgatctctaaaaaaaaaaactaaaactcccataaaacaacgcgaactcaaataaacgaccacttaccgcgcgtaaacgactctaaccaataacgattatcgttacaacgaacaatttaaccccgtttataaaaaaccgcgacaaacgaaaaaaaaaaaaataaaaacgatcgtcaactaaaaaccccgaaactcgcgaaaaatacgcaaaacaaataaaaaaataatactaaacaaaaaccgaaacgacgataaaacaaaaatataaaactcgaattcccaacgaaaaacatatccaaaaaacgactaccgacgaaataatacttctacctaaacctacttaaaaccgaaaataaaatcgcgcgaaaaaaataccgaaaaacaaatcccaaaaaaatatatatatatcgctacaaacccatccgaaaaaccgaccgaaaaataaacgtcccgaaatcgaacgaccgctccgttaactacaaaaccccgacgatcttcctccgc

SEQ ID NO: 17475 - DNA, 594 bp, Artificial Sequence
  chemically treated genomic DNA (Homo sapiens) CpG-island No: 17475
gttagaagtattttaattttaaggtagagtttgagttttatagtcgttaggtcggcgtatgttttattatcgtatttttttagtgttttagcggtttttgaaggagagaattaaaatttttataagataacgcgagtttaggtgggcggttatttgtcgcgcgtgggcggttttgattaataacgattgtcgttatagcgaatagtttggtttcgtttgtaaaaggtcgcggtaggcgaagagagaagaggtgagggcggtcgttagttaagggtttcggggttcgcggggggtgcgtagggtaggtaagggggtagtgttgagtaaggatcggggcggcggtggggtaggggtgtagagttcgggtttttagcggaaagtatgtttaaggagcggttgtcggcgaggtgatgtttttgtttgggtttatttgggatcggaagtgaagtcgcgcgaggaggatgtcgggaagtaggttttaaggggatatgtgtgtgtcgttgtagatttattcgagaaatcggtcgggaggtgagcgtttcggagtcgggcgatcgtttcgttgattgtagggtttcggcggttttttttcgt

SEQ ID NO: 17476 - DNA, 594 bp, Artificial Sequence
  chemically treated genomic DNA (Homo sapiens) CpG-island No: 17476
acgaaaaaaaaccgccgaaaccctacaatcaacgaaacgatcgcccgactccgaaacgctcacctcccgaccgatttctcgaataaatctacaacgacacacacatatccccttaaaacctacttcccgacatcctcctcgcgcgacttcacttccgatcccaaataaacccaaacaaaaacatcacctcgccgacaaccgctccttaaacatactttccgctaaaaacccgaactctacacccctaccccaccgccgccccgatccttactcaacactacccccttacctaccctacgcaccccccgcgaaccccgaaacccttaactaacgaccgccctcacctcttctctcttcgcctaccgcgaccttttacaaacgaaaccaaactattcgctataacgacaatcgttattaatcaaaaccgcccacgcgcgacaaataaccgcccacctaaactcgcgttatcttataaaaattttaattctctccttcaaaaaccgctaaaacactaaaaaaatacgataataaaacatacgccgacctaacgactataaaactcaaactctaccttaaaattaaaatacttctaac

SEQ ID NO: 17477 - DNA, 925 bp, Artificial Sequence
  chemically treated genomic DNA (Homo sapiens) CpG-island No: 17477
attcgcgacgttcgcgatttttaatatggcgttttatttttttttagggtattttttgtttgttttttgtatatatagtcgcgcgaggcgtagttttgagtgatttacgtacgagtggttcgcgtttttagtcgcgtcgtcgtaggttagcgagggtagtttgagtcgtttttcgtttcggcgaggatcgtcgttagttcgttgttttagtaggaggcggttttatagcgtattcggtagtttagttatcgttagtatcgcgtttcgggcgggtttttttttttttcgggaggcgcgaatttttaggggttttttgagagggcgttagggagtagttgcgcgcggatgttttttggttttttgcggtcgtcgtagtttttcggtagaaattcggaagtggaattttgagttatttagcgtttgggtgaagacggaggcgggttttatagagacgtaggttgttagggagtgtttatttcgcgttcgtttttgttttttcgcgtttttgtgttgtttcgatttatatattcgtttagaatcggttttagttttttcgcgtagaagtttttcggagttatggtcgagtatttttacgtgaagtttattaagttcgtgtttaagggaattaagacgaagaggtgggttttgtagtttgggcgggagtttttttcgtttttttcggacgtattttattttcgtaatttcggtggaagtcgtggcgcggagagtcggttttgtggttttttaggtttcgttttggtttttgttcgggttggacggaggtcgggtcgcggttttcggcgtttgtgtagagaggggtagtttttcgcgcggacgattttggaaataggatagacgggtaggtgattcgtgatttcgtatttacgagtttgggttttttgaggtatttttttaggtttttgtt

SEQ ID NO: 17478 - DNA, 925 bp, Artificial Sequence
  chemically treated genomic DNA (Homo sapiens) CpG-island No: 17478
aacaaaaacctaaaaaaatacctcaaaaaacccaaactcgtaaatacgaaatcacgaatcacctacccgtctatcctatttccaaaatcgtccgcgcgaaaaactacccctctctacacaaacgccgaaaaccgcgacccgacctccgtccaacccgaacaaaaaccaaaacgaaacctaaaaaaccacaaaaccgactctccgcgccacgacttccaccgaaattacgaaaataaaatacgtccgaaaaaaacgaaaaaaactcccgcccaaactacaaaacccacctcttcgtcttaattcccttaaacacgaacttaataaacttcacgtaaaaatactcgaccataactccgaaaaacttctacgcgaaaaaactaaaaccgattctaaacgaatatataaatcgaaacaacacaaaaacgcgaaaaaacaaaaacgaacgcgaaataaacactccctaacaacctacgtctctataaaacccgcctccgtcttcacccaaacgctaaataactcaaaattccacttccgaatttctaccgaaaaactacgacgaccgcaaaaaaccaaaaaacatccgcgcgcaactactccctaacgccctctcaaaaaacccctaaaaattcgcgcctcccgaaaaaaaaaaaaacccgcccgaaacgcgatactaacgataactaaactaccgaatacgctataaaaccgcctcctactaaaacaacgaactaacgacgatcctcgccgaaacgaaaaacgactcaaactaccctcgctaacctacgacgacgcgactaaaaacgcgaaccactcgtacgtaaatcactcaaaactacgcctcgcgcgactatatatacaaaaaacaaacaaaaaataccctaaaaaaaaataaaacgccatattaaaaatcgcgaacgtcgcgaat

SEQ ID NO: 17479 - DNA, 925 bp, Artificial Sequence
  chemically treated genomic DNA (Homo sapiens) CpG-island No: 17479
ggtagaggtttggagagatgttttaggggatttaaattcgtgggtacggggttacgggttatttgttcgtttattttgtttttagggtcgttcgcgcgggaggttgtttttttttgtatagacgtcgggaatcgcggttcggttttcgtttagttcggataggggttagggcgaagtttgggaggttataaagtcggtttttcgcgttacggtttttatcggagttgcgggggtggagtgcgttcgaaaagaacggaggaggttttcgtttaagttgtaggatttattttttcgttttggtttttttgagtacgagtttggtagattttacgtaggagtattcggttatggtttcgggaaatttttgcgcggagaggttgaggtcggttttggacgagtatgtgagtcggggtagtataggggcgcggagaaatagaagcggacgcgaaataaatattttttgatagtttacgtttttgtagaattcgttttcgtttttatttaaacgttgaatggtttagagttttattttcgggtttttgtcggggagttacggcggtcgtagagggttaaaaggtattcgcgcgtagttgttttttggcgtttttttaaggagtttttgaggattcgcgtttttcggaagggagaaaagttcgttcgaggcgcggtgttgacggtggttgggttgtcgggtgcgttgtggaatcgttttttgttagagtagcgggttggcgacggttttcgtcggggcgggaagcggtttaggttgttttcgttggtttgcggcggcgcggttggaagcgcgggttattcgtgcgtgggttatttaggattgcgtttcgcgcgattgtgtgtgtaggaaataagtaggaaatattttaaaagagaatgaagcgttatgttgagggtcgcggacgtcgcgagt

SEQ ID NO: 17480 - DNA, 925 bp, Artificial Sequence
  chemically treated genomic DNA (Homo sapiens) CpG-island No: 17480
actcgcgacgtccgcgaccctcaacataacgcttcattctcttttaaaatatttcctacttatttcctacacacacaatcgcgcgaaacgcaatcctaaataacccacgcacgaataacccgcgcttccaaccgcgccgccgcaaaccaacgaaaacaacctaaaccgcttcccgccccgacgaaaaccgtcgccaacccgctactctaacaaaaaacgattccacaacgcacccgacaacccaaccaccgtcaacaccgcgcctcgaacgaacttttctcccttccgaaaaacgcgaatcctcaaaaactccttaaaaaaacgccaaaaaacaactacgcgcgaataccttttaaccctctacgaccgccgtaactccccgacaaaaacccgaaaataaaactctaaaccattcaacgtttaaataaaaacgaaaacgaattctacaaaaacgtaaactatcaaaaaatatttatttcgcgtccgcttctatttctccgcgcccctatactaccccgactcacatactcgtccaaaaccgacctcaacctctccgcgcaaaaatttcccgaaaccataaccgaatactcctacgtaaaatctaccaaactcgtactcaaaaaaaccaaaacgaaaaaataaatcctacaacttaaacgaaaacctcctccgttcttttcgaacgcactccacccccgcaactccgataaaaaccgtaacgcgaaaaaccgactttataacctcccaaacttcgccctaacccctatccgaactaaacgaaaaccgaaccgcgattcccgacgtctatacaaaaaaaaacaacctcccgcgcgaacgaccctaaaaacaaaataaacgaacaaataacccgtaaccccgtacccacgaatttaaatcccctaaaacatctctccaaacctctacc

SEQ ID NO: 17481 - DNA, 579 bp, Artificial Sequence
  chemically treated genomic DNA (Homo sapiens) CpG-island No: 17481
gggagtttttattgtggtcggtttggaaatcggaaaggagagcgaagttacgatgttgtttttttacgtttcgttggaggtttttgtgttttcgtagagttcgggaaatagttaacgtggtcgcgttttcgggggcgggagatacgcgagtaataggtttttttgtagagggcgaaggagcgtggaattcggaattacggtttattcggttcgagtgtgattttcgtgtggacgggtttgttcgtttcgcgttttgttgtttaacgcggggtcgtgtcgtttgtgaattacgtggatggaaaacggataattattcgcgtttcggtttattgtttttattttttgggaggcggaattcgttcgaattgtttcgggatgaagtgattcgggtcggcgattcggagggttggtgagttggtgggcgtttcgtaagtagacgcggttgtgggtcgagttttcggtttgtatcgggtattttacgttttttcggagtgcgaggtttcgttggttttggaggcggaagatcgtttttttttttgtttttttttttgtttttttttttgttttttgttttttttt

SEQ ID NO: 17482 - DNA, 579 bp, Artificial Sequence
  chemically treated genomic DNA (Homo sapiens) CpG-island No: 17482
aaaaaaaaacaaaaaacaaaaaaaaaaacaaaaaaaaaaacaaaaaaaaaaacgatcttccgcctccaaaaccaacgaaacctcgcactccgaaaaaacgtaaaatacccgatacaaaccgaaaactcgacccacaaccgcgtctacttacgaaacgcccaccaactcaccaaccctccgaatcgccgacccgaatcacttcatcccgaaacaattcgaacgaattccgcctcccaaaaaataaaaacaataaaccgaaacgcgaataattatccgttttccatccacgtaattcacaaacgacacgaccccgcgttaaacaacaaaacgcgaaacgaacaaacccgtccacacgaaaatcacactcgaaccgaataaaccgtaattccgaattccacgctccttcgccctctacaaaaaaacctattactcgcgtatctcccgcccccgaaaacgcgaccacgttaactatttcccgaactctacgaaaacacaaaaacctccaacgaaacgtaaaaaaacaacatcgtaacttcgctctcctttccgatttccaaaccgaccacaataaaaactccc

SEQ ID NO: 17483 - DNA, 579 bp, Artificial Sequence
  chemically treated genomic DNA (Homo sapiens) CpG-island No: 17483
gaaagggagtaagagatagagaggaaagtagagaggaaagtagagaggaaagcggtttttcgtttttagggttagcgggatttcgtatttcgggaaaacgtggggtgttcggtgtaggtcgagagttcggtttatagtcgcgtttgtttgcggggcgtttattagtttattagtttttcggatcgtcggttcgggttattttatttcggagtaattcggacgaatttcgttttttaaggaatgagagtaatgagtcgagacgcgggtgattgttcgttttttatttacgtggtttatagacgatacggtttcgcgttgagtaatagagcgcgaggcggataggttcgtttatacgggagttatattcgggtcgagtgaatcgtgatttcgggttttacgttttttcgttttttgtaaggggatttgttgttcgcgtgtttttcgttttcgaaagcgcgattacgttggttgtttttcgagttttgcggggatatagaaatttttagcgaagcgtggaaaagtagtatcgtgatttcgttttttttttcggtttttagatcggttatagtggagattttt

SEQ ID NO: 17484 - DNA, 579 bp, Artificial Sequence
  chemically treated genomic DNA (Homo sapiens) CpG-island No: 17484
aaaaatctccactataaccgatctaaaaaccgaaaaaaaaaacgaaatcacgatactacttttccacgcttcgctaaaaatttctatatccccgcaaaactcgaaaaacaaccaacgtaatcgcgctttcgaaaacgaaaaacacgcgaacaacaaatccccttacaaaaaacgaaaaaacgtaaaacccgaaatcacgattcactcgacccgaatataactcccgtataaacgaacctatccgcctcgcgctctattactcaacgcgaaaccgtatcgtctataaaccacgtaaataaaaaacgaacaatcacccgcgtctcgactcattactctcattccttaaaaaacgaaattcgtccgaattactccgaaataaaataacccgaaccgacgatccgaaaaactaataaactaataaacgccccgcaaacaaacgcgactataaaccgaactctcgacctacaccgaacaccccacgttttcccgaaatacgaaatcccgctaaccctaaaaacgaaaaaccgctttcctctctactttcctctctactttcctctctatctcttactccctttc

SEQ ID NO: 17485 - DNA, 814 bp, Artificial Sequence
  chemically treated genomic DNA (Homo sapiens) CpG-island No: 17485
ggagtcgcgagggagaggagggtttagagttcggagtgggcggtgtttgagtaggggcggggcggggtcggggtttggagttggggacgcgggtcggggtcgggagttgcggattcgttggcgggtgggaggagcggaatcggggggaggttggcggaaatttaggggatcgttcggttgggttttgcgtatttcggattattagtttcgggcgttggtttttatcgaggttgtttaggcgtcgttttttcgcgtttttgcgataggaggcgtttgttgggcgcgttatggatttcgtttcgcggagacgtttggttcgggttttgtttttagtgagcggttggagcggtcgcggggtcgtagagttttcgggatttcgaggaagggcgtttttcggagttgttcgaggtcgggttcggcgtttattcgttattcgtttcgttttttttcggtttcgtatcgttttttatttcgtttttttcgggttttttttgcgttcggtagagtttgcgcgttttattcggacggttacggattcgtagtttcggcgaggacgttgtttgcgtttcgattgtttggattttttcgcgtggttttcggcgaagtttagtagtcggagggtgttaggttcgtttgacgcgtttttttttacgggaagaacggggcgggggtttaggagggacgtaagtcgggttttttcggcgtgttgattcgaattcgcgcgggaaaatttgcgtaaattaaaggagggaagagttaggtagtttttagttttttagggaggtttaggtgaaaaatagacgtcggtttcgtt

SEQ ID NO: 17486 - DNA, 814 bp, Artificial Sequence
  chemically treated genomic DNA (Homo sapiens) CpG-island No: 17486
aacgaaaccgacgtctatttttcacctaaacctccctaaaaaactaaaaactacctaactcttccctcctttaatttacgcaaattttcccgcgcgaattcgaatcaacacgccgaaaaaacccgacttacgtccctcctaaacccccgccccgttcttcccgtaaaaaaaaacgcgtcaaacgaacctaacaccctccgactactaaacttcgccgaaaaccacgcgaaaaaatccaaacaatcgaaacgcaaacaacgtcctcgccgaaactacgaatccgtaaccgtccgaataaaacgcgcaaactctaccgaacgcaaaaaaaacccgaaaaaaacgaaataaaaaacgatacgaaaccgaaaaaaaacgaaacgaataacgaataaacgccgaacccgacctcgaacaactccgaaaaacgcccttcctcgaaatcccgaaaactctacgaccccgcgaccgctccaaccgctcactaaaaacaaaacccgaaccaaacgtctccgcgaaacgaaatccataacgcgcccaacaaacgcctcctatcgcaaaaacgcgaaaaaacgacgcctaaacaacctcgataaaaaccaacgcccgaaactaataatccgaaatacgcaaaacccaaccgaacgatcccctaaatttccgccaacctccccccgattccgctcctcccacccgccaacgaatccgcaactcccgaccccgacccgcgtccccaactccaaaccccgaccccgccccgcccctactcaaacaccgcccactccgaactctaaaccctcctctccctcgcgactcc

SEQ ID NO: 17487 - DNA, 814 bp, Artificial Sequence
  chemically treated genomic DNA (Homo sapiens) CpG-island No: 17487
ggcgaggtcggcgtttgttttttatttgggtttttttggggggttgggggttgtttgattttttttttttttggtttgcgtaagttttttcgcgcgggttcggattaatacgtcgggggagttcggtttacgttttttttggattttcgtttcgtttttttcgtggggaggggcgcgttaggcggatttggtatttttcgattgttgggtttcgtcgggagttacgcggggaggtttaggtagtcgggacgtaggtagcgttttcgtcgaggttgcgagttcgtggtcgttcgggtgaggcgcgtaggttttgtcggacgtagaaggaattcgaaggaggcggggtggagggcggtgcggggtcggggaggggcgaggcgagtggcgagtggacgtcgggttcggtttcgggtaatttcgaggggcgttttttttcggggtttcggaggttttgcgatttcgcggtcgttttagtcgtttattggggataaggttcgagttaggcgttttcgcgaggcggggtttatagcgcgtttagtaggcgttttttgtcgtagggacgcgggggagcggcgtttgaatagtttcggtgggaattagcgttcgaagttggtgattcggggtgcgtagggtttagtcgggcgattttttggattttcgttagttttttttcgatttcgttttttttattcgttagcgagttcgtaattttcggtttcggttcgcgtttttagttttaggtttcggtttcgtttcgtttttgtttaggtatcgtttatttcgggttttgggtttttttttttttcgcggtttt

SEQ ID NO: 17488 - DNA, 814 bp, Artificial Sequence
  chemically treated genomic DNA (Homo sapiens) CpG-island No: 17488
aaaaccgcgaaaaaaaaaaaaacccaaaacccgaaataaacgatacctaaacaaaaacgaaacgaaaccgaaacctaaaactaaaaacgcgaaccgaaaccgaaaattacgaactcgctaacgaataaaaaaaacgaaatcgaaaaaaaactaacgaaaatccaaaaaatcgcccgactaaaccctacgcaccccgaatcaccaacttcgaacgctaattcccaccgaaactattcaaacgccgctcccccgcgtccctacgacaaaaaacgcctactaaacgcgctataaaccccgcctcgcgaaaacgcctaactcgaaccttatccccaataaacgactaaaacgaccgcgaaatcgcaaaacctccgaaaccccgaaaaaaaacgcccctcgaaattacccgaaaccgaacccgacgtccactcgccactcgcctcgcccctccccgaccccgcaccgccctccaccccgcctccttcgaattccttctacgtccgacaaaacctacgcgcctcacccgaacgaccacgaactcgcaacctcgacgaaaacgctacctacgtcccgactacctaaacctccccgcgtaactcccgacgaaacccaacaatcgaaaaataccaaatccgcctaacgcgcccctccccacgaaaaaaacgaaacgaaaatccaaaaaaaacgtaaaccgaactcccccgacgtattaatccgaacccgcgcgaaaaaacttacgcaaaccaaaaaaaaaaaaaatcaaacaacccccaaccccccaaaaaaacccaaataaaaaacaaacgccgacctcgcc

SEQ ID NO: 17489 - DNA, 678 bp, Artificial Sequence
  chemically treated genomic DNA (Homo sapiens) CpG-island No: 17489
ttacggtcggattcggttttaggggagtttcgcggagtttcgtcgtaggtttcgatttttttacgttcgtattttgggcgtttttatcgtattttcgaggttggtaattcgcgtttttcgggagttgagggaggtttgttttttttagttcgtcgtttttgttcgttttcgagttcgttttattttatattttagacgtcgaatttttttttttttttcgtcgtttttcgttggttagttttttttcgtttttttaatttttttagggacggttgtgttaggttagttttaagcgtcgtcgtcgttcgcgacgttcgttttattttagggttcgagtcgtagagttgttaggtttggacgcgttcgagtttgttgatttagtgcgggtgattagttggatttgtgcgagggcgcggacgcgtattcgttttttattggcgtaggtagagttggtagcgtcgaagtcgcgattcgttttttgtagagcgtatttgagggcggggtttttagaaagcgcgtcgcgtacgggcggttttagacgttcggtttcgcgcgtttcggcgtacgtaggtaagtagcgcgttcggaagaggagagcggttgagggtggggcgagcggtgggcgtcgttgtttagggtttttgagttattagagtcgggtttcgtggttttttttta

SEQ ID NO: 17490 - DNA, 678 bp, Artificial Sequence
  chemically treated genomic DNA (Homo sapiens) CpG-island No: 17490
taaaaaaaaaccacgaaacccgactctaataactcaaaaaccctaaacaacgacgcccaccgctcgccccaccctcaaccgctctcctcttccgaacgcgctacttacctacgtacgccgaaacgcgcgaaaccgaacgtctaaaaccgcccgtacgcgacgcgctttctaaaaaccccgccctcaaatacgctctacaaaaaacgaatcgcgacttcgacgctaccaactctacctacgccaataaaaaacgaatacgcgtccgcgccctcgcacaaatccaactaatcacccgcactaaatcaacaaactcgaacgcgtccaaacctaacaactctacgactcgaaccctaaaataaaacgaacgtcgcgaacgacgacgacgcttaaaactaacctaacacaaccgtccctaaaaaaattaaaaaaacgaaaaaaaactaaccaacgaaaaacgacgaaaaaaaaaaaaaaattcgacgtctaaaatataaaataaaacgaactcgaaaacgaacaaaaacgacgaactaaaaaaaacaaacctccctcaactcccgaaaaacgcgaattaccaacctcgaaaatacgataaaaacgcccaaaatacgaacgtaaaaaaatcgaaacctacgacgaaactccgcgaaactcccctaaaaccgaatccgaccgtaa

SEQ ID NO: 17491 - DNA, 678 bp, Artificial Sequence
  chemically treated genomic DNA (Homo sapiens) CpG-island No: 17491
tggggaagagttacgaggttcgattttagtggtttaggggttttgggtagcggcgtttatcgttcgttttatttttagtcgtttttttttttcgggcgcgttgtttgtttgcgtgcgtcgggacgcgcggggtcgagcgtttgaagtcgttcgtacgcgacgcgttttttaggagtttcgtttttaggtgcgttttgtaggaggcgggtcgcgatttcggcgttgttagttttgtttgcgttagtgaggggcgggtgcgcgttcgcgttttcgtatagatttagttggttattcgtattgagttaatagattcgagcgcgtttaggtttgatagttttgcggttcgggttttgaggtgaggcggacgtcgcgggcggcggcggcgtttgaggttagtttggtatagtcgtttttgggggagttgaggggacgaggaggggttggttagcgagggacggcggggagagaaggggagttcggcgtttgaggtgtggggtgaagcgggttcggaagcgggtagaggcggcgagttgagggaaatagattttttttagttttcgggaagcgcgggttgttagtttcggggatgcggtgggagcgtttaggatgcggacgtgagggggtcggggtttgcggcggggtttcgcgaggtttttttgggatcgggttcggtcgtgg

SEQ ID NO: 17492 - DNA, 678 bp, Artificial Sequence
  chemically treated genomic DNA (Homo sapiens) CpG-island No: 17492
ccacgaccgaacccgatcccaaaaaaacctcgcgaaaccccgccgcaaaccccgaccccctcacgtccgcatcctaaacgctcccaccgcatccccgaaactaacaacccgcgcttcccgaaaactaaaaaaaatctatttccctcaactcgccgcctctacccgcttccgaacccgcttcaccccacacctcaaacgccgaactccccttctctccccgccgtccctcgctaaccaacccctcctcgtcccctcaactcccccaaaaacgactataccaaactaacctcaaacgccgccgccgcccgcgacgtccgcctcacctcaaaacccgaaccgcaaaactatcaaacctaaacgcgctcgaatctattaactcaatacgaataaccaactaaatctatacgaaaacgcgaacgcgcacccgcccctcactaacgcaaacaaaactaacaacgccgaaatcgcgacccgcctcctacaaaacgcacctaaaaacgaaactcctaaaaaacgcgtcgcgtacgaacgacttcaaacgctcgaccccgcgcgtcccgacgcacgcaaacaaacaacgcgcccgaaaaaaaaaaacgactaaaaataaaacgaacgataaacgccgctacccaaaacccctaaaccactaaaatcgaacctcgtaactcttcccca

SEQ ID NO: 17493 - DNA, 523 bp, Artificial Sequence
  chemically treated genomic DNA (Homo sapiens) CpG-island No: 17493
cgcggaacgaggcggatcggaggggagatatagtatcgagtagagaatatgcgagcgaagcgcggtacggcgagcgagattcggggagcgaaggggagggtcgtatgttagcggggagtaggcgaggggcgacgggaagggtggtacgagttaggttcggaagcgaagagcggcgtgagttttggatcgggtcgacggaggtggtatataagggcgggggcggagagttaatcggcgaggggggtcgaaggtggggggacgtcgaggatgtagaaggtcggcggatagggtaggacgagagtggggaggtagttcgaagtaagaggcgaggggagaagaggtttgcgggtatgacgaggagcgaggaggcggagaatagaagcgcgagagtatagttagttagaaggcggaagattttgatgagacgttcgaaaacggggtggaggtggttggagaggtgaaatgagtgtaggttagtatgtgggtatatgtggattatttagtcgtgttaaattagggtata

SEQ ID NO: 17494 - DNA, 523 bp, Artificial Sequence
  chemically treated genomic DNA (Homo sapiens) CpG-island No: 17494
tataccctaatttaacacgactaaataatccacatatacccacatactaacctacactcatttcacctctccaaccacctccaccccgttttcgaacgtctcatcaaaatcttccgccttctaactaactatactctcgcgcttctattctccgcctcctcgctcctcgtcatacccgcaaacctcttctcccctcgcctcttacttcgaactacctccccactctcgtcctaccctatccgccgaccttctacatcctcgacgtccccccaccttcgacccccctcgccgattaactctccgcccccgcccttatataccacctccgtcgacccgatccaaaactcacgccgctcttcgcttccgaacctaactcgtaccacccttcccgtcgcccctcgcctactccccgctaacatacgaccctccccttcgctccccgaatctcgctcgccgtaccgcgcttcgctcgcatattctctactcgatactatatctcccctccgatccgcctcgttccgcg

SEQ ID NO: 17495 - DNA, 523 bp, Artificial Sequence
  chemically treated genomic DNA (Homo sapiens) CpG-island No: 17495
tgtattttagtttaatacgattaagtagtttatatgtgtttatatattagtttgtatttattttatttttttagttatttttatttcgttttcgagcgttttattagaatttttcgttttttggttggttgtattttcgcgtttttatttttcgttttttcgtttttcgttatgttcgtaggtttttttttttttcgttttttgtttcgggttgtttttttattttcgttttgttttattcgtcggttttttgtattttcgacgtttttttattttcgatttttttcgtcgattggtttttcgttttcgtttttatgtgttattttcgtcggttcggtttagaatttacgtcgtttttcgttttcgggtttggttcgtgttatttttttcgtcgtttttcgtttgtttttcgttggtatgcggttttttttttcgtttttcggatttcgttcgtcgtgtcgcgtttcgttcgtatgttttttgttcggtgttgtgtttttttttcgattcgtttcgtttcgcg

SEQ ID NO: 17496 - DNA, 523 bp, Artificial Sequence
  chemically treated genomic DNA (Homo sapiens) CpG-island No: 17496
cgcgaaacgaaacgaatcgaaaaaaaaacacaacaccgaacaaaaaacatacgaacgaaacgcgacacgacgaacgaaatccgaaaaacgaaaaaaaaaaccgcataccaacgaaaaacaaacgaaaaacgacgaaaaaaataacacgaaccaaacccgaaaacgaaaaacgacgtaaattctaaaccgaaccgacgaaaataacacataaaaacgaaaacgaaaaaccaatcgacgaaaaaaatcgaaaataaaaaaacgtcgaaaatacaaaaaaccgacgaataaaacaaaacgaaaataaaaaaacaacccgaaacaaaaaacgaaaaaaaaaaaaacctacgaacataacgaaaaacgaaaaaacgaaaaataaaaacgcgaaaatacaaccaaccaaaaaacgaaaaattctaataaaacgctcgaaaacgaaataaaaataactaaaaaaataaaataaatacaaactaatatataaacacatataaactacttaatcgtattaaactaaaataca

SEQ ID NO: 17497 - DNA, 1193 bp, Artificial Sequence
  chemically treated genomic DNA (Homo sapiens) CpG-island No: 17497
gcggacgttgttttcgttcggtcgtagaggtttcgcggttagggtttcgcgtgcggggtatcgggggtagaattagcgcgtgatcggggttcgcggtgtcgtaacgtttcgggtttgcgtagaggtttttgtagtttttgttcggtttagttcgagtttttcgggcgggtttttagttcggcgatttgtaggaatttttttcggcgtttttacgcgaagtcgtcgtagggtttttttgtaaagttttattagtttgaaggacgcgaattttagcgagagaatttgcggaaagcgaatatgtggggcgcgtagacggggaaattgagtttcgcgagagggtcggtttgtgcgttgtttcgttcgcgtttcgttagtatcgtcgtgttcgggcgcgttcgttttgtttttttcgcgggcggtttcggtttagtcgttcgttttttttttcgttattcggttagtttttatttcgggcgtcgtgttcgtttttaaggcggttcgttatcgttgcgaggttaatgggttgggtcgcgcggtcgcgcgtattcgtattcgttgttttcgaggtttttttgtatttttttcggcgtcgtttttcggttttcgttttgttcgtcgttatcgtcgtcgtcgttagagtcgttatgtagatttcgcgcgtcgtttttttttcgttgttgttgttgttgttggcggcgttcgtttcggcgtagttgtttcgggtcggtcgttcggcgtttttggtcgtcggttgtttagatcgttgcgagtcggcgcgttgttcgtcgtagtcggagtattgcgagggcggtcgggttcgggacgcgtgcggttgttgcgaggtgtgcggcgcgttcgagggcgtcgcgtgcggtttgtaggagggttcgtgcggcgaggggttgtagtgcgtggtgtttttcggggtgttagtttcggttacggtgcggcggcgcgcgtaggtcggtttttgtgtgtgcgttagtagcgagtcggtgtgcggtagcgacgttaatatttacgttaatttgtgttagttgcgcgtcgttagtcgtcgtttcgagaggttgtatcggtcgtcggttatcgttttgtagcgcggagtttgcggttaaggtatttcgtcgcgtttttgggtagttttttattttttttattttagttcggatttgtttttgcgggattggtgggta

SEQ ID NO: 17498 - DNA, 1193 bp, Artificial Sequence
  chemically treated genomic DNA (Homo sapiens) CpG-island No: 17498
tacccaccaatcccgcaaaaacaaatccgaactaaaataaaaaaaataaaaaactacccaaaaacgcgacgaaataccttaaccgcaaactccgcgctacaaaacgataaccgacgaccgatacaacctctcgaaacgacgactaacgacgcgcaactaacacaaattaacgtaaatattaacgtcgctaccgcacaccgactcgctactaacgcacacacaaaaaccgacctacgcgcgccgccgcaccgtaaccgaaactaacaccccgaaaaacaccacgcactacaacccctcgccgcacgaaccctcctacaaaccgcacgcgacgccctcgaacgcgccgcacacctcgcaacaaccgcacgcgtcccgaacccgaccgccctcgcaatactccgactacgacgaacaacgcgccgactcgcaacgatctaaacaaccgacgaccaaaaacgccgaacgaccgacccgaaacaactacgccgaaacgaacgccgccaacaacaacaacaacaacgaaaaaaaaacgacgcgcgaaatctacataacgactctaacgacgacgacgataacgacgaacaaaacgaaaaccgaaaaacgacgccgaaaaaaatacaaaaaaacctcgaaaacaacgaatacgaatacgcgcgaccgcgcgacccaacccattaacctcgcaacgataacgaaccgccttaaaaacgaacacgacgcccgaaataaaaactaaccgaataacgaaaaaaaaaacgaacgactaaaccgaaaccgcccgcgaaaaaaacaaaacgaacgcgcccgaacacgacgatactaacgaaacgcgaacgaaacaacgcacaaaccgaccctctcgcgaaactcaatttccccgtctacgcgccccacatattcgctttccgcaaattctctcgctaaaattcgcgtccttcaaactaataaaactttacaaaaaaaccctacgacgacttcgcgtaaaaacgccgaaaaaaattcctacaaatcgccgaactaaaaacccgcccgaaaaactcgaactaaaccgaacaaaaactacaaaaacctctacgcaaacccgaaacgttacgacaccgcgaaccccgatcacgcgctaattctacccccgataccccgcacgcgaaaccctaaccgcgaaacctctacgaccgaacgaaaacaacgtccgc

SEQ ID NO: 17499 - DNA, 1193 bp, Artificial Sequence
  chemically treated genomic DNA (Homo sapiens) CpG-island No: 17499
tgtttattagtttcgtagaagtaggttcgagttgggatggagagagtggggagttgtttaggagcgcggcggagtattttggtcgtaggtttcgcgttgtaggacgatgatcggcggtcggtgtagtttttcggagcggcggttggcggcgcgtagttggtataggttggcgtaggtgttggcgtcgttgtcgtatatcggttcgttgttggcgtatatatagaggtcggtttgcgcgcgtcgtcgtatcgtggtcgaggttggtatttcgaagggtattacgtattgtagtttttcgtcgtacgggtttttttgtaggtcgtacgcggcgttttcgggcgcgtcgtatatttcgtagtagtcgtacgcgtttcgggttcggtcgttttcgtagtgtttcggttgcggcgggtagcgcgtcggttcgtagcggtttgggtagtcggcggttaaaggcgtcgagcggtcggttcgggatagttgcgtcgaggcgggcgtcgttagtagtagtagtagtagcgggagaagagcggcgcgcgggatttgtatggcgattttggcggcggcggcggtggcggcggatagggcgagggtcggagagcggcgtcggggagagtgtaggagggtttcgggggtagcgggtgcgagtgcgcgcggtcgcgcggtttagtttattggtttcgtagcggtgacgagtcgttttggggacgggtacggcgttcgggatgggggttggtcggatggcgggagggagggcgggcggttggatcgggatcgttcgcggagggggtagggcgggcgcgttcgggtacggcggtgttggcggggcgcgggcggggtagcgtataggtcggttttttcgcgggatttagttttttcgtttgcgcgttttatatattcgtttttcgtaggttttttcgttgagattcgcgttttttaaattaatggaattttgtaagggggttttgcggcggtttcgcgtgggagcgtcggggaaagtttttgtaaatcgtcggattgggggttcgttcgggaggttcggattgggtcgggtagggattgtaggggtttttgcgtagattcggggcgttgcggtatcgcggatttcggttacgcgttggttttgttttcggtatttcgtacgcgggattttgatcgcggggtttttgcggtcggacgaaggtagcgttcgt

SEQ ID NO: 17500 - DNA, 1193 bp, Artificial Sequence
  chemically treated genomic DNA (Homo sapiens) CpG-island No: 17500
acgaacgctaccttcgtccgaccgcaaaaaccccgcgatcaaaatcccgcgtacgaaataccgaaaacaaaaccaacgcgtaaccgaaatccgcgataccgcaacgccccgaatctacgcaaaaacccctacaatccctacccgacccaatccgaacctcccgaacgaacccccaatccgacgatttacaaaaactttccccgacgctcccacgcgaaaccgccgcaaaacccccttacaaaattccattaatttaaaaaacgcgaatctcaacgaaaaaacctacgaaaaacgaatatataaaacgcgcaaacgaaaaaactaaatcccgcgaaaaaaccgacctatacgctaccccgcccgcgccccgccaacaccgccgtacccgaacgcgcccgccctaccccctccgcgaacgatcccgatccaaccgcccgccctccctcccgccatccgaccaacccccatcccgaacgccgtacccgtccccaaaacgactcgtcaccgctacgaaaccaataaactaaaccgcgcgaccgcgcgcactcgcacccgctacccccgaaaccctcctacactctccccgacgccgctctccgaccctcgccctatccgccgccaccgccgccgccgccaaaatcgccatacaaatcccgcgcgccgctcttctcccgctactactactactactaacgacgcccgcctcgacgcaactatcccgaaccgaccgctcgacgcctttaaccgccgactacccaaaccgctacgaaccgacgcgctacccgccgcaaccgaaacactacgaaaacgaccgaacccgaaacgcgtacgactactacgaaatatacgacgcgcccgaaaacgccgcgtacgacctacaaaaaaacccgtacgacgaaaaactacaatacgtaatacccttcgaaataccaacctcgaccacgatacgacgacgcgcgcaaaccgacctctatatatacgccaacaacgaaccgatatacgacaacgacgccaacacctacgccaacctataccaactacgcgccgccaaccgccgctccgaaaaactacaccgaccgccgatcatcgtcctacaacgcgaaacctacgaccaaaatactccgccgcgctcctaaacaactccccactctctccatcccaactcgaacctacttctacgaaactaataaaca

SEQ ID NO: 17501 - DNA, 975 bp, Artificial Sequence
  chemically treated genomic DNA (Homo sapiens) CpG-island No: 17501
gacgggtgttttcggttttttttattttcggtcggtttagtttggttttattcgagttttgttgtgaaattcgttattttcgttggtttcggtaaaaagtaaggcgtttcgtttcgagggtagagttttttgtaattgtcggataaatatttttcgaaagtttttcgcggtttttacgttcggtttttttattttacgagtttcggggaggggtttatttgtttttcgtcgttcgttttatattttgtcgtcgcggttgtattcgcgcgcgaggggcggggggtagggggcgcggcgagagttggggatcggcggcgttcgtattgagaaagtagttttcgtcgcgttcgttatggcgcgcggcggcggtagcggtttttttcggtttttttgttttttcgtttttagtttgatttttttttttagtgtgtttgagggagagcggttgtgcgcgcgcgtgtatatgtttttgtgtgtgtgtgcgcgcgcgcgtggggaaggggtcgggttcgtttttcgacgtttgacgttattgttatggtaacggtaattttcgtttttcgttttttattttttgttttcgtttattgtgtacgttttggggtttttacgtgtttatttatacgtacgtacgtaggtacgtattttcggggcgcgcgcgtttagagcgttggggtttgggaggtaatttggattttcgtttgttttttttttttcgttgtttttcggaatttgattaatttcgtgaggaggagtcgtgggcggggcgggttcggttttcggagtggcgtgaaaaatttttcgaggtagagcgaaaagtttttatgcgttattgagtatgttcggtgttcgaaggggcgttttggacgttagtgaagcgaggagaggcggagaaggaatcgagcgggtagttgagggaaatttcggaggaggttatttgcgattaaattggggttgcgtattgttagggttagg

SEQ ID NO: 17502 - DNA, 975 bp, Artificial Sequence
  chemically treated genomic DNA (Homo sapiens) CpG-island No: 17502
cctaaccctaacaatacgcaaccccaatttaatcgcaaataacctcctccgaaatttccctcaactacccgctcgattccttctccgcctctcctcgcttcactaacgtccaaaacgccccttcgaacaccgaacatactcaataacgcataaaaacttttcgctctacctcgaaaaatttttcacgccactccgaaaaccgaacccgccccgcccacgactcctcctcacgaaattaatcaaattccgaaaaacaacgaaaaaaaaaaaacaaacgaaaatccaaattacctcccaaaccccaacgctctaaacgcgcgcgccccgaaaatacgtacctacgtacgtacgtataaataaacacgtaaaaaccccaaaacgtacacaataaacgaaaacaaaaaataaaaaacgaaaaacgaaaattaccgttaccataacaataacgtcaaacgtcgaaaaacgaacccgaccccttccccacgcgcgcgcgcacacacacacaaaaacatatacacgcgcgcgcacaaccgctctccctcaaacacactaaaaaaaaaaatcaaactaaaaacgaaaaaacaaaaaaaccgaaaaaaaccgctaccgccgccgcgcgccataacgaacgcgacgaaaactactttctcaatacgaacgccgccgatccccaactctcgccgcgccccctaccccccgcccctcgcgcgcgaatacaaccgcgacgacaaaatataaaacgaacgacgaaaaacaaataaacccctccccgaaactcgtaaaataaaaaaaccgaacgtaaaaaccgcgaaaaactttcgaaaaatatttatccgacaattacaaaaaactctaccctcgaaacgaaacgccttactttttaccgaaaccaacgaaaataacgaatttcacaacaaaactcgaataaaaccaaactaaaccgaccgaaaataaaaaaaaccgaaaacacccgtc

SEQ ID NO: 17503 - DNA, 975 bp, Artificial Sequence
  chemically treated genomic DNA (Homo sapiens) CpG-island No: 17503
tttgattttaataatacgtagttttagtttgatcgtaggtaatttttttcgagattttttttaattgttcgttcggtttttttttcgttttttttcgttttattggcgtttaaagcgttttttcgggtatcggatatgtttagtaacgtatgaagatttttcgttttgtttcgggaaattttttacgttatttcgggagtcgagttcgtttcgtttacggtttttttttacgggattggttaaatttcgggaggtagcgagggaagggaggtaggcggaggtttaaattattttttaaattttagcgttttgggcgcgcgcgtttcgagagtgcgtgtttgcgtgcgtgcgtgtgagtgagtacgtgagggttttagaacgtgtatagtgggcggggataggaaatgggaagcgaggggcgggggttgtcgttgttatggtagtgacgttaggcgtcggggagcgaattcggttttttttttacgcgcgcgcgtatatatatatagagatatgtatacgcgcgcgtatagtcgtttttttttagatatattggagggaaaggttaaattaaaggcgagggagtagagagatcggagggagtcgttgtcgtcgtcgcgcgttatgacggacgcggcggaagttgtttttttagtgcggacgtcgtcgatttttagttttcgtcgcgttttttgtttttcgtttttcgcgcgcgagtgtagtcgcggcgatagggtatggggcgggcggcgggaggtaggtgggttttttttcggggttcgtgaagtggggggatcgggcgtgggggtcgcgggaagttttcgggaaatgtttattcggtagttgtaagaaattttgttttcgggacgaggcgttttgttttttgtcggggttagcgaaagtggcggattttatagtaaaattcgggtgaagttaggttggatcggtcgggagtgagagaggtcgggagtattcgtt

SEQ ID NO: 17504 - DNA, 975 bp, Artificial Sequence
  chemically treated genomic DNA (Homo sapiens) CpG-island No: 17504
aacgaatactcccgacctctctcactcccgaccgatccaacctaacttcacccgaattttactataaaatccgccactttcgctaaccccgacaaaaaacaaaacgcctcgtcccgaaaacaaaatttcttacaactaccgaataaacatttcccgaaaacttcccgcgacccccacgcccgatccccccacttcacgaaccccgaaaaaaaacccacctacctcccgccgcccgccccataccctatcgccgcgactacactcgcgcgcgaaaaacgaaaaacaaaaaacgcgacgaaaactaaaaatcgacgacgtccgcactaaaaaaacaacttccgccgcgtccgtcataacgcgcgacgacgacaacgactccctccgatctctctactccctcgcctttaatttaacctttccctccaatatatctaaaaaaaaacgactatacgcgcgcgtatacatatctctatatatatatacgcgcgcgcgtaaaaaaaaaaccgaattcgctccccgacgcctaacgtcactaccataacaacgacaacccccgcccctcgcttcccatttcctatccccgcccactatacacgttctaaaaccctcacgtactcactcacacgcacgcacgcaaacacgcactctcgaaacgcgcgcgcccaaaacgctaaaatttaaaaaataatttaaacctccgcctacctcccttccctcgctacctcccgaaatttaaccaatcccgtaaaaaaaaaccgtaaacgaaacgaactcgactcccgaaataacgtaaaaaatttcccgaaacaaaacgaaaaatcttcatacgttactaaacatatccgatacccgaaaaaacgctttaaacgccaataaaacgaaaaaaaacgaaaaaaaaaccgaacgaacaattaaaaaaaatctcgaaaaaaattacctacgatcaaactaaaactacgtattattaaaatcaaa

SEQ ID NO: 17505 - DNA, 915 bp, Artificial Sequence
  chemically treated genomic DNA (Homo sapiens) CpG-island No: 17505
tttttcgttttattggcgtttaaagcgttttttcgggtatcggatatgtttagtaacgtatgaagatttttcgttttgtttcgggaaattttttacgttatttcgggagtcgagttcgtttcgtttacggtttttttttacgggattggttaaatttcgggaggtagcgagggaagggaggtaggcggaggtttaaattattttttaaattttagcgttttgggcgcgcgcgtttcgagagtgcgtgtttgcgtgcgtgcgtgtgagtgagtacgtgagggttttagaacgtgtatagtgggcggggataggaaatgggaagcgaggggcgggggttgtcgttgttatggtagtgacgttaggcgtcggggagcgaattcggttttttttttacgcgcgcgcgtatatatatatagagatatgtatacgcgcgcgtatagtcgtttttttttagatatattggagggaaaggttaaattaaaggcgagggagtagagagatcggagggagtcgttgtcgtcgtcgcgcgttatgacggacgcggcggaggttgtttttttagtgcggacgtcgtcgatttttagttttcgtcgcgttttttgtttttcgtttttcgcgcgttttttattttggcgttggcgcgttttcgcgttttttttttcggtcgttttaggcgcgtttcgggttcggggcgcggggcgttgggagcgggagggtgggggtcgcggcgggtcggcggtttttttgttcgattttcgatttcgggttaggtgagtgttttggggcgggagagggcgttcggagcggagaggatatcgggcgtttagtttttcgtttgattttttttcggggcgttgataggttttcgggatacggtttttggggggcgttgtggggttatttgtgtcggggggt

SEQ ID NO: 17506 - DNA, 915 bp, Artificial Sequence
  chemically treated genomic DNA (Homo sapiens) CpG-island No: 17506
accccccgacacaaataaccccacaacgccccccaaaaaccgtatcccgaaaacctatcaacgccccgaaaaaaaatcaaacgaaaaactaaacgcccgatatcctctccgctccgaacgccctctcccgccccaaaacactcacctaacccgaaatcgaaaatcgaacaaaaaaaccgccgacccgccgcgacccccaccctcccgctcccaacgccccgcgccccgaacccgaaacgcgcctaaaacgaccgaaaaaaaaaacgcgaaaacgcgccaacgccaaaataaaaaacgcgcgaaaaacgaaaaacaaaaaacgcgacgaaaactaaaaatcgacgacgtccgcactaaaaaaacaacctccgccgcgtccgtcataacgcgcgacgacgacaacgactccctccgatctctctactccctcgcctttaatttaacctttccctccaatatatctaaaaaaaaacgactatacgcgcgcgtatacatatctctatatatatatacgcgcgcgcgtaaaaaaaaaaccgaattcgctccccgacgcctaacgtcactaccataacaacgacaacccccgcccctcgcttcccatttcctatccccgcccactatacacgttctaaaaccctcacgtactcactcacacgcacgcacgcaaacacgcactctcgaaacgcgcgcgcccaaaacgctaaaatttaaaaaataatttaaacctccgcctacctcccttccctcgctacctcccgaaatttaaccaatcccgtaaaaaaaaaccgtaaacgaaacgaactcgactcccgaaataacgtaaaaaatttcccgaaacaaaacgaaaaatcttcatacgttactaaacatatccgatacccgaaaaaacgctttaaacgccaataaaacgaaaaa

SEQ ID NO: 17507 - DNA, 915 bp, Artificial Sequence
  chemically treated genomic DNA (Homo sapiens) CpG-island No: 17507
atttttcgatataagtgattttataacgttttttagaggtcgtgtttcgagagtttgttagcgtttcggaagggggttaggcggggggttgagcgttcggtgtttttttcgtttcggacgttttttttcgttttaaggtatttatttggttcggggtcgggggtcgggtaaagaggtcgtcggttcgtcgcggtttttattttttcgtttttagcgtttcgcgtttcgagttcgaggcgcgtttggagcggtcgggggagagggcgcggggacgcgttagcgttagggtgaggggcgcgcgaggggcggggggtagggggcgcggcgagagttggggatcggcggcgttcgtattgagaaagtagttttcgtcgcgttcgttatggcgcgcggcggcggtagcggtttttttcggtttttttgttttttcgtttttagtttgatttttttttttagtgtgtttgagggagagcggttgtgcgcgcgcgtgtatatgtttttgtgtgtgtgtgcgcgcgcgcgtggggaaggggtcgggttcgtttttcgacgtttgacgttattgttatggtaacggtaattttcgtttttcgttttttattttttgttttcgtttattgtgtacgttttggggtttttacgtgtttatttatacgtacgtacgtaggtacgtattttcggggcgcgcgcgtttagagcgttggggtttgggaggtaatttggattttcgtttgttttttttttttcgttgtttttcggaatttgattaatttcgtgaggaggagtcgtgggcggggcgggttcggttttcggagtggcgtgaaaaatttttcgaggtagagcgaaaagtttttatgcgttattgagtatgttcggtgttcgaaggggcgttttggacgttagtgaagcgaggag

SEQ ID NO: 17508 - DNA, 915 bp, Artificial Sequence
  chemically treated genomic DNA (Homo sapiens) CpG-island No: 17508
ctcctcgcttcactaacgtccaaaacgccccttcgaacaccgaacatactcaataacgcataaaaacttttcgctctacctcgaaaaatttttcacgccactccgaaaaccgaacccgccccgcccacgactcctcctcacgaaattaatcaaattccgaaaaacaacgaaaaaaaaaaaacaaacgaaaatccaaattacctcccaaaccccaacgctctaaacgcgcgcgccccgaaaatacgtacctacgtacgtacgtataaataaacacgtaaaaaccccaaaacgtacacaataaacgaaaacaaaaaataaaaaacgaaaaacgaaaattaccgttaccataacaataacgtcaaacgtcgaaaaacgaacccgaccccttccccacgcgcgcgcgcacacacacacaaaaacatatacacgcgcgcgcacaaccgctctccctcaaacacactaaaaaaaaaaatcaaactaaaaacgaaaaaacaaaaaaaccgaaaaaaaccgctaccgccgccgcgcgccataacgaacgcgacgaaaactactttctcaatacgaacgccgccgatccccaactctcgccgcgccccctaccccccgcccctcgcgcgcccctcaccctaacgctaacgcgtccccgcgccctctcccccgaccgctccaaacgcgcctcgaactcgaaacgcgaaacgctaaaaacgaaaaaataaaaaccgcgacgaaccgacgacctctttacccgacccccgaccccgaaccaaataaataccttaaaacgaaaaaaaacgtccgaaacgaaaaaaacaccgaacgctcaaccccccgcctaacccccttccgaaacgctaacaaactctcgaaacacgacctctaaaaaacgttataaaatcacttatatcgaaaaat

SEQ ID NO: 17509 - DNA, 1073 bp, Artificial Sequence
  chemically treated genomic DNA (Homo sapiens) CpG-island No: 17509
gtacgtcgattcgattgtagcgcgggaacggaaggaggaaacggaagatttgaaaagattttgtcgtttttagaaattgtgcgacgcgtgttttcgtagttatttttaagaagtttcgtttttattaacgcgagtaggtagtagttttttttaggcggtcgagcgcggcgcgattgtgggtttaggtatcgcgattattcggttttatggcgggcgggaacgaggttcgttttcggagcggtttttcggttgtcggtttttcggttgtcgattattcggtatcgtttcgttttcggatgaaaggtttttcgtagagcggaagtaaggaagtttcgggaaatatagggaagttgtaggttagcgattcgaaatcggttaagtttttttcgcgtttgggacggcgggtcgtagaggggcgtgcgcgcgttggggaggggcggggtacggcggtcgtaatgtttttaaaatagggattcgtagggtataggggcggggtcgcgagagttagtcgttggtcgagtgggcgggatttaggggtggggttggaggttgaaatttgttaaagtttcggcgtgtgggatttaggggaggggtcgcgagagtcgtgggatcgagggggcggggtcggacggttgaaatttgttaaagtttcggcgcgcgggttttaggggcggagtcgcgagaatacgtcggggatagaggggcgggtttaggagtttcggggcgggataggacggtcgaaatcgaagttttggcgcgcggggtttaggggcgggtttaggggtttcggggtaggataggacggttgaaatcgaggtttcggcgcgcggggtttaggcgtcgtgtagtgagagtacgtcgtttgatcgaagggcggggtttgaaggttgagcgtagtcgcgaggttgtagttggtaggagagcgggcggtttgaagtcgttttgggttgtttggacggatgaagtttaggtggaaagttagtcgacgtttttcgggagttacgattttagggatttttattcgagtttaatcgttggaataattataaatttagaaatttttagttgagtgt

SEQ ID NO: 17510 - DNA, 1073 bp, Artificial Sequence
  chemically treated genomic DNA (Homo sapiens) CpG-island No: 17510
acactcaactaaaaatttctaaatttataattattccaacgattaaactcgaataaaaatccctaaaatcgtaactcccgaaaaacgtcgactaactttccacctaaacttcatccgtccaaacaacccaaaacgacttcaaaccgcccgctctcctaccaactacaacctcgcgactacgctcaaccttcaaaccccgcccttcgatcaaacgacgtactctcactacacgacgcctaaaccccgcgcgccgaaacctcgatttcaaccgtcctatcctaccccgaaacccctaaacccgcccctaaaccccgcgcgccaaaacttcgatttcgaccgtcctatcccgccccgaaactcctaaacccgcccctctatccccgacgtattctcgcgactccgcccctaaaacccgcgcgccgaaactttaacaaatttcaaccgtccgaccccgccccctcgatcccacgactctcgcgacccctcccctaaatcccacacgccgaaactttaacaaatttcaacctccaaccccacccctaaatcccgcccactcgaccaacgactaactctcgcgaccccgcccctataccctacgaatccctattttaaaaacattacgaccgccgtaccccgcccctccccaacgcgcgcacgcccctctacgacccgccgtcccaaacgcgaaaaaaacttaaccgatttcgaatcgctaacctacaacttccctatatttcccgaaacttccttacttccgctctacgaaaaacctttcatccgaaaacgaaacgataccgaataatcgacaaccgaaaaaccgacaaccgaaaaaccgctccgaaaacgaacctcgttcccgcccgccataaaaccgaataatcgcgatacctaaacccacaatcgcgccgcgctcgaccgcctaaaaaaaactactacctactcgcgttaataaaaacgaaacttcttaaaaataactacgaaaacacgcgtcgcacaatttctaaaaacgacaaaatcttttcaaatcttccgtttcctccttccgttcccgcgctacaatcgaatcgacgtac

SEQ ID NO: 17511 - DNA, 1073 bp, Artificial Sequence
  chemically treated genomic DNA (Homo sapiens) CpG-island No: 17511
atatttagttaaaagtttttgggtttgtgattgttttaacggttaagttcggatgagggtttttggagtcgtagttttcgggaaacgtcgattggttttttatttggattttattcgtttaggtagtttagagcggttttaggtcgttcgtttttttgttaattatagtttcgcgattgcgtttagtttttaggtttcgtttttcggttaagcggcgtgtttttattgtacggcgtttgggtttcgcgcgtcgggatttcggttttagtcgttttgttttgtttcgaggtttttaggttcgtttttgggtttcgcgcgttaggatttcggtttcgatcgttttgtttcgtttcgaggtttttaggttcgtttttttgttttcggcgtgttttcgcggtttcgtttttaggattcgcgcgtcgggattttggtaagttttagtcgttcggtttcgttttttcggttttacggttttcgcggttttttttttaagttttatacgtcgggattttggtaagttttagtttttagttttatttttaggtttcgtttattcggttagcggttggttttcgcggtttcgtttttgtgttttgcgagtttttattttgggagtattgcggtcgtcgtgtttcgtttttttttagcgcgcgtacgtttttttgcggttcgtcgttttagacgcgggaagagtttggtcggtttcgagtcgttggtttgtagtttttttgtgtttttcgaggtttttttgttttcgttttgcgaggagttttttattcgaaggcgggacgatgtcgaataatcgatagtcgaggaatcggtagtcgagaaatcgtttcgggaacgagtttcgttttcgttcgttatggaatcggatggtcgcggtgtttgggtttatagtcgcgtcgcgttcgatcgtttggagaagattgttgtttgttcgcgttggtaaagacggagttttttgggggtggttgcgagggtacgcgtcgtatagtttttgggggcggtagaatttttttaaatttttcgtttttttttttcgttttcgcgttgtagtcgggtcggcgtgt

SEQ ID NO: 17512 - DNA, 1073 bp, Artificial Sequence
  chemically treated genomic DNA (Homo sapiens) CpG-island No: 17512
acacgccgacccgactacaacgcgaaaacgaaaaaaaaaaacgaaaaatttaaaaaaattctaccgcccccaaaaactatacgacgcgtaccctcgcaaccacccccaaaaaactccgtctttaccaacgcgaacaaacaacaatcttctccaaacgatcgaacgcgacgcgactataaacccaaacaccgcgaccatccgattccataacgaacgaaaacgaaactcgttcccgaaacgatttctcgactaccgattcctcgactatcgattattcgacatcgtcccgccttcgaataaaaaactcctcgcaaaacgaaaacaaaaaaacctcgaaaaacacaaaaaaactacaaaccaacgactcgaaaccgaccaaactcttcccgcgtctaaaacgacgaaccgcaaaaaaacgtacgcgcgctaaaaaaaaacgaaacacgacgaccgcaatactcccaaaataaaaactcgcaaaacacaaaaacgaaaccgcgaaaaccaaccgctaaccgaataaacgaaacctaaaaataaaactaaaaactaaaacttaccaaaatcccgacgtataaaacttaaaaaaaaaaccgcgaaaaccgtaaaaccgaaaaaacgaaaccgaacgactaaaacttaccaaaatcccgacgcgcgaatcctaaaaacgaaaccgcgaaaacacgccgaaaacaaaaaaacgaacctaaaaacctcgaaacgaaacaaaacgatcgaaaccgaaatcctaacgcgcgaaacccaaaaacgaacctaaaaacctcgaaacaaaacaaaacgactaaaaccgaaatcccgacgcgcgaaacccaaacgccgtacaataaaaacacgccgcttaaccgaaaaacgaaacctaaaaactaaacgcaatcgcgaaactataattaacaaaaaaacgaacgacctaaaaccgctctaaactacctaaacgaataaaatccaaataaaaaaccaatcgacgtttcccgaaaactacgactccaaaaaccctcatccgaacttaaccgttaaaacaatcacaaacccaaaaacttttaactaaatat

SEQ ID NO: 17513 - DNA, 848 bp, Artificial Sequence
  chemically treated genomic DNA (Homo sapiens) CpG-island No: 17513
  misc_feature (454)..(454): n is either a, c, g or t
ttacgtcgttcgcgttgtagttttcggttcgcgtgggtttagggtcgaggttttacgttagtcgtttttcggattttagcgggtcgttttttattttgttcgtcgttgtttttggtgtcgcgggtcgttcgcgcgtatatttagcggttaggtgcggcgtcgacgatagggttttaggtttcgaggttggggagtttttcgggtttagtttaatcgtacgcggaggtcgcgtcgttaatcggttttcgtcgtttttataatcggcgtcgtatttatcgttacgtcggagttcgggttttttcggtttcgggttcgcgtaggtttggttgagttttagagcgtttacgtttcgcgtcgtcgttcggggattttggcgtagttgtcggggtcgtaatgcgaggggacgaacgtatgcgatttcgtttaacgttttttcgtttcggtttcggtcgtntagataattgtagtgtcgtagttcggcgtagttatagtagcgtttgttgagcggaatcgtttgggacgtttattttcggtcggtattcgttgtttatgtagagaggttgttatttattggttcgcgagcggtggcgcgtgcggggttgggtttatcgaattcgggtcggggagcgcggcgttggcggttcggggcggggcgaggttattacgggttatttcgcggagtcgtcgcggatcggatttggttgtagtttgcgcggggcgggggcgggaacggggtcgattaggagggacggatcgcgggtgggggagtggagtcgggatttttggtagttacgtgggaggagcgggtaggttataggggttgtaggagttttcgtttttttagaaaa

SEQ ID NO: 17514 - DNA, 848 bp, Artificial Sequence
  chemically treated genomic DNA (Homo sapiens) CpG-island No: 17514
  misc_feature (395)..(395): n is either a, c, g or t
ttttctaaaaaaacgaaaactcctacaacccctataacctacccgctcctcccacgtaactaccaaaaatcccgactccactcccccacccgcgatccgtccctcctaatcgaccccgttcccgcccccgccccgcgcaaactacaaccaaatccgatccgcgacgactccgcgaaataacccgtaataacctcgccccgccccgaaccgccaacgccgcgctccccgacccgaattcgataaacccaaccccgcacgcgccaccgctcgcgaaccaataaataacaacctctctacataaacaacgaataccgaccgaaaataaacgtcccaaacgattccgctcaacaaacgctactataactacgccgaactacgacactacaattatctanacgaccgaaaccgaaacgaaaaaacgttaaacgaaatcgcatacgttcgtcccctcgcattacgaccccgacaactacgccaaaatccccgaacgacgacgcgaaacgtaaacgctctaaaactcaaccaaacctacgcgaacccgaaaccgaaaaaacccgaactccgacgtaacgataaatacgacgccgattataaaaacgacgaaaaccgattaacgacgcgacctccgcgtacgattaaactaaacccgaaaaactccccaacctcgaaacctaaaaccctatcgtcgacgccgcacctaaccgctaaatatacgcgcgaacgacccgcgacaccaaaaacaacgacgaacaaaataaaaaacgacccgctaaaatccgaaaaacgactaacgtaaaacctcgaccctaaacccacgcgaaccgaaaactacaacgcgaacgacgtaa

SEQ ID NO: 17515 - DNA, 848 bp, Artificial Sequence
  chemically treated genomic DNA (Homo sapiens) CpG-island No: 17515
  misc_feature (395)..(395): n is either a, c, g or t
ttttttggaggggcggaagtttttgtagtttttatggtttattcgttttttttacgtaattgttaaagatttcggttttatttttttattcgcggttcgttttttttggtcgatttcgttttcgttttcgtttcgcgtagattgtagttaggttcggttcgcggcggtttcgcggaatgattcgtagtaatttcgtttcgtttcgggtcgttagcgtcgcgtttttcggttcgaattcgataggtttagtttcgtacgcgttatcgttcgcgggttaatgggtggtagtttttttgtataggtaacgagtgtcggtcgggggtgagcgttttaggcggtttcgtttaatagacgttgttgtggttgcgtcgggttgcgatattgtagttgtttangcggtcggggtcgggacgaggaggcgttggacggggtcgtatacgttcgttttttcgtattgcggtttcgatagttgcgttaggattttcgggcggcggcgcggggcgtgaacgttttggggtttagttaggtttgcgcgggttcgaggtcggaggaattcggatttcggcgtagcggtgagtgcggcgtcggttgtgggagcggcgggagtcggttgacggcgcggttttcgcgtgcggttaggttgggttcgaggggttttttagtttcggggtttgggattttgtcgtcggcgtcgtatttgatcgttgggtgtgcgcgcgggcggttcgcggtattaggagtagcggcgagtagggtgggaggcggttcgttgaggttcgggaagcggttgacgtggggtttcggttttgagtttacgcgagtcgggagttgtagcgcgaacggcgtgg

SEQ ID NO: 17516 - DNA, 848 bp, Artificial Sequence
  chemically treated genomic DNA (Homo sapiens) CpG-island No: 17516
  misc_feature (454)..(454): n is either a, c, g or t
ccacgccgttcgcgctacaactcccgactcgcgtaaactcaaaaccgaaaccccacgtcaaccgcttcccgaacctcaacgaaccgcctcccaccctactcgccgctactcctaataccgcgaaccgcccgcgcgcacacccaacgatcaaatacgacgccgacgacaaaatcccaaaccccgaaactaaaaaacccctcgaacccaacctaaccgcacgcgaaaaccgcgccgtcaaccgactcccgccgctcccacaaccgacgccgcactcaccgctacgccgaaatccgaattcctccgacctcgaacccgcgcaaacctaactaaaccccaaaacgttcacgccccgcgccgccgcccgaaaatcctaacgcaactatcgaaaccgcaatacgaaaaaacgaacgtatacgaccccgtccaacgcctcctcgtcccgaccccgaccgcntaaacaactacaatatcgcaacccgacgcaaccacaacaacgtctattaaacgaaaccgcctaaaacgctcacccccgaccgacactcgttacctatacaaaaaaactaccacccattaacccgcgaacgataacgcgtacgaaactaaacctatcgaattcgaaccgaaaaacgcgacgctaacgacccgaaacgaaacgaaattactacgaatcattccgcgaaaccgccgcgaaccgaacctaactacaatctacgcgaaacgaaaacgaaaacgaaatcgaccaaaaaaaacgaaccgcgaataaaaaaataaaaccgaaatctttaacaattacgtaaaaaaaacgaataaaccataaaaactacaaaaacttccgcccctccaaaaaa

SEQ ID NO: 17517 - DNA, 545 bp, Artificial Sequence
  chemically treated genomic DNA (Homo sapiens) CpG-island No: 17517
tttttcggcgtaggcggggattttattttgcgggatttcggttttttcgtgcggatagggggcgttcgtagtcgtgtttttttcgttaattttattagtgttttagttcgtttttgtgcgatcgtttttagggttcgggatattttttgtttcggggcgtgtgggattcggatgtaagcgtgttatataagcgttgtttaagttttatttttttttttttgaggaagacgcggtcgtaagggttgaggatttttggttcgtacgtttttgtttttgatttatcgttgttcgttttcgtcgaggaataagtcggttaggaagttcgcgcgtaatagttatggtgaggcggtagtcggcggcgggcggcgtaacgtagggttcgggcgtcggggggatttcggtttcgagttcgtgtttttgagggtagatgtcggggcgtgtaggggcggaaaggcgtttttgaaatggtggggaaacgcgggaagttttcggaagttgtttttttttagaagtggtagattatttttggtttattgttttttttt

SEQ ID NO: 17518 - DNA, 545 bp, Artificial Sequence
  chemically treated genomic DNA (Homo sapiens) CpG-island No: 17518
aaaaaaaaacaataaaccaaaaataatctaccacttctaaaaaaaaacaacttccgaaaacttcccgcgtttccccaccatttcaaaaacgcctttccgcccctacacgccccgacatctaccctcaaaaacacgaactcgaaaccgaaatccccccgacgcccgaaccctacgttacgccgcccgccgccgactaccgcctcaccataactattacgcgcgaacttcctaaccgacttattcctcgacgaaaacgaacaacgataaatcaaaaacaaaaacgtacgaaccaaaaatcctcaacccttacgaccgcgtcttcctcaaaaaaaaaaaaataaaacttaaacaacgcttatataacacgcttacatccgaatcccacacgccccgaaacaaaaaatatcccgaaccctaaaaacgatcgcacaaaaacgaactaaaacactaataaaattaacgaaaaaaacacgactacgaacgccccctatccgcacgaaaaaaccgaaatcccgcaaaataaaatccccgcctacgccgaaaaa

SEQ ID NO: 17519 - DNA, 545 bp, Artificial Sequence
  chemically treated genomic DNA (Homo sapiens) CpG-island No: 17519
gaaaaagaataataagttaaaaatggtttgttatttttggagaaaggtagttttcggaagtttttcgcgtttttttattattttaggagcgttttttcgtttttatacgtttcggtatttgtttttaggagtacgaattcgaaatcggggttttttcggcgttcgagttttgcgttgcgtcgttcgtcgtcgattgtcgttttattatggttgttgcgcgcgggttttttgatcgatttgtttttcggcgagagcgaatagcggtgagttaggagtaggagcgtgcggattaaaaatttttagtttttacgatcgcgttttttttaaaaagaaaggggtgggatttgagtaacgtttatatagtacgtttgtattcgggttttatacgtttcggaataggaaatatttcgggttttagaggcggtcgtataagggcgagttggagtattagtggagttggcgggaaaggtacggttgcgggcgttttttgttcgtacggaggagtcgaagtttcgtagggtggggttttcgtttgcgtcgagagg

SEQ ID NO: 17520 - DNA, 545 bp, Artificial Sequence
  chemically treated genomic DNA (Homo sapiens) CpG-island No: 17520
cctctcgacgcaaacgaaaaccccaccctacgaaacttcgactcctccgtacgaacaaaaaacgcccgcaaccgtacctttcccgccaactccactaatactccaactcgcccttatacgaccgcctctaaaacccgaaatatttcctattccgaaacgtataaaacccgaatacaaacgtactatataaacgttactcaaatcccacccctttctttttaaaaaaaacgcgatcgtaaaaactaaaaatttttaatccgcacgctcctactcctaactcaccgctattcgctctcgccgaaaaacaaatcgatcaaaaaacccgcgcgcaacaaccataataaaacgacaatcgacgacgaacgacgcaacgcaaaactcgaacgccgaaaaaaccccgatttcgaattcgtactcctaaaaacaaataccgaaacgtataaaaacgaaaaaacgctcctaaaataataaaaaaacgcgaaaaacttccgaaaactacctttctccaaaaataacaaaccatttttaacttattattctttttc

SEQ ID NO: 17521 - DNA, 962 bp, Artificial Sequence
  chemically treated genomic DNA (Homo sapiens) CpG-island No: 17521
cgtcgttattattacgcgttgttttaaatagattatataacgtaggtttttggttcgtatttttggggttttatttttttttttttttttttgttgatttttcgcgattgttcgagtcggaatattatttttttgatcgcggttcgaggtttagcgaaagtgcgaggtcggtggggttattgttcgcgggtattatgttcggcgatcgggtaagcgaaatagggcgtgagcggcggcgaatagaaaaggatatatagttgagacgttgttttatttcgttggatgagggtttttgttggcggtacgagagtttttgtattttttttagttcgtagcggcggttcggcgtgttttttagttgttttcgagtaaagaattagcgagaagaagttttacggttcgacgttatgatattttttttttcgttcgtttttttatttatttttcgttttttttggttcgcggatttttcgttaagcgcgcgatttcgttttatttcgttcgtcgtagattacgtattatttttttttattatcgttttcgtttttgcgtatgcgggggttcgttttatcgattcgttttagttttttgttttttttttttgttttcggtttcgtttttgcgtacgggattataatgtttcgcgtcgtttgttattgggaggcgtcgaaggtggagaggtcggttcggaaggaaaaggtcggcgtagtatgtcgggtttagggttggcggggcgaaggggtggggagggaaggggcggggaggggaggggaggggaaagtgggagagggtggattttggtcggtgtgaagagaggcggtcgggcggttgcgttgtgggggtttgggcgtgtatttcggaggttcgtcgcggttttttttagacgggaggtttagcggttttttaaaaagagaaaaataatttttattgtcgtagttttacgttattatttttattttttt

SEQ ID NO: 17522 - DNA, 962 bp, Artificial Sequence
  chemically treated genomic DNA (Homo sapiens) CpG-island No: 17522
aaaaaaataaaaataataacgtaaaactacgacaataaaaattatttttctctttttaaaaaaccgctaaacctcccgtctaaaaaaaaccgcgacgaacctccgaaatacacgcccaaacccccacaacgcaaccgcccgaccgcctctcttcacaccgaccaaaatccaccctctcccactttcccctcccctcccctccccgccccttccctccccaccccttcgccccgccaaccctaaacccgacatactacgccgaccttttccttccgaaccgacctctccaccttcgacgcctcccaataacaaacgacgcgaaacattataatcccgtacgcaaaaacgaaaccgaaaacaaaaaaaaaaaacaaaaaactaaaacgaatcgataaaacgaacccccgcatacgcaaaaacgaaaacgataataaaaaaaaataatacgtaatctacgacgaacgaaataaaacgaaatcgcgcgcttaacgaaaaatccgcgaaccaaaaaaaacgaaaaataaataaaaaaacgaacgaaaaaaaaaatatcataacgtcgaaccgtaaaacttcttctcgctaattctttactcgaaaacaactaaaaaacacgccgaaccgccgctacgaactaaaaaaaatacaaaaactctcgtaccgccaacaaaaaccctcatccaacgaaataaaacaacgtctcaactatatatccttttctattcgccgccgctcacgccctatttcgcttacccgatcgccgaacataatacccgcgaacaataaccccaccgacctcgcactttcgctaaacctcgaaccgcgatcaaaaaaataatattccgactcgaacaatcgcgaaaaatcaacaaaaaaaaaaaaaaaaaaataaaaccccaaaaatacgaaccaaaaacctacgttatataatctatttaaaacaacgcgtaataataacgacg

SEQ ID NO: 17523 - DNA, 962 bp, Artificial Sequence
  chemically treated genomic DNA (Homo sapiens) CpG-island No: 17523
aggaaaatggaagtagtggcgtgaggttgcgatagtgaaggttatttttttttttttaaagggtcgttagatttttcgtttaaaggaagtcgcgacgggttttcgaagtatacgtttaggtttttatagcgtagtcgttcgatcgtttttttttatatcggttagagtttatttttttttattttttttttttttttttttttcgttttttttttttttattttttcgtttcgttaattttagattcggtatgttgcgtcgatttttttttttcgagtcgatttttttattttcggcgttttttaatgataagcggcgcggagtattgtggtttcgtgcgtaagagcgaggtcgagggtagaaaaagaaagtaaaagattagggcgagtcggtagagcgggttttcgtatgcgtaagggcggaggcggtggtgaaaaagggtggtgcgtggtttacggcgagcggagtggggcggggtcgcgcgtttggcggggagttcgcgagttaggaggggcggggggtgaatgaaggagcgggcggaggaggaagtgttatggcgtcgggtcgtggagttttttttcgttggttttttattcgggaatagttggagaatacgtcgagtcgtcgttgcgagttggagggagtataagagttttcgtgtcgttagtagaaatttttatttagcgagatgggatagcgttttaattgtgtatttttttttgttcgtcgtcgtttacgttttgtttcgtttgttcggtcgtcgggtatggtgttcgcgaataatggttttatcggtttcgtattttcgttgggtttcgggtcgcggttagggaagtaatgtttcggttcgggtagtcgcgaggggttagtagaggaagggaggaggagataggattttaggaatgcgggttaggagtttgcgttgtgtaatttgtttggggtagcgcgtggtggtggcggcg

SEQ ID NO: 17524 - DNA, 962 bp, Artificial Sequence
  chemically treated genomic DNA (Homo sapiens) CpG-island No: 17524
cgccgccaccaccacgcgctaccccaaacaaattacacaacgcaaactcctaacccgcattcctaaaatcctatctcctcctcccttcctctactaacccctcgcgactacccgaaccgaaacattacttccctaaccgcgacccgaaacccaacgaaaatacgaaaccgataaaaccattattcgcgaacaccatacccgacgaccgaacaaacgaaacaaaacgtaaacgacgacgaacaaaaaaaaatacacaattaaaacgctatcccatctcgctaaataaaaatttctactaacgacacgaaaactcttatactccctccaactcgcaacgacgactcgacgtattctccaactattcccgaataaaaaaccaacgaaaaaaaactccacgacccgacgccataacacttcctcctccgcccgctccttcattcaccccccgcccctcctaactcgcgaactccccgccaaacgcgcgaccccgccccactccgctcgccgtaaaccacgcaccaccctttttcaccaccgcctccgcccttacgcatacgaaaacccgctctaccgactcgccctaatcttttactttctttttctaccctcgacctcgctcttacgcacgaaaccacaatactccgcgccgcttatcattaaaaaacgccgaaaataaaaaaatcgactcgaaaaaaaaaaatcgacgcaacataccgaatctaaaattaacgaaacgaaaaaataaaaaaaaaaaaaacgaaaaaaaaaaaaaaaaaaaaaataaaaaaaaataaactctaaccgatataaaaaaaaacgatcgaacgactacgctataaaaacctaaacgtatacttcgaaaacccgtcgcgacttcctttaaacgaaaaatctaacgaccctttaaaaaaaaaaaaataaccttcactatcgcaacctcacgccactacttccattttcct

SEQ ID NO: 17525 - DNA, 527 bp, Artificial Sequence
  chemically treated genomic DNA (Homo sapiens) CpG-island No: 17525
aattggtttcgtttttcgggttttaaatttagattcggtttcgttcgaagtttcggattttggggttcgtttttggtttcgcgtcggtagatcgtgggttcgtttttgggcgtgttttaaatttttcgtaggtaacgttttttaatttgagttatatttcgattttttttttaaattttttttcgttttttatattttggatttttcgtttcgtttcggtttcgttttaagtttaattaggtttcggttacgaatttaagtttcgatcggttttttagtttttgggtttttatcgaaatcggtttttttttaaatttttttttttaaagtttttttttcgaatttaattggtatttcgaattttttttcgtttttattattttcggtttagttttacgtcggttcgtttaaagttttgttttttagagttcgcgtatcgtttggttatgtgttacgatatagttaatttttcgtttcggtttcgttttttgagtttttttttgggtttggttttagttttattttaa

SEQ ID NO: 17526 - DNA, 527 bp, Artificial Sequence
  chemically treated genomic DNA (Homo sapiens) CpG-island No: 17526
ttaaaataaaactaaaaccaaacccaaaaaaaaactcaaaaaacgaaaccgaaacgaaaaattaactatatcgtaacacataaccaaacgatacgcgaactctaaaaaacaaaactttaaacgaaccgacgtaaaactaaaccgaaaataataaaaacgaaaaaaaattcgaaataccaattaaattcgaaaaaaaaactttaaaaaaaaaaatttaaaaaaaaaccgatttcgataaaaacccaaaaactaaaaaaccgatcgaaacttaaattcgtaaccgaaacctaattaaacttaaaacgaaaccgaaacgaaacgaaaaatccaaaatataaaaaacgaaaaaaaatttaaaaaaaaaatcgaaatataactcaaattaaaaaacgttacctacgaaaaatttaaaacacgcccaaaaacgaacccacgatctaccgacgcgaaaccaaaaacgaaccccaaaatccgaaacttcgaacgaaaccgaatctaaatttaaaacccgaaaaacgaaaccaatt

SEQ ID NO: 17527 - DNA, 527 bp, Artificial Sequence
  chemically treated genomic DNA (Homo sapiens) CpG-island No: 17527
ttagggtggggttaaggttagatttagagaagggtttaggaggcggggtcggggcggggggttgattatgtcgtagtatatggttaggcggtgcgcggattttgggaggtagagttttggacgggtcgacgtggggttgggtcgggggtggtggaggcgggggggagttcggggtgttagttgggttcggggggggggttttgggggggggggtttagggaggggtcggtttcggtagggatttagggattgggaggtcggtcggggtttgggttcgtggtcgagatttagttgggtttggggcggggtcgagacggagcgagggatttagggtgtgggaaacggggaggggtttgaggaggggatcggaatgtggtttaagttgggaggcgttatttgcggagggtttgaggtacgtttaggagcgagtttacggtttgtcgacgcggggttaggggcgggttttaggattcggagtttcgggcggggtcgagtttgggtttggggttcgggaggcggggttagtt

SEQ ID NO: 17528 - DNA, 527 bp, Artificial Sequence
  chemically treated genomic DNA (Homo sapiens) CpG-island No: 17528
aactaaccccgcctcccgaaccccaaacccaaactcgaccccgcccgaaactccgaatcctaaaacccgcccctaaccccgcgtcgacaaaccgtaaactcgctcctaaacgtacctcaaaccctccgcaaataacgcctcccaacttaaaccacattccgatcccctcctcaaacccctccccgtttcccacaccctaaatccctcgctccgtctcgaccccgccccaaacccaactaaatctcgaccacgaacccaaaccccgaccgacctcccaatccctaaatccctaccgaaaccgacccctccctaaacccccccccccaaaaccccccccccgaacccaactaacaccccgaactcccccccgcctccaccacccccgacccaaccccacgtcgacccgtccaaaactctacctcccaaaatccgcgcaccgcctaaccatatactacgacataatcaaccccccgccccgaccccgcctcctaaacccttctctaaatctaaccttaaccccaccctaa

SEQ ID NO: 17529 - DNA, 710 bp, Artificial Sequence
  chemically treated genomic DNA (Homo sapiens) CpG-island No: 17529
ggggtttattagtttattatacggcggttattttacgtttattagggtcggggtttattagtttattatacggcggttattttatgtttattagggtcggggtttattagtttattatacggcggttattttatgtttattagggtcggggtttattagtttattatacggtagttattttatgtttattagggtcggggtttattagtttattatacggcggttattttatgttgattagggtcggggtttattagtttattatacggcggttattttatgtttattagggtcggggtttattagtttattatacggcggttattttatgtttattagggtcggggtttattagtttattatacggtagttattttatgtttattagggtcggggtttattagtttattatacggcggttattttatgttgattagggtcggggtttattagtttattatacggcggttattttacgtttattagggtcggggtttattagtttattatacggcggttattttacgttgattagggtcggggtttattagtttattatacggcggttattttacgtttattagggtcggggtttattagtttattatacggcggttattttacgttgattagggtcggggtttattagtttattatacggcggttattttatgttgattagaagttttgatagtaagtttagatgtttg

SEQ ID NO: 17530 - DNA, 710 bp, Artificial Sequence
  chemically treated genomic DNA (Homo sapiens) CpG-island No: 17530
caaacatctaaacttactatcaaaacttctaatcaacataaaataaccgccgtataataaactaataaaccccgaccctaatcaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaatcaacataaaataaccgccgtataataaactaataaaccccgaccctaataaacataaaataactaccgtataataaactaataaaccccgaccctaataaacataaaataaccgccgtataataaactaataaaccccgaccctaataaacataaaataaccgccgtataataaactaataaaccccgaccctaatcaacataaaataaccgccgtataataaactaataaaccccgaccctaataaacataaaataactaccgtataataaactaataaaccccgaccctaataaacataaaataaccgccgtataataaactaataaaccccgaccctaataaacataaaataaccgccgtataataaactaataaaccccgaccctaataaacgtaaaataaccgccgtataataaactaataaacccc

SEQ ID NO: 17531 - DNA, 710 bp, Artificial Sequence
  chemically treated genomic DNA (Homo sapiens) CpG-island No: 17531
tagatatttaggtttgttgttaaggtttttgattaatatgagatgatcgtcgtgtggtaaattgatgaatttcgattttgattaacgtgagatgatcgtcgtgtggtaaattgatgaatttcgattttgatgaacgtgagatgatcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgattaatatgagatgatcgtcgtgtggtaaattgatgaatttcgattttgatgaatatgagatggttgtcgtgtggtaaattgatgaatttcgattttgatgaatatgagatgatcgtcgtgtggtaaattgatgaatttcgattttgatgaatatgagatggtcgtcgtgtggtaaattgatgaatttcgattttgattaatatgagatgatcgtcgtgtggtaaattgatgaatttcgattttgatgaatatgagatggttgtcgtgtggtaaattgatgaatttcgattttgatgaatatgagatgatcgtcgtgtggtaaattgatgaatttcgattttgatgaatatgagatggtcgtcgtgtggtaaattgatgaatttcgattttgatgaacgtgagatggtcgtcgtgtggtaaattgatgaatttt

SEQ ID NO: 17532 - DNA, 710 bp, Artificial Sequence
  chemically treated genomic DNA (Homo sapiens) CpG-island No: 17532
aaaattcatcaatttaccacacgacgaccatctcacgttcatcaaaatcgaaattcatcaatttaccacacgacgaccatctcatattcatcaaaatcgaaattcatcaatttaccacacgacgatcatctcatattcatcaaaatcgaaattcatcaatttaccacacgacaaccatctcatattcatcaaaatcgaaattcatcaatttaccacacgacgatcatctcatattaatcaaaatcgaaattcatcaatttaccacacgacgaccatctcatattcatcaaaatcgaaattcatcaatttaccacacgacgatcatctcatattcatcaaaatcgaaattcatcaatttaccacacgacaaccatctcatattcatcaaaatcgaaattcatcaatttaccacacgacgatcatctcatattaatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgatcatctcacgttcatcaaaatcgaaattcatcaatttaccacacgacgatcatctcacgttaatcaaaatcgaaattcatcaatttaccacacgacgatcatctcatattaatcaaaaaccttaacaacaaacctaaatatcta

SEQ ID NO: 17533 - DNA, 902 bp, Artificial Sequence
  chemically treated genomic DNA (Homo sapiens) CpG-island No: 17533
aacgtttcgtacgggtttcgcgaggcggtagagttttttttagacggaggggggtgcggggcgatgaggggagagttaggttggggatttcgtcgaggttcggtagcgttgttcgtttattttttgtcgtcgtcgttttttttttttttttttcggtcgtcgtcgtcgttttttttattagggtagtcgtttttatcgtcgttttcgttattacggtcgtcgttagcgtcgtcgtcgttttcggttttattcggtaggggggatattttagtttttttttttttttcgtttagtttttttcgttcgttcgtcgtcgttaatttttttcggtcgtcgtcgtcgttatcgtttttggttgagggggaggggagggggtcgggttgggtcgtttcgtcggcggttgtagtagattaaaaacgacggcggggcggtcgtcgttttttaatttttagtttcggttcgttcggtttttttatttttttttgtttttatttttttcgcgttcgtttgttttttttttatttttttagttttcgttcgttttcgtcgcggtttcgttagtttagtttaaattaaaatattgttatataatatggcggcgcggcggtcggtaaatatcgcgagatttgtagtcgcggttgaggcggcggttgtgacgaggttttttttagtcgaacggcgggggagtagtaggcggcggcggcggcggttgcggttgcggttcggggatgtttttttttcgatttgtatttttttttcgatattcgtagtttttacgtttgttttgttagggttggagggaggacgcgggtcgtcgttggggtcgtgcgaggggggtgtcggtgcgggtagttcggggagggttgaaatttttttttttcgtttgggttttttatttttgg

SEQ ID NO: 17534 - DNA, 902 bp, Artificial Sequence
  chemically treated genomic DNA (Homo sapiens) CpG-island No: 17534
ccaaaaataaaaaacccaaacgaaaaaaaaaaatttcaaccctccccgaactacccgcaccgacacccccctcgcacgaccccaacgacgacccgcgtcctccctccaaccctaacaaaacaaacgtaaaaactacgaatatcgaaaaaaaaatacaaatcgaaaaaaaaacatccccgaaccgcaaccgcaaccgccgccgccgccgcctactactcccccgccgttcgactaaaaaaaacctcgtcacaaccgccgcctcaaccgcgactacaaatctcgcgatatttaccgaccgccgcgccgccatattatataacaatattttaatttaaactaaactaacgaaaccgcgacgaaaacgaacgaaaactaaaaaaataaaaaaaaaacaaacgaacgcgaaaaaaataaaaacaaaaaaaaataaaaaaaccgaacgaaccgaaactaaaaattaaaaaacgacgaccgccccgccgtcgtttttaatctactacaaccgccgacgaaacgacccaacccgaccccctcccctccccctcaaccaaaaacgataacgacgacgacgaccgaaaaaaattaacgacgacgaacgaacgaaaaaaactaaacgaaaaaaaaaaaaaaactaaaatatcccccctaccgaataaaaccgaaaacgacgacgacgctaacgacgaccgtaataacgaaaacgacgataaaaacgactaccctaataaaaaaaacgacgacgacgaccgaaaaaaaaaaaaaaaaaacgacgacgacaaaaaataaacgaacaacgctaccgaacctcgacgaaatccccaacctaactctcccctcatcgccccgcacccccctccgtctaaaaaaaactctaccgcctcgcgaaacccgtacgaaacgtt

SEQ ID NO: 17535 - DNA, 902 bp, Artificial Sequence
  chemically treated genomic DNA (Homo sapiens) CpG-island No: 17535
ttaaggatggggggtttaggcggagaaagggggttttagtttttttcgggttgttcgtatcggtatttttttcgtacggttttagcggcggttcgcgttttttttttagttttagtaagataggcgtagagattgcgagtgtcgggggaggggtataggtcggaggaagagtattttcgggtcgtagtcgtagtcgtcgtcgtcgtcgtttgttgttttttcgtcgttcggttaggggaggtttcgttatagtcgtcgttttagtcgcggttgtagatttcgcggtgtttgtcggtcgtcgcgtcgttatattgtgtgatagtattttgatttggattgggttggcggagtcgcggcgagagcgagcgagagttgggggggtggggggagggtaggcgagcgcgaggggggtgggggtagagggaggtggggaggtcgagcgagtcggagttgaggattggggagcggcgatcgtttcgtcgtcgtttttgatttgttgtagtcgtcggcggggcgatttagttcgattttttttttttttttttagttaggagcggtggcggcggcggcggtcggagggagttggcggcggcgggcgagcggagggggttgagcggggagggagggagggttgaggtgttttttttgtcgggtggaatcggaggcggcggcggcgttggcggcggtcgtggtggcggaggcgacggtggagacggttgttttagtgggagaggcggcggcggcggtcgaggaggaggagggggaagcggcggcggtaaagggtaagcggatagcgttgtcgggtttcggcgggatttttaatttggttttttttttatcgtttcgtattttttttcgtttggaaggggttttgtcgtttcgcgaggttcgtgcggggcgtt

SEQ ID NO: 17536 - DNA, 902 bp, Artificial Sequence
  chemically treated genomic DNA (Homo sapiens) CpG-island No: 17536
aacgccccgcacgaacctcgcgaaacgacaaaaccccttccaaacgaaaaaaaatacgaaacgataaaaaaaaaaccaaattaaaaatcccgccgaaacccgacaacgctatccgcttaccctttaccgccgccgcttccccctcctcctcctcgaccgccgccgccgcctctcccactaaaacaaccgtctccaccgtcgcctccgccaccacgaccgccgccaacgccgccgccgcctccgattccacccgacaaaaaaaacacctcaaccctccctccctccccgctcaaccccctccgctcgcccgccgccgccaactccctccgaccgccgccgccgccaccgctcctaactaaaaaaaaaaaaaaaaaatcgaactaaatcgccccgccgacgactacaacaaatcaaaaacgacgacgaaacgatcgccgctccccaatcctcaactccgactcgctcgacctccccacctccctctacccccacccccctcgcgctcgcctaccctccccccacccccccaactctcgctcgctctcgccgcgactccgccaacccaatccaaatcaaaatactatcacacaatataacgacgcgacgaccgacaaacaccgcgaaatctacaaccgcgactaaaacgacgactataacgaaacctcccctaaccgaacgacgaaaaaacaacaaacgacgacgacgacgactacgactacgacccgaaaatactcttcctccgacctatacccctcccccgacactcgcaatctctacgcctatcttactaaaactaaaaaaaaaacgcgaaccgccgctaaaaccgtacgaaaaaaataccgatacgaacaacccgaaaaaaactaaaaccccctttctccgcctaaaccccccatccttaa

SEQ ID NO: 17537 - DNA, 710 bp, Artificial Sequence
  chemically treated genomic DNA (Homo sapiens) CpG-island No: 17537
gttttttcgtaggaagcggttttcgcgcgtgggcgcgggttcgagtggcgacgtgggtcgcggttttggcgggggagaagtattcggcgggtaggcgcggggtagggaagttcgggggaattcgtagttttttcgtagattcggttagggggcgcgcgttcgaaaacgtttcgtgtgtacgcgttcgttttttttttcgcgtttcgcgcgcgtttttcgtagtttggagtcggagcgttggtttcgcgcggtttggagaggcggagaggtttgtttatcgttttttttgtcgtttacgtttcgttgcgggtcggaggagtagttttcgttcgtaggtgttcggagaggtcgggtcgcggtttttataggtgtcgggaagcggtcgcgcgtatgcgtcggagtttattcgtttggttgcgcgtttcgggttcggcggttgaagaggagtcgcggcgaggtagggcggatttcggggaggtagcggcggggtttggcgggcggaacgggaagtagtcggaaggcgcgtcggaaggggcggcgggttggaagttgtcggcgaaaacggtagtaggcgggaagggaaaaaaagggaagtcggtaagggaaaagtcgggaagggaagtcgtaagggaaaagcgtttcgtatttggcgtaaggtgttttttttttatagttagacggtatagttgatgttttaacgtttggttttt

SEQ ID NO: 17538 - DNA, 710 bp, Artificial Sequence
  chemically treated genomic DNA (Homo sapiens) CpG-island No: 17538
aaaaaccaaacgttaaaacatcaactataccgtctaactataaaaaaaaaacaccttacgccaaatacgaaacgcttttcccttacgacttcccttcccgacttttcccttaccgacttccctttttttcccttcccgcctactaccgttttcgccgacaacttccaacccgccgccccttccgacgcgccttccgactacttcccgttccgcccgccaaaccccgccgctacctccccgaaatccgccctacctcgccgcgactcctcttcaaccgccgaacccgaaacgcgcaaccaaacgaataaactccgacgcatacgcgcgaccgcttcccgacacctataaaaaccgcgacccgacctctccgaacacctacgaacgaaaactactcctccgacccgcaacgaaacgtaaacgacaaaaaaaacgataaacaaacctctccgcctctccaaaccgcgcgaaaccaacgctccgactccaaactacgaaaaacgcgcgcgaaacgcgaaaaaaaaaacgaacgcgtacacacgaaacgttttcgaacgcgcgccccctaaccgaatctacgaaaaaactacgaattcccccgaacttccctaccccgcgcctacccgccgaatacttctcccccgccaaaaccgcgacccacgtcgccactcgaacccgcgcccacgcgcgaaaaccgcttcctacgaaaaaac

SEQ ID NO: 17539 - DNA, 710 bp, Artificial Sequence
  chemically treated genomic DNA (Homo sapiens) CpG-island No: 17539
aagggttaagcgttgaggtattagttgtgtcgtttaattgtgaaaagaaaatattttgcgttaaatacgaaacgttttttttttgcggttttttttttcggttttttttttgtcggttttttttttttttttttttcgtttattgtcgttttcgtcgataatttttaattcgtcgtttttttcgacgcgtttttcggttgtttttcgtttcgttcgttaggtttcgtcgttgttttttcggggttcgttttatttcgtcgcggtttttttttagtcgtcgggttcgggacgcgtagttaggcgggtgggtttcggcgtatgcgcgcggtcgtttttcggtatttgtgggagtcgcggttcggttttttcgagtatttgcgagcgggagttgttttttcgattcgtagcggggcgtgggcggtagagggggcggtggataggttttttcgtttttttaggtcgcgcggagttagcgtttcggttttaggttgcgaggggcgcgcgcggggcgcggggaggggggcgggcgcgtgtatacggggcgttttcgggcgcgcgttttttggtcgggtttgcggaggagttgcgggttttttcgggtttttttgtttcgcgtttgttcgtcgggtgtttttttttcgttaggatcgcggtttacgtcgttattcgagttcgcgtttacgcgcgggggtcgttttttgcgaggaggt

SEQ ID NO: 17540 - DNA, 710 bp, Artificial Sequence
  chemically treated genomic DNA (Homo sapiens) CpG-island No: 17540
acctcctcgcaaaaaacgacccccgcgcgtaaacgcgaactcgaataacgacgtaaaccgcgatcctaacgaaaaaaaaacacccgacgaacaaacgcgaaacaaaaaaacccgaaaaaacccgcaactcctccgcaaacccgaccaaaaaacgcgcgcccgaaaacgccccgtatacacgcgcccgcccccctccccgcgccccgcgcgcgcccctcgcaacctaaaaccgaaacgctaactccgcgcgacctaaaaaaacgaaaaaacctatccaccgccccctctaccgcccacgccccgctacgaatcgaaaaaacaactcccgctcgcaaatactcgaaaaaaccgaaccgcgactcccacaaataccgaaaaacgaccgcgcgcatacgccgaaacccacccgcctaactacgcgtcccgaacccgacgactaaaaaaaaaccgcgacgaaataaaacgaaccccgaaaaaacaacgacgaaacctaacgaacgaaacgaaaaacaaccgaaaaacgcgtcgaaaaaaacgacgaattaaaaattatcgacgaaaacgacaataaacgaaaaaaaaaaaaaaaaaaaaccgacaaaaaaaaaaccgaaaaaaaaaaccgcaaaaaaaaaacgtttcgtatttaacgcaaaatattttcttttcacaattaaacgacacaactaatacctcaacgcttaaccctt

SEQ ID NO: 17541 - DNA, 540 bp, Artificial Sequence
  chemically treated genomic DNA (Homo sapiens) CpG-island No: 17541
  misc_feature (42)..(42): n is either a, c, g or t
tcgcggggtgggcggcggtgggtggttttcgtttcgtttttnggaggtcgcgtggggggcgtgggggttttttcgcgggtttttataggttttttttcgggacgcggtaatttcggtcggaagataatgagtcgttcgcgtcgcgttcgtagttatcgttttcgtcgagggtttcgtcgttttagtcggtatagaagtaggagtagaagtcgaagttaagcgcgcggggttagggcgggggtttttttcggggttgtttcgtttggttttcggcggtcgcggggatcggttgttcggagcgaatgggggttttttttggattcggggttttggggaggggagcgcggtttttggtttttcgtcgtgcgttcggggtgcgggggtgttttggttgttgattttcgcgagtttcgagtatcgcgatttattcgttttatcgcgtcgcggttttcgagttttgtcgggcgttttttgtagttttcgttttatgtgttggggagattttcgggcggtttgggcgggatttcgtaggggtttttt

SEQ ID NO: 17542 - DNA, 540 bp, Artificial Sequence
  chemically treated genomic DNA (Homo sapiens) CpG-island No: 17542
  misc_feature (499)..(499): n is either a, c, g or t
aaaaaacccctacgaaatcccgcccaaaccgcccgaaaatctccccaacacataaaacgaaaactacaaaaaacgcccgacaaaactcgaaaaccgcgacgcgataaaacgaataaatcgcgatactcgaaactcgcgaaaatcaacaaccaaaacacccccgcaccccgaacgcacgacgaaaaaccaaaaaccgcgctcccctccccaaaaccccgaatccaaaaaaaacccccattcgctccgaacaaccgatccccgcgaccgccgaaaaccaaacgaaacaaccccgaaaaaaacccccgccctaaccccgcgcgcttaacttcgacttctactcctacttctataccgactaaaacgacgaaaccctcgacgaaaacgataactacgaacgcgacgcgaacgactcattatcttccgaccgaaattaccgcgtcccgaaaaaaaacctataaaaacccgcgaaaaaacccccacgccccccacgcgacctccnaaaaacgaaacgaaaaccacccaccgccgcccaccccgcga

SEQ ID NO: 17543 - DNA, 540 bp, Artificial Sequence
  chemically treated genomic DNA (Homo sapiens) CpG-island No: 17543
  misc_feature (499)..(499): n is either a, c, g or t
gagggatttttgcggaatttcgtttagatcgttcgggggtttttttagtatatggggcgggggttgtaaggggcgttcggtaggattcgggagtcgcggcgcggtggggcgggtgggtcgcggtgttcggggttcgcgggggttagtagttaggatattttcgtatttcgggcgtacggcggaggattaagggtcgcgtttttttttttagggtttcgagtttaggagagatttttattcgtttcggatagtcgattttcgcgatcgtcgagagttaagcggagtaatttcgggaggagttttcgttttggtttcgcgcgtttggtttcggtttttgtttttgtttttgtgtcggttggggcggcgggattttcggcgggggcggtgattgcgggcgcggcgcgggcggtttattgtttttcggtcggggttgtcgcgtttcgggggagggtttgtggagattcgcgaggaggtttttacgttttttacgcggtttttnggaggcggagcggaaattatttatcgtcgtttatttcgcgg

SEQ ID NO: 17544 - DNA, 540 bp, Artificial Sequence
  chemically treated genomic DNA (Homo sapiens) CpG-island No: 17544
  misc_feature (42)..(42): n is either a, c, g or t
ccgcgaaataaacgacgataaataatttccgctccgcctccnaaaaaccgcgtaaaaaacgtaaaaacctcctcgcgaatctccacaaaccctcccccgaaacgcgacaaccccgaccgaaaaacaataaaccgcccgcgccgcgcccgcaatcaccgcccccgccgaaaatcccgccgccccaaccgacacaaaaacaaaaacaaaaaccgaaaccaaacgcgcgaaaccaaaacgaaaactcctcccgaaattactccgcttaactctcgacgatcgcgaaaatcgactatccgaaacgaataaaaatctctcctaaactcgaaaccctaaaaaaaaaaacgcgacccttaatcctccgccgtacgcccgaaatacgaaaatatcctaactactaacccccgcgaaccccgaacaccgcgacccacccgccccaccgcgccgcgactcccgaatcctaccgaacgccccttacaacccccgccccatatactaaaaaaacccccgaacgatctaaacgaaattccgcaaaaatccctc

SEQ ID NO: 17545 - DNA, 2157 bp, Artificial Sequence
  chemically treated genomic DNA (Homo sapiens) CpG-island No: 17545
aaggttcgattttggttagatttgtaggttgcggaatcgggggcgcgcgggcgtagcgtagtatagttcggttatggagtacgcggtggttttttgcgttttttatttagggattgagttcggggttgtcggggagagcgagagcgagggcgtcgcgttttcggcgtagatattttgtagtttcggcgcgtttttgtgttttagtttcggggaagagttttcgtcgtagtttttcgttttagcggcggaaggcgcggttattttttcgttttttagcggtggttcgcgggtggtggagcggtagtgggaggtcggtagcgcgggcgtcgcgttttcggaggagttcgcgttttttgaggagcgcgcgtgttcggaagagttcgcggcgtcgtttttcgaatcgcgcgtttggtttgaggatttcgcgtttttcgaggagttcggggagttcgcgttcgtattttcggggttcggggcggtgtacggggagtcggatttggtgttggaggtgtcggggcgtcggttgcgcgcgtataaggcggtgttggcggcgcgtagcgattattttcgcgcgcgcgcgtcgcgggacgtgttgcgggtgtagggagtgagtttgacggcgttgcggttgttttttgtttacgtttatagcgagcgtatggcgggcgtgcggttcgataaagtggtcgaggtggtggtcggcgcgcgtcgtttgtagttgttcggcgtcgcgtagcgcgttatcgacgtcgtggggtcgtagttgagtttggttaattgttacgaggttttgagcgcggttaagcggtagcggttgaacgagttgcgcgacgtcgtttattgttttatgagtaataataattggaggtgttgcgcgagttcgtcgtgttcggtcgtttgtcgggcgtagagcgggatttgttgttgcgtcgtcgtttgcgcgtcggtcgcgtttattttttggtcgcggcgttcgggtcggcgggggagcgcgcgggtagtcggttttagagtttttcgggggatcggacgcgcgcggggacgcggtcgtttattgtttttacgcggcggtcggagagtggcgcgagttgacgcggttgttcgagggcgcgtcggcgcggggttgcggtttgtgcgttttttataattattttttcgtggcgggcggcgtggcgttcgcgggtttcgacggtcgcgcgcgttcgttcgattaggttttttgttataattcggttacggatagttggagcgtcgtgaggtttttgcgttaggcgcgttcgtagttgcggttgttggttttggacggttatttttacgtcgtgggcggcgagtgtttgtttagcgtggagcgttacgattcgcgcgtcgatcgttgggttttcgtggcgtcgttgtttcggggcgttttcgtcgtggcgtatgaggttattatttgttacggcgagatttacgtgttcgggggtttttttttttatcgtttgtttaagtatgattcgcggcgcgacgagtggtaggagtgttcgtgtagtagtagtcgcgagcgttcggtcgatatggtggttttcgacggttttatttatcgtttcgatttgagcggtagtcgcggcgaggcgtaggcggcggggtcgagcggggttagcgtgtttcgatattattgtttggttaagtagtggagttcgtgcgtcgcgtttttgcgttttttcggcggttttacgggtttgtagttttttcgttgcgtcgttttggacggcgttatttattgcgtgagtcgcgcgggtatttggcgtttttagtttgttcgggaaggcgaggtcggcggcgacgtaggttagggcggcggtttcgaggcgttgggcgtttttttggacgttcggggtgtgtttatttcgttcgtttttagtttgtttgagaagtcgtttcgaggggagtagggcgtttcgtaggtcggcggggtcggcgggcgtttttttcggtaggggtttgcggggtttaggtttttttgggttcgcggaggaggacgtggtggggagtcggggtcgttggttacgttggtggtttggatatttcgaaggagtttcgaggacgtttttagggtcgttttcgttttgttttttttttgtttgtttttgtttttgggggtggatgttttgagattta

SEQ ID NO: 17546 - DNA, 2157 bp, Artificial Sequence
  chemically treated genomic DNA (Homo sapiens) CpG-island No: 17546
taaatctcaaaacatccacccccaaaaacaaaaacaaacaaaaaaaaaacaaaacgaaaacgaccctaaaaacgtcctcgaaactccttcgaaatatccaaaccaccaacgtaaccaacgaccccgactccccaccacgtcctcctccgcgaacccaaaaaaacctaaaccccgcaaacccctaccgaaaaaaacgcccgccgaccccgccgacctacgaaacgccctactcccctcgaaacgacttctcaaacaaactaaaaacgaacgaaataaacacaccccgaacgtccaaaaaaacgcccaacgcctcgaaaccgccgccctaacctacgtcgccgccgacctcgccttcccgaacaaactaaaaacgccaaatacccgcgcgactcacgcaataaataacgccgtccaaaacgacgcaacgaaaaaactacaaacccgtaaaaccgccgaaaaaacgcaaaaacgcgacgcacgaactccactacttaaccaaacaataatatcgaaacacgctaaccccgctcgaccccgccgcctacgcctcgccgcgactaccgctcaaatcgaaacgataaataaaaccgtcgaaaaccaccatatcgaccgaacgctcgcgactactactacacgaacactcctaccactcgtcgcgccgcgaatcatacttaaacaaacgataaaaaaaaaaacccccgaacacgtaaatctcgccgtaacaaataataacctcatacgccacgacgaaaacgccccgaaacaacgacgccacgaaaacccaacgatcgacgcgcgaatcgtaacgctccacgctaaacaaacactcgccgcccacgacgtaaaaataaccgtccaaaaccaacaaccgcaactacgaacgcgcctaacgcaaaaacctcacgacgctccaactatccgtaaccgaattataacaaaaaacctaatcgaacgaacgcgcgcgaccgtcgaaacccgcgaacgccacgccgcccgccacgaaaaaataattataaaaaacgcacaaaccgcaaccccgcgccgacgcgccctcgaacaaccgcgtcaactcgcgccactctccgaccgccgcgtaaaaacaataaacgaccgcgtccccgcgcgcgtccgatcccccgaaaaactctaaaaccgactacccgcgcgctcccccgccgacccgaacgccgcgaccaaaaaataaacgcgaccgacgcgcaaacgacgacgcaacaacaaatcccgctctacgcccgacaaacgaccgaacacgacgaactcgcgcaacacctccaattattattactcataaaacaataaacgacgtcgcgcaactcgttcaaccgctaccgcttaaccgcgctcaaaacctcgtaacaattaaccaaactcaactacgaccccacgacgtcgataacgcgctacgcgacgccgaacaactacaaacgacgcgcgccgaccaccacctcgaccactttatcgaaccgcacgcccgccatacgctcgctataaacgtaaacaaaaaacaaccgcaacgccgtcaaactcactccctacacccgcaacacgtcccgcgacgcgcgcgcgcgaaaataatcgctacgcgccgccaacaccgccttatacgcgcgcaaccgacgccccgacacctccaacaccaaatccgactccccgtacaccgccccgaaccccgaaaatacgaacgcgaactccccgaactcctcgaaaaacgcgaaatcctcaaaccaaacgcgcgattcgaaaaacgacgccgcgaactcttccgaacacgcgcgctcctcaaaaaacgcgaactcctccgaaaacgcgacgcccgcgctaccgacctcccactaccgctccaccacccgcgaaccaccgctaaaaaacgaaaaaataaccgcgccttccgccgctaaaacgaaaaactacgacgaaaactcttccccgaaactaaaacacaaaaacgcgccgaaactacaaaatatctacgccgaaaacgcgacgccctcgctctcgctctccccgacaaccccgaactcaatccctaaataaaaaacgcaaaaaaccaccgcgtactccataaccgaactatactacgctacgcccgcgcgcccccgattccgcaacctacaaatctaaccaaaatcgaacctt

SEQ ID NO: 17547 - DNA, 2157 bp, Artificial Sequence
  chemically treated genomic DNA (Homo sapiens) CpG-island No: 17547
tgggttttaaggtatttatttttagaagtaaagataagtaaaaggaaagtaaagcgaaagcggttttgagagcgttttcggggttttttcgaagtgtttaaattattagcgtggttagcggtttcgattttttattacgttttttttcgcgggtttaaagggatttgggtttcgtaaatttttgtcgagggagacgttcgtcgatttcgtcggtttacggggcgttttgtttttttcggggcggttttttaggtaggttgagagcgaacgggatgagtatatttcggacgtttaagggggcgtttagcgtttcgaagtcgtcgttttggtttgcgtcgtcgtcggtttcgttttttcgggtaggttggaagcgttaggtgttcgcgcggtttacgtagtagatggcgtcgtttagggcggcgtagcggaagggttgtaggttcgtggggtcgtcggggaggcgtaggggcgcgacgtacgggttttattgtttggttaggtagtggtatcgggatacgttgatttcgttcggtttcgtcgtttgcgtttcgtcgcggttgtcgtttagatcgaagcggtagatgaagtcgtcgagagttattatgtcggtcgagcgttcgcggttgttgttgtacgggtatttttgttattcgtcgcgtcgcgggttatatttgagtaggcgatagaagagggagttttcggatacgtagatttcgtcgtggtaggtggtggttttatgcgttacggcgaaggcgtttcggggtagcggcgttacgggggtttagcggtcggcgcgcgggtcgtagcgttttacgttgagtaggtattcgtcgtttacggcgtagaggtgatcgtttagggttagtagtcgtagttgcgagcgcgtttggcgtaggggttttacggcgttttagttgttcgtggtcgggttgtagtagaagatttggtcggacgggcgcgcgcggtcgtcggggttcgcgggcgttacgtcgttcgttacgaagaggtagttgtagaggacgtataggtcgtagtttcgcgtcggcgcgttttcgggtagtcgcgttagttcgcgttatttttcggtcgtcgcgtggaagtagtagacggtcgcgttttcgcgcgcgttcggtttttcgaggggttttgaggtcggttgttcgcgcgttttttcgtcggttcgagcgtcgcggttaagaggtgggcgcggtcggcgcgtaggcggcggcgtagtagtaggtttcgttttgcgttcgataggcggtcgaatacggcgggttcgcgtagtatttttagttattgttgtttatgaagtagtaggcggcgtcgcgtagttcgtttagtcgttgtcgtttggtcgcgtttaggatttcgtagtagttggttaggtttagttgcggttttacggcgtcggtggcgcgttgcgcggcgtcgggtagttgtaggcggcgcgcgtcggttattatttcggttattttgtcgggtcgtacgttcgttatgcgttcgttgtaggcgtaggtaaggagtagtcgtagcgtcgttaggtttattttttgtattcgtagtacgtttcgcgacgcgcgcgcgcggaagtagtcgttgcgcgtcgttagtatcgttttgtgcgcgcgtagtcggcgtttcgatatttttagtattaggttcggtttttcgtatatcgtttcgaatttcgggggtacgggcgcgggtttttcgggtttttcgggggacgcggggtttttaagttaaacgcgcggttcgggggacggcgtcgcgggttttttcgggtacgcgcgttttttaggggacgcgagttttttcggggacgcggcgttcgcgttgtcggttttttattgtcgttttattattcgcgggttatcgttggagggcggggaggtggtcgcgtttttcgtcgttgaggcgagggattgcggcggggattttttttcggagttgaagtatagggacgcgtcgagattgtagggtgtttgcgtcggggacgcggcgttttcgttttcgtttttttcggtagtttcgggtttagtttttgggtagaggacgtagggggttatcgcgtgttttatggtcgggttgtgttgcgttgcgttcgcgcgttttcggtttcgtagtttgtaggtttggttaaggtcgagtttt

SEQ ID NO: 17548 - DNA, 2157 bp, Artificial Sequence
  chemically treated genomic DNA (Homo sapiens) CpG-island No: 17548
aaaactcgaccttaaccaaacctacaaactacgaaaccgaaaacgcgcgaacgcaacgcaacacaacccgaccataaaacacgcgataaccccctacgtcctctacccaaaaactaaacccgaaactaccgaaaaaaacgaaaacgaaaacgccgcgtccccgacgcaaacaccctacaatctcgacgcgtccctatacttcaactccgaaaaaaaatccccgccgcaatccctcgcctcaacgacgaaaaacgcgaccacctccccgccctccaacgataacccgcgaataataaaacgacaataaaaaaccgacaacgcgaacgccgcgtccccgaaaaaactcgcgtcccctaaaaaacgcgcgtacccgaaaaaacccgcgacgccgtcccccgaaccgcgcgtttaacttaaaaaccccgcgtcccccgaaaaacccgaaaaacccgcgcccgtacccccgaaattcgaaacgatatacgaaaaaccgaacctaatactaaaaatatcgaaacgccgactacgcgcgcacaaaacgatactaacgacgcgcaacgactacttccgcgcgcgcgcgtcgcgaaacgtactacgaatacaaaaaataaacctaacgacgctacgactactccttacctacgcctacaacgaacgcataacgaacgtacgacccgacaaaataaccgaaataataaccgacgcgcgccgcctacaactacccgacgccgcgcaacgcgccaccgacgccgtaaaaccgcaactaaacctaaccaactactacgaaatcctaaacgcgaccaaacgacaacgactaaacgaactacgcgacgccgcctactacttcataaacaacaataactaaaaatactacgcgaacccgccgtattcgaccgcctatcgaacgcaaaacgaaacctactactacgccgccgcctacgcgccgaccgcgcccacctcttaaccgcgacgctcgaaccgacgaaaaaacgcgcgaacaaccgacctcaaaacccctcgaaaaaccgaacgcgcgcgaaaacgcgaccgtctactacttccacgcgacgaccgaaaaataacgcgaactaacgcgactacccgaaaacgcgccgacgcgaaactacgacctatacgtcctctacaactacctcttcgtaacgaacgacgtaacgcccgcgaaccccgacgaccgcgcgcgcccgtccgaccaaatcttctactacaacccgaccacgaacaactaaaacgccgtaaaacccctacgccaaacgcgctcgcaactacgactactaaccctaaacgatcacctctacgccgtaaacgacgaatacctactcaacgtaaaacgctacgacccgcgcgccgaccgctaaacccccgtaacgccgctaccccgaaacgccttcgccgtaacgcataaaaccaccacctaccacgacgaaatctacgtatccgaaaactccctcttctatcgcctactcaaatataacccgcgacgcgacgaataacaaaaatacccgtacaacaacaaccgcgaacgctcgaccgacataataactctcgacgacttcatctaccgcttcgatctaaacgacaaccgcgacgaaacgcaaacgacgaaaccgaacgaaatcaacgtatcccgataccactacctaaccaaacaataaaacccgtacgtcgcgcccctacgcctccccgacgaccccacgaacctacaacccttccgctacgccgccctaaacgacgccatctactacgtaaaccgcgcgaacacctaacgcttccaacctacccgaaaaaacgaaaccgacgacgacgcaaaccaaaacgacgacttcgaaacgctaaacgcccccttaaacgtccgaaatatactcatcccgttcgctctcaacctacctaaaaaaccgccccgaaaaaaacaaaacgccccgtaaaccgacgaaatcgacgaacgtctccctcgacaaaaatttacgaaacccaaatccctttaaacccgcgaaaaaaaacgtaataaaaaatcgaaaccgctaaccacgctaataatttaaacacttcgaaaaaaccccgaaaacgctctcaaaaccgctttcgctttactttccttttacttatctttacttctaaaaataaataccttaaaaccca

SEQ ID NO: 17549 - DNA, 591 bp, Artificial Sequence
  chemically treated genomic DNA (Homo sapiens) CpG-island No: 17549
tttatatcgagtttttttgcgtacgcgcgttgcggagtcggatagttggtggtgttggtttggttcggttgttcgttttcgcgttttgtttcgaagcgcgcgatcgtggcgcgatacgtcggcgtataggcgttttcggggaggggcggcgcgtaggcgcggttgggggtgcgaggttgcgtaggcgcggacggcgttggtttgaagatttttagcgttgttttggcggagtagagataggttttcggggtggaggtgaggagagttgaggtcgcgcgggttttagtttcggagagcggtgggtcgcggtcgagtagagcgttaggcgggaggcgggtttaacggaggttttgtgggtagggagtaggttatcggggcgcggggggtcggggtcgttcgttttcgtcgggattcgttcgggttattttaggcgatggagtcgtagtacggcggggtaagtggttttcgggcgcgggtagcgatttatttcgtcggcgtgtggatcgtattttttttttaggggttagttagaaaggagatcggttttagggaagttggattttcgaattttatatttatttttcgttcgtt

SEQ ID NO: 17550 - DNA, 591 bp, Artificial Sequence
  chemically treated genomic DNA (Homo sapiens) CpG-island No: 17550
aacgaacgaaaaataaatataaaattcgaaaatccaacttccctaaaaccgatctcctttctaactaacccctaaaaaaaaaatacgatccacacgccgacgaaataaatcgctacccgcgcccgaaaaccacttaccccgccgtactacgactccatcgcctaaaataacccgaacgaatcccgacgaaaacgaacgaccccgaccccccgcgccccgataacctactccctacccacaaaacctccgttaaacccgcctcccgcctaacgctctactcgaccgcgacccaccgctctccgaaactaaaacccgcgcgacctcaactctcctcacctccaccccgaaaacctatctctactccgccaaaacaacgctaaaaatcttcaaaccaacgccgtccgcgcctacgcaacctcgcacccccaaccgcgcctacgcgccgcccctccccgaaaacgcctatacgccgacgtatcgcgccacgatcgcgcgcttcgaaacaaaacgcgaaaacgaacaaccgaaccaaaccaacaccaccaactatccgactccgcaacgcgcgtacgcaaaaaaactcgatataaa

SEQ ID NO: 17551 - DNA, 591 bp, Artificial Sequence
  chemically treated genomic DNA (Homo sapiens) CpG-island No: 17551
ggcgggcgggagatgggtgtggggttcgaggatttaatttttttagaatcgattttttttttagttgatttttgggaggaaagtgcggtttatacgtcggcgggataggtcgttgttcgcgttcggaggttatttgtttcgtcgtgttgcggttttatcgtttgaggtggttcgggcgggtttcggcgggagcgagcggtttcggtttttcgcgtttcggtagtttgttttttgtttatagagttttcgttaggttcgtttttcgtttggcgttttgttcggtcgcggtttatcgtttttcgggattggagttcgcgcggttttagttttttttatttttatttcgagggtttgtttttgtttcgttagggtaacgttgaaggtttttaaattaacgtcgttcgcgtttgcgtagtttcgtatttttagtcgcgtttgcgcgtcgttttttttcgagagcgtttgtgcgtcggcgtgtcgcgttacggtcgcgcgtttcggagtaaggcgcggagacgaatagtcgggttaagttagtattattaattgttcggtttcgtagcgcgcgtgcgtaggagggttcggtgtgga

SEQ ID NO: 17552 - DNA, 591 bp, Artificial Sequence
  chemically treated genomic DNA (Homo sapiens) CpG-island No: 17552
tccacaccgaaccctcctacgcacgcgcgctacgaaaccgaacaattaataatactaacttaacccgactattcgtctccgcgccttactccgaaacgcgcgaccgtaacgcgacacgccgacgcacaaacgctctcgaaaaaaaacgacgcgcaaacgcgactaaaaatacgaaactacgcaaacgcgaacgacgttaatttaaaaaccttcaacgttaccctaacgaaacaaaaacaaaccctcgaaataaaaataaaaaaaactaaaaccgcgcgaactccaatcccgaaaaacgataaaccgcgaccgaacaaaacgccaaacgaaaaacgaacctaacgaaaactctataaacaaaaaacaaactaccgaaacgcgaaaaaccgaaaccgctcgctcccgccgaaacccgcccgaaccacctcaaacgataaaaccgcaacacgacgaaacaaataacctccgaacgcgaacaacgacctatcccgccgacgtataaaccgcactttcctcccaaaaatcaactaaaaaaaaaatcgattctaaaaaaattaaatcctcgaaccccacacccatctcccgcccgcc

SEQ ID NO: 17553 - DNA, 595 bp, Artificial Sequence
  chemically treated genomic DNA (Homo sapiens) CpG-island No: 17553
aggtttcgcgtaggaggtagcgtagtaaaagaattttttatttcgtatttttttcgtttttgtattttgcgagtagtaggattatataaagtgatcggcgtttgtttttgttagtagttttgttcggcggtcggaggcgggacgaacgcgcgtatttcgttggggattaaaaatttgttgttcgtggtggtttcggacgtcgggacgtagttcgatttgcggaggtcggttcgtatttgtttgtacgtcggtgtagtggaaaagttgagggggtttgggaagggaggggatattaggcgttaggttgtgattagcgttgtaatcgtcgtaaattatcgacgggtagagttagtttatttaagttgaaagagagggggaaggcgatggaggttgcggttagttttttttaaaattcgttagtgttcgagttggtttcggcgtttttttttgtttttgtttaaatcgagggttagaagtttacggatttttttttggcggttaagatttttgttgagtatttttacgaatttattggaatcgagtaacgatttttttttttttgttggttttgttattttcgggaattcgaaatatt

SEQ ID NO: 17554 - DNA, 595 bp, Artificial Sequence
  chemically treated genomic DNA (Homo sapiens) CpG-island No: 17554
aatatttcgaattcccgaaaataacaaaaccaacaaaaaaaaaaaaatcgttactcgattccaataaattcgtaaaaatactcaacaaaaatcttaaccgccaaaaaaaaatccgtaaacttctaaccctcgatttaaacaaaaacaaaaaaaaacgccgaaaccaactcgaacactaacgaattttaaaaaaaactaaccgcaacctccatcgccttccccctctctttcaacttaaataaactaactctacccgtcgataatttacgacgattacaacgctaatcacaacctaacgcctaatatcccctcccttcccaaaccccctcaacttttccactacaccgacgtacaaacaaatacgaaccgacctccgcaaatcgaactacgtcccgacgtccgaaaccaccacgaacaacaaatttttaatccccaacgaaatacgcgcgttcgtcccgcctccgaccgccgaacaaaactactaacaaaaacaaacgccgatcactttatataatcctactactcgcaaaatacaaaaacgaaaaaaatacgaaataaaaaattcttttactacgctacctcctacgcgaaacct

SEQ ID NO: 17555 - DNA, 595 bp, Artificial Sequence
  chemically treated genomic DNA (Homo sapiens) CpG-island No: 17555
ggtgtttcgaattttcggaagtagtaaagttaataggaaagggagaatcgttgttcggttttagtgaattcgtggggatgtttagtaaaagttttggtcgttagaaagagattcgtgggtttttgattttcggtttaggtaaaaatagggggaggcgtcgagattagttcgagtattagcggattttgagagaaattgatcgtaatttttatcgtttttttttttttttttaatttggatgggttgattttattcgtcggtgatttacgacgattgtagcgttagttatagtttggcgtttggtgttttttttttttttaagtttttttagtttttttattgtatcggcgtataagtaagtgcgagtcggttttcgtaagtcggattacgtttcggcgttcgaggttattacgggtagtagatttttggtttttagcgaggtgcgcgcgttcgtttcgttttcgatcgtcgagtagagttgttagtagaagtaggcgtcggttattttatataattttgttgttcgtagggtgtaagagcgggaaaagtgcggagtagggaatttttttgttgcgttgttttttacgcggagttt

SEQ ID NO: 17556 - DNA, 595 bp, Artificial Sequence
  chemically treated genomic DNA (Homo sapiens) CpG-island No: 17556
aaactccgcgtaaaaaacaacgcaacaaaaaaattccctactccgcacttttcccgctcttacaccctacgaacaacaaaattatataaaataaccgacgcctacttctactaacaactctactcgacgatcgaaaacgaaacgaacgcgcgcacctcgctaaaaaccaaaaatctactacccgtaataacctcgaacgccgaaacgtaatccgacttacgaaaaccgactcgcacttacttatacgccgatacaataaaaaaactaaaaaaacttaaaaaaaaaaaaaacaccaaacgccaaactataactaacgctacaatcgtcgtaaatcaccgacgaataaaatcaacccatccaaattaaaaaaaaaaaaaaaaacgataaaaattacgatcaatttctctcaaaatccgctaatactcgaactaatctcgacgcctccccctatttttacctaaaccgaaaatcaaaaacccacgaatctctttctaacgaccaaaacttttactaaacatccccacgaattcactaaaaccgaacaacgattctccctttcctattaactttactacttccgaaaattcgaaacacc

SEQ ID NO: 17557 - DNA, 556 bp, Artificial Sequence
  chemically treated genomic DNA (Homo sapiens) CpG-island No: 17557
gtcggcgatgtttaggtgttttatgaagaagaagaggcgcgagtgtttttggcgtgtggtgcgtagttttagtagtatatacgggttttcgttaagcgttagaaggaggatagatatagtatagttattttacgggcgatagggtttcgtgtaatcgagggggttcgacggtgcggttgttttcggtttacggcggagcggcgttggagttggatgtttcggcgttttagttggatgcgagcgcgttttttatgattttggcggtatcggtgcgtttcggttttcgagttttttacggtttggcgcggttgggtcgtattaggcgtgtagaagggtgtaggggcgttcggggttttatttttggagattttacgaacggatatgttgggtttatcgtgaaataaatcgggagggtcgtgaggagatcgtcgcgtttttttttagacgcgggtagggcgtgtttgttttatttttaggaatttaatttatttgaaataatagggtataatcgtcggtttcgggttgtttagtcgttattttagaaattttcgttgga

SEQ ID NO: 17558 - DNA, 556 bp, Artificial Sequence
  chemically treated genomic DNA (Homo sapiens) CpG-island No: 17558
tccaacgaaaatttctaaaataacgactaaacaacccgaaaccgacgattataccctattatttcaaataaattaaattcctaaaaataaaacaaacacgccctacccgcgtctaaaaaaaaacgcgacgatctcctcacgaccctcccgatttatttcacgataaacccaacatatccgttcgtaaaatctccaaaaataaaaccccgaacgcccctacacccttctacacgcctaatacgacccaaccgcgccaaaccgtaaaaaactcgaaaaccgaaacgcaccgataccgccaaaatcataaaaaacgcgctcgcatccaactaaaacgccgaaacatccaactccaacgccgctccgccgtaaaccgaaaacaaccgcaccgtcgaaccccctcgattacacgaaaccctatcgcccgtaaaataactatactatatctatcctccttctaacgcttaacgaaaacccgtatatactactaaaactacgcaccacacgccaaaaacactcgcgcctcttcttcttcataaaacacctaaacatcgccgac

SEQ ID NO: 17559 - DNA, 556 bp, Artificial Sequence
  chemically treated genomic DNA (Homo sapiens) CpG-island No: 17559
tttaacggggatttttggggtggcggttgagtaattcgaggtcggcggttgtgttttgttgttttagatgagttgggtttttgggaatgggataagtacgttttattcgcgtttgaagagaaacgcggcggtttttttacggttttttcggtttgttttacggtggatttagtatattcgttcgtggagtttttaggagtggagtttcgggcgtttttatatttttttatacgtttgatgcggtttagtcgcgttaagtcgtaaagggttcgaaggtcggggcgtatcgatgtcgttagggttatggagggcgcgttcgtatttaattggagcgtcgaggtatttaattttagcgtcgtttcgtcgtgggtcgaaggtaatcgtatcgtcggattttttcggttgtacgaggttttgtcgttcgtgaagtagttgtgttgtgtttattttttttttggcgtttaacgggaattcgtgtgtgttgttggggttgcgtattatacgttagaagtattcgcgtttttttttttttatgaagtatttaagtatcgtcgat

SEQ ID NO: 17560 - DNA, 556 bp, Artificial Sequence
  chemically treated genomic DNA (Homo sapiens) CpG-island No: 17560
atcgacgatacttaaatacttcataaaaaaaaaaaaacgcgaatacttctaacgtataatacgcaaccccaacaacacacacgaattcccgttaaacgccaaaaaaaaaataaacacaacacaactacttcacgaacgacaaaacctcgtacaaccgaaaaaatccgacgatacgattaccttcgacccacgacgaaacgacgctaaaattaaatacctcgacgctccaattaaatacgaacgcgccctccataaccctaacgacatcgatacgccccgaccttcgaaccctttacgacttaacgcgactaaaccgcatcaaacgtataaaaaaatataaaaacgcccgaaactccactcctaaaaactccacgaacgaatatactaaatccaccgtaaaacaaaccgaaaaaaccgtaaaaaaaccgccgcgtttctcttcaaacgcgaataaaacgtacttatcccattcccaaaaacccaactcatctaaaacaacaaaacacaaccgccgacctcgaattactcaaccgccaccccaaaaatccccgttaaa

SEQ ID NO: 17561 - DNA, 1360 bp, Artificial Sequence
  chemically treated genomic DNA (Homo sapiens) CpG-island No: 17561
gttttcggcgatatttggagttcgtagttgagttattgatttttattcgggttttttcgttttcgttcggtcgtgatttgtttcggttttaaaagggaggaagggcgggaatgttcgggaagagtttggggttggtaggatttttagggggtggaatgaatgtcgtgagggcgagtaaggaggtatcggttggggttgaaaatgcgtacggggattatgagggtgattcgttttgagtcgttgcgaacgttttgcgagttggggtggttttggaggttttggagtagaagttaggttttcgtagagttcgttgtagcgtcgttggcgatcgggttgggttttattttttacgaaaagtttcgcggtttcggtcgcggaggtgttggagtttttgcgtttagacgaagggtcgaacggttagggttaggtcgcgtttttagagtttggcgagggtttcgcgttgttgggaaggcggaaacgtcggggcgcgcgtgtattttcgcgtttgtagcgtcgcgtacggtcgttaggtgtcgttgtggcgtttagcgcgtcgttcgtttcgttttagggaacgcgaaagtggcgcgggtttggacggcgggacggattacgtagggcgttgagaaggtcgcgttacggtgggcggggtttcgggtttttttttttcggtttttttcgcgttgtggttcgtttcgggcgcgttgcgttcgcgagtttttaggaggtttggcgggtatcgtaattagcgtcgcggatatcggtatcggcgttacggatttcgtaggatttcgcgttcgtcgtcgtcgttatgttggggttgttggtggcgttgttggttttggggttcgttgtttttgcgttgttggacgtttggtatttggtgcgtttttcgtgcgtcgtgttgcgcgcgcgtttgttgtagtcgcgcgttcgtgatttgttagttgagtagcgtttttcgggtcgcgtgttgttttcggatttggatttgttgttgtatatgaataacgcgcgttatttgcgcgaggtcgattttgcgcgcgtcgcgtatttgattcgttgcggggtgttcggggcgttgagggagttgcgggcgtatacggtgttggcggtttcgtgcgcgcgttatcgtcgttcgttgcgtttgttggaattttttaaggtgcgtattcgtttgttgggttgggataatcgcgcgttttatttggaagcgcgttttgttagtttgcgggacggtttcgtgtgcgcgttgttgcgttttcggtagtatttgttgggtattttattcgagcgcgtcgtgtagtttttgtgttagcgtagggtgagcggttttcgtttttggtttcggagtagggtt

SEQ ID NO: 17562 - DNA, 1360 bp, Artificial Sequence
  chemically treated genomic DNA (Homo sapiens) CpG-island No: 17562
aaccctactccgaaaccaaaaacgaaaaccgctcaccctacgctaacacaaaaactacacgacgcgctcgaataaaatacccaacaaatactaccgaaaacgcaacaacgcgcacacgaaaccgtcccgcaaactaacaaaacgcgcttccaaataaaacgcgcgattatcccaacccaacaaacgaatacgcaccttaaaaaattccaacaaacgcaacgaacgacgataacgcgcgcacgaaaccgccaacaccgtatacgcccgcaactccctcaacgccccgaacaccccgcaacgaatcaaatacgcgacgcgcgcaaaatcgacctcgcgcaaataacgcgcgttattcatatacaacaacaaatccaaatccgaaaacaacacgcgacccgaaaaacgctactcaactaacaaatcacgaacgcgcgactacaacaaacgcgcgcgcaacacgacgcacgaaaaacgcaccaaataccaaacgtccaacaacgcaaaaacaacgaaccccaaaaccaacaacgccaccaacaaccccaacataacgacgacgacgaacgcgaaatcctacgaaatccgtaacgccgataccgatatccgcgacgctaattacgatacccgccaaacctcctaaaaactcgcgaacgcaacgcgcccgaaacgaaccacaacgcgaaaaaaaccgaaaaaaaaaaacccgaaaccccgcccaccgtaacgcgaccttctcaacgccctacgtaatccgtcccgccgtccaaacccgcgccactttcgcgttccctaaaacgaaacgaacgacgcgctaaacgccacaacgacacctaacgaccgtacgcgacgctacaaacgcgaaaatacacgcgcgccccgacgtttccgccttcccaacaacgcgaaaccctcgccaaactctaaaaacgcgacctaaccctaaccgttcgacccttcgtctaaacgcaaaaactccaacacctccgcgaccgaaaccgcgaaacttttcgtaaaaaataaaacccaacccgatcgccaacgacgctacaacgaactctacgaaaacctaacttctactccaaaacctccaaaaccaccccaactcgcaaaacgttcgcaacgactcaaaacgaatcaccctcataatccccgtacgcattttcaaccccaaccgatacctccttactcgccctcacgacattcattccaccccctaaaaatcctaccaaccccaaactcttcccgaacattcccgcccttcctcccttttaaaaccgaaacaaatcacgaccgaacgaaaacgaaaaaacccgaataaaaatcaataactcaactacgaactccaaatatcgccgaaaac

SEQ ID NO: 17563 - DNA, 1360 bp, Artificial Sequence
  chemically treated genomic DNA (Homo sapiens) CpG-island No: 17563
ggttttgtttcggggttaggggcgggggtcgtttattttgcgttggtataggagttgtacgacgcgttcgggtgaggtgtttagtaggtgttgtcggaagcgtagtagcgcgtatacgaaatcgtttcgtaggttgataaagcgcgtttttaggtagaacgcgcggttgttttagtttagtaggcgggtgcgtattttgaagggttttagtaggcgtagcgagcggcggtggcgcgcgtacgaggtcgttagtatcgtgtgcgttcgtaatttttttagcgtttcgagtatttcgtagcgggttaggtgcgcgacgcgcgtaaagtcggtttcgcgtaggtagcgcgcgttgtttatgtgtaatagtaggtttaagttcgagggtagtacgcggttcgggaagcgttgtttagttagtaggttacggacgcgcggttgtagtaggcgcgcgcgtagtacggcgtacggaaggcgtattaggtattagacgtttagtagcgtaaagatagcgagttttagggttagtaacgttattagtagttttagtatagcggcggcggcgggcgcggggttttgcggagttcgtggcgtcggtgtcggtgttcgcggcgttggttacggtgttcgttaggttttttgggaattcgcgagcgtagcgcgttcggagcgaattatagcgcgagggaggtcgagggggaggggttcggagtttcgtttatcgtggcgcgatttttttagcgttttacgtggttcgtttcgtcgtttaggttcgcgttattttcgcgttttttggggcggggcgggcggcgcgttgagcgttatagcggtatttggcggtcgtgcgcggcgttgtaggcgcgagggtgtacgcgcgtttcggcgttttcgtttttttagtagcgcgagattttcgttaggttttgaagacgcggtttggttttggtcgttcggtttttcgtttgagcgtaaaggttttagtattttcgcggtcgaagtcgcgggatttttcgtggaaaatgggatttagttcgatcgttagcggcgttgtagcggattttgcgggaatttagtttttgttttaggatttttagggttattttagttcgtagggcgttcgtagcggtttagggcgaattatttttatggttttcgtgcgtatttttagttttagtcggtatttttttattcgtttttacgatatttattttattttttaaaggttttgttaattttaggtttttttcgagtattttcgtttttttttttttttgaaatcggagtaaattacggtcgggcggaagcgggggagttcgggtgagagttagtgatttagttgcggattttaagtgtcgtcggaggt

SEQ ID NO: 17564 - DNA, 1360 bp, Artificial Sequence
  chemically treated genomic DNA (Homo sapiens) CpG-island No: 17564
acctccgacgacacttaaaatccgcaactaaatcactaactctcacccgaactcccccgcttccgcccgaccgtaatttactccgatttcaaaaaaaaaaaaaaacgaaaatactcgaaaaaaacctaaaattaacaaaacctttaaaaaataaaataaatatcgtaaaaacgaataaaaaaataccgactaaaactaaaaatacgcacgaaaaccataaaaataattcgccctaaaccgctacgaacgccctacgaactaaaataaccctaaaaatcctaaaacaaaaactaaattcccgcaaaatccgctacaacgccgctaacgatcgaactaaatcccattttccacgaaaaatcccgcgacttcgaccgcgaaaatactaaaacctttacgctcaaacgaaaaaccgaacgaccaaaaccaaaccgcgtcttcaaaacctaacgaaaatctcgcgctactaaaaaaacgaaaacgccgaaacgcgcgtacaccctcgcgcctacaacgccgcgcacgaccgccaaataccgctataacgctcaacgcgccgcccgccccgccccaaaaaacgcgaaaataacgcgaacctaaacgacgaaacgaaccacgtaaaacgctaaaaaaatcgcgccacgataaacgaaactccgaacccctccccctcgacctccctcgcgctataattcgctccgaacgcgctacgctcgcgaattcccaaaaaacctaacgaacaccgtaaccaacgccgcgaacaccgacaccgacgccacgaactccgcaaaaccccgcgcccgccgccgccgctatactaaaactactaataacgttactaaccctaaaactcgctatctttacgctactaaacgtctaatacctaatacgccttccgtacgccgtactacgcgcgcgcctactacaaccgcgcgtccgtaacctactaactaaacaacgcttcccgaaccgcgtactaccctcgaacttaaacctactattacacataaacaacgcgcgctacctacgcgaaaccgactttacgcgcgtcgcgcacctaacccgctacgaaatactcgaaacgctaaaaaaattacgaacgcacacgatactaacgacctcgtacgcgcgccaccgccgctcgctacgcctactaaaacccttcaaaatacgcacccgcctactaaactaaaacaaccgcgcgttctacctaaaaacgcgctttatcaacctacgaaacgatttcgtatacgcgctactacgcttccgacaacacctactaaacacctcacccgaacgcgtcgtacaactcctataccaacgcaaaataaacgacccccgcccctaaccccgaaacaaaacc

SEQ ID NO: 17565 - DNA, 631 bp, Artificial Sequence
  chemically treated genomic DNA (Homo sapiens) CpG-island No: 17565
acgaggcgaggttttttagaggtttttaggcgttacgggtcgtttgaacgtttcgtttttacggtttggtcggggcggtggttacgcggtgttaggtaaacgtcgttcggttttgttttttcggttcgtggttgtggagggcgagttaggtttattcgttcgttgggagttttttggatttcgttgtttcgtagttaggttggcgtttgtttatattcgcggtagggttacgattagtagtaaggcgagtagcgttatcgtttttagcggtgtttagggaaggttagcgcgcggcgtttttttttcgtttttttggaattttcgtagttttcgcgcgtttttttttgggtttggtcggtagggggagtttcgttcgtttcggggcgcgcgttttttattcgtcggggtttgtttgggtttttggatttttattttagggttttttcgtcgttggcggttttgaacgtcggttttgattttttttttttgttgttgtttggacgcggtcggttggttatgtatgaaacgggcgcgggacgttttgtgaaagggttttttttgaaacgtttttttttattttattgggttttttttttgtggattttacgggttatataatgttgtcggcggt

SEQ ID NO: 17566 - DNA, 631 bp, Artificial Sequence
  chemically treated genomic DNA (Homo sapiens) CpG-island No: 17566
accgccgacaacattatataacccgtaaaatccacaaaaaaaaaacccaataaaataaaaaaaaacgtttcaaaaaaaaccctttcacaaaacgtcccgcgcccgtttcatacataaccaaccgaccgcgtccaaacaacaacaaaaaaaaaaaatcaaaaccgacgttcaaaaccgccaacgacgaaaaaaccctaaaataaaaatccaaaaacccaaacaaaccccgacgaataaaaaacgcgcgccccgaaacgaacgaaactccccctaccgaccaaacccaaaaaaaaacgcgcgaaaactacgaaaattccaaaaaaacgaaaaaaaaacgccgcgcgctaaccttccctaaacaccgctaaaaacgataacgctactcgccttactactaatcgtaaccctaccgcgaatataaacaaacgccaacctaactacgaaacaacgaaatccaaaaaactcccaacgaacgaataaacctaactcgccctccacaaccacgaaccgaaaaaacaaaaccgaacgacgtttacctaacaccgcgtaaccaccgccccgaccaaaccgtaaaaacgaaacgttcaaacgacccgtaacgcctaaaaacctctaaaaaacctcgcctcgt

SEQ ID NO: 17567 - DNA, 631 bp, Artificial Sequence
  chemically treated genomic DNA (Homo sapiens) CpG-island No: 17567
gtcgtcgataatattatgtggttcgtggggtttataagaagaaggtttaatgggataagggggggcgttttaaaaagagtttttttatagggcgtttcgcgttcgttttatgtatggttagtcggtcgcgtttaaatagtagtaaaaggggggaattagaatcggcgtttagggtcgttagcggcggggaggttttgagatgagggtttaaagatttaaataggtttcggcgggtgggaggcgcgcgtttcggggcgggcggggttttttttatcggttagatttagggagaggcgcgcggaggttgcgaaggttttagaagggcggggagggggcgtcgcgcgttgattttttttgggtatcgttggggacgatggcgttgttcgttttgttgttggtcgtggttttatcgcgggtgtggatagacgttaatttgattgcgagataacgagatttagaggatttttagcggacgggtgagtttggttcgttttttatagttacgggtcgagaggatagggtcgggcggcgtttgtttggtatcgcgtggttatcgtttcgattaggtcgtgagaacggagcgtttaggcggttcgtggcgtttggaagtttttggggagtttcgtttcgt

SEQ ID NO: 17568 - DNA, 631 bp, Artificial Sequence
  chemically treated genomic DNA (Homo sapiens) CpG-island No: 17568
acgaaacgaaactccccaaaaacttccaaacgccacgaaccgcctaaacgctccgttctcacgacctaatcgaaacgataaccacgcgataccaaacaaacgccgcccgaccctatcctctcgacccgtaactataaaaaacgaaccaaactcacccgtccgctaaaaatcctctaaatctcgttatctcgcaatcaaattaacgtctatccacacccgcgataaaaccacgaccaacaacaaaacgaacaacgccatcgtccccaacgatacccaaaaaaaatcaacgcgcgacgccccctccccgcccttctaaaaccttcgcaacctccgcgcgcctctccctaaatctaaccgataaaaaaaaccccgcccgccccgaaacgcgcgcctcccacccgccgaaacctatttaaatctttaaaccctcatctcaaaacctccccgccgctaacgaccctaaacgccgattctaattccccccttttactactatttaaacgcgaccgactaaccatacataaaacgaacgcgaaacgccctataaaaaaactctttttaaaacgcccccccttatcccattaaaccttcttcttataaaccccacgaaccacataatattatcgacgac

SEQ ID NO: 17569 - DNA, 1394 bp, Artificial Sequence
  chemically treated genomic DNA (Homo sapiens) CpG-island No: 17569
cgtgtcgtatttgtatagcgttgatgtcggcgttttgtttgttttttagtttttgtagttgtttttttagcgttttatttatgtttcggtatgtttcgatttttagggttttggttttgagtagacgacggttttcggatatttcgtttttggcggcgcgtacggcgtcggtgtttttggcggcgttttcggttagtacggtgaagcggtttttgaattattttttagcgttttgtatgtttttggcggttagtttttcgtattgcgcgcggatgtttttgagcgcggcggaaaggtcgggtttggttacgtttatttttacggagatttgcgcgtattggatttgcgtttgtagttcggcgatttttttttcgtgtattttttttagaaaagagatttcgtttattaagttgtcgatgcgtttttcgagttcggcgcgagcgagcgtcgtttcgtcggcgtttttgcgcgtttttattagtcggttttcggcgttttcgcggtttagtattttttttttatagcgcgtttgtaggttgcgtagggttttttttagtttttcgcgttcgttttggagcgtttgtttttcgttggtggtatttttcgtcgttaggcgtaggtcgcggattttttgttcgtatagcgttcggaagcgggatggttcggagtgtttttggcgtagtattagtagttcggtttttaggattttgttttgttgttttagttcgtgtacgcgttcgatgaagttggcgaagcggttattgaggttttggagttgcgtttttttttgcgtgcggatggatttgaggtcgttgttgatggcggttatttggtttaggtcgaggttttttagattgggtattaacgatttagagttggaggagtagttgcggcgtacggatagcgaggaagatatcggcgtcgagtagttggagtaagttgagcgtgcggtgttgtagtcgttgcgtacgttggagatgtgtattcggggcgtttttacgtagcgtcgtttgtaggaggtcgagtagtacggttcgtagttgaaggaatttatggtggcggtcggtggtttttcggttcgcggcggcggtgggagttcggagagagaggataggggagagagggaagggggaggatggatggttgtgtgcggttcggcgtcgttttgttatttttatttatacgtcgggaggtttttgacgtagtttgcgatcgattacggtacgtcggttagtgggggtagcgcgttgttgtagttaaggcgaggattttgcgtaaaagggaaggcggggtcgagttacggttcgaggagttgcggcggtcgttttttttattttgtttagagggttttgattttttttgagattttatgtttttttatttatttttttttt

SEQ ID NO: 17570 - DNA, 1394 bp, Artificial Sequence
  chemically treated genomic DNA (Homo sapiens) CpG-island No: 17570
aaaaaaaaaataaataaaaaaacataaaatctcaaaaaaaatcaaaaccctctaaacaaaataaaaaaaacgaccgccgcaactcctcgaaccgtaactcgaccccgccttcccttttacgcaaaatcctcgccttaactacaacaacgcgctacccccactaaccgacgtaccgtaatcgatcgcaaactacgtcaaaaacctcccgacgtataaataaaaataacaaaacgacgccgaaccgcacacaaccatccatcctcccccttccctctctcccctatcctctctctccgaactcccaccgccgccgcgaaccgaaaaaccaccgaccgccaccataaattccttcaactacgaaccgtactactcgacctcctacaaacgacgctacgtaaaaacgccccgaatacacatctccaacgtacgcaacgactacaacaccgcacgctcaacttactccaactactcgacgccgatatcttcctcgctatccgtacgccgcaactactcctccaactctaaatcgttaatacccaatctaaaaaacctcgacctaaaccaaataaccgccatcaacaacgacctcaaatccatccgcacgcaaaaaaaaacgcaactccaaaacctcaataaccgcttcgccaacttcatcgaacgcgtacacgaactaaaacaacaaaacaaaatcctaaaaaccgaactactaatactacgccaaaaacactccgaaccatcccgcttccgaacgctatacgaacaaaaaatccgcgacctacgcctaacgacgaaaaataccaccaacgaaaaacaaacgctccaaaacgaacgcgaaaaactaaaaaaaaccctacgcaacctacaaacgcgctataaaaaaaaaatactaaaccgcgaaaacgccgaaaaccgactaataaaaacgcgcaaaaacgccgacgaaacgacgctcgctcgcgccgaactcgaaaaacgcatcgacaacttaataaacgaaatctcttttctaaaaaaaatacacgaaaaaaaaatcgccgaactacaaacgcaaatccaatacgcgcaaatctccgtaaaaataaacgtaaccaaacccgacctttccgccgcgctcaaaaacatccgcgcgcaatacgaaaaactaaccgccaaaaacatacaaaacgctaaaaaataattcaaaaaccgcttcaccgtactaaccgaaaacgccgccaaaaacaccgacgccgtacgcgccgccaaaaacgaaatatccgaaaaccgtcgtctactcaaaaccaaaaccctaaaaatcgaaacataccgaaacataaataaaacgctaaaaaaacaactacaaaaactaaaaaacaaacaaaacgccgacatcaacgctatacaaatacgacacg

SEQ ID NO: 17571 - DNA, 1394 bp, Artificial Sequence
  chemically treated genomic DNA (Homo sapiens) CpG-island No: 17571
agaagggaaatgagtgagggggtatgggattttagagaaaattagggttttttgagtaaagtggaaaggacgatcgtcgtagtttttcgggtcgtagttcgatttcgtttttttttttgcgtagaattttcgttttggttgtagtagcgcgttgtttttattggtcggcgtgtcgtgatcgatcgtaggttgcgttaggagtttttcggcgtataaataggggtggtagaacggcgtcgagtcgtatatagttatttattttttttttttttttttttttttgtttttttttttcgggtttttatcgtcgtcgcgggtcggggagttatcggtcgttattatgagtttttttagttacgagtcgtattattcgattttttataagcggcgttacgtggagacgtttcgggtgtatatttttagcgtgcgtagcggttatagtatcgtacgtttagtttattttagttattcggcgtcggtgtttttttcgttgttcgtgcgtcgtagttatttttttagttttggatcgttgatgtttagtttggagaatttcgatttgagttaggtagtcgttattagtaacgattttaagtttattcgtacgtaggagaaggcgtagttttaggattttaatgatcgtttcgttagttttatcgagcgcgtgtacgagttggagtagtagaataaggttttggaagtcgagttgttggtgttgcgttagaagtatttcgagttatttcgttttcgggcgttgtacgagtaggagattcgcgatttgcgtttggcggcggaagatgttattaacgagaagtaggcgttttagggcgagcgcgaagggttggaggagattttgcgtaatttgtaggcgcgttatgaagaggaggtgttgagtcgcgaggacgtcgagggtcggttgatggaagcgcgtaaaggcgtcgacgaggcggcgttcgttcgcgtcgagttcgagaagcgtatcgatagtttgatggacgaaattttttttttgaagaaagtgtacgaagaggagatcgtcgaattgtaggcgtagatttagtacgcgtagattttcgtggagatggacgtgattaagttcgattttttcgtcgcgtttaaggatattcgcgcgtagtacgagaagttggtcgttaagaatatgtagaacgttgaggaatggtttaagagtcgttttatcgtgttgatcgagagcgtcgttaagaatatcgacgtcgtgcgcgtcgttaaggacgaggtgttcgagagtcgtcgtttgtttaaggttaagattttggaaatcgaagtatgtcggggtatgaatgaagcgttggagaagtagttgtaggagttggaggataagtagaacgtcgatattagcgttatgtaggtgcggtacg

SEQ ID NO: 17572 - DNA, 1394 bp, Artificial Sequence
  chemically treated genomic DNA (Homo sapiens) CpG-island No: 17572
cgtaccgcacctacataacgctaatatcgacgttctacttatcctccaactcctacaactacttctccaacgcttcattcataccccgacatacttcgatttccaaaatcttaaccttaaacaaacgacgactctcgaacacctcgtccttaacgacgcgcacgacgtcgatattcttaacgacgctctcgatcaacacgataaaacgactcttaaaccattcctcaacgttctacatattcttaacgaccaacttctcgtactacgcgcgaatatccttaaacgcgacgaaaaaatcgaacttaatcacgtccatctccacgaaaatctacgcgtactaaatctacgcctacaattcgacgatctcctcttcgtacactttcttcaaaaaaaaaatttcgtccatcaaactatcgatacgcttctcgaactcgacgcgaacgaacgccgcctcgtcgacgcctttacgcgcttccatcaaccgaccctcgacgtcctcgcgactcaacacctcctcttcataacgcgcctacaaattacgcaaaatctcctccaacccttcgcgctcgccctaaaacgcctacttctcgttaataacatcttccgccgccaaacgcaaatcgcgaatctcctactcgtacaacgcccgaaaacgaaataactcgaaatacttctaacgcaacaccaacaactcgacttccaaaaccttattctactactccaactcgtacacgcgctcgataaaactaacgaaacgatcattaaaatcctaaaactacgccttctcctacgtacgaataaacttaaaatcgttactaataacgactacctaactcaaatcgaaattctccaaactaaacatcaacgatccaaaactaaaaaaataactacgacgcacgaacaacgaaaaaaacaccgacgccgaataactaaaataaactaaacgtacgatactataaccgctacgcacgctaaaaatatacacccgaaacgtctccacgtaacgccgcttataaaaaatcgaataatacgactcgtaactaaaaaaactcataataacgaccgataactccccgacccgcgacgacgataaaaacccgaaaaaaaaaaacaaaaaaaaaaaaaaaaaaaaaaaataaataactatatacgactcgacgccgttctaccacccctatttatacgccgaaaaactcctaacgcaacctacgatcgatcacgacacgccgaccaataaaaacaacgcgctactacaaccaaaacgaaaattctacgcaaaaaaaaaaacgaaatcgaactacgacccgaaaaactacgacgatcgtcctttccactttactcaaaaaaccctaattttctctaaaatcccataccccctcactcatttcccttct

SEQ ID NO: 17573 - DNA, 1076 bp, Artificial Sequence
  chemically treated genomic DNA (Homo sapiens) CpG-island No: 17573
gattcgttttgtgtttagtttaagcgttggtcggattttaagtatttttgtttattatttcgtttcgcgttttcgattttagtcgggttttggttcgggagcgtttattttgtagcgtagttcgcgtttagtgtggatgtatagcgttcgggatatatgttcgcgttcggttaggggtagtagtaggtagtcggcgatgcggttgggtttcggcgcgttttcggagttttcgtcggttttcggagcggtaggcgggggttgcgggttgtagggcgagtcgggggggttgaggtagttcggggggttggagtattcggagaggcgcgggtatttggtcgttatagtcgtcgcgtcgtcggcgtttagtaggcgtttggtcgggacgtttcgggtggttgggaagagtagggtcgggtcgcggggttgcgaggcgtcgtttatggtagagcgtatcggatcgattcgtatttcgttttgggtcggggtggtttcggttttttaagtttcgggattcgcgcgggaagacgttgcgggtttggtgtcggtttcgcgattttttttagtcggcgggatggagtttgtagattggttttggttcggtttttacgaggggtaaagtaggagttatttttcggcgttcgcgttgtacgcggggattacgttggttgtgcgttcggggggcggaggtcggttcgagttttcggattttcgtaggtaagggttttcggagtttcgttgggggcggtcgttattattgttgtcgaggttgtcgatagttcgggaggtagaggcggcggcggtagcggttagcgatttcggggtttcgagtcgcgaggataggatttagtaggttcggcggagttacgaagtaaatgtattttttaaagcgatgagtttttagtaaaagtcgggggaattttttcgcggcgttcgggattttgagcgtttttgggtttcgggcgtgtatgagagcgagcgagacgcgtttagagagagtgattgtgagtgagtgtgagcgttgtatcgatttcggttagtgtattttttttttttttttttttttatttttttcgttt

SEQ ID NO: 17574 - DNA, 1076 bp, Artificial Sequence
  chemically treated genomic DNA (Homo sapiens) CpG-island No: 17574
aaacgaaaaaaataaaaaaaaaaaaaaaaaaaaaatacactaaccgaaatcgatacaacgctcacactcactcacaatcactctctctaaacgcgtctcgctcgctctcatacacgcccgaaacccaaaaacgctcaaaatcccgaacgccgcgaaaaaattcccccgacttttactaaaaactcatcgctttaaaaaatacatttacttcgtaactccgccgaacctactaaatcctatcctcgcgactcgaaaccccgaaatcgctaaccgctaccgccgccgcctctacctcccgaactatcgacaacctcgacaacaataataacgaccgcccccaacgaaactccgaaaacccttacctacgaaaatccgaaaactcgaaccgacctccgccccccgaacgcacaaccaacgtaatccccgcgtacaacgcgaacgccgaaaaataactcctactttacccctcgtaaaaaccgaaccaaaaccaatctacaaactccatcccgccgactaaaaaaaatcgcgaaaccgacaccaaacccgcaacgtcttcccgcgcgaatcccgaaacttaaaaaaccgaaaccaccccgacccaaaacgaaatacgaatcgatccgatacgctctaccataaacgacgcctcgcaaccccgcgacccgaccctactcttcccaaccacccgaaacgtcccgaccaaacgcctactaaacgccgacgacgcgacgactataacgaccaaatacccgcgcctctccgaatactccaaccccccgaactacctcaacccccccgactcgccctacaacccgcaacccccgcctaccgctccgaaaaccgacgaaaactccgaaaacgcgccgaaacccaaccgcatcgccgactacctactactacccctaaccgaacgcgaacatatatcccgaacgctatacatccacactaaacgcgaactacgctacaaaataaacgctcccgaaccaaaacccgactaaaatcgaaaacgcgaaacgaaataataaacaaaaatacttaaaatccgaccaacgcttaaactaaacacaaaacgaatc

SEQ ID NO: 17575 - DNA, 1076 bp, Artificial Sequence
  chemically treated genomic DNA (Homo sapiens) CpG-island No: 17575
aggcggaggaggtggaggaaaaggagaaggaggagtgtattggtcgggatcggtgtagcgtttatatttatttatagttattttttttgagcgcgtttcgttcgtttttatatacgttcggagtttaggagcgtttaggatttcgagcgtcgcgaaaaagttttttcggtttttgttggagatttatcgttttgggaagtgtatttgtttcgtggtttcgtcgagtttgttgaattttgttttcgcggttcgggatttcgggatcgttgatcgttgtcgtcgtcgtttttgtttttcggattatcggtagtttcggtaataatagtggcggtcgtttttagcgaggtttcgggagtttttgtttgcgggggttcggggattcgagtcggttttcgtttttcggacgtatagttagcgtggttttcgcgtgtaacgcgagcgtcggggagtggtttttgttttgtttttcgtgggggtcgagttaagattagtttgtaaattttatttcgtcggttggaagaagtcgcggagtcggtattaaattcgtagcgttttttcgcgcggatttcgggatttaaaaagtcggggttatttcggtttaggacgggatgcgggtcggttcggtgcgttttgttatgagcggcgtttcgtagtttcgcggttcggttttgttttttttagttattcgaggcgtttcggttaaacgtttgttggacgtcgacgacgcggcggttgtggcggttaagtgttcgcgttttttcgagtgttttagtttttcggattattttagttttttcggttcgttttgtagttcgtagttttcgtttgtcgtttcgggggtcggcggaggtttcgggagcgcgtcggggtttagtcgtatcgtcgattatttgttgttgtttttagtcgagcgcgagtatgtgtttcgggcgttgtgtatttatattggacgcgagttgcgttgtaaggtaggcgttttcgggttaggattcggttggggtcgggggcgcgggacggggtggtaggtaaaggtgtttggggttcggttaacgtttgggttgggtatagggcggatt

SEQ ID NO: 17576 - DNA, 1076 bp, Artificial Sequence
  chemically treated genomic DNA (Homo sapiens) CpG-island No: 17576
aatccgccctatacccaacccaaacgttaaccgaaccccaaacacctttacctaccaccccgtcccgcgcccccgaccccaaccgaatcctaacccgaaaacgcctaccttacaacgcaactcgcgtccaatataaatacacaacgcccgaaacacatactcgcgctcgactaaaaacaacaacaaataatcgacgatacgactaaaccccgacgcgctcccgaaacctccgccgacccccgaaacgacaaacgaaaactacgaactacaaaacgaaccgaaaaaactaaaataatccgaaaaactaaaacactcgaaaaaacgcgaacacttaaccgccacaaccgccgcgtcgtcgacgtccaacaaacgtttaaccgaaacgcctcgaataactaaaaaaaacaaaaccgaaccgcgaaactacgaaacgccgctcataacaaaacgcaccgaaccgacccgcatcccgtcctaaaccgaaataaccccgactttttaaatcccgaaatccgcgcgaaaaaacgctacgaatttaataccgactccgcgacttcttccaaccgacgaaataaaatttacaaactaatcttaactcgacccccacgaaaaacaaaacaaaaaccactccccgacgctcgcgttacacgcgaaaaccacgctaactatacgtccgaaaaacgaaaaccgactcgaatccccgaacccccgcaaacaaaaactcccgaaacctcgctaaaaacgaccgccactattattaccgaaactaccgataatccgaaaaacaaaaacgacgacgacaacgatcaacgatcccgaaatcccgaaccgcgaaaacaaaattcaacaaactcgacgaaaccacgaaacaaatacacttcccaaaacgataaatctccaacaaaaaccgaaaaaactttttcgcgacgctcgaaatcctaaacgctcctaaactccgaacgtatataaaaacgaacgaaacgcgctcaaaaaaaataactataaataaatataaacgctacaccgatcccgaccaatacactcctccttctccttttcctccacctcctccgcct

SEQ ID NO: 17577 - DNA, 540 bp, Artificial Sequence
  chemically treated genomic DNA (Homo sapiens) CpG-island No: 17577
tagcgcgcgttcgggcgtaggtggtgcgtttcgggtcggtttggacgcgcgtatacgtttttagggttgggaggggttgggtaggaggcggcgcgcgcgttttttcgtaggtttttagtttagcggagaagtcgaaggagggggcggaggaaaagttttcgtgacgtaagggttcggggaagtgggcgggagggacggggttgcggggagcgaaacgatcgttgattggtgcgcgcgttttatttatagtaagtataatgggttgcgggcgcgaggcgggagcgcgtattacggttttttgtattcgtcgttcgttgtagtttcgcggcgacgtttttcgtttcggggatttttttatcgtttagcgtttggggagtttcggttggagtcgtgggcgtcgtcgaggttcggttgtagtcggaggaaggagggggatagggaggtgatgaattttagaattagttatttatttttacgcggtagtttcggggaagatttgtgcgtggtagtggatgtggtttttttttttttttttttttg

SEQ ID NO: 17578 - DNA, 540 bp, Artificial Sequence
  chemically treated genomic DNA (Homo sapiens) CpG-island No: 17578
caaaaaaaaaaaaaaaaaaaaaccacatccactaccacgcacaaatcttccccgaaactaccgcgtaaaaataaataactaattctaaaattcatcacctccctatccccctccttcctccgactacaaccgaacctcgacgacgcccacgactccaaccgaaactccccaaacgctaaacgataaaaaaatccccgaaacgaaaaacgtcgccgcgaaactacaacgaacgacgaatacaaaaaaccgtaatacgcgctcccgcctcgcgcccgcaacccattatacttactataaataaaacgcgcgcaccaatcaacgatcgtttcgctccccgcaaccccgtccctcccgcccacttccccgaacccttacgtcacgaaaacttttcctccgccccctccttcgacttctccgctaaactaaaaacctacgaaaaaacgcgcgcgccgcctcctacccaacccctcccaaccctaaaaacgtatacgcgcgtccaaaccgacccgaaacgcaccacctacgcccgaacgcgcgcta

SEQ ID NO: 17579 - DNA, 540 bp, Artificial Sequence
  chemically treated genomic DNA (Homo sapiens) CpG-island No: 17579
taggaaaagggaaaaaaaaaagttatatttattattacgtataggtttttttcggaattatcgcgtgggggtgaatgattgattttggaatttattatttttttatttttttttttttttcggttgtagtcgggtttcggcggcgtttacggttttaatcggagttttttaggcgttgggcggtggggggattttcggggcgaaaggcgtcgtcgcggggttgtagcgagcggcgggtgtagagaatcgtggtgcgcgttttcgtttcgcgttcgtagtttattgtgtttattgtgaatgaggcgcgcgtattaattagcggtcgtttcgtttttcgtagtttcgtttttttcgtttattttttcgggtttttacgttacgggaatttttttttcgttttttttttcggttttttcgttgagttgggggtttgcgggagggcgcgcgcgtcgttttttgtttagttttttttagttttgggggcgtgtgcgcgcgtttaggtcggttcgggacgtattatttgcgttcgagcgcgcgttg

SEQ ID NO: 17580 - DNA, 540 bp, Artificial Sequence
  chemically treated genomic DNA (Homo sapiens) CpG-island No: 17580
caacgcgcgctcgaacgcaaataatacgtcccgaaccgacctaaacgcgcgcacacgcccccaaaactaaaaaaaactaaacaaaaaacgacgcgcgcgccctcccgcaaacccccaactcaacgaaaaaaccgaaaaaaaaaacgaaaaaaaaattcccgtaacgtaaaaacccgaaaaaataaacgaaaaaaacgaaactacgaaaaacgaaacgaccgctaattaatacgcgcgcctcattcacaataaacacaataaactacgaacgcgaaacgaaaacgcgcaccacgattctctacacccgccgctcgctacaaccccgcgacgacgcctttcgccccgaaaatccccccaccgcccaacgcctaaaaaactccgattaaaaccgtaaacgccgccgaaacccgactacaaccgaaaaaaaaaaaaaaataaaaaaataataaattccaaaatcaatcattcacccccacgcgataattccgaaaaaaacctatacgtaataataaatataacttttttttttcccttttccta

SEQ ID NO: 17581 - DNA, 746 bp, Artificial Sequence
  chemically treated genomic DNA (Homo sapiens) CpG-island No: 17581
gggttcggcgtttattggttcgtcgttgcggcgttggttcgcgattggtcgggcggcgtcggttcggcggtttttttatttttcggcgttagttttcgtagcgtttgtaagcgggcgggggcggggtgtgaggcgttgcggacggggttgcgggttcggtagcggtagttttagggcgcgagcgcggcggtgtcgattattgtaggtaatagaggcgttgcgagggtagtcgcggttttgtggaggtgagcgagacgtcgagggggttcgggtgtttatcgcggggcgggaagtgcggtatggggcggtatcgtttatagttagtcggtttcgtcgcggttttttatttcgggcggggttttatttgtttaaacgttttcgaacgttttcgtgtatagttttagtcggtcgcgtttcgagtagttagttggttcgcgtttcgttattcgttcggtttatgtttttgtagatcgtttcgttcgcgtatagcggcgggaattttagtttttgcgcgttcggtcgcgtttcgggtttttgtttcgtttcgttttcgttgttcggcgtttttgttcgttttgcgtttttggagtttttgtgtttttacgggcgggagcggggcgcgaaggtttgggggtgtttcgaggacgcgtcgcgtagtgagttttcgggtttaaggtttgattggttttgattttatgtcggttttgggatgtgattttatttttttttttagttgatttcgattt

SEQ ID NO: 17582 - DNA, 746 bp, Artificial Sequence
  chemically treated genomic DNA (Homo sapiens) CpG-island No: 17582
aaatcgaaatcaactaaaaaaaaaaataaaatcacatcccaaaaccgacataaaatcaaaaccaatcaaaccttaaacccgaaaactcactacgcgacgcgtcctcgaaacacccccaaaccttcgcgccccgctcccgcccgtaaaaacacaaaaactccaaaaacgcaaaacgaacaaaaacgccgaacaacgaaaacgaaacgaaacaaaaacccgaaacgcgaccgaacgcgcaaaaactaaaattcccgccgctatacgcgaacgaaacgatctacaaaaacataaaccgaacgaataacgaaacgcgaaccaactaactactcgaaacgcgaccgactaaaactatacacgaaaacgttcgaaaacgtttaaacaaataaaaccccgcccgaaataaaaaaccgcgacgaaaccgactaactataaacgataccgccccataccgcacttcccgccccgcgataaacacccgaaccccctcgacgtctcgctcacctccacaaaaccgcgactaccctcgcaacgcctctattacctacaataatcgacaccgccgcgctcgcgccctaaaactaccgctaccgaacccgcaaccccgtccgcaacgcctcacaccccgcccccgcccgcttacaaacgctacgaaaactaacgccgaaaaataaaaaaaccgccgaaccgacgccgcccgaccaatcgcgaaccaacgccgcaacgacgaaccaataaacgccgaaccc

SEQ ID NO: 17583 - DNA, 746 bp, Artificial Sequence
  chemically treated genomic DNA (Homo sapiens) CpG-island No: 17583
agatcggagttagttggaggagaaagtaaaattatattttagaatcggtatgaggttaaagttagttaaattttgggttcggaggtttattacgcggcgcgttttcggggtatttttagattttcgcgtttcgttttcgttcgtggaggtatagaaattttaggggcgtagagcggataaaggcgtcgggtagcgggagcgaggcggggtagaggttcggggcgcggtcgggcgcgtagaagttggggttttcgtcgttgtgcgcgggcgggacggtttgtagggatatggatcgggcgggtgacgggacgcgggttagttggttgttcgaggcgcggtcggttgaggttgtgtacgggggcgttcgggggcgtttgggtaagtgggatttcgttcggggtgggaagtcgcggcgggatcggttggttgtgagcggtatcgttttatgtcgtatttttcgtttcgcggtgggtattcgagttttttcggcgtttcgtttatttttatagggtcgcggttgttttcgtagcgtttttgttatttgtagtggtcggtatcgtcgcgttcgcgttttgaagttgtcgttatcgagttcgtaatttcgttcgtagcgttttatatttcgttttcgttcgtttgtaggcgttgcggagattagcgtcgaggggtgggggagtcgtcgagtcgacgtcgttcggttaatcgcgggttagcgtcgtagcggcgagttaatgagcgtcgagttt

SEQ ID NO: 17584 - DNA, 746 bp, Artificial Sequence
  chemically treated genomic DNA (Homo sapiens) CpG-island No: 17584
aaactcgacgctcattaactcgccgctacgacgctaacccgcgattaaccgaacgacgtcgactcgacgactcccccacccctcgacgctaatctccgcaacgcctacaaacgaacgaaaacgaaatataaaacgctacgaacgaaattacgaactcgataacgacaacttcaaaacgcgaacgcgacgataccgaccactacaaataacaaaaacgctacgaaaacaaccgcgaccctataaaaataaacgaaacgccgaaaaaactcgaatacccaccgcgaaacgaaaaatacgacataaaacgataccgctcacaaccaaccgatcccgccgcgacttcccaccccgaacgaaatcccacttacccaaacgcccccgaacgcccccgtacacaacctcaaccgaccgcgcctcgaacaaccaactaacccgcgtcccgtcacccgcccgatccatatccctacaaaccgtcccgcccgcgcacaacgacgaaaaccccaacttctacgcgcccgaccgcgccccgaacctctaccccgcctcgctcccgctacccgacgcctttatccgctctacgcccctaaaatttctatacctccacgaacgaaaacgaaacgcgaaaatctaaaaataccccgaaaacgcgccgcgtaataaacctccgaacccaaaatttaactaactttaacctcataccgattctaaaatataattttactttctcctccaactaactccgatct

SEQ ID NO: 17585 - DNA, 775 bp, Artificial Sequence
  chemically treated genomic DNA (Homo sapiens) CpG-island No: 17585
gtcgtcgttagtcgcgttagcgttagttgtttacgttggtttcgttttttcgtttttttacgatttagtgggggtttttttggttttatttggttatggcggcgtggattgggcggaaaataaggaaaggtcgcggcgtttaaggtttcgaagttagcgttttcggtcgtcgagtttcggggcggcgcgttcgtagtttttagaaattgttagaaggtttcgttttcggtttcgtttcgttttgtcgcggcgcgttcgggagttttagtcgggatttgggaggcgggtcgcgcggggacggcggacgcggacgcggggttgggagaggtttgggtcgtcggggttcgttgcgtttttttaacgttagggcgggacggggttgtttgggtcgttgcgaagggcgagggcgttgtaagttcgcggtgttggcgggttcgtgattttcggcgtcggaagtagggcgttgagtagcgggtgtttgagagtttaatcggtagtgtagacgcgatatcgtcgttagtgtttcggtaggttttttatagttttcgaggatacgatttcgaacgtttaggtcgttgtaagatcggtttttggggtatagcgcgtatacgttatatcgtttgcggatttcgtttaagagcgagttcgcgtttagttgtcgcgttgcgtattttttcgcgacgtagtttttcgttttttttttttttcggtatttttttaattagttttatgttattgcgggagtatttttattttatttacgtaataatttttt

SEQ ID NO: 17586 - DNA, 775 bp, Artificial Sequence
  chemically treated genomic DNA (Homo sapiens) CpG-island No: 17586
aaaaaattattacgtaaataaaataaaaatactcccgcaataacataaaactaattaaaaaaataccgaaaaaaaaaaaaaacgaaaaactacgtcgcgaaaaaatacgcaacgcgacaactaaacgcgaactcgctcttaaacgaaatccgcaaacgatataacgtatacgcgctataccccaaaaaccgatcttacaacgacctaaacgttcgaaatcgtatcctcgaaaactataaaaaacctaccgaaacactaacgacgatatcgcgtctacactaccgattaaactctcaaacacccgctactcaacgccctacttccgacgccgaaaatcacgaacccgccaacaccgcgaacttacaacgccctcgcccttcgcaacgacccaaacaaccccgtcccgccctaacgttaaaaaaacgcaacgaaccccgacgacccaaacctctcccaaccccgcgtccgcgtccgccgtccccgcgcgacccgcctcccaaatcccgactaaaactcccgaacgcgccgcgacaaaacgaaacgaaaccgaaaacgaaaccttctaacaatttctaaaaactacgaacgcgccgccccgaaactcgacgaccgaaaacgctaacttcgaaaccttaaacgccgcgacctttccttattttccgcccaatccacgccgccataaccaaataaaaccaaaaaaacccccactaaatcgtaaaaaaacgaaaaaacgaaaccaacgtaaacaactaacgctaacgcgactaacgacgac

SEQ ID NO: 17587 - DNA, 775 bp, Artificial Sequence
  chemically treated genomic DNA (Homo sapiens) CpG-island No: 17587
aaaggattattacgtgaataaaatggaaatattttcgtagtaatatgggattagttggaaaggtgtcgggaaggggggagggcgagagattgcgtcgcggaaaaatacgtagcgcggtaattgggcgcggattcgtttttaggcgaaattcgtaaacggtgtgacgtgtgcgcgttgtgttttaaaggtcggttttatagcgatttgggcgttcgaggtcgtgttttcgagagttatagggagtttgtcgaggtattgacggcggtgtcgcgtttatattgtcggttggatttttaggtattcgttatttagcgttttgttttcggcgtcgggaattacgagttcgttagtatcgcggatttgtagcgttttcgtttttcgtagcggtttagatagtttcgtttcgttttagcgttaggagagcgtagcgaatttcggcggtttaagttttttttagtttcgcgttcgcgttcgtcgttttcgcgcgattcgttttttagatttcggttggggttttcgggcgcgtcgcggtagggcggggcggggtcgggggcggggttttttggtagtttttgggagttgcgaacgcgtcgtttcggggttcggcggtcggaaacgttggtttcggagttttaggcgtcgcggtttttttttgtttttcgtttagtttacgtcgttatggttaagtggggttaggggaatttttattggatcgtggaggagcgggaggacgggattaacgtgaataattggcgttggcgcggttggcggcggt

SEQ ID NO: 17588 - DNA, 775 bp, Artificial Sequence
  chemically treated genomic DNA (Homo sapiens) CpG-island No: 17588
accgccgccaaccgcgccaacgccaattattcacgttaatcccgtcctcccgctcctccacgatccaataaaaattcccctaaccccacttaaccataacgacgtaaactaaacgaaaaacaaaaaaaaaccgcgacgcctaaaactccgaaaccaacgtttccgaccgccgaaccccgaaacgacgcgttcgcaactcccaaaaactaccaaaaaaccccgcccccgaccccgccccgccctaccgcgacgcgcccgaaaaccccaaccgaaatctaaaaaacgaatcgcgcgaaaacgacgaacgcgaacgcgaaactaaaaaaaacttaaaccgccgaaattcgctacgctctcctaacgctaaaacgaaacgaaactatctaaaccgctacgaaaaacgaaaacgctacaaatccgcgatactaacgaactcgtaattcccgacgccgaaaacaaaacgctaaataacgaatacctaaaaatccaaccgacaatataaacgcgacaccgccgtcaatacctcgacaaactccctataactctcgaaaacacgacctcgaacgcccaaatcgctataaaaccgacctttaaaacacaacgcgcacacgtcacaccgtttacgaatttcgcctaaaaacgaatccgcgcccaattaccgcgctacgtatttttccgcgacgcaatctctcgccctccccccttcccgacacctttccaactaatcccatattactacgaaaatatttccattttattcacgtaataatccttt

SEQ ID NO: 17589 - DNA, 806 bp, Artificial Sequence
  chemically treated genomic DNA (Homo sapiens) CpG-island No: 17589
gcgcgcgggggtgcgggcggtagggtgcgcgcgtggtcgtgggggagcgcgcgcgcgggtcggggttcgtgttggggtttttaaagaaaagttgtagcgaggcgtttttcggcgttcggcgtttgggttcggtcgggggtgtttcgttagttttttttttcgtcgcggtcgtaggttagtttggttcgttttaattcggcgtttcgcgcgggaagcgtagttatcggggatcgggggttttgggttggttttcgtaatagtcgttgggagatcgttcgcggttttcgttttcgttatcgttttcgttttttcgggtcgtttttattttttcggggaggcggcgttcgggtttagttgttcgggaatttaggtttgcggcgttttcgggtagcgaaggcggattggcgcgcggcggagtcggggattgtagttttttcgtttcgttttttgtaattggtttcgttcgaaagtgttcggaaagtaaggttgggtcgcgttcgtttcgtcggggacggggtgatttttcggtttttagtcgtgtttttgttgtttgttttttttggggtggttttttttgcgtaggagaaaacgtttcggcgggagtatttggtcggttcgtagcgtattagcgtagtattttgggtaataataacgtttggttttagcgcggttttttttatttaattttttatagtttcggattttagcggaaatgttttttcggggtcggtttattgggataattggagatgggggggttaagtagggtgttacggtttagacgttttaaattattttaatatata

SEQ ID NO: 17590 - DNA, 806 bp, Artificial Sequence
  chemically treated genomic DNA (Homo sapiens) CpG-island No: 17590
tatatattaaaataatttaaaacgtctaaaccgtaacaccctacttaacccccccatctccaattatcccaataaaccgaccccgaaaaaacatttccgctaaaatccgaaactataaaaaattaaataaaaaaaaccgcgctaaaaccaaacgttattattacccaaaatactacgctaatacgctacgaaccgaccaaatactcccgccgaaacgttttctcctacgcaaaaaaaaccaccccaaaaaaaacaaacaacaaaaacacgactaaaaaccgaaaaatcaccccgtccccgacgaaacgaacgcgacccaaccttactttccgaacactttcgaacgaaaccaattacaaaaaacgaaacgaaaaaactacaatccccgactccgccgcgcgccaatccgccttcgctacccgaaaacgccgcaaacctaaattcccgaacaactaaacccgaacgccgcctccccgaaaaaataaaaacgacccgaaaaaacgaaaacgataacgaaaacgaaaaccgcgaacgatctcccaacgactattacgaaaaccaacccaaaacccccgatccccgataactacgcttcccgcgcgaaacgccgaattaaaacgaaccaaactaacctacgaccgcgacgaaaaaaaaaactaacgaaacacccccgaccgaacccaaacgccgaacgccgaaaaacgcctcgctacaacttttctttaaaaaccccaacacgaaccccgacccgcgcgcgcgctcccccacgaccacgcgcgcaccctaccgcccgcacccccgcgcgc

SEQ ID NO: 17591 - DNA, 806 bp, Artificial Sequence
  chemically treated genomic DNA (Homo sapiens) CpG-island No: 17591
tgtgtattggaatgatttggagcgtttaagtcgtggtattttatttaatttttttatttttagttattttaatgaatcgatttcgagggggtattttcgttgaagttcggggttgtaaaaaattaagtgagaagagtcgcgttaaagttaagcgttgttgttatttaaggtattgcgttgatgcgttgcgggtcgattaggtgttttcgtcggggcgtttttttttacgtaggaagggttattttaaaagaggtaggtaataagggtacggttggaggtcggaaggttatttcgttttcggcggggcgggcgcggtttaattttatttttcgggtattttcgggcggggttaattgtagggaacggggcggggaggttatagttttcggtttcgtcgcgcgttagttcgttttcgttgttcggaggcgtcgtaggtttgggttttcggatagttgaattcgagcgtcgttttttcgaaaaggtgaaggcggttcggggaggcggggacggtgacgggggcgggggtcgcgggcggttttttaacggttgttgcgggggttagtttaaagttttcgattttcggtagttgcgtttttcgcgcggggcgtcggattagggcgggttaagttggtttgcggtcgcggcgggaagaagggttagcgaagtattttcgatcgggtttaggcgtcggacgtcggggggcgtttcgttgtaatttttttttggaagttttaatacgagtttcggttcgcgcgcgcgtttttttacggttacgcgcgtattttgtcgttcgtattttcgcgcgt

SEQ ID NO: 17592 - DNA, 806 bp, Artificial Sequence
  chemically treated genomic DNA (Homo sapiens) CpG-island No: 17592
acgcgcgaaaatacgaacgacaaaatacgcgcgtaaccgtaaaaaaacgcgcgcgcgaaccgaaactcgtattaaaacttccaaaaaaaaattacaacgaaacgccccccgacgtccgacgcctaaacccgatcgaaaatacttcgctaacccttcttcccgccgcgaccgcaaaccaacttaacccgccctaatccgacgccccgcgcgaaaaacgcaactaccgaaaatcgaaaactttaaactaacccccgcaacaaccgttaaaaaaccgcccgcgacccccgcccccgtcaccgtccccgcctccccgaaccgccttcaccttttcgaaaaaacgacgctcgaattcaactatccgaaaacccaaacctacgacgcctccgaacaacgaaaacgaactaacgcgcgacgaaaccgaaaactataacctccccgccccgttccctacaattaaccccgcccgaaaatacccgaaaaataaaattaaaccgcgcccgccccgccgaaaacgaaataaccttccgacctccaaccgtacccttattacctacctcttttaaaataacccttcctacgtaaaaaaaaacgccccgacgaaaacacctaatcgacccgcaacgcatcaacgcaataccttaaataacaacaacgcttaactttaacgcgactcttctcacttaattttttacaaccccgaacttcaacgaaaataccccctcgaaatcgattcattaaaataactaaaaataaaaaaattaaataaaataccacgacttaaacgctccaaatcattccaatacaca

SEQ ID NO: 17593 - DNA, 751 bp, Artificial Sequence
  chemically treated genomic DNA (Homo sapiens) CpG-island No: 17593
gtcgcgttttcgggtgttgaatgtcgtttttgttttttcgtaaattcgtagtatttatggtcgtttacgtagtattttaatgaggagcgttattcgttcgcgtttaggagtatgaagggttttttcggaagtcggatttagtcgtcgttgtgtttcgggtatacgtgtggtttggcgtttcggaggattgcgagtatttgtattacgggttcgacgcgcggtcgttttatttgttgagtttcgtcgatagttgtttcggggggcgttatcgttgttcgtcgcgtagttcggtgtattcggagtgcgtgatgatgtcggtggtgttgggcgattacgtgtttagtagtattttttcgcggatgtattatagttcgtattacgatacgcgcgacgattgcgttgtggtttacgcgggcgttaagattaatcgtatttcggttaatttgttggattagttcgagaagtagttgtcgttgtatcgggacggtttttatacgttgtagtattagaggacgttcgcggtcgtcgagtagcgtagcgagagtttcgggcggattcgttatttggtatatttcgtgtagaagttttttattaagtcgtattcgttggagggtttttttaaaagtaacgttaacggtattaaggcggacggtcgggcggataattattattacgtttattacgttaagtatagtaagaggagtaagagtaaggagcgtaagtcggagggtaagtttcggttcggtatgag

SEQ ID NO: 17594 - DNA, 751 bp, Artificial Sequence
  chemically treated genomic DNA (Homo sapiens) CpG-island No: 17594
ctcataccgaaccgaaacttaccctccgacttacgctccttactcttactcctcttactatacttaacgtaataaacgtaataataattatccgcccgaccgtccgccttaataccgttaacgttacttttaaaaaaaccctccaacgaatacgacttaataaaaaacttctacacgaaatataccaaataacgaatccgcccgaaactctcgctacgctactcgacgaccgcgaacgtcctctaatactacaacgtataaaaaccgtcccgatacaacgacaactacttctcgaactaatccaacaaattaaccgaaatacgattaatcttaacgcccgcgtaaaccacaacgcaatcgtcgcgcgtatcgtaatacgaactataatacatccgcgaaaaaatactactaaacacgtaatcgcccaacaccaccgacatcatcacgcactccgaatacaccgaactacgcgacgaacaacgataacgccccccgaaacaactatcgacgaaactcaacaaataaaacgaccgcgcgtcgaacccgtaatacaaatactcgcaatcctccgaaacgccaaaccacacgtatacccgaaacacaacgacgactaaatccgacttccgaaaaaacccttcatactcctaaacgcgaacgaataacgctcctcattaaaatactacgtaaacgaccataaatactacgaatttacgaaaaaacaaaaacgacattcaacacccgaaaacgcgac

SEQ ID NO: 17595 - DNA, 751 bp, Artificial Sequence
  chemically treated genomic DNA (Homo sapiens) CpG-island No: 17595
tttatgtcgggtcggggtttgtttttcggtttgcgttttttgtttttgttttttttgttgtgtttggcgtggtgggcgtggtggtggttgttcgttcggtcgttcgttttggtgtcgttggcgttgtttttggaggagttttttagcgagtgcgatttggtgaagagtttttgtacggagtgtattaggtggcggattcgttcggggttttcgttgcgttgttcggcggtcgcggacgttttttggtattgtagcgtgtggaagtcgtttcggtgtagcggtagttgtttttcgaattggtttagtaggttggtcgggatgcggttgattttggcgttcgcgtgggttatagcgtagtcgtcgcgcgtgtcgtagtgcgagttgtagtgtattcgcgggaaggtgttgttggatacgtggtcgtttagtattatcggtattattacgtatttcgagtgtatcgagttgcgcggcgagtagcggtggcgtttttcggggtagttgtcggcggggtttagtaggtagggcggtcgcgcgtcgggttcgtggtgtaggtgttcgtagtttttcggggcgttagattatacgtgtgttcggaatatagcggcggttgggttcgattttcggaaaggttttttatgtttttgggcgcgggcgagtagcgttttttattgaagtgttgcgtgggcgattatgagtattgcgggtttgcggggaaatagaaacggtatttaatattcggaagcgcggt

SEQ ID NO: 17596 - DNA, 751 bp, Artificial Sequence
  chemically treated genomic DNA (Homo sapiens) CpG-island No: 17596
accgcgcttccgaatattaaataccgtttctatttccccgcaaacccgcaatactcataatcgcccacgcaacacttcaataaaaaacgctactcgcccgcgcccaaaaacataaaaaacctttccgaaaatcgaacccaaccgccgctatattccgaacacacgtataatctaacgccccgaaaaactacgaacacctacaccacgaacccgacgcgcgaccgccctacctactaaaccccgccgacaactaccccgaaaaacgccaccgctactcgccgcgcaactcgatacactcgaaatacgtaataataccgataatactaaacgaccacgtatccaacaacaccttcccgcgaatacactacaactcgcactacgacacgcgcgacgactacgctataacccacgcgaacgccaaaatcaaccgcatcccgaccaacctactaaaccaattcgaaaaacaactaccgctacaccgaaacgacttccacacgctacaataccaaaaaacgtccgcgaccgccgaacaacgcaacgaaaaccccgaacgaatccgccacctaatacactccgtacaaaaactcttcaccaaatcgcactcgctaaaaaactcctccaaaaacaacgccaacgacaccaaaacgaacgaccgaacgaacaaccaccaccacgcccaccacgccaaacacaacaaaaaaaacaaaaacaaaaaacgcaaaccgaaaaacaaaccccgacccgacataaa

SEQ ID NO: 17597 - DNA, 1220 bp, Artificial Sequence
  chemically treated genomic DNA (Homo sapiens) CpG-island No: 17597
ttcgaattcgtcggtttttatttgtgttattttcgatttcgtcggtttttatttgtgttattttcgatttcgtcggtttttatttgtgttattttcgatttcgtcggtttttatttgtgttattttcgatttcgtcggtttttatttgtgttattttcgatttcgtcggtttttatttgtgttattttcgaattcgtcggtttttatttgtgttattttcgaattcgtcggtttttatttgtgttattttggaattcgtcggtttttatttgtgttattttcgatttcgtcggtttttatttgtgttattttcgatttcgtcggtttttatttgtgttattttcgatttcgtcggtttttatttgtgttatttttttaattcgtcggtttttatttgtgttattttcgaattcgtcggtttttatttgtgttattttttaattcgtcggtttttatttgtgttattttttaattcgtcggtttttatttgtgttattttcgatttcgtcggtttttatttgtgttattttcgatttcgtcggtttttatttgtgttattttcgatttcgttggtttttatttgtgttattttggaattcgtcggtttttatttgtgttattttcgatttcgtcggtttttatttgtgttattttttaaattcgtcggtttttatttgtgttattttcgaattcgtcggtttttatttgtgttattttttaattcgtcggtttttatttgtgttattttttaattcgtcggtttttatttgtgttattttcgatttcgtcggtttttatttgtgttattttcgatttcgtcggtttttatttgtgttattttcgatttcgtcggtttttatttgtgttattttggaattcgtcggtttttatttgtgttattttcgaattcgtcggtttttatttgtgttattttcgatttcgtcggtttttatttgtgttattttcgatttcgttagtttttatttgtgttattttcgatttcgtcggtttttatttgtgttattttggaattcgtcggtttttatttgtgttattttcgaattcgtcggtttttatttgtgttattttcgatttcgtcggtttttatttgtgttattttttaattcgtcggtttttatttgtgttattttcgatttcgtcggtttttatttgtgttatttttcggggttgaaattattttaagtgtttatttgggtgtt

SEQ ID NO: 17598 - DNA, 1220 bp, Artificial Sequence
  chemically treated genomic DNA (Homo sapiens) CpG-island No: 17598
aacacccaaataaacacttaaaataatttcaaccccgaaaaataacacaaataaaaaccgacgaaatcgaaaataacacaaataaaaaccgacgaattaaaaaataacacaaataaaaaccgacgaaatcgaaaataacacaaataaaaaccgacgaattcgaaaataacacaaataaaaaccgacgaattccaaaataacacaaataaaaaccgacgaaatcgaaaataacacaaataaaaactaacgaaatcgaaaataacacaaataaaaaccgacgaaatcgaaaataacacaaataaaaaccgacgaattcgaaaataacacaaataaaaaccgacgaattccaaaataacacaaataaaaaccgacgaaatcgaaaataacacaaataaaaaccgacgaaatcgaaaataacacaaataaaaaccgacgaaatcgaaaataacacaaataaaaaccgacgaattaaaaaataacacaaataaaaaccgacgaattaaaaaataacacaaataaaaaccgacgaattcgaaaataacacaaataaaaaccgacgaatttaaaaaataacacaaataaaaaccgacgaaatcgaaaataacacaaataaaaaccgacgaattccaaaataacacaaataaaaaccaacgaaatcgaaaataacacaaataaaaaccgacgaaatcgaaaataacacaaataaaaaccgacgaaatcgaaaataacacaaataaaaaccgacgaattaaaaaataacacaaataaaaaccgacgaattaaaaaataacacaaataaaaaccgacgaattcgaaaataacacaaataaaaaccgacgaattaaaaaaataacacaaataaaaaccgacgaaatcgaaaataacacaaataaaaaccgacgaaatcgaaaataacacaaataaaaaccgacgaaatcgaaaataacacaaataaaaaccgacgaattccaaaataacacaaataaaaaccgacgaattcgaaaataacacaaataaaaaccgacgaattcgaaaataacacaaataaaaaccgacgaaatcgaaaataacacaaataaaaaccgacgaaatcgaaaataacacaaataaaaaccgacgaaatcgaaaataacacaaataaaaaccgacgaaatcgaaaataacacaaataaaaaccgacgaaatcgaaaataacacaaataaaaaccgacgaattcgaa

SEQ ID NO: 17599 - DNA, 1220 bp, Artificial Sequence
  chemically treated genomic DNA (Homo sapiens) CpG-island No: 17599
ggtatttaggtgagtatttaaaatggttttagtttcgaggggtgatataggtgaggatcggcggggtcgagggtgatataggtgagggtcggcgggttggagggtgatataggtgaggatcggcggggtcgagggtgatataggtgaggatcggcgggttcgagggtgatataggtgaggatcggcgggttttagggtgatataggtgaggatcggcggggtcgagggtgatataggtgaggattggcggggtcgagggtgatataggtgagggtcggcggggtcgagggtgatataggtgaggatcggcgggttcgagggtgatataggtgaggatcggcgggttttagggtgatataggtgaggatcggcggggtcgagggtgatataggtgaggatcggcggggtcgagggtgatataggtgagggtcggcggggtcgagggtgatataggtgagggtcggcgggttggagggtgatataggtgggggtcggcgggttggagggtgatataggtgagggtcggcgggttcgagggtgatataggtgaggatcggcgggtttgaggggtgatataggtgaggatcggcggggtcgagggtgatataggtgaggatcggcgggttttagggtgatataggtgaggattagcggggtcgagggtgatataggtgagggtcggcggggtcgagggtgatataggtgagggtcggcggggtcgagggtgatataggtgagggtcggcgggttggagggtgatataggtgggggtcggcgggttggagggtgatataggtgagggtcggcgggttcgagggtgatataggtgagggtcggcgggttggaggggtgatataggtgagggtcggcggggtcgagggtgatataggtgagggtcggcggggtcgagggtgatataggtgaggatcggcggggtcgagggtgatataggtgaggatcggcgggttttagggtgatataggtgaggatcggcgggttcgagggtgatataggtgagggtcggcgggttcgagggtgatataggtgaggatcggcggggtcgagggtgatataggtgaggatcggcggggtcgagggtgatataggtgagggtcggcggggtcgagggtgatataggtggggatcggcggggtcgagggtgatataggtgaggatcggcggggtcgagggtgatataggtggggatcggcgggttcgag

SEQ ID NO: 17600 - DNA, 1220 bp, Artificial Sequence
  chemically treated genomic DNA (Homo sapiens) CpG-island No: 17600
ctcgaacccgccgatccccacctatatcaccctcgaccccgccgatcctcacctatatcaccctcgaccccgccgatccccacctatatcaccctcgaccccgccgaccctcacctatatcaccctcgaccccgccgatcctcacctatatcaccctcgaccccgccgatcctcacctatatcaccctcgaacccgccgaccctcacctatatcaccctcgaacccgccgatcctcacctatatcaccctaaaacccgccgatcctcacctatatcaccctcgaccccgccgatcctcacctatatcaccctcgaccccgccgaccctcacctatatcaccctcgaccccgccgaccctcacctatatcacccctccaacccgccgaccctcacctatatcaccctcgaacccgccgaccctcacctatatcaccctccaacccgccgacccccacctatatcaccctccaacccgccgaccctcacctatatcaccctcgaccccgccgaccctcacctatatcaccctcgaccccgccgaccctcacctatatcaccctcgaccccgctaatcctcacctatatcaccctaaaacccgccgatcctcacctatatcaccctcgaccccgccgatcctcacctatatcacccctcaaacccgccgatcctcacctatatcaccctcgaacccgccgaccctcacctatatcaccctccaacccgccgacccccacctatatcaccctccaacccgccgaccctcacctatatcaccctcgaccccgccgaccctcacctatatcaccctcgaccccgccgatcctcacctatatcaccctcgaccccgccgatcctcacctatatcaccctaaaacccgccgatcctcacctatatcaccctcgaacccgccgatcctcacctatatcaccctcgaccccgccgaccctcacctatatcaccctcgaccccgccaatcctcacctatatcaccctcgaccccgccgatcctcacctatatcaccctaaaacccgccgatcctcacctatatcaccctcgaacccgccgatcctcacctatatcaccctcgaccccgccgatcctcacctatatcaccctccaacccgccgaccctcacctatatcaccctcgaccccgccgatcctcacctatatcacccctcgaaactaaaaccattttaaatactcacctaaatacc

SEQ ID NO: 17601 - DNA, 552 bp, Artificial Sequence
  chemically treated genomic DNA (Homo sapiens) CpG-island No: 17601
ggtgggcgttttcggtggttgcgattgtagcggagttgtgagggtgaagatgaggtgggcggtttcggtggttcgggtagagttgtgagggtgaagacgaggtgggcggtttcggtggttgaggcggagttgtgagggtgaagacgaggtgggcggtttcggtgattgaggcggagttgtgagggtgaaaacgaggtgggcggtttcggtggttgaggttgagttgtgagggtgaagacgaggtgggcggtttcggtggttgaggcggagttgtgagggtgaagacgaggtgggcgttttcggtggttgtgattgaggcggagttgtgagggtgaagacgaggtgggcggtatcggtggttgaggttgagttgtgagggtgaagatgaggtgggcggtttcggtggttgaggttgagttgtgagggtgaagacgaggtgggcggtttcggtggtcgaggttgagttgtgagggtgaagatgaggtgggcggtttcggtggttcgggtagagttgtgagggtgaagacgaggtgggtggtttcggtggttgtg

SEQ ID NO: 17602 - DNA, 552 bp, Artificial Sequence
  chemically treated genomic DNA (Homo sapiens) CpG-island No: 17602
cacaaccaccgaaaccacccacctcgtcttcaccctcacaactctacccgaaccaccgaaaccgcccacctcatcttcaccctcacaactcaacctcgaccaccgaaaccgcccacctcgtcttcaccctcacaactcaacctcaaccaccgaaaccgcccacctcatcttcaccctcacaactcaacctcaaccaccgataccgcccacctcgtcttcaccctcacaactccgcctcaatcacaaccaccgaaaacgcccacctcgtcttcaccctcacaactccgcctcaaccaccgaaaccgcccacctcgtcttcaccctcacaactcaacctcaaccaccgaaaccgcccacctcgttttcaccctcacaactccgcctcaatcaccgaaaccgcccacctcgtcttcaccctcacaactccgcctcaaccaccgaaaccgcccacctcgtcttcaccctcacaactctacccgaaccaccgaaaccgcccacctcatcttcaccctcacaactccgctacaatcgcaaccaccgaaaacgcccacc

SEQ ID NO: 17603 - DNA, 552 bp, Artificial Sequence
  chemically treated genomic DNA (Homo sapiens) CpG-island No: 17603
tatagttatcgaggttatttatttcgtttttatttttatagttttgttcgagttatcggggtcgtttattttatttttatttttatagtttagtttcggttatcgaggtcgtttatttcgtttttatttttatagtttagttttagttatcgaggtcgtttattttatttttatttttatagtttagttttagttatcgatgtcgtttatttcgtttttatttttatagtttcgttttagttatagttatcgaggacgtttatttcgtttttatttttatagtttcgttttagttatcgaggtcgtttatttcgtttttatttttatagtttagttttagttatcgaggtcgtttatttcgtttttatttttatagtttcgttttagttatcgaggtcgtttatttcgtttttatttttatagtttcgttttagttatcgaggtcgtttatttcgtttttatttttatagttttgttcgagttatcgaggtcgtttattttatttttatttttatagtttcgttatagtcgtagttatcgaggacgtttatt

SEQ ID NO: 17604 - DNA, 552 bp, Artificial Sequence
  chemically treated genomic DNA (Homo sapiens) CpG-island No: 17604
aataaacgtcctcgataactacgactataacgaaactataaaaataaaaataaaataaacgacctcgataactcgaacaaaactataaaaataaaaacgaaataaacgacctcgataactaaaacgaaactataaaaataaaaacgaaataaacgacctcgataactaaaacgaaactataaaaataaaaacgaaataaacgacctcgataactaaaactaaactataaaaataaaaacgaaataaacgacctcgataactaaaacgaaactataaaaataaaaacgaaataaacgtcctcgataactataactaaaacgaaactataaaaataaaaacgaaataaacgacatcgataactaaaactaaactataaaaataaaaataaaataaacgacctcgataactaaaactaaactataaaaataaaaacgaaataaacgacctcgataaccgaaactaaactataaaaataaaaataaaataaacgaccccgataactcgaacaaaactataaaaataaaaacgaaataaataacctcgataactata

SEQ ID NO: 17605 - DNA, 991 bp, Artificial Sequence
  chemically treated genomic DNA (Homo sapiens) CpG-island No: 17605
tcgtcggtttttatttgtgttattttcgatttcgtcggtttttatttgtgttattttttaattcgtcggtttttatttgtgttattttcgatttcgtcggtttttatttgtgttattttcgatttcgtcggtttttatttgtgttattttcgatttcgtcggtttttatttgtgttattttcgatttcgtcggtttttatttgtgttattttttaattcgtcggtttttatttgtgttattttcgatttcgtcggtttttatttgtgttattttttaattcgtcggtttttatttgtgttattttcgaattcgtcggtttttatttgtgttattttcgatttcgtcggtttttatttgtgttattttttaattcgtcggtttttatttgtgttattttttaattcgtcggtttttatttgtgttattttttaattcgtcggtttttatttgtgttattttttaattcgtcggtttttatttgtgttattttttaattcgtcggtttttatttgtgttattttcgatttcgtcggtttttatttgtgttattttttaattcgtcggtttttatttgtgttattttcgatttcgtcggtttttatttgtgttatttttataattattcggtttttatatgtgttatttacgatttcgtcggtttttatttgtgttattttcgatttcgtcggtttttatttgtgttattttttaattcgtcggtttttatttgtgttattttcgatttcgtcggtttttatttgtgttattttttaattcgtcggtttttatttgtgttattttttaattcgtcggtttttatttgtgttattttttaattcgtcggtttttatatgtgttattttcgatttcgtcggtttttatttgtgttattttcgatttcgtcggtttttatttgtgttattttttaattcgtcggtttttatttgtgttatttttcggggttgaaattattttaagtgtttatttggg

SEQ ID NO: 17606 - DNA, 991 bp, Artificial Sequence
  chemically treated genomic DNA (Homo sapiens) CpG-island No: 17606
cccaaataaacacttaaaataatttcaaccccgaaaaataacacaaataaaaaccgacgaattaaaaaataacacaaataaaaaccgacgaaatcgaaaataacacaaataaaaaccgacgaaatcgaaaataacacatataaaaaccgacgaattaaaaaataacacaaataaaaaccgacgaattaaaaaataacacaaataaaaaccgacgaattaaaaaataacacaaataaaaaccgacgaaatcgaaaataacacaaataaaaaccgacgaattaaaaaataacacaaataaaaaccgacgaaatcgaaaataacacaaataaaaaccgacgaaatcgtaaataacacatataaaaaccgaataattataaaaataacacaaataaaaaccgacgaaatcgaaaataacacaaataaaaaccgacgaattaaaaaataacacaaataaaaaccgacgaaatcgaaaataacacaaataaaaaccgacgaattaaaaaataacacaaataaaaaccgacgaattaaaaaataacacaaataaaaaccgacgaattaaaaaataacacaaataaaaaccgacgaattaaaaaataacacaaataaaaaccgacgaattaaaaaataacacaaataaaaaccgacgaaatcgaaaataacacaaataaaaaccgacgaattcgaaaataacacaaataaaaaccgacgaattaaaaaataacacaaataaaaaccgacgaaatcgaaaataacacaaataaaaaccgacgaattaaaaaataacacaaataaaaaccgacgaaatcgaaaataacacaaataaaaaccgacgaaatcgaaaataacacaaataaaaaccgacgaaatcgaaaataacacaaataaaaaccgacgaaatcgaaaataacacaaataaaaaccgacgaattaaaaaataacacaaataaaaaccgacgaaatcgaaaataacacaaataaaaaccgacga

SEQ ID NO: 17607 - DNA, 991 bp, Artificial Sequence
  chemically treated genomic DNA (Homo sapiens) CpG-island No: 17607
tttaggtgagtatttaaaatggttttagtttcgaggggtgatataggtgaggatcggcgggttggagggtgatataggtgaggatcggcggggtcgagggtgatataggtgaggatcggcggggtcgagggtgatatatgtgagggtcggcgggttggagggtgatataggtgagggtcggcgggttggagggtgatataggtgagggtcggcgggttggagggtgatataggtgagggtcggcggggtcgagggtgatataggtgagggtcggcgggttggagggtgatataggtgaggatcggcggggtcgagggtgatataggtgaggatcggcggggtcgtgggtgatatatgtgagggtcggatggttgtgagggtgatataggtgaggatcggcggggtcgagggtgatataggtgaggatcggcgggttggagggtgatataggtgaggatcggcggggtcgagggtgatataggtgagggtcggcgggttggagggtgatataggtgggggtcggcgggttggagggtgatataggtgagggtcggcgggttggagggtgatataggtgagggtcggcgggttggagggtgatataggtgaggatcggcgggttggagggtgatataggtgaggatcggcggggtcgagggtgatataggtgagggtcggcgggttcgagggtgatataggtgagggtcggcgggttggagggtgatataggtgaggatcggcggggtcgagggtgatataggtgagggtcggcgggttggagggtgatataggtgaggatcggcggggtcgagggtgatataggtgaggatcggcggggtcgagggtgatataggtgagggtcggcggggtcgagggtgatataggtgagggtcggcggggtcgagggtgatataggtgagggtcggcgggttggagggtgatataggtgaggatcggcggggtcgagggtgatataggtgagggtcggcgg

SEQ ID NO: 17608 - DNA, 991 bp, Artificial Sequence
  chemically treated genomic DNA (Homo sapiens) CpG-island No: 17608
ccgccgaccctcacctatatcaccctcgaccccgccgatcctcacctatatcaccctccaacccgccgaccctcacctatatcaccctcgaccccgccgaccctcacctatatcaccctcgaccccgccgaccctcacctatatcaccctcgaccccgccgatcctcacctatatcaccctcgaccccgccgatcctcacctatatcaccctccaacccgccgaccctcacctatatcaccctcgaccccgccgatcctcacctatatcaccctccaacccgccgaccctcacctatatcaccctcgaacccgccgaccctcacctatatcaccctcgaccccgccgatcctcacctatatcaccctccaacccgccgatcctcacctatatcaccctccaacccgccgaccctcacctatatcaccctccaacccgccgaccctcacctatatcaccctccaacccgccgacccccacctatatcaccctccaacccgccgaccctcacctatatcaccctcgaccccgccgatcctcacctatatcaccctccaacccgccgatcctcacctatatcaccctcgaccccgccgatcctcacctatatcaccctcacaaccatccgaccctcacatatatcacccacgaccccgccgatcctcacctatatcaccctcgaccccgccgatcctcacctatatcaccctccaacccgccgaccctcacctatatcaccctcgaccccgccgaccctcacctatatcaccctccaacccgccgaccctcacctatatcaccctccaacccgccgaccctcacctatatcaccctccaacccgccgaccctcacatatatcaccctcgaccccgccgatcctcacctatatcaccctcgaccccgccgatcctcacctatatcaccctccaacccgccgatcctcacctatatcacccctcgaaactaaaaccattttaaatactcacctaaa

SEQ ID NO: 17609 - DNA, 994 bp, Artificial Sequence
  chemically treated genomic DNA (Homo sapiens) CpG-island No: 17609
gttcgcgtttcggggtgatcgtttatttgtagtttcggggcgtttatttttggagtacgcggggttataaagggcggttttggcgttttagcggtatcgtacgggcggtttttttttgtttcgcgtcgcgtttgggagaagagggcgcgggtttatttaacgcgagggagaaaggaaaggacggtgtcgaggttggcggtttaacgtttcgcggaaatcgagggcggatggtgaattgataagttttagtattagttgggagttaggcgaggtttgtttacgttcgggcggaaggcgattttataggcgtcgcggtttcgttttcgcgtttcgttttttttagattttcgtagttttagtacgtagtcgggatatattttttttttcgttttttgtttttttttttcgggcgcgtcgggttgggttgggtttcggtagcgttcggcgggcgtttattggagtcgtcgtttgttgtttaagtattcgtaggggcgcggtcgggaggggtatttgggttcgggttgtgggtcggttttgtaatttttttcgaatttagggtttcggtttgtgtagcgggcgcgtgtgttttgttcggaagaggcgtttgtgtgtttgtgcgtgtttatgtgcgcgttcgtgcgtgtgtatgtggatttttttgtgttttcgtatgggcggaggttttttatatttgttttagagttttttttaagagtttcgttgcgttacgttttgagcgattttttttattttttgtaggttttattagttcggttttttagtcggattcggttgtttgtttagtagtcgttttcgttttcgttcgataggtttttttcgatttttagtttttcgtgtcgttaaagttttcgttgaaattttcgttttcgtttaatttcgtttatattgtttatcgtcgtttagcgtttatttttttttttatttttttagttttaagtatatttattggattttgtttattgggttttttttt

SEQ ID NO: 17610 - DNA, 994 bp, Artificial Sequence
  chemically treated genomic DNA (Homo sapiens) CpG-island No: 17610
aaaaaaaaacccaataaacaaaatccaataaatatacttaaaactaaaaaaataaaaaaaaaaataaacgctaaacgacgataaacaatataaacgaaattaaacgaaaacgaaaatttcaacgaaaactttaacgacacgaaaaactaaaaatcgaaaaaaacctatcgaacgaaaacgaaaacgactactaaacaaacaaccgaatccgactaaaaaaccgaactaataaaacctacaaaaaataaaaaaaatcgctcaaaacgtaacgcaacgaaactcttaaaaaaaactctaaaacaaatataaaaaacctccgcccatacgaaaacacaaaaaaatccacatacacacgcacgaacgcgcacataaacacgcacaaacacacaaacgcctcttccgaacaaaacacacgcgcccgctacacaaaccgaaaccctaaattcgaaaaaaattacaaaaccgacccacaacccgaacccaaatacccctcccgaccgcgcccctacgaatacttaaacaacaaacgacgactccaataaacgcccgccgaacgctaccgaaacccaacccaacccgacgcgcccgaaaaaaaaaaacaaaaaacgaaaaaaaaaatatatcccgactacgtactaaaactacgaaaatctaaaaaaaacgaaacgcgaaaacgaaaccgcgacgcctataaaatcgccttccgcccgaacgtaaacaaacctcgcctaactcccaactaatactaaaacttatcaattcaccatccgccctcgatttccgcgaaacgttaaaccgccaacctcgacaccgtcctttcctttctccctcgcgttaaataaacccgcgccctcttctcccaaacgcgacgcgaaacaaaaaaaaaccgcccgtacgataccgctaaaacgccaaaaccgccctttataaccccgcgtactccaaaaataaacgccccgaaactacaaataaacgatcaccccgaaacgcgaac

SEQ ID NO: 17611 - DNA, 994 bp, Artificial Sequence
  chemically treated genomic DNA (Homo sapiens) CpG-island No: 17611
aaaaaagagtttagtgggtaaggtttagtgagtgtgtttaaaattgggaaaatgaggggaagggtaagcgttgggcggcggtgggtaatatggacgagattaaacgggagcgaggattttagcgagagttttggcgatacggaaggttgagaatcggagggagtttgtcgggcgaaagcgaaggcggttgttgggtaggtagtcgaattcggttggagagtcgagttggtgagatttataggaagtgaagggagtcgtttagggcgtggcgtaacgagatttttagaagaaattttgaggtagatatggggggttttcgtttatacggagatataaggaagtttatatgtatacgtacgagcgcgtatatgaatacgtataagtatataaacgtttttttcgggtagggtatacgcgttcgttgtataggtcgaggttttggattcggaggggattgtagagtcgatttataattcgggtttagatgtttttttcggtcgcgtttttacgaatgtttgggtaataggcggcggttttagtgggcgttcgtcgggcgttgtcggagtttagtttagttcggcgcgttcgggaggagggagtagggagcggggaaaggggtgtgtttcggttgcgtgttgggattgcgagggtttgggaggggcgaggcgcgggggcggggtcgcggcgtttataaagtcgtttttcgttcggacgtaaataaatttcgtttggtttttagttggtgttgaagtttgttagtttattattcgttttcggttttcgcggggcgttgggtcgttagtttcggtatcgtttttttttttttttttcgcgttaggtaagttcgcgttttttttttttaggcgcgacgcggagtagaaaggggtcgttcgtgcggtgtcgttggagcgttaggatcgttttttgtagtttcgcgtattttaggagtaagcgtttcggagttgtaagtgggcggttatttcggggcgcgggt

SEQ ID NO: 17612 - DNA, 994 bp, Artificial Sequence
  chemically treated genomic DNA (Homo sapiens) CpG-island No: 17612
acccgcgccccgaaataaccgcccacttacaactccgaaacgcttactcctaaaatacgcgaaactacaaaaaacgatcctaacgctccaacgacaccgcacgaacgacccctttctactccgcgtcgcgcctaaaaaaaaaaaacgcgaacttacctaacgcgaaaaaaaaaaaaaaaaacgataccgaaactaacgacccaacgccccgcgaaaaccgaaaacgaataataaactaacaaacttcaacaccaactaaaaaccaaacgaaatttatttacgtccgaacgaaaaacgactttataaacgccgcgaccccgcccccgcgcctcgcccctcccaaaccctcgcaatcccaacacgcaaccgaaacacacccctttccccgctccctactccctcctcccgaacgcgccgaactaaactaaactccgacaacgcccgacgaacgcccactaaaaccgccgcctattacccaaacattcgtaaaaacgcgaccgaaaaaaacatctaaacccgaattataaatcgactctacaatcccctccgaatccaaaacctcgacctatacaacgaacgcgtataccctacccgaaaaaaacgtttatatacttatacgtattcatatacgcgctcgtacgtatacatataaacttccttatatctccgtataaacgaaaaccccccatatctacctcaaaatttcttctaaaaatctcgttacgccacgccctaaacgactcccttcacttcctataaatctcaccaactcgactctccaaccgaattcgactacctacccaacaaccgccttcgctttcgcccgacaaactccctccgattctcaaccttccgtatcgccaaaactctcgctaaaatcctcgctcccgtttaatctcgtccatattacccaccgccgcccaacgcttacccttcccctcattttcccaattttaaacacactcactaaaccttacccactaaactctttttt

SEQ ID NO: 17613 - DNA, 725 bp, Artificial Sequence
  chemically treated genomic DNA (Homo sapiens) CpG-island No: 17613
cgtagcggggatttagttcgtaggaagtttcgtacgtgtcggatttcgggtacgtatttgtagggtcgttttttttacgtcgcgttcgagagcggttggggtttgtattgtaaggagagcgcgggacgcgcgggttacggcggcggtgatcgtttcgttttttcggtcgcgtttttagttttttcgaatcgatattttagtaagagaagtcggggttttagcgtttagagtagttggattgtattcgttacggttttcgtttcgtcgcgcgtcggaaacgttagtttttatttttggttcgttttttcggtattttcggcgacgttttgggtagcgggaggatagcgcgttcggcggcgggagagcgggacggtttagtcgcggcgtttttagtttatcggttgttcgtaggcgtcggtcgagttttttttgtcgggtaggaagttttgtttcgtggggggtaaggtcgagtcgttggcgcgtcgggattcggttcgagttaattgaggatcgggtattcgtaggacgtgttaggaggtgtcgaaggttcgttgtggggcggttacgcgcgttttcgttcgtttttcgcggcgtttcgcgtttgtttcgggtttcgttcggtttacgggattttttaggttttcggggttgtggtagtacgcgggtttcgagcgtgggtttttttggggtcgagagtttggagcgttttaggcgttgtttttcgt

SEQ ID NO: 17614 - DNA, 725 bp, Artificial Sequence
  chemically treated genomic DNA (Homo sapiens) CpG-island No: 17614
acgaaaaacaacgcctaaaacgctccaaactctcgaccccaaaaaaacccacgctcgaaacccgcgtactaccacaaccccgaaaacctaaaaaatcccgtaaaccgaacgaaacccgaaacaaacgcgaaacgccgcgaaaaacgaacgaaaacgcgcgtaaccgccccacaacgaaccttcgacacctcctaacacgtcctacgaatacccgatcctcaattaactcgaaccgaatcccgacgcgccaacgactcgaccttaccccccacgaaacaaaacttcctacccgacaaaaaaaactcgaccgacgcctacgaacaaccgataaactaaaaacgccgcgactaaaccgtcccgctctcccgccgccgaacgcgctatcctcccgctacccaaaacgtcgccgaaaataccgaaaaaacgaaccaaaaataaaaactaacgtttccgacgcgcgacgaaacgaaaaccgtaacgaatacaatccaactactctaaacgctaaaaccccgacttctcttactaaaatatcgattcgaaaaaactaaaaacgcgaccgaaaaaacgaaacgatcaccgccgccgtaacccgcgcgtcccgcgctctccttacaatacaaaccccaaccgctctcgaacgcgacgtaaaaaaaacgaccctacaaatacgtacccgaaatccgacacgtacgaaacttcctacgaactaaatccccgctacg

SEQ ID NO: 17615 - DNA, 725 bp, Artificial Sequence
  chemically treated genomic DNA (Homo sapiens) CpG-island No: 17615
gcggggggtagcgtttggggcgttttaagttttcggttttaaggaagtttacgttcgggattcgcgtgttgttatagtttcgggggtttggagggtttcgtgagtcgagcgggattcgggataagcgcgggacgtcgcggggaacggacgggaacgcgcgtggtcgttttatagcgggttttcgatattttttgatacgttttgcgggtgttcggtttttagttggttcgagtcggatttcggcgcgttaacggttcgattttgttttttacgaggtagggttttttgttcggtaggaaggattcggtcggcgtttgcgggtaatcgatgagttgaaggcgtcgcggttgggtcgtttcgttttttcgtcgtcgagcgcgttgttttttcgttgtttagagcgtcgtcggaagtgtcgagggggcgggttaggggtggagattggcgttttcggcgcgcgacggggcggggatcgtagcgggtgtagtttagttgttttggacgttgaggtttcggttttttttgttggggtgtcgattcgggagggttgagggcgcggtcgagagaacggggcggttatcgtcgtcgtggttcgcgcgtttcgcgttttttttgtagtgtaggttttagtcgttttcgggcgcggcgtgggggaggcggttttgtaggtgcgtattcggggttcgatacgtgcggggttttttgcgagttgagttttcgttgcg

SEQ ID NO: 17616 - DNA, 725 bp, Artificial Sequence
  chemically treated genomic DNA (Homo sapiens) CpG-island No: 17616
cgcaacgaaaactcaactcgcaaaaaaccccgcacgtatcgaaccccgaatacgcacctacaaaaccgcctcccccacgccgcgcccgaaaacgactaaaacctacactacaaaaaaaacgcgaaacgcgcgaaccacgacgacgataaccgccccgttctctcgaccgcgccctcaaccctcccgaatcgacaccccaacaaaaaaaaccgaaacctcaacgtccaaaacaactaaactacacccgctacgatccccgccccgtcgcgcgccgaaaacgccaatctccacccctaacccgccccctcgacacttccgacgacgctctaaacaacgaaaaaacaacgcgctcgacgacgaaaaaacgaaacgacccaaccgcgacgccttcaactcatcgattacccgcaaacgccgaccgaatccttcctaccgaacaaaaaaccctacctcgtaaaaaacaaaatcgaaccgttaacgcgccgaaatccgactcgaaccaactaaaaaccgaacacccgcaaaacgtatcaaaaaatatcgaaaacccgctataaaacgaccacgcgcgttcccgtccgttccccgcgacgtcccgcgcttatcccgaatcccgctcgactcacgaaaccctccaaacccccgaaactataacaacacgcgaatcccgaacgtaaacttccttaaaaccgaaaacttaaaacgccccaaacgctaccccccgc

SEQ ID NO: 17617 - DNA, 569 bp, Artificial Sequence
  chemically treated genomic DNA (Homo sapiens) CpG-island No: 17617
tcgtcgtatttgtagggtttttcgtcgttgtggatgcgtaggtgttgcgtgaagtgcgagttgtggttgaaggcgcggtcgtattggtcgtattcgtagggtttttcgttcgtgtggatgcggtggtgttggatgaagttcgattagtcgcggaagcgtttgtcgtattcgtggtaggcgtagggtttttcgttcgtgtggatgcgttggtgttttaggagtagcgagttatatttgaaatttttgtcgtaggtttcgtatttgtgcggtttggtttttcgcgcgttgttttgtcggtttcgatcgaagttgatttttagttcggtagttcgttcgggcgtattttcgggttcggtcgttgtttgttgtacgagcgttacgcgttaggcgtttcgcggttgggcgtaagggacggttttaggcggttggttcgtcggtcgtttcgcgttggatttaggttcgaagtcggcgttgtatcgggttttgcggggaaggttttttaggaggttgcgtagcgtttcgttcgttttttcgttaggggtttgagagttaggagagcgtggagtttg

SEQ ID NO: 17618 - DNA, 569 bp, Artificial Sequence
  chemically treated genomic DNA (Homo sapiens) CpG-island No: 17618
caaactccacgctctcctaactctcaaacccctaacgaaaaaacgaacgaaacgctacgcaacctcctaaaaaaccttccccgcaaaacccgatacaacgccgacttcgaacctaaatccaacgcgaaacgaccgacgaaccaaccgcctaaaaccgtcccttacgcccaaccgcgaaacgcctaacgcgtaacgctcgtacaacaaacaacgaccgaacccgaaaatacgcccgaacgaactaccgaactaaaaatcaacttcgatcgaaaccgacaaaacaacgcgcgaaaaaccaaaccgcacaaatacgaaacctacgacaaaaatttcaaatataactcgctactcctaaaacaccaacgcatccacacgaacgaaaaaccctacgcctaccacgaatacgacaaacgcttccgcgactaatcgaacttcatccaacaccaccgcatccacacgaacgaaaaaccctacgaatacgaccaatacgaccgcgccttcaaccacaactcgcacttcacgcaacacctacgcatccacaacgacgaaaaaccctacaaatacgacga

SEQ ID NO: 17619 - DNA, 569 bp, Artificial Sequence
  chemically treated genomic DNA (Homo sapiens) CpG-island No: 17619
taggttttacgtttttttggtttttaggtttttgacgagggggcgggcggggcgttgcgtaattttttgaggagtttttttcgtagggttcggtgtagcgtcggtttcgggtttgaatttagcgcggagcggtcggcgggttagtcgtttggggtcgttttttgcgtttagtcgcggggcgtttggcgcgtgacgttcgtgtagtaagtagcggtcgggttcgagggtgcgttcgagcgggttgtcgagttgggagttaatttcggtcggagtcggtagggtagcgcgcggggggttaagtcgtataggtgcgaggtttgcggtaagagttttaagtataattcgttgtttttgaagtattagcgtatttatacgggcgagaagttttacgtttgttacgagtgcggtaagcgttttcgcggttggtcgggttttatttagtattatcgtatttatacgggcgagaagttttacgagtgcggttagtgcggtcgcgtttttagttatagttcgtattttacgtagtatttgcgtatttataacggcgagaagttttataagtgcggcga

SEQ ID NO: 17620 - DNA, 569 bp, Artificial Sequence
  chemically treated genomic DNA (Homo sapiens) CpG-island No: 17620
tcgccgcacttataaaacttctcgccgttataaatacgcaaatactacgtaaaatacgaactataactaaaaacgcgaccgcactaaccgcactcgtaaaacttctcgcccgtataaatacgataatactaaataaaacccgaccaaccgcgaaaacgcttaccgcactcgtaacaaacgtaaaacttctcgcccgtataaatacgctaatacttcaaaaacaacgaattatacttaaaactcttaccgcaaacctcgcacctatacgacttaaccccccgcgcgctaccctaccgactccgaccgaaattaactcccaactcgacaacccgctcgaacgcaccctcgaacccgaccgctacttactacacgaacgtcacgcgccaaacgccccgcgactaaacgcaaaaaacgaccccaaacgactaacccgccgaccgctccgcgctaaattcaaacccgaaaccgacgctacaccgaaccctacgaaaaaaactcctcaaaaaattacgcaacgccccgcccgccccctcgtcaaaaacctaaaaaccaaaaaaacgtaaaaccta

SEQ ID NO: 17621 - DNA, 834 bp, Artificial Sequence
  chemically treated genomic DNA (Homo sapiens) CpG-island No: 17621
ttcgttgttgtttcgcgatttttaggagtttatttcgtttttcgggtttggtttaaggttaaggttacggcgagcggcggttgtaagggtcgtacggttcggttgggtagggttgtatcgcggagtacggcgtacgagttcggattgggttggttttaggtattcggagtcgtcgtcgtcgttcgcgtttatttatttttcgagcgggaggaggacgtcgcgcgtcggacggaagtgttcggtttcgttttatttcgttcggttggcgcgtattttcgggacgatttgggtttcgggaggatcgtacgtttcggtggtcgtgtgggggcggggtcgggagcgaagaggaggttttttttcgttttttttttcgtgggttgcgttcgcgcgtggttttcgcgtatacgatggttcggatttcgttcgcgtttgtaaagcgttcgggcgcggggagcggcgttgcgtggggcgtagaagtcggcgtttcggagttttttttttgacgtcggttttgtatcgttcggggagttagcgcggggtcgggtttcgggagatgacggcgtcgtttttacgttgttcgcggttttttcgtgtattttaggttttcgggggttttcggttggagttgtttttacgtttagttcgcgagtttttttcgtcgtttttttgggtttttttttcgggatgtgttcgtagcgatggttatcggcggtcgggaatcgttgcgagacgcgcgatttttcgtttttttcgcgggggttttagcgttttcgattttgtttgttttttaggggcgttttcgggagtttgaggaggatgttataggttttttaa

SEQ ID NO: 17622 - DNA, 834 bp, Artificial Sequence
  chemically treated genomic DNA (Homo sapiens) CpG-island No: 17622
ttaaaaaacctataacatcctcctcaaactcccgaaaacgcccctaaaaaacaaacaaaatcgaaaacgctaaaacccccgcgaaaaaaacgaaaaatcgcgcgtctcgcaacgattcccgaccgccgataaccatcgctacgaacacatcccgaaaaaaaaacccaaaaaaacgacgaaaaaaactcgcgaactaaacgtaaaaacaactccaaccgaaaacccccgaaaacctaaaatacacgaaaaaaccgcgaacaacgtaaaaacgacgccgtcatctcccgaaacccgaccccgcgctaactccccgaacgatacaaaaccgacgtcaaaaaaaaaactccgaaacgccgacttctacgccccacgcaacgccgctccccgcgcccgaacgctttacaaacgcgaacgaaatccgaaccatcgtatacgcgaaaaccacgcgcgaacgcaacccacgaaaaaaaaaacgaaaaaaaacctcctcttcgctcccgaccccgcccccacacgaccaccgaaacgtacgatcctcccgaaacccaaatcgtcccgaaaatacgcgccaaccgaacgaaataaaacgaaaccgaacacttccgtccgacgcgcgacgtcctcctcccgctcgaaaaataaataaacgcgaacgacgacgacgactccgaatacctaaaaccaacccaatccgaactcgtacgccgtactccgcgatacaaccctacccaaccgaaccgtacgacccttacaaccgccgctcgccgtaaccttaaccttaaaccaaacccgaaaaacgaaataaactcctaaaaatcgcgaaacaacaacgaa

SEQ ID NO: 17623 - DNA, 834 bp, Artificial Sequence
  chemically treated genomic DNA (Homo sapiens) CpG-island No: 17623
ttggggaatttgtaatattttttttaggttttcggggacgtttttggaaagtaggtagaatcgagggcgttggggttttcgcgaggggagcgggaggtcgcgcgtttcgtagcggttttcggtcgtcggtgattatcgttgcggatatatttcgaggagggaatttaagagggcggcgggggggattcgcgagttgaacgtggaagtaattttagtcgaggattttcggaggtttggagtgtacggaggggtcgcgggtagcgtggggacggcgtcgttatttttcgaagttcggtttcgcgttggtttttcgggcggtgtagggtcggcgttaggaaggaggtttcgaggcgtcggtttttgcgttttacgtagcgtcgtttttcgcgttcgggcgttttgtaggcgcgggcgggattcgggttatcgtgtacgcgaaagttacgcgcgggcgtagtttacgaggggaggggcggggaaaggtttttttttcgttttcggtttcgtttttatacggttatcgaggcgtgcggttttttcggggtttaaatcgtttcggaagtgcgcgttagtcgggcggagtggggcggggtcggatattttcgttcggcgcgcggcgtttttttttcgttcggaaggtgagtgggcgcgggcggcggcggcggtttcgggtgtttgggattagtttagttcgagttcgtgcgtcgtatttcgcggtgtagttttgtttagtcgggtcgtgcggtttttgtagtcgtcgttcgtcgtgattttggttttgggttaagttcggggagcggggtgggtttttgggggtcgcggagtagtagcgga

SEQ ID NO: 17624 - DNA, 834 bp, Artificial Sequence
  chemically treated genomic DNA (Homo sapiens) CpG-island No: 17624
tccgctactactccgcgacccccaaaaacccaccccgctccccgaacttaacccaaaaccaaaatcacgacgaacgacgactacaaaaaccgcacgacccgactaaacaaaactacaccgcgaaatacgacgcacgaactcgaactaaactaatcccaaacacccgaaaccgccgccgccgcccgcgcccactcaccttccgaacgaaaaaaaaacgccgcgcgccgaacgaaaatatccgaccccgccccactccgcccgactaacgcgcacttccgaaacgatttaaaccccgaaaaaaccgcacgcctcgataaccgtataaaaacgaaaccgaaaacgaaaaaaaaacctttccccgcccctcccctcgtaaactacgcccgcgcgtaactttcgcgtacacgataacccgaatcccgcccgcgcctacaaaacgcccgaacgcgaaaaacgacgctacgtaaaacgcaaaaaccgacgcctcgaaacctccttcctaacgccgaccctacaccgcccgaaaaaccaacgcgaaaccgaacttcgaaaaataacgacgccgtccccacgctacccgcgacccctccgtacactccaaacctccgaaaatcctcgactaaaattacttccacgttcaactcgcgaatcccccccgccgccctcttaaattccctcctcgaaatatatccgcaacgataatcaccgacgaccgaaaaccgctacgaaacgcgcgacctcccgctcccctcgcgaaaaccccaacgccctcgattctacctactttccaaaaacgtccccgaaaacctaaaaaaaatattacaaattccccaa

SEQ ID NO: 17625 - DNA, 1082 bp, Artificial Sequence
  chemically treated genomic DNA (Homo sapiens) CpG-island No: 17625
ggggcgagttttgattttattaattttagtacgcggggcgagttttgattttattaattttagtacgcggggtgagttttgattttattaatattagtacgtagggcgagttttgattttattaatattagtacgcggggcgagtcgtgattttattaatattagtacgcggggcgagttttgattttattaattttagtacgcggggcgagttttgattttattaatattagtacgcggggcgagttttgattttattaatattagtacgcggggcgagtcgtgattttattaatattagtacgcggggcgagttttgattttattaatattagtacgcggggtgagttttgattttaagaatattagtacgcggggtgagttttgattttattaatattagtacgcggggcgagttttgattttattaattttagtacgcggggagagttttgattttattaatattagtacgcggggcgagtcgtgattttattaatattagtacgcggggcgagttttgattttattaatattagtacgcggggcgagttttgattttaagaatattagtacgcggggcgagttttgattttattaatattagtacgcggggcgagttttgattttattaattttagtacgcggggagagttttgattttattaatattagtacgcggggtgagtcgtgattttattaatattagtacgcggggcgagttttgattttattaattttagtacgtggggcgagttttgattttattaatattagtacgcggggtgagttttgattttattaatattagacgcggggcgagttttgattttaagaatattagtacgcggggcgagttttgattttattaattttagtacgtggggcgagttttgattttattaatattagtacgcggggtgagttttgattttattaatattagacgcggggtgagttttgattttaagaatattagtacgcggggcgagttttgattttattaatattagatacggggcgagttgatacggttatatagttcgtaggatttagtagtgtgtttacgacgttacgtatta

SEQ ID NO: 17626 - DNA, 1082 bp, Artificial Sequence
  chemically treated genomic DNA (Homo sapiens) CpG-island No: 17626
taatacgtaacgtcgtaaacacactactaaatcctacgaactatataaccgtatcaactcgccccgtatctaatattaataaaatcaaaactcgccccgcgtactaatattcttaaaatcaaaactcaccccgcgtctaatattaataaaatcaaaactcaccccgcgtactaatattaataaaatcaaaactcgccccacgtactaaaattaataaaatcaaaactcgccccgcgtactaatattcttaaaatcaaaactcgccccgcgtctaatattaataaaatcaaaactcaccccgcgtactaatattaataaaatcaaaactcgccccacgtactaaaattaataaaatcaaaactcgccccgcgtactaatattaataaaatcacgactcaccccgcgtactaatattaataaaatcaaaactctccccgcgtactaaaattaataaaatcaaaactcgccccgcgtactaatattaataaaatcaaaactcgccccgcgtactaatattcttaaaatcaaaactcgccccgcgtactaatattaataaaatcaaaactcgccccgcgtactaatattaataaaatcacgactcgccccgcgtactaatattaataaaatcaaaactctccccgcgtactaaaattaataaaatcaaaactcgccccgcgtactaatattaataaaatcaaaactcaccccgcgtactaatattcttaaaatcaaaactcaccccgcgtactaatattaataaaatcaaaactcgccccgcgtactaatattaataaaatcacgactcgccccgcgtactaatattaataaaatcaaaactcgccccgcgtactaatattaataaaatcaaaactcgccccgcgtactaaaattaataaaatcaaaactcgccccgcgtactaatattaataaaatcacgactcgccccgcgtactaatattaataaaatcaaaactcgccctacgtactaatattaataaaatcaaaactcaccccgcgtactaaaattaataaaatcaaaactcgccccgcgtactaaaattaataaaatcaaaactcgcccc

SEQ ID NO: 17627 - DNA, 1082 bp, Artificial Sequence
  chemically treated genomic DNA (Homo sapiens) CpG-island No: 17627
taatacgtgacgtcgtaagtatattgttggattttacgaattgtgtgatcgtgttagttcgtttcgtgtttggtgttagtgagattagagttcgtttcgcgtgttggtgtttttgagattagggtttatttcgcgtttagtgttagtgagattagagtttatttcgcgtgttggtgttagtgagattagggttcgttttacgtgttggagttagtgagattagggttcgtttcgcgtgttggtgtttttgagattagggttcgtttcgcgtttagtgttagtgagattagagtttatttcgcgtgttggtgttagtgagattagggttcgttttacgtgttggagttagtgagattagggttcgtttcgcgtgttggtgttagtgagattacggtttatttcgcgtgttggtgttagtgagattagggtttttttcgcgtgttagagttagtgagattagggttcgtttcgcgtgttggtgttagtgagattagggttcgtttcgcgtgttggtgtttttgagattagggttcgtttcgcgtgttggtgttagtgagattagggttcgtttcgcgtgttggtgttagtgagattacggttcgtttcgcgtgttggtgttagtgagattagggtttttttcgcgtgttagagttagtgagattagggttcgtttcgcgtgttggtgttagtgagattagggtttatttcgcgtgttggtgtttttgagattagggtttatttcgcgtgttggtgttagtgagattagggttcgtttcgcgtgttggtgttagtgagattacggttcgtttcgcgtgttggtgttagtgagattagggttcgtttcgcgtgttggtgttagtgagattagggttcgtttcgcgtgttggagttagtgagattagggttcgtttcgcgtgttggtgttagtgagattacggttcgtttcgcgtgttggtgttagtgagattagggttcgttttgcgtgttggtgttagtgagattagggtttatttcgcgtgttggagttagtgagattagggttcgtttcgcgtgttggagttagtgagattagggttcgtttt

SEQ ID NO: 17628 - DNA, 1082 bp, Artificial Sequence
  chemically treated genomic DNA (Homo sapiens) CpG-island No: 17628
aaaacgaaccctaatctcactaactccaacacgcgaaacgaaccctaatctcactaactccaacacgcgaaataaaccctaatctcactaacaccaacacgcaaaacgaaccctaatctcactaacaccaacacgcgaaacgaaccgtaatctcactaacaccaacacgcgaaacgaaccctaatctcactaactccaacacgcgaaacgaaccctaatctcactaacaccaacacgcgaaacgaaccctaatctcactaacaccaacacgcgaaacgaaccgtaatctcactaacaccaacacgcgaaacgaaccctaatctcactaacaccaacacgcgaaataaaccctaatctcaaaaacaccaacacgcgaaataaaccctaatctcactaacaccaacacgcgaaacgaaccctaatctcactaactctaacacgcgaaaaaaaccctaatctcactaacaccaacacgcgaaacgaaccgtaatctcactaacaccaacacgcgaaacgaaccctaatctcactaacaccaacacgcgaaacgaaccctaatctcaaaaacaccaacacgcgaaacgaaccctaatctcactaacaccaacacgcgaaacgaaccctaatctcactaactctaacacgcgaaaaaaaccctaatctcactaacaccaacacgcgaaataaaccgtaatctcactaacaccaacacgcgaaacgaaccctaatctcactaactccaacacgtaaaacgaaccctaatctcactaacaccaacacgcgaaataaactctaatctcactaacactaaacgcgaaacgaaccctaatctcaaaaacaccaacacgcgaaacgaaccctaatctcactaactccaacacgtaaaacgaaccctaatctcactaacaccaacacgcgaaataaactctaatctcactaacactaaacgcgaaataaaccctaatctcaaaaacaccaacacgcgaaacgaactctaatctcactaacaccaaacacgaaacgaactaacacgatcacacaattcgtaaaatccaacaatatacttacgacgtcacgtatta

SEQ ID NO: 17629 - DNA, 1237 bp, Artificial Sequence
  chemically treated genomic DNA (Homo sapiens) CpG-island No: 17629
gtaggtttcggcgtaaaaggcgggggtagttggaaggggcggtttttttcgtgcggcgtttgtggtcgtagttttaagtgtttttcggacgcggtaaagtatcggagtatttattcgggggagaaatcgtacgagtgtagcgattgcgggaaggtttttatttattgttcgtacgtggttcggtattagcgggcgtatagcggggagaggttttacgcgtgcgtcgagtgcggtaaggttttcggttagagttttaatttttttcggtattagcgcgtgtatacgggcgagaagttttacgcgtgcgtcgattgcggtaaggttttcggttagaggtcggacgtcgttaagtatcgtcgtatttatatcggggagaggttgtacgcgtgcggcgagtgcgggaagcgttttttgtatagttcgaacgtggttcggtatcggcggatttattacggggagaattcgtacgagtgtcgggagtgcggttaggtttttagttagagttttaattttttttagtattagcgcgtgtatacgggggagcggtttttcgtttgttaggattgcggtcgcgtttttagtcgtagttttttttttcgcgagtatcgtcgtatttatatcggggagaagttttattagtgcggttattgcgggcgcgcgtttcgggcgttgtcgggtttttttcggtattagcgattttatacgggcgagaagtcgtttcgttgtatcgagtgcggtcgcgtttttcgtttgagtttttattttatttagtatcggcgggtgtatggcgtcgagtgagtcggggttgcggcggaagagatgtcggcggtttggtgggcgcgaggtcgaggtcgggggaggtttttgttcgtttcgtgcgcggtgaggaagtaatagtcggttgcgcgtttggttttcgggttgcgaaagtttcgttaggtttgtattcgttttggtttgggagtaattaggagagatagggttcggggaaggcgagcgttgttcgcgggaggcgatttttagaggcggggaggtttttggggtttgtttcgggtcggtcgttcgtttttgaaatttttcgttttttacggttagttgttgcggggtagtggtcggtgattgaatcggttattttttcgtaattaggtttttattaaaattttgtatgagatgacggtttcgggtttcgggttggtgaaggcggggtgggggggtagttacgaagggggcgtttaga

SEQ ID NO: 17630 - DNA, 1237 bp, Artificial Sequence
  chemically treated genomic DNA (Homo sapiens) CpG-island No: 17630
tctaaacgcccccttcgtaactacccccccaccccgccttcaccaacccgaaacccgaaaccgtcatctcatacaaaattttaataaaaacctaattacgaaaaaataaccgattcaatcaccgaccactaccccgcaacaactaaccgtaaaaaacgaaaaatttcaaaaacgaacgaccgacccgaaacaaaccccaaaaacctccccgcctctaaaaatcgcctcccgcgaacaacgctcgccttccccgaaccctatctctcctaattactcccaaaccaaaacgaatacaaacctaacgaaactttcgcaacccgaaaaccaaacgcgcaaccgactattacttcctcaccgcgcacgaaacgaacaaaaacctcccccgacctcgacctcgcgcccaccaaaccgccgacatctcttccgccgcaaccccgactcactcgacgccatacacccgccgatactaaataaaataaaaactcaaacgaaaaacgcgaccgcactcgatacaacgaaacgacttctcgcccgtataaaatcgctaataccgaaaaaaacccgacaacgcccgaaacgcgcgcccgcaataaccgcactaataaaacttctccccgatataaatacgacgatactcgcgaaaaaaaaaactacgactaaaaacgcgaccgcaatcctaacaaacgaaaaaccgctcccccgtatacacgcgctaatactaaaaaaaattaaaactctaactaaaaacctaaccgcactcccgacactcgtacgaattctccccgtaataaatccgccgataccgaaccacgttcgaactatacaaaaaacgcttcccgcactcgccgcacgcgtacaacctctccccgatataaatacgacgatacttaacgacgtccgacctctaaccgaaaaccttaccgcaatcgacgcacgcgtaaaacttctcgcccgtatacacgcgctaataccgaaaaaaattaaaactctaaccgaaaaccttaccgcactcgacgcacgcgtaaaacctctccccgctatacgcccgctaataccgaaccacgtacgaacaataaataaaaaccttcccgcaatcgctacactcgtacgatttctcccccgaataaatactccgatactttaccgcgtccgaaaaacacttaaaactacgaccacaaacgccgcacgaaaaaaaccgccccttccaactacccccgccttttacgccgaaacctac

SEQ ID NO: 17631 - DNA, 1237 bp, Artificial Sequence
  chemically treated genomic DNA (Homo sapiens) CpG-island No: 17631
tttgggcgtttttttcgtaattgtttttttatttcgtttttattaattcgaagttcgaggtcgttattttatgtagggttttgatggaggtttggttgcggaggaatgatcgatttaattatcggttattgtttcgtagtagttgatcgtgggaggcggggagttttagaggcgggcggtcggttcgggatagattttagagattttttcgtttttgggaatcgtttttcgcgggtagcgttcgtttttttcgagttttgttttttttgattgtttttaagttaaggcggatgtaggtttggcgaggttttcgtaattcgagaattaggcgcgtagtcggttgttatttttttatcgcgtacggggcggataggagtttttttcggtttcggtttcgcgtttattaggtcgtcggtatttttttcgtcgtagtttcggtttattcggcgttatgtattcgtcggtgttggatgaggtggaagtttaggcggaaggcgcggtcgtattcggtgtagcggaacggtttttcgttcgtgtggagtcgttggtgtcggaagaagttcgatagcgttcggaacgcgcgttcgtagtggtcgtattggtggggttttttttcggtgtggatgcggcggtgttcgcggaggaaggagttgcggttgaaggcgcggtcgtagttttggtaggcgaagggtcgttttttcgtgtgtacgcgttggtgttggaggaggttggagttttggttgaaggtttggtcgtattttcggtattcgtacgggtttttttcgtggtgggttcgtcggtgtcggattacgttcgagttgtgtaggaagcgtttttcgtattcgtcgtacgcgtatagttttttttcggtgtgggtgcggcggtgtttggcggcgttcgatttttggtcgaaggttttgtcgtagtcggcgtacgcgtagggtttttcgttcgtgtgtacgcgttggtgtcggaggaggttgaagttttggtcgaaggttttgtcgtattcggcgtacgcgtagggttttttttcgttgtgcgttcgttggtgtcggattacgtgcgagtagtggatgaaggttttttcgtagtcgttgtattcgtacggtttttttttcgagtggatgtttcggtgttttgtcgcgttcgaggagtatttgaagttgcggttataggcgtcgtacgggaaaggtcgttttttttagttgttttcgttttttgcgtcggggtttgt

SEQ ID NO: 17632 - DNA, 1237 bp, Artificial Sequence
  chemically treated genomic DNA (Homo sapiens) CpG-island No: 17632
acaaaccccgacgcaaaaaacgaaaacaactaaaaaaaacgacctttcccgtacgacgcctataaccgcaacttcaaatactcctcgaacgcgacaaaacaccgaaacatccactcgaaaaaaaaaccgtacgaatacaacgactacgaaaaaaccttcatccactactcgcacgtaatccgacaccaacgaacgcacaacgaaaaaaaaccctacgcgtacgccgaatacgacaaaaccttcgaccaaaacttcaacctcctccgacaccaacgcgtacacacgaacgaaaaaccctacgcgtacgccgactacgacaaaaccttcgaccaaaaatcgaacgccgccaaacaccgccgcacccacaccgaaaaaaaactatacgcgtacgacgaatacgaaaaacgcttcctacacaactcgaacgtaatccgacaccgacgaacccaccacgaaaaaaacccgtacgaataccgaaaatacgaccaaaccttcaaccaaaactccaacctcctccaacaccaacgcgtacacacgaaaaaacgacccttcgcctaccaaaactacgaccgcgccttcaaccgcaactccttcctccgcgaacaccgccgcatccacaccgaaaaaaaaccccaccaatacgaccactacgaacgcgcgttccgaacgctatcgaacttcttccgacaccaacgactccacacgaacgaaaaaccgttccgctacaccgaatacgaccgcgccttccgcctaaacttccacctcatccaacaccgacgaatacataacgccgaataaaccgaaactacgacgaaaaaaataccgacgacctaataaacgcgaaaccgaaaccgaaaaaaactcctatccgccccgtacgcgataaaaaaataacaaccgactacgcgcctaattctcgaattacgaaaacctcgccaaacctacatccgccttaacttaaaaacaatcaaaaaaaacaaaactcgaaaaaaacgaacgctacccgcgaaaaacgattcccaaaaacgaaaaaatctctaaaatctatcccgaaccgaccgcccgcctctaaaactccccgcctcccacgatcaactactacgaaacaataaccgataattaaatcgatcattcctccgcaaccaaacctccatcaaaaccctacataaaataacgacctcgaacttcgaattaataaaaacgaaataaaaaaacaattacgaaaaaaacgcccaaa

SEQ ID NO: 17633 - DNA, 2391 bp, Artificial Sequence
  chemically treated genomic DNA (Homo sapiens) CpG-island No: 17633
atacgtacgttatatatacgtacgttatatatacgtacgttatatacgtacgttatacgtacgttatatacgtacgttatatatacgtattttatatacgtacgttatatatacgtacgttatatacgtacgttatatatacgtacgttatataggtacgttatacgtacgtacgttatacgtacgtacgttatacgtacgttatatataggtacgttatatataggtacgttatatatacgtacgttatatacgtacgttacgtacgtacgttacgtatatatgttatatacgtacgttatatataggtacgttatatacgtacgttataaatataggtacgttatatatacgtacgttatatacgtacgttatatacgtacgttatatatatacgtacgttatatatatacgttatacgtacgttatatacgtatgttatacgtatattatacgtacgttatatataggtacgttatatatataggtacgttatatatatgtacgttatatacgtacgttatatacgtacgttatatatatgtttattatacgtacgttatatatatgtacgttatatatatgtacgttatatttataggtacgttatatagatgtatgttatatatataggtacgttatatacgtacgttatatataggtatgttaaatacgtacgttatatatgtacgttatatatataggtacgttatataggtacgttatacgtacgttatatacgtatgttatacgtacgttatataggtacgttatatatataggtacgttatatataggtacgttatatatatgtatgttatatacgtacgttatatatatacgttatatatatgtacgttatatatatgtacgttatatttataggtacgttatatagatgtatgttatatatataggtacgttatatacgtacgttatatatataggtacgttatatacgtacgttatatatatgtttattatatacgtacgttatatatatgtatattatacgtacgttatatataggtatgttatataggtacgttatataggtacgttatacgtacgttatatatataggtacgttatataataggtacgttaaagatgtacgttatatatacgtacgttatatatagatacgttatatatatgtacgttatatatatgtaggttatatatatgtatgttatataggtacgttatatatatacgttatacgtatattatatacgtacgttatatacgtacgttatatacgtacgttatacgtacgttatacgtacgttatatataggtacgttatatacgttatatacgtacgtacgttatatacgtacgttatatataggtacgttatatatatgtatatatatatgtatgttatatataggtacgttatatgcgtatattatatacgtacgtaatatatacgtacgttatacgtacgtaatatacgtacgttatacgtacgttatatacgtacgttatatacgtacgttatatataggtacgttatatacgttatatacgtacgttatatacgtacgtacgttatatacgtacgttatatataggtacgttatatatatgtatatatatatatgtacgttatataggtacgttatatataggtatattatatacgtacgttatatataggtatgttaaatacgtacgttatatatgtacgttatatatataggtatattatatataggtacgttatataggtacgttatatatataggtacgttatatacgtatgttatatataggtacgttatataggtacgttatatataggtacgttatatatataggtacgttatatatatgtacgttatatacgtacgttatatacgtacgttatatatatgtttattatacgtacgttatatatatgtacgttatatatatgtacgttatatttataggtacgttatatagatgtatgttatatatataggtacgttatatacgtacgttatatatataggtacgttatatacgtacgttatacgtacgttatatatatgtttattatatacgtacgttatatatatgtacgttatataggtacgttatatatatatgtacgttatatatatgtttattatatacgtacgttatatatatgtacgttatatatataggtacgttatatatatacgtacgttatatatataggtacgttatatacgtacgttatacgtacgttatatatatgtttattatatacgtacgttatatatatgtacgttatatatataggtatattatatatatgtacgttatatatatatgtacgttatatatatgtacgttttatatagatatgttatatataggtatattatacgtataagtgtatatatattatataat

SEQ ID NO: 17634 - DNA, 2391 bp, Artificial Sequence
  chemically treated genomic DNA (Homo sapiens) CpG-island No: 17634
attatataatatatatacacttatacgtataatatacctatatataacatatctatataaaacgtacatatatataacgtacatatatatataacgtacatatatataatatacctatatatataacgtacatatatataacgtacgtatataataaacatatatataacgtacgtataacgtacgtatataacgtacctatatatataacgtacgtatatatataacgtacctatatatataacgtacatatatataacgtacgtatataataaacatatatataacgtacatatatatataacgtacctatataacgtacatatatataacgtacgtatataataaacatatatataacgtacgtataacgtacgtatataacgtacctatatatataacgtacgtatataacgtacctatatatataacatacatctatataacgtacctataaatataacgtacatatatataacgtacatatatataacgtacgtataataaacatatatataacgtacgtatataacgtacgtatataacgtacatatatataacgtacctatatatataacgtacctatatataacgtacctatataacgtacctatatataacatacgtatataacgtacctatatatataacgtacctatataacgtacctatatataatatacctatatatataacgtacatatataacgtacgtatttaacatacctatatataacgtacgtatataatatacctatatataacgtacctatataacgtacatatatatatatacatatatataacgtacctatatataacgtacgtatataacgtacgtacgtatataacgtacgtatataacgtatataacgtacctatatataacgtacgtatataacgtacgtatataacgtacgtataacgtacgtatattacgtacgtataacgtacgtatatattacgtacgtatataatatacgcatataacgtacctatatataacatacatatatatatacatatatataacgtacctatatataacgtacgtatataacgtacgtacgtatataacgtatataacgtacctatatataacgtacgtataacgtacgtataacgtacgtatataacgtacgtatataacgtacgtatataatatacgtataacgtatatatataacgtacctatataacatacatatatataacctacatatatataacgtacatatatataacgtatctatatataacgtacgtatatataacgtacatctttaacgtacctattatataacgtacctatatatataacgtacgtataacgtacctatataacgtacctatataacatacctatatataacgtacgtataatatacatatatataacgtacgtatataataaacatatatataacgtacgtatataacgtacctatatatataacgtacgtatataacgtacctatatatataacatacatctatataacgtacctataaatataacgtacatatatataacgtacatatatataacgtatatatataacgtacgtatataacatacatatatataacgtacctatatataacgtacctatatatataacgtacctatataacgtacgtataacatacgtatataacgtacgtataacgtacctatataacgtacctatatatataacgtacatatataacgtacgtatttaacatacctatatataacgtacgtatataacgtacctatatatataacatacatctatataacgtacctataaatataacgtacatatatataacgtacatatatataacgtacgtataataaacatatatataacgtacgtatataacgtacgtatataacgtacatatatataacgtacctatatatataacgtacctatatataacgtacgtataatatacgtataacatacgtatataacgtacgtataacgtatatatataacgtacgtatatatataacgtacgtatataacgtacgtatataacgtacgtatatataacgtacctatatttataacgtacgtatataacgtacctatatataacgtacgtatataacatatatacgtaacgtacgtacgtaacgtacgtatataacgtacgtatatataacgtacctatatataacgtacctatatataacgtacgtataacgtacgtacgtataacgtacgtacgtataacgtacctatataacgtacgtatatataacgtacgtatataacgtacgtatatataacgtacgtatataaaatacgtatatataacgtacgtatataacgtacgtataacgtacgtatataacgtacgtatatataacgtacgtatatataacgtacgtat

SEQ ID NO: 17635 - DNA, 2391 bp, Artificial Sequence
  chemically treated genomic DNA (Homo sapiens) CpG-island No: 17635
attgtgtggtgtgtgtgtatttgtgcgtgtggtgtgtttgtgtgtggtatgtttgtgtggggcgtgtatgtgtgtggcgtgtatgtgtgtgtggcgtgtatgtgtgtggtgtgtttgtgtgtgtggcgtgtatgtgtgtggcgtgcgtgtgtggtgagtatgtgtgtggcgtgcgtgtggcgtgcgtgtgtggcgtgtttgtgtgtgtggcgtgcgtgtgtgtgtggcgtgtttgtgtgtgtggcgtgtatgtgtgtggcgtgcgtgtgtggtgagtatgtgtgtggcgtgtatgtgtgtgtggcgtgtttgtgtggcgtgtatgtgtgtggcgtgcgtgtgtggtgagtatgtgtgtggcgtgcgtgtggcgtgcgtgtgtggcgtgtttgtgtgtgtggcgtgcgtgtgtggcgtgtttgtgtgtgtggtatgtatttgtgtggcgtgtttgtgggtgtggcgtgtatgtgtgtggcgtgtatgtgtgtggcgtgcgtgtggtgagtatgtgtgtggcgtgcgtgtgtggcgtgcgtgtgtggcgtgtatgtgtgtggcgtgtttgtgtgtgtggcgtgtttgtgtgtggcgtgtttgtgtggcgtgtttgtgtgtggtatgcgtgtgtggcgtgtttgtgtgtgtggcgtgtttgtgtggcgtgtttgtgtgtggtgtgtttgtgtgtgtggcgtgtatgtgtggcgtgcgtgtttggtatgtttgtgtgtggcgtgcgtgtgtggtgtgtttgtgtgtggcgtgtttgtgtggcgtgtatgtgtgtgtgtgtatgtgtgtggcgtgtttgtgtgtggcgtgcgtgtgtggcgtgcgtgcgtgtgtggcgtgcgtgtgtggcgtgtgtggcgtgtttgtgtgtggcgtgcgtgtgtggcgtgcgtgtgtggcgtgcgtgtggcgtgcgtgtgttgcgtgcgtgtggcgtgcgtgtgtgttgcgtgcgtgtgtggtgtgcgtatgtggcgtgtttgtgtgtggtatgtatgtgtgtgtgtatgtgtgtggcgtgtttgtgtgtggcgtgcgtgtgtggcgtgcgtgcgtgtgtggcgtgtgtggcgtgtttgtgtgtggcgtgcgtgtggcgtgcgtgtggcgtgcgtgtgtggcgtgcgtgtgtggcgtgcgtgtgtggtgtgcgtgtggcgtgtgtgtgtgacgtgtttgtgtggtatgtatgtgtgtggtttgtatgtgtgtggcgtgtatgtgtgtggcgtgtttgtgtgtggcgtgcgtgtgtgtggcgtgtatttttggcgtgtttgttgtgtggcgtgtttgtgtgtgtggcgtgcgtgtggcgtgtttgtgtggcgtgtttgtgtggtatgtttgtgtgtggcgtgcgtgtggtgtgtatgtgtgtggcgtgcgtgtgtggtgagtatgtgtgtggcgtgcgtgtgtggcgtgtttgtgtgtgtggcgtgcgtgtgtggcgtgtttgtgtgtgtggtatgtatttgtatggcgtgtttgtgggtgtggcgtgtatgtgtgtggcgtgtatgtgtgtggcgtgtgtgtgtggcgtgcgtgtgtggtatgtatgtgtgtggcgtgtttgtgtgtggcgtgtttgtgtgtgtggcgtgtttgtgtggcgtgcgtgtggtatgcgtgtgtggcgtgcgtgtggcgtgtttgtgtggcgtgtttgtgtgtgtggcgtgtatgtgtggcgtgcgtgtttggtatgtttgtgtgtggcgtgcgtgtgtggcgtgtttgtgtgtgtggtatgtatttgtatggcgtgtttgtgggtgtggcgtgtatgtgtgtggcgtgtatgtgtgtggcgtgcgtgtggtgagtatgtgtgtggcgtgcgtgtgtggcgtgcgtgtgtggcgtgtatgtgtgtggcgtgtttgtgtgtgtggcgtgtttgtgtgtggcgtgcgtgtggtgtgcgtgtggtatgcgtgtgtggcgtgcgtgtggcgtgtgtgtgtaacgtgcgtgtgtgtgtagcgtgcgtgtgtggcgtgcgtgtgtggcgtgcgtgtgtgtggcgtgtttgtgtttgtggcgtgcgtgtgtggcgtatttgtgtgtggcgtgcgtgtgtggtatgtgtgcgtggcgtgcgtgcgtggcgtgcgtgtgtggcgtgcgtgtgtgtggcgtgtttgtgtgtggcgtgtttgtgtgtggcgtgcgtgtggcgtgcgtgcgtgtggcgtgcgtgcgtgtggcgtgtttgtgtggcgtgcgtgtgtgtggcgtgcgtgtgtggcgtgcgtgtgtgtggcgtgcgtgtgtggagtgcgtgtgtgtggcgtgcgtgtgtggcgtgcgtgtggcgtgcgtgtgtggcgtgcgtgtgtgtggcgtgcgtgtgtgtggcgtgcgtgt

SEQ ID NO: 17636 - DNA, 2391 bp, Artificial Sequence
  chemically treated genomic DNA (Homo sapiens) CpG-island No: 17636
acacgcacgccacacacacgcacgccacacacacgcacgccacacacgcacgccacacgcacgccacacacgcacgccacacacacgcactccacacacgcacgccacacacacgcacgccacacacgcacgccacacacacgcacgccacacaaacacgccacacgcacgcacgccacacgcacgcacgccacacgcacgccacacacaaacacgccacacacaaacacgccacacacacgcacgccacacacgcacgccacgcacgcacgccacgcacacataccacacacgcacgccacacacaaatacgccacacacgcacgccacaaacacaaacacgccacacacacgcacgccacacacgcacgccacacacgcacgctacacacacacgcacgttacacacacacgccacacgcacgccacacacgcataccacacgcacaccacacgcacgccacacacaaacacgccacacacacaaacacgccacacacatacacgccacacacgcacgccacacacgcacgccacacacatactcaccacacgcacgccacacacatacacgccacacacatacacgccacacccacaaacacgccatacaaatacataccacacacacaaacacgccacacacgcacgccacacacaaacataccaaacacgcacgccacacatacacgccacacacacaaacacgccacacaaacacgccacacgcacgccacacacgcataccacacgcacgccacacaaacacgccacacacacaaacacgccacacacaaacacgccacacacatacataccacacacgcacgccacacacacacgccacacacatacacgccacacacatacacgccacacccacaaacacgccatacaaatacataccacacacacaaacacgccacacacgcacgccacacacacaaacacgccacacacgcacgccacacacatactcaccacacacgcacgccacacacatacacaccacacgcacgccacacacaaacataccacacaaacacgccacacaaacacgccacacgcacgccacacacacaaacacgccacacaacaaacacgccaaaaatacacgccacacacacgcacgccacacacaaacacgccacacacatacacgccacacacatacaaaccacacacatacataccacacaaacacgtcacacacacacgccacacgcacaccacacacgcacgccacacacgcacgccacacacgcacgccacacgcacgccacacgcacgccacacacaaacacgccacacacgccacacacgcacgcacgccacacacgcacgccacacacaaacacgccacacacatacacacacacatacataccacacacaaacacgccacatacgcacaccacacacgcacgcaacacacacgcacgccacacgcacgcaacacacgcacgccacacgcacgccacacacgcacgccacacacgcacgccacacacaaacacgccacacacgccacacacgcacgccacacacgcacgcacgccacacacgcacgccacacacaaacacgccacacacatacacacacacacatacacgccacacaaacacgccacacacaaacacaccacacacgcacgccacacacaaacataccaaacacgcacgccacacatacacgccacacacacaaacacaccacacacaaacacgccacacaaacacgccacacacacaaacacgccacacacgcataccacacacaaacacgccacacaaacacgccacacacaaacacgccacacacacaaacacgccacacacatacacgccacacacgcacgccacacacgcacgccacacacatactcaccacacgcacgccacacacatacacgccacacacatacacgccacacccacaaacacgccacacaaatacataccacacacacaaacacgccacacacgcacgccacacacacaaacacgccacacacgcacgccacacgcacgccacacacatactcaccacacacgcacgccacacacatacacgccacacaaacacgccacacacacatacacgccacacacatactcaccacacacgcacgccacacacatacacgccacacacacaaacacgccacacacacacgcacgccacacacacaaacacgccacacacgcacgccacacgcacgccacacacatactcaccacacacgcacgccacacacatacacgccacacacacaaacacaccacacacatacacgccacacacacatacacgccacacacatacacgccccacacaaacataccacacacaaacacaccacacgcacaaatacacacacaccacacaat

SEQ ID NO: 17637 - DNA, 756 bp, Artificial Sequence
  chemically treated genomic DNA (Homo sapiens) CpG-island No: 17637
cgagcgggtagatttttggagttttcgtaaagggagtcgaggagttaggcgcgtcgagtttaggttcgttttgatttttagtttgggacgtttcgtatagttttttttttcgtttttcgaatttttttcgtacgtttagcggtcgtcgcggcgtatgcgtagtataatttgttagttagtcgcgggcgtttcggtcgcggttgttaggggttatcgtttcgcgggcgggcggagttggtcgtttagagttcgtttttttggaattttggttggttgatatagttgttcgtcgaagcggtattgtcgtttattgggtaatggttagtttcgtacgttagattcgtgtttcgtttagtcgcgtcgcgggtcgtttttatttaggagggatagtcggggatcggcgcgggtatttaggagttcgcggtttaggtggtgcgggcggttttagttcggttgcggagcgttgcgcgagcggcgggttggttgatttcgagggatttttagcgtagcgggtgcggcgatgattttggaggagaggtcggacggcgcgggcgtcggcgaggagagttcgcggttgtaggtgcgtagaattggcgcggcggcgggaggaggggttcggaatttcggtttttttttgttttttttcgaggcgcgtttcgggcgttttttttttacgttttattcggttcggacgtaggtagggaaattgaggttagagtttgcgtttttttttttttgagttcggtggaggtgttt

SEQ ID NO: 17638 - DNA, 756 bp, Artificial Sequence
  chemically treated genomic DNA (Homo sapiens) CpG-island No: 17638
aaacacctccaccgaactcaaaaaaaaaaaaacgcaaactctaacctcaatttccctacctacgtccgaaccgaataaaacgtaaaaaaaaaacgcccgaaacgcgcctcgaaaaaaaacaaaaaaaaaccgaaattccgaacccctcctcccgccgccgcgccaattctacgcacctacaaccgcgaactctcctcgccgacgcccgcgccgtccgacctctcctccaaaatcatcgccgcacccgctacgctaaaaatccctcgaaatcaaccaacccgccgctcgcgcaacgctccgcaaccgaactaaaaccgcccgcaccacctaaaccgcgaactcctaaatacccgcgccgatccccgactatccctcctaaataaaaacgacccgcgacgcgactaaacgaaacacgaatctaacgtacgaaactaaccattacccaataaacgacaataccgcttcgacgaacaactatatcaaccaaccaaaattccaaaaaaacgaactctaaacgaccaactccgcccgcccgcgaaacgataacccctaacaaccgcgaccgaaacgcccgcgactaactaacaaattatactacgcatacgccgcgacgaccgctaaacgtacgaaaaaaattcgaaaaacgaaaaaaaaaactatacgaaacgtcccaaactaaaaatcaaaacgaacctaaactcgacgcgcctaactcctcgactccctttacgaaaactccaaaaatctacccgctcg

SEQ ID NO: 17639 - DNA, 756 bp, Artificial Sequence
  chemically treated genomic DNA (Homo sapiens) CpG-island No: 17639
aagtatttttatcgagtttagaggaggagggacgtaggttttggttttagtttttttgtttgcgttcgggtcgaatgagacgtaggaggggggcgttcggaacgcgtttcgagggggggtaggaaaaggtcgggatttcgggttttttttttcgtcgtcgcgttagttttgcgtatttgtagtcgcgggtttttttcgtcggcgttcgcgtcgttcggttttttttttaggattatcgtcgtattcgttgcgttgggggtttttcggggttagttagttcgtcgttcgcgtagcgtttcgtagtcgggttagggtcgttcgtattatttgggtcgcgggtttttgagtgttcgcgtcggttttcgattgttttttttgagtgggggcggttcgcggcgcggttgggcggggtacgggtttggcgtgcgaagttggttattgtttaataggcggtaatgtcgtttcgacggatagttatattagttaattagagttttaggaaggcgggttttggacggttagtttcgttcgttcgcgggacggtaatttttggtaatcgcggtcggaacgttcgcggttggttggtaggttgtattgcgtatgcgtcgcggcggtcgttgagcgtgcgggagaagttcgggaaacggagaaaaaaattatacggaacgttttaagttgagagttagggcggatttggattcggcgcgtttagtttttcggttttttttgcggggattttaggagtttgttcgttcg

SEQ ID NO: 17640 - DNA, 756 bp, Artificial Sequence
  chemically treated genomic DNA (Homo sapiens) CpG-island No: 17640
cgaacgaacaaactcctaaaatccccgcaaaaaaaaccgaaaaactaaacgcgccgaatccaaatccgccctaactctcaacttaaaacgttccgtataatttttttctccgtttcccgaacttctcccgcacgctcaacgaccgccgcgacgcatacgcaatacaacctaccaaccaaccgcgaacgttccgaccgcgattaccaaaaattaccgtcccgcgaacgaacgaaactaaccgtccaaaacccgccttcctaaaactctaattaactaatataactatccgtcgaaacgacattaccgcctattaaacaataaccaacttcgcacgccaaacccgtaccccgcccaaccgcgccgcgaaccgcccccactcaaaaaaaacaatcgaaaaccgacgcgaacactcaaaaacccgcgacccaaataatacgaacgaccctaacccgactacgaaacgctacgcgaacgacgaactaactaaccccgaaaaacccccaacgcaacgaatacgacgataatcctaaaaaaaaaaccgaacgacgcgaacgccgacgaaaaaaacccgcgactacaaatacgcaaaactaacgcgacgacgaaaaaaaaaacccgaaatcccgaccttttcctaccccccctcgaaacgcgttccgaacgcccccctcctacgtctcattcgacccgaacgcaaacaaaaaaactaaaaccaaaacctacgtccctcctcctctaaactcgataaaaatactt

SEQ ID NO: 17641 - DNA, 656 bp, Artificial Sequence
  chemically treated genomic DNA (Homo sapiens) CpG-island No: 17641
agcggggttagggtttaggtgagggtttagggtcggggcgagcgcggcgcggttcggatgcgtagcgttatcgcgttagatttttcgtttagttgtcgtgggtttttttttttttcgattatagacggcgtaggtttttagttattttagagcggtttcggaagaattcgggcggaatcgcggttggttttcggttttcggcgttttcggaggcgtattgaggtttcgtagggggcggggaagtttgcgtgtgcgtagttcggttcggttcgttttttttattttagttcgtttttttttcggttttggattcggttttgtgggagggttcgtttcgggttcggtgcgattgcgtagtttttcggcgttttttcggtggttttttcgggtcgagtaaataggtggggtagtgtcggattaggaaggagcgttaagcgggtaggtaggcggggagggcgcggggagggcgcggggaggcggcggttagtttaggaggagtttgttttgggtgtcgcgggagttatcgacgggttgtagaggtcgggaggaggcgatcgcggcgcggttttagaaggttggattgaggattatagttggttttcggttttttttcggagtttggggttttcggtagtattttcgcggtttttttttta

SEQ ID NO: 17642 - DNA, 656 bp, Artificial Sequence
  chemically treated genomic DNA (Homo sapiens) CpG-island No: 17642
taaaaaaaaaaccgcgaaaatactaccgaaaaccccaaactccgaaaaaaaaccgaaaaccaactataatcctcaatccaaccttctaaaaccgcgccgcgatcgcctcctcccgacctctacaacccgtcgataactcccgcgacacccaaaacaaactcctcctaaactaaccgccgcctccccgcgccctccccgcgccctccccgcctacctacccgcttaacgctccttcctaatccgacactaccccacctatttactcgacccgaaaaaaccaccgaaaaaacgccgaaaaactacgcaatcgcaccgaacccgaaacgaaccctcccacaaaaccgaatccaaaaccgaaaaaaaaacgaactaaaataaaaaaaacgaaccgaaccgaactacgcacacgcaaacttccccgccccctacgaaacctcaatacgcctccgaaaacgccgaaaaccgaaaaccaaccgcgattccgcccgaattcttccgaaaccgctctaaaataactaaaaacctacgccgtctataatcgaaaaaaaaaaaaacccacgacaactaaacgaaaaatctaacgcgataacgctacgcatccgaaccgcgccgcgctcgccccgaccctaaaccctcacctaaaccctaaccccgct

SEQ ID NO: 17643 - DNA, 656 bp, Artificial Sequence
  chemically treated genomic DNA (Homo sapiens) CpG-island No: 17643
tgagaaggaggtcgcggggatgttgtcgaaggttttaggtttcggggagaggtcggaagttagttgtggtttttagtttagttttttagggtcgcgtcgcggtcgttttttttcggtttttgtagttcgtcggtggttttcgcggtatttagaataggttttttttggattggtcgtcgttttttcgcgtttttttcgcgtttttttcgtttgtttgttcgtttggcgtttttttttggttcgatattgttttatttgtttgttcgattcggggaagttatcgaggaagcgtcgaggagttgcgtagtcgtatcgagttcggaacggatttttttatagaatcgggtttagagtcggggagggggcgggttaggatgaagagggcgggtcgggtcgagttgcgtatacgtaggttttttcgttttttgcggggttttagtacgttttcgagaacgtcgggaatcggaagttagtcgcggtttcgttcggattttttcggggtcgttttgggatgattggaggtttgcgtcgtttatggtcggggagggggagagtttacggtagttgagcggagggtttggcgcggtgacgttgcgtattcgggtcgcgtcgcgttcgtttcgattttaaatttttatttgaattttaatttcgtt

SEQ ID NO: 17644 - DNA, 656 bp, Artificial Sequence
  chemically treated genomic DNA (Homo sapiens) CpG-island No: 17644
aacgaaattaaaattcaaataaaaatttaaaatcgaaacgaacgcgacgcgacccgaatacgcaacgtcaccgcgccaaaccctccgctcaactaccgtaaactctccccctccccgaccataaacgacgcaaacctccaatcatcccaaaacgaccccgaaaaaatccgaacgaaaccgcgactaacttccgattcccgacgttctcgaaaacgtactaaaaccccgcaaaaaacgaaaaaacctacgtatacgcaactcgacccgacccgccctcttcatcctaacccgccccctccccgactctaaacccgattctataaaaaaatccgttccgaactcgatacgactacgcaactcctcgacgcttcctcgataacttccccgaatcgaacaaacaaataaaacaatatcgaaccaaaaaaaaacgccaaacgaacaaacaaacgaaaaaaacgcgaaaaaaacgcgaaaaaacgacgaccaatccaaaaaaaacctattctaaataccgcgaaaaccaccgacgaactacaaaaaccgaaaaaaaacgaccgcgacgcgaccctaaaaaactaaactaaaaaccacaactaacttccgacctctccccgaaacctaaaaccttcgacaacatccccgcgacctccttctca

SEQ ID NO: 17645 - DNA, 646 bp, Artificial Sequence
  chemically treated genomic DNA (Homo sapiens) CpG-island No: 17645
gaagaggcgcgcgttaggggtttcggcggggattttttataagttattttcggcgtcgtttcgcggatttattagcgatattttcggtgggcgtttcgcgttttcgtcgtaaaggaacgattagcgaggtaaggaaacgtttggttggggtagcggggaagtggtttttttttacgtttttgttttaattattttttcgggcgtaattcgtcggttacgcggtaatgcggacgtttagattcgggcgcggggtgtagcggtttttttttatcgtttcgggattgcgagcgtttttgggtacggtttcgttatacgtcgttattattgcgtttattgttatttttaggggttttttcgacggttagggatgtgttgaggtaacgtcgggcgggtagtaggggcgagttcgcgtttttttggagtcgaaaggagtattgcggtcggtgatttcgggcggaaatttgttgggagcgtatcggaagtagtcgtttatagaggtttgcgtatttgttttcggtttgttttgagatattcggatgatcgtttattcggtggtttaacggttttcgataggagtttcgggttcgggtaaggaaggggttagttgggtttttagtgtgaagcgattgtgggatattttggtgaa

SEQ ID NO: 17646 - DNA, 646 bp, Artificial Sequence
  chemically treated genomic DNA (Homo sapiens) CpG-island No: 17646
ttcaccaaaatatcccacaatcgcttcacactaaaaacccaactaaccccttccttacccgaacccgaaactcctatcgaaaaccgttaaaccaccgaataaacgatcatccgaatatctcaaaacaaaccgaaaacaaatacgcaaacctctataaacgactacttccgatacgctcccaacaaatttccgcccgaaatcaccgaccgcaatactcctttcgactccaaaaaaacgcgaactcgcccctactacccgcccgacgttacctcaacacatccctaaccgtcgaaaaaacccctaaaaataacaataaacgcaataataacgacgtataacgaaaccgtacccaaaaacgctcgcaatcccgaaacgataaaaaaaaaccgctacaccccgcgcccgaatctaaacgtccgcattaccgcgtaaccgacgaattacgcccgaaaaaataattaaaacaaaaacgtaaaaaaaaaccacttccccgctaccccaaccaaacgtttccttacctcgctaatcgttcctttacgacgaaaacgcgaaacgcccaccgaaaatatcgctaataaatccgcgaaacgacgccgaaaataacttataaaaaatccccgccgaaacccctaacgcgcgcctcttc

SEQ ID NO: 17647 - DNA, 646 bp, Artificial Sequence
  chemically treated genomic DNA (Homo sapiens) CpG-island No: 17647
tttattaggatgttttatagtcgttttatattaagagtttaattggttttttttttgttcggattcggagtttttgtcggggatcgttgaattatcgagtgggcggttattcgggtgttttagagtagatcgagagtaggtgcgtagatttttgtggacggttattttcggtgcgtttttaataggttttcgttcggggttatcggtcgtagtgtttttttcggttttagggaagcgcggattcgtttttgttgttcgttcggcgttgttttagtatatttttgatcgtcggaggagtttttagaagtggtagtgggcgtaatggtggcggcgtgtggcggggtcgtgtttagaagcgttcgtagtttcggagcggtgggggagggtcgttgtatttcgcgttcgagtttgggcgttcgtattgtcgcgtggtcggcgaattgcgttcgagggggtggttaagataaaagcgtggggaggggttattttttcgttgttttagttaggcgtttttttgtttcgttgatcgtttttttacggcgggaacgcgaggcgtttatcggggatgtcgttaatgagttcgcggggcgacgtcgagagtggtttgtgaggggttttcgtcggagtttttggcgcgcgttttttt

SEQ ID NO: 17648 - DNA, 646 bp, Artificial Sequence
  chemically treated genomic DNA (Homo sapiens) CpG-island No: 17648
aaaaaaacgcgcgccaaaaactccgacgaaaacccctcacaaaccactctcgacgtcgccccgcgaactcattaacgacatccccgataaacgcctcgcgttcccgccgtaaaaaaacgatcaacgaaacaaaaaaacgcctaactaaaacaacgaaaaaataacccctccccacgcttttatcttaaccaccccctcgaacgcaattcgccgaccacgcgacaatacgaacgcccaaactcgaacgcgaaatacaacgaccctcccccaccgctccgaaactacgaacgcttctaaacacgaccccgccacacgccgccaccattacgcccactaccacttctaaaaactcctccgacgatcaaaaatatactaaaacaacgccgaacgaacaacaaaaacgaatccgcgcttccctaaaaccgaaaaaaacactacgaccgataaccccgaacgaaaacctattaaaaacgcaccgaaaataaccgtccacaaaaatctacgcacctactctcgatctactctaaaacacccgaataaccgcccactcgataattcaacgatccccgacaaaaactccgaatccgaacaaaaaaaaaaccaattaaactcttaatataaaacgactataaaacatcctaataaa

SEQ ID NO: 17649 - DNA, 925 bp, Artificial Sequence
  chemically treated genomic DNA (Homo sapiens) CpG-island No: 17649
agtgttcgtcgttattgcgtggttacgggggtgggaagtgtttatcgttagtgtgtggttacggggtgggaagtgttcgtcgttagtgcgtggttacgggggtgggaagtgtttatcgttagtgcgtggttataggggtgggaagtgtttttcgttagtgcgtggttacgggggtgggaagtgttcgtcgttagtgtgtggttacgggggtgagaaatgttcgttgtaaatgagtggttacggggtgggaagtgttcgtcgttagtgcgtggttacggggtgggaagtgttcgtcgttagtgcgtggttacgggggtgggaagtgttcgtcgttagtgcgtggttacgggggtgggaagtgttcgtcgttagtgcgtggttacgggggtgggaagtgtttatcgttagtgtgtggttacgggggtgggaagtgtttttcgttagtgcgtggttacggggtgggaaatgttcgttgtaaatgagtggttacggggtgggaaatgttcgtttttagtgcgtggttacggggtgggaagtgttcgttttaaatgagtggttacggggtgggaaatgttcgtttttagtgcgtggttacggggtgggaaatgttcgtcgttattgcgtggttacgggggtgggaaatgttcgtcgttagtgcgtggttacgggggtgggaaatgttcgtcgttagtgcgtggttacgggggtgggaaatggtcgtcgttagtgtgtggttacgggggtgggaagtgttcgtcgttagtgcgtggttacgggggtgggaaatggttttcgttagtgtgtggttacgggggtgggaagtgttcgtcgttagtgtgtggttacggggtgggaagtgtttatcgttagtgtgtggttacggggtgggaagtgtttatcgttagtgtgtggttacgggggtggg

SEQ ID NO: 17650 - DNA, 925 bp, Artificial Sequence
  chemically treated genomic DNA (Homo sapiens) CpG-island No: 17650
cccacccccgtaaccacacactaacgataaacacttcccaccccgtaaccacacactaacgataaacacttcccaccccgtaaccacacactaacgacgaacacttcccacccccgtaaccacacactaacgaaaaccatttcccacccccgtaaccacgcactaacgacgaacacttcccacccccgtaaccacacactaacgacgaccatttcccacccccgtaaccacgcactaacgacgaacatttcccacccccgtaaccacgcactaacgacgaacatttcccacccccgtaaccacgcaataacgacgaacatttcccaccccgtaaccacgcactaaaaacgaacatttcccaccccgtaaccactcatttaaaacgaacacttcccaccccgtaaccacgcactaaaaacgaacatttcccaccccgtaaccactcatttacaacgaacatttcccaccccgtaaccacgcactaacgaaaaacacttcccacccccgtaaccacacactaacgataaacacttcccacccccgtaaccacgcactaacgacgaacacttcccacccccgtaaccacgcactaacgacgaacacttcccacccccgtaaccacgcactaacgacgaacacttcccaccccgtaaccacgcactaacgacgaacacttcccaccccgtaaccactcatttacaacgaacatttctcacccccgtaaccacacactaacgacgaacacttcccacccccgtaaccacgcactaacgaaaaacacttcccacccctataaccacgcactaacgataaacacttcccacccccgtaaccacgcactaacgacgaacacttcccaccccgtaaccacacactaacgataaacacttcccacccccgtaaccacgcaataacgacgaacact

SEQ ID NO: 17651 - DNA, 925 bp, Artificial Sequence
  chemically treated genomic DNA (Homo sapiens) CpG-island No: 17651
tttattttcgtgattatatattggcggtgagtattttttatttcgtgattatatattggcggtgagtattttttatttcgtgattatatattggcggcgagtattttttattttcgtgattatatattggcggggattattttttattttcgtgattacgtattggcggcgagtattttttattttcgtgattatatattggcggcgattattttttattttcgtgattacgtattggcggcgagtattttttattttcgtgattacgtattggcggcgagtattttttattttcgtgattacgtagtggcggcgagtattttttatttcgtgattacgtattgggggcgagtattttttatttcgtgattatttatttagagcgagtattttttatttcgtgattacgtattgggggcgagtattttttatttcgtgattatttatttatagcgagtattttttatttcgtgattacgtattggcggggagtattttttattttcgtgattatatattagcggtgagtattttttattttcgtgattacgtattggcggcgagtattttttattttcgtgattacgtattggcggcgagtattttttattttcgtgattacgtattggcggcgagtattttttatttcgtgattacgtattggcggcgagtattttttatttcgtgattatttatttatagcgagtattttttattttcgtgattatatattggcggcgagtattttttattttcgtgattacgtattggcggggagtattttttatttttgtgattacgtattggcggtgagtattttttattttcgtgattacgtattggcggcgagtattttttatttcgtgattatatattggcggtgagtattttttattttcgtgattacgtagtggcggcgagtatt

SEQ ID NO: 17652 - DNA, 925 bp, Artificial Sequence
  chemically treated genomic DNA (Homo sapiens) CpG-island No: 17652
aatactcgccgccactacgtaatcacgaaaataaaaaatactcaccgccaatatataatcacgaaataaaaaatactcgccgccaatacgtaatcacgaaaataaaaaatactcaccgccaatacgtaatcacaaaaataaaaaatactccccgccaatacgtaatcacgaaaataaaaaatactcgccgccaatatataatcacgaaaataaaaaatactcgctataaataaataatcacgaaataaaaaatactcgccgccaatacgtaatcacgaaataaaaaatactcgccgccaatacgtaatcacgaaaataaaaaatactcgccgccaatacgtaatcacgaaaataaaaaatactcgccgccaatacgtaatcacgaaaataaaaaatactcaccgctaatatataatcacgaaaataaaaaatactccccgccaatacgtaatcacgaaataaaaaatactcgctataaataaataatcacgaaataaaaaatactcgcccccaatacgtaatcacgaaataaaaaatactcgctctaaataaataatcacgaaataaaaaatactcgcccccaatacgtaatcacgaaataaaaaatactcgccgccactacgtaatcacgaaaataaaaaatactcgccgccaatacgtaatcacgaaaataaaaaatactcgccgccaatacgtaatcacgaaaataaaaaataatcgccgccaatatataatcacgaaaataaaaaatactcgccgccaatacgtaatcacgaaaataaaaaataatccccgccaatatataatcacgaaaataaaaaatactcgccgccaatatataatcacgaaataaaaaatactcaccgccaatatataatcacgaaataaaaaatactcaccgccaatatataatcacgaaaataaa

SEQ ID NO: 17653 - DNA, 586 bp, Artificial Sequence
  chemically treated genomic DNA (Homo sapiens) CpG-island No: 17653
ttacggggtgggaaatgttcgtcgttagtgcgtggttacggggtgggaaatgttcgtcgttagtgcgtggttataggggtgggaaatgtttttcgttagtgcgtggttataggggtgggaaatgttcgtcgttagtgcgtggttacggggtgggaaatgttcgtcgttagtgcgtggttacggggtgggaaatgttcgtcgttaatgcgtggttacgggggtgggaaatgttcgtcgttagtgtgtggttacgggggtgggaaatgttcgtcgttagtgcgtggttacgggggtgggaaatgttcgtcgttagtgcgtggttacgggggtgggaaatggtcgtcgttagtgtgtggttacggggtgggaagtgttcgtcgttagtgcgtggttacgggggtgggaaatgttcgtcgttagtgcgtggttacgggggtgggaaatggtcgtcgttagtgtgtggttacgggggtgggaagtgttcgtcgttagtgcgtggttataggggtgggaaatggtcgtcgttagtgtgtggttacgggggtgggaagtgttcgtcgttagtgtgttgttataagtttaaggt

SEQ ID NO: 17654 - DNA, 586 bp, Artificial Sequence
  chemically treated genomic DNA (Homo sapiens) CpG-island No: 17654
accttaaacttataacaacacactaacgacgaacacttcccacccccgtaaccacacactaacgacgaccatttcccacccctataaccacgcactaacgacgaacacttcccacccccgtaaccacacactaacgacgaccatttcccacccccgtaaccacgcactaacgacgaacatttcccacccccgtaaccacgcactaacgacgaacacttcccaccccgtaaccacacactaacgacgaccatttcccacccccgtaaccacgcactaacgacgaacatttcccacccccgtaaccacgcactaacgacgaacatttcccacccccgtaaccacacactaacgacgaacatttcccacccccgtaaccacgcattaacgacgaacatttcccaccccgtaaccacgcactaacgacgaacatttcccaccccgtaaccacgcactaacgacgaacatttcccacccctataaccacgcactaacgaaaaacatttcccacccctataaccacgcactaacgacgaacatttcccaccccgtaaccacgcactaacgacgaacatttcccaccccgtaa

SEQ ID NO: 17655 - DNA, 586 bp, Artificial Sequence
  chemically treated genomic DNA (Homo sapiens) CpG-island No: 17655
attttaaatttgtgataatatattggcggcgagtattttttattttcgtgattatatattggcggcgattattttttatttttgtgattacgtattggcggcgagtattttttattttcgtgattatatattggcggcgattattttttattttcgtgattacgtattggcggcgagtattttttattttcgtgattacgtattggcggcgagtattttttatttcgtgattatatattggcggcgattattttttattttcgtgattacgtattggcggcgagtattttttattttcgtgattacgtattggcggcgagtattttttattttcgtgattatatattggcggcgagtattttttattttcgtgattacgtattggcggcgagtattttttatttcgtgattacgtattggcggcgagtattttttatttcgtgattacgtattggcggcgagtattttttatttttgtgattacgtattggcggggagtattttttatttttgtgattacgtattggcggcgagtattttttatttcgtgattacgtattggcggcgagtattttttatttcgtga

SEQ ID NO: 17656 - DNA, 586 bp, Artificial Sequence
  chemically treated genomic DNA (Homo sapiens) CpG-island No: 17656
tcacgaaataaaaaatactcgccgccaatacgtaatcacgaaataaaaaatactcgccgccaatacgtaatcacaaaaataaaaaatactccccgccaatacgtaatcacaaaaataaaaaatactcgccgccaatacgtaatcacgaaataaaaaatactcgccgccaatacgtaatcacgaaataaaaaatactcgccgccaatacgtaatcacgaaaataaaaaatactcgccgccaatatataatcacgaaaataaaaaatactcgccgccaatacgtaatcacgaaaataaaaaatactcgccgccaatacgtaatcacgaaaataaaaaataatcgccgccaatatataatcacgaaataaaaaatactcgccgccaatacgtaatcacgaaaataaaaaatactcgccgccaatacgtaatcacgaaaataaaaaataatcgccgccaatatataatcacgaaaataaaaaatactcgccgccaatacgtaatcacaaaaataaaaaataatcgccgccaatatataatcacgaaaataaaaaatactcgccgccaatatattatcacaaatttaaaat

SEQ ID NO: 17657 - DNA, 779 bp, Artificial Sequence
  chemically treated genomic DNA (Homo sapiens) CpG-island No: 17657
cgaaagagacgggaagatatcgttaatttatagggtaggttcgcgcgggaggtttttggcgcggcgacggggcggggttaggcggtttttagtatgtcgcgcgcgtttttcgcgggatttcggttttcggtatgtcgcgcgttagcgtatgcgtgatgcggtttcgcgaggtagtgttttttggcggcgggtagtgatcgtcgcgggggcggagtcggaggcggggggttgcgtttggtgacgggaggacgcgcggtcgtcgcgtattgggtcggcggcggcggcggaagacgtcgatagtacgggttgtcgcggtagtagcggcggagtagtagagaggtcggggagcggcggttggtttacgcgcgtcgcgcgggtcgggatgagggattgtggcggcgcggttcgcgcgtaatcggtcggtgagagcgcgggtaacgggcggtgggcggcgcgggttaagaagatggcggaggggtcggcgttgcggttttcgtggttttggtttagtttcggcggaggttttaggttcggtagcgtaaggaatttaggttcgcggcgattgtagcggcgggaggggttgtgattgggtcgtggaaggagggggcgtgggtgtgcggggttcggtcgggcggggggcgcggaagttcgaggggtcgaggtcgcgcggggttcgggtgcgcgtcgacgggtcgggttgggagtgtgagggtgggtgagttcgtttgtgttcggttcgaagtgggtgtgattgtattttgtttagagtgagttgtgtt

SEQ ID NO: 17658 - DNA, 779 bp, Artificial Sequence
  chemically treated genomic DNA (Homo sapiens) CpG-island No: 17658
aacacaactcactctaaacaaaatacaatcacacccacttcgaaccgaacacaaacgaactcacccaccctcacactcccaacccgacccgtcgacgcgcacccgaaccccgcgcgacctcgacccctcgaacttccgcgccccccgcccgaccgaaccccgcacacccacgccccctccttccacgacccaatcacaacccctcccgccgctacaatcgccgcgaacctaaattccttacgctaccgaacctaaaacctccgccgaaactaaaccaaaaccacgaaaaccgcaacgccgacccctccgccatcttcttaacccgcgccgcccaccgcccgttacccgcgctctcaccgaccgattacgcgcgaaccgcgccgccacaatccctcatcccgacccgcgcgacgcgcgtaaaccaaccgccgctccccgacctctctactactccgccgctactaccgcgacaacccgtactatcgacgtcttccgccgccgccgccgacccaatacgcgacgaccgcgcgtcctcccgtcaccaaacgcaaccccccgcctccgactccgcccccgcgacgatcactacccgccgccaaaaaacactacctcgcgaaaccgcatcacgcatacgctaacgcgcgacataccgaaaaccgaaatcccgcgaaaaacgcgcgcgacatactaaaaaccgcctaaccccgccccgtcgccgcgccaaaaacctcccgcgcgaacctaccctataaattaacgatatcttcccgtctctttcg

SEQ ID NO: 17659 - DNA, 779 bp, Artificial Sequence
  chemically treated genomic DNA (Homo sapiens) CpG-island No: 17659
gatataatttattttggatagggtatagttatatttatttcgggtcgggtataggcgaatttatttatttttatatttttagttcggttcgtcggcgcgtattcgggtttcgcgcggtttcggtttttcgagttttcgcgtttttcgttcggtcgggtttcgtatatttacgttttttttttttacggtttagttatagtttttttcgtcgttgtagtcgtcgcgggtttggattttttgcgttgtcgggtttggagttttcgtcgaggttgggttaggattacggggatcgtagcgtcggttttttcgttatttttttggttcgcgtcgtttatcgttcgttgttcgcgtttttatcggtcggttgcgcgcgggtcgcgtcgttatagttttttatttcggttcgcgcgacgcgcgtgagttagtcgtcgtttttcggtttttttgttgtttcgtcgttgttgtcgcggtagttcgtgttgtcggcgtttttcgtcgtcgtcgtcggtttagtgcgcggcggtcgcgcgttttttcgttattaagcgtaatttttcgttttcggtttcgttttcgcggcggttattattcgtcgttagggggtattgtttcgcgaggtcgtattacgtatgcgttggcgcgcggtatgtcgggagtcggagtttcgcggagggcgcgcgcggtatgttgggagtcgtttggtttcgtttcgtcgtcgcgttagaggtttttcgcgcggatttattttgtgagttagcggtgttttttcgtttttttcg

SEQ ID NO: 17660 - DNA, 779 bp, Artificial Sequence
  chemically treated genomic DNA (Homo sapiens) CpG-island No: 17660
cgaaaaaaacgaaaaaacaccgctaactcacaaaataaatccgcgcgaaaaacctctaacgcgacgacgaaacgaaaccaaacgactcccaacataccgcgcgcgccctccgcgaaactccgactcccgacataccgcgcgccaacgcatacgtaatacgacctcgcgaaacaataccccctaacgacgaataataaccgccgcgaaaacgaaaccgaaaacgaaaaattacgcttaataacgaaaaaacgcgcgaccgccgcgcactaaaccgacgacgacgacgaaaaacgccgacaacacgaactaccgcgacaacaacgacgaaacaacaaaaaaaccgaaaaacgacgactaactcacgcgcgtcgcgcgaaccgaaataaaaaactataacgacgcgacccgcgcgcaaccgaccgataaaaacgcgaacaacgaacgataaacgacgcgaaccaaaaaaataacgaaaaaaccgacgctacgatccccgtaatcctaacccaacctcgacgaaaactccaaacccgacaacgcaaaaaatccaaacccgcgacgactacaacgacgaaaaaaactataactaaaccgtaaaaaaaaaaaacgtaaatatacgaaacccgaccgaacgaaaaacgcgaaaactcgaaaaaccgaaaccgcgcgaaacccgaatacgcgccgacgaaccgaactaaaaatataaaaataaataaattcgcctatacccgacccgaaataaatataactataccctatccaaaataaattatatc

SEQ ID NO: 17661 - DNA, 725 bp, Artificial Sequence
  chemically treated genomic DNA (Homo sapiens) CpG-island No: 17661
ttttgcgtaatcgttcggttcggcggagcgggtttcgggggttcggtcgtacgttttcgattatagttagtatggatcggggcgtagggtttttcgtttcgataagggttcggaatttaaggcgagcggaggcgatagtgtcggttgcgggttcgttttttgtcgagtttcgcgcgtttattgcgggggttatagtttttattaggtcgggttcggagatcgcgttttttttagttttcgtttcgcggtcgcggtcgatttatttttgggtcgtcgagatagtttcgggagaaataaacgttatttcgttttagggttcgttaaggtttttttttcggaaacggtcgatgcgtcgttttgggaggtttggaggatcgcgcgtttcgatggcgttcgggtttcgacggtttttagtttttgcggcgcggcggtcgttagggttttagttaggggcgcgtttggggggtttcgggttagatcgggtattagttttaggttcgacgggcgcggaagggcgtcgacgttttcggcgtttcgtttttttcgggatcggaggtagcgaacgtttattttttgcgtttattttttgttttcgggtggtttgcgggggttggggagtacggtgcgggatcgattttcggattcgtaggaagggcggagtaggggcgttcggttagggtcggttttttatataaatttatgatattgtttagtatgattttttt

SEQ ID NO: 17662 - DNA, 725 bp, Artificial Sequence
  chemically treated genomic DNA (Homo sapiens) CpG-island No: 17662
aaaaaaatcatactaaacaatatcataaatttatataaaaaaccgaccctaaccgaacgcccctactccgcccttcctacgaatccgaaaatcgatcccgcaccgtactccccaacccccgcaaaccacccgaaaacaaaaaataaacgcaaaaaataaacgttcgctacctccgatcccgaaaaaaacgaaacgccgaaaacgtcgacgcccttccgcgcccgtcgaacctaaaactaatacccgatctaacccgaaaccccccaaacgcgcccctaactaaaaccctaacgaccgccgcgccgcaaaaactaaaaaccgtcgaaacccgaacgccatcgaaacgcgcgatcctccaaacctcccaaaacgacgcatcgaccgtttccgaaaaaaaaaccttaacgaaccctaaaacgaaataacgtttatttctcccgaaactatctcgacgacccaaaaataaatcgaccgcgaccgcgaaacgaaaactaaaaaaaacgcgatctccgaacccgacctaataaaaactataacccccgcaataaacgcgcgaaactcgacaaaaaacgaacccgcaaccgacactatcgcctccgctcgccttaaattccgaacccttatcgaaacgaaaaaccctacgccccgatccatactaactataatcgaaaacgtacgaccgaacccccgaaacccgctccgccgaaccgaacgattacgcaaaa

SEQ ID NO: 17663 - DNA, 725 bp, Artificial Sequence
  chemically treated genomic DNA (Homo sapiens) CpG-island No: 17663
aaaaaagttatattaaataatgttataaatttatataagagatcgattttggtcggacgtttttgtttcgttttttttgcgggttcgggagtcgatttcgtatcgtgttttttaattttcgtaggttattcgggggtagagagtgggcgtaaggggtgaacgttcgttgttttcgatttcgggggaaacggagcgtcgagaacgtcgacgttttttcgcgttcgtcgggtttgggattgatattcggtttggttcggaattttttaggcgcgtttttagttggggttttggcgatcgtcgcgtcgtaggggttagaagtcgtcgaaattcgagcgttatcgaggcgcgcggttttttaggttttttaaaacggcgtatcggtcgttttcggggggggggttttgacgggttttggggcggggtggcgtttgtttttttcggggttgtttcggcggtttaagggtgagtcggtcgcggtcgcggggcggggattgggaggggcgcggttttcgagttcggtttggtggaggttgtagttttcgtagtgggcgcgcggagttcggtagggagcggattcgtagtcggtattgtcgttttcgttcgttttgggtttcgaatttttatcggggcgaagggttttgcgtttcggtttatgttggttgtggtcgggggcgtgcggtcgggttttcgagattcgtttcgtcgagtcggacggttgcgtagag

SEQ ID NO: 17664 - DNA, 725 bp, Artificial Sequence
  chemically treated genomic DNA (Homo sapiens) CpG-island No: 17664
ctctacgcaaccgtccgactcgacgaaacgaatctcgaaaacccgaccgcacgcccccgaccacaaccaacataaaccgaaacgcaaaacccttcgccccgataaaaattcgaaacccaaaacgaacgaaaacgacaataccgactacgaatccgctccctaccgaactccgcgcgcccactacgaaaactacaacctccaccaaaccgaactcgaaaaccgcgcccctcccaatccccgccccgcgaccgcgaccgactcacccttaaaccgccgaaacaaccccgaaaaaaacaaacgccaccccgccccaaaacccgtcaaaaccccccccccgaaaacgaccgatacgccgttttaaaaaacctaaaaaaccgcgcgcctcgataacgctcgaatttcgacgacttctaacccctacgacgcgacgatcgccaaaaccccaactaaaaacgcgcctaaaaaattccgaaccaaaccgaatatcaatcccaaacccgacgaacgcgaaaaaacgtcgacgttctcgacgctccgtttcccccgaaatcgaaaacaacgaacgttcaccccttacgcccactctctacccccgaataacctacgaaaattaaaaaacacgatacgaaatcgactcccgaacccgcaaaaaaaacgaaacaaaaacgtccgaccaaaatcgatctcttatataaatttataacattatttaatataactttttt

SEQ ID NO: 17665 - DNA, 944 bp, Artificial Sequence
  chemically treated genomic DNA (Homo sapiens) CpG-island No: 17665
ttttttcgagtttacgtatattaggatatttttagtcgcgttttttggtgcgtttgcgcgggggttttggaggaggagaagtaggcggggtcggcggtcgttggtgattataagtttcggcgtgtatcgcgttaggttggtcgtggcgcgttcggaaggtgtcgcggttttgggtttcgtttcggaagataaggtcgttcgttgacgtcgtgttttttttttcggtcgcgttggtgaataggtaggttatttttgcggttttgcggtatgggtagtattcgtcgttattttttttcgtgaggcgcgttgagattcggatcggtttttttgagaggatgtcggtgcgggcgttcgcggagagggtagggagtggtgggcgcggcggtttcgggggcggggtttcggaaagtcgggttggcgggggtattcgggtcgttcggtcgcgttaattgtgagtcgtttttaggattcgtcgttatgggtcgtgtgattcgtggatagaggaagggcgtcgggtttgtgtttcgcgcgtacgtgaagtatcgtaaaggcgttgcgcgtttgcgcgtcgtggatttcgttgagcggtacggttatattaagggtatcgttaaggtgcggaacgttggtcggggcgggaggggaagggacgttcggtcggaacgtcgtatttacgtcgtttttgtttataggatattatttacgattcgggtcgcggcgcgtttttcgttaaggtggtttttcgggattcgtatcggtttaagaagcggacggagttgtttattgtcgtcgagggtatttatacgggttagtttgtgtattgcggtaagaagggttagtatcgcggcggggaaggaaggtcggggtggggaggggtttgggtgttgtttgaggagttaacgttttaagtcgatatgggaatttcgtaggtagaagttttaggt

SEQ ID NO: 17666 - DNA, 944 bp, Artificial Sequence
  chemically treated genomic DNA (Homo sapiens) CpG-island No: 17666
acctaaaacttctacctacgaaattcccatatcgacttaaaacgttaactcctcaaacaacacccaaacccctccccaccccgaccttccttccccgccgcgatactaacccttcttaccgcaatacacaaactaacccgtataaataccctcgacgacaataaacaactccgtccgcttcttaaaccgatacgaatcccgaaaaaccaccttaacgaaaaacgcgccgcgacccgaatcgtaaataatatcctataaacaaaaacgacgtaaatacgacgttccgaccgaacgtcccttcccctcccgccccgaccaacgttccgcaccttaacgatacccttaatataaccgtaccgctcaacgaaatccacgacgcgcaaacgcgcaacgcctttacgatacttcacgtacgcgcgaaacacaaacccgacgcccttcctctatccacgaatcacacgacccataacgacgaatcctaaaaacgactcacaattaacgcgaccgaacgacccgaatacccccgccaacccgactttccgaaaccccgcccccgaaaccgccgcgcccaccactccctaccctctccgcgaacgcccgcaccgacatcctctcaaaaaaaccgatccgaatctcaacgcgcctcacgaaaaaaaataacgacgaatactacccataccgcaaaaccgcaaaaataacctacctattcaccaacgcgaccgaaaaaaaaaacacgacgtcaacgaacgaccttatcttccgaaacgaaacccaaaaccgcgacaccttccgaacgcgccacgaccaacctaacgcgatacacgccgaaacttataatcaccaacgaccgccgaccccgcctacttctcctcctccaaaacccccgcgcaaacgcaccaaaaaacgcgactaaaaatatcctaatatacgtaaactcgaaaaaa

SEQ ID NO: 17667 - DNA, 944 bp, Artificial Sequence
  chemically treated genomic DNA (Homo sapiens) CpG-island No: 17667
atttgaagtttttgtttgcgaggtttttatatcggtttaggacgttaattttttaggtaatatttagatttttttttatttcgatttttttttttcgtcgcgatgttaattttttttgtcgtaatatataaattggttcgtgtgaatgttttcggcggtaatgaatagtttcgttcgttttttaaatcgatacggatttcggaagattattttggcgaggggcgcgtcgcggttcgggtcgtggatgatgttttgtgggtagaggcggcgtgagtgcggcgtttcggtcgggcgtttttttttttttcgtttcggttagcgtttcgtattttgacgatgtttttgatgtagtcgtgtcgtttagcgaaatttacggcgcgtaggcgcgtagcgtttttacggtgttttacgtgcgcgcggaatatagattcggcgttttttttttgtttacggattatacggtttatggcgacgggttttgggggcgatttataattagcgcggtcgggcggttcgggtattttcgttagttcggtttttcgggatttcgttttcgaggtcgtcgcgtttattattttttatttttttcgcgggcgttcgtatcggtatttttttaggagggtcggttcgggttttagcgcgttttacggaagaggatggcggcggatattgtttatgtcgtaaggtcgtaaggatgatttatttgtttattagcgcggtcgaaagaggaaatacggcgttagcgagcggttttatttttcggggcggggtttagggtcgcgatatttttcgggcgcgttacggttagtttagcgcggtgtacgtcggggtttgtagttattagcggtcgtcggtttcgtttatttttttttttttagggttttcgcgtaggcgtattaggagacgcggttgaaggtgttttggtgtgcgtgggttcggaagga

SEQ ID NO: 17668 - DNA, 944 bp, Artificial Sequence
  chemically treated genomic DNA (Homo sapiens) CpG-island No: 17668
tccttccgaacccacgcacaccaaaacaccttcaaccgcgtctcctaatacgcctacgcgaaaaccctaaaaaaaaaaaaataaacgaaaccgacgaccgctaataactacaaaccccgacgtacaccgcgctaaactaaccgtaacgcgcccgaaaaatatcgcgaccctaaaccccgccccgaaaaataaaaccgctcgctaacgccgtatttcctctttcgaccgcgctaataaacaaataaatcatccttacgaccttacgacataaacaatatccgccgccatcctcttccgtaaaacgcgctaaaacccgaaccgaccctcctaaaaaaataccgatacgaacgcccgcgaaaaaaataaaaaataataaacgcgacgacctcgaaaacgaaatcccgaaaaaccgaactaacgaaaatacccgaaccgcccgaccgcgctaattataaatcgcccccaaaacccgtcgccataaaccgtataatccgtaaacaaaaaaaaaacgccgaatctatattccgcgcgcacgtaaaacaccgtaaaaacgctacgcgcctacgcgccgtaaatttcgctaaacgacacgactacatcaaaaacatcgtcaaaatacgaaacgctaaccgaaacgaaaaaaaaaaaaacgcccgaccgaaacgccgcactcacgccgcctctacccacaaaacatcatccacgacccgaaccgcgacgcgcccctcgccaaaataatcttccgaaatccgtatcgatttaaaaaacgaacgaaactattcattaccgccgaaaacattcacacgaaccaatttatatattacgacaaaaaaaattaacatcgcgacgaaaaaaaaaaatcgaaataaaaaaaaatctaaatattacctaaaaaattaacgtcctaaaccgatataaaaacctcgcaaacaaaaacttcaaat

SEQ ID NO: 17669 - DNA, 750 bp, Artificial Sequence
  chemically treated genomic DNA (Homo sapiens) CpG-island No: 17669
gcgggaaggtttttcggtagagtacgtagttgggtgtttattatcgcgtttatattcgcgagcggttttacgtatgcggcgagtgcggtaaggtttttagtcgtagttttcggttgttgtagtattagaagttttatatcggggagaagtttttcgcgtgtatagagtgcggtaaggcgttttgtcgtaggtttatttttaacgagtacggtcgtatttatagcggggagcggttttatcggtgtttgcggtgtgggtagcgttttattcgagggttttcgtttttgaagtattatcggttgtacgcgtaggagggtgtttaggacggcggcgcggggtagggcgttttgttcggagttgcgtagaggttttaggcgggggattcgttttacgagtgttcggtgtgcgggaggtcgtttcgatataattttttgttgttgttgtatttgcgtttatatacgggcgagaagtcgttcgagtgcgcggagtgcggtaaggttttcggtcgtaagtttaattttattttgtattagaagatttatattaaggagaagtttttcgcgtgtatcgagtgcggtaaggcgtttcgtaggagttatacgttgaacgagtattatcggttttatagcggcgagaggttatatcggtgtcgcgtttgcgggagggtttgtagtcggttgtttatttttatttagtattagaaggtgtacggtcgcgagttcggggaggatatagagggtaggcgggcgt

SEQ ID NO: 17670 - DNA, 750 bp, Artificial Sequence
  chemically treated genomic DNA (Homo sapiens) CpG-island No: 17670
acgcccgcctaccctctatatcctccccgaactcgcgaccgtacaccttctaatactaaataaaaataaacaaccgactacaaaccctcccgcaaacgcgacaccgatataacctctcgccgctataaaaccgataatactcgttcaacgtataactcctacgaaacgccttaccgcactcgatacacgcgaaaaacttctccttaatataaatcttctaatacaaaataaaattaaacttacgaccgaaaaccttaccgcactccgcgcactcgaacgacttctcgcccgtatataaacgcaaatacaacaacaacaaaaaattatatcgaaacgacctcccgcacaccgaacactcgtaaaacgaatcccccgcctaaaacctctacgcaactccgaacaaaacgccctaccccgcgccgccgtcctaaacaccctcctacgcgtacaaccgataatacttcaaaaacgaaaaccctcgaataaaacgctacccacaccgcaaacaccgataaaaccgctccccgctataaatacgaccgtactcgttaaaaataaacctacgacaaaacgccttaccgcactctatacacgcgaaaaacttctccccgatataaaacttctaatactacaacaaccgaaaactacgactaaaaaccttaccgcactcgccgcatacgtaaaaccgctcgcgaatataaacgcgataataaacacccaactacgtactctaccgaaaaaccttcccgc

SEQ ID NO: 17671 - DNA, 750 bp, Artificial Sequence
  chemically treated genomic DNA (Homo sapiens) CpG-island No: 17671
gcgttcgtttgttttttgtgtttttttcgggttcgcggtcgtgtattttttggtgttggatgagggtggatagtcggttgtaggttttttcgtaggcgcggtatcggtatggtttttcgtcgttgtggagtcggtagtgttcgtttagcgtgtagtttttgcggaacgttttgtcgtattcggtgtacgcgaagggtttttttttggtgtggattttttggtgtagagtgaggttggatttgcgatcgaaggttttgtcgtatttcgcgtattcgaacggtttttcgttcgtgtgtaggcgtaggtgtagtagtagtagggagttgtgtcggaacggtttttcgtatatcgggtattcgtggggcgggtttttcgtttggggtttttgcgtagtttcgagtagggcgttttgtttcgcgtcgtcgttttgggtatttttttgcgcgtgtagtcggtggtgttttaggagcgaggattttcggatgaagcgttgtttatatcgtaggtatcggtagggtcgtttttcgttgtggatgcggtcgtgttcgttgagggtgaatttgcggtagaacgttttgtcgtattttgtgtacgcgaagggttttttttcggtgtggaatttttggtgttgtagtagtcgggagttgcggttgaaggttttgtcgtattcgtcgtatgcgtagggtcgttcgcgggtgtggacgcggtggtgggtatttagttgcgtgttttgtcggaaggttttttcgt

SEQ ID NO: 17672 - DNA, 750 bp, Artificial Sequence
  chemically treated genomic DNA (Homo sapiens) CpG-island No: 17672
acgaaaaaaccttccgacaaaacacgcaactaaatacccaccaccgcgtccacacccgcgaacgaccctacgcatacgacgaatacgacaaaaccttcaaccgcaactcccgactactacaacaccaaaaattccacaccgaaaaaaaacccttcgcgtacacaaaatacgacaaaacgttctaccgcaaattcaccctcaacgaacacgaccgcatccacaacgaaaaacgaccctaccgatacctacgatataaacaacgcttcatccgaaaatcctcgctcctaaaacaccaccgactacacgcgcaaaaaaatacccaaaacgacgacgcgaaacaaaacgccctactcgaaactacgcaaaaaccccaaacgaaaaacccgccccacgaatacccgatatacgaaaaaccgttccgacacaactccctactactactacacctacgcctacacacgaacgaaaaaccgttcgaatacgcgaaatacgacaaaaccttcgatcgcaaatccaacctcactctacaccaaaaaatccacaccaaaaaaaaacccttcgcgtacaccgaatacgacaaaacgttccgcaaaaactacacgctaaacgaacactaccgactccacaacgacgaaaaaccataccgataccgcgcctacgaaaaaacctacaaccgactatccaccctcatccaacaccaaaaaatacacgaccgcgaacccgaaaaaaacacaaaaaacaaacgaacgc

SEQ ID NO: 17673 - DNA, 784 bp, Artificial Sequence
  chemically treated genomic DNA (Homo sapiens) CpG-island No: 17673
ttcgtcggcgcgtattcgggtttcgcgcggtttcggttttttaagttttcgcgtttttcgttcggtcgggtttcgtatatttacgttttttttttttacggtttagttatagtttttttcgtcgttgtagtcgtcgcgggtttggattttttgcgttgtcgggtttggagttttcgtcgaggttgggttaggattacggggatcgtagcgtcggttttttcgttatttttttggttcgcgtcgtttatcgttcgttgttcgcgtttttatcggtcggttgcgcgcgggtcgcgtcgttatagttttttatttcggttcgcgcgacgcgcgtgagttagtcgtcgtttttcggtttttttgttgtttcgtcgttgttgtcgcggtagttcgtgttgtcggcgtttttcgtcgtcgtcgtcggtttagtgcgcggcggtcgcgcgttttttcgttattaagcgtaatttttcgttttcggtttcgttttcgcggcggttattattcgtcgttagggggtattgtttcgcgaggtcgtattacgtatgcgttggcgcgcggtatgtcgggagtcggagtttcgcggagggcgcgcgcggtatgttgggagtcgtttggtttcgtttcgtcgtcgcgttagaggtttttcgcgcggatttattttgtgagttagcggtgttttttcgtttttttcggtgtagagtagttattatttgatacgtttcggtgtggtttggtgtaattttgtttttttaaattacgttgggtttttcgagtttgagatttt

SEQ ID NO: 17674 - DNA, 784 bp, Artificial Sequence
  chemically treated genomic DNA (Homo sapiens) CpG-island No: 17674
aaaatctcaaactcgaaaaacccaacgtaatttaaaaaaacaaaattacaccaaaccacaccgaaacgtatcaaataataactactctacaccgaaaaaaacgaaaaaacaccgctaactcacaaaataaatccgcgcgaaaaacctctaacgcgacgacgaaacgaaaccaaacgactcccaacataccgcgcgcgccctccgcgaaactccgactcccgacataccgcgcgccaacgcatacgtaatacgacctcgcgaaacaataccccctaacgacgaataataaccgccgcgaaaacgaaaccgaaaacgaaaaattacgcttaataacgaaaaaacgcgcgaccgccgcgcactaaaccgacgacgacgacgaaaaacgccgacaacacgaactaccgcgacaacaacgacgaaacaacaaaaaaaccgaaaaacgacgactaactcacgcgcgtcgcgcgaaccgaaataaaaaactataacgacgcgacccgcgcgcaaccgaccgataaaaacgcgaacaacgaacgataaacgacgcgaaccaaaaaaataacgaaaaaaccgacgctacgatccccgtaatcctaacccaacctcgacgaaaactccaaacccgacaacgcaaaaaatccaaacccgcgacgactacaacgacgaaaaaaactataactaaaccgtaaaaaaaaaaaacgtaaatatacgaaacccgaccgaacgaaaaacgcgaaaacttaaaaaaccgaaaccgcgcgaaacccgaatacgcgccgacgaa

SEQ ID NO: 17675 - DNA, 784 bp, Artificial Sequence
  chemically treated genomic DNA (Homo sapiens) CpG-island No: 17675
gaaattttagattcgggaagtttaacgtggtttgagagggtaaaattatattaaattatatcgagacgtgttagatggtaattgttttgtatcgaaagagacgggaagatatcgttaatttatagggtaggttcgcgcgggaggtttttggcgcggcgacggggcggggttaggcggtttttagtatgtcgcgcgcgtttttcgcgggatttcggttttcggtatgtcgcgcgttagcgtatgcgtgatgcggtttcgcgaggtagtgttttttggcggcgggtagtgatcgtcgcgggggcggagtcggaggcggggggttgcgtttggtgacgggaggacgcgcggtcgtcgcgtattgggtcggcggcggcggcggaggacgtcgatagtacgggttgtcgcggtagtagcggcggagtagtagagaggtcggggagcggcggttggtttacgcgcgtcgcgcgggtcgggatgagggattgtggcggcgcggttcgcgcgtagtcggtcggtgagagcgcgggtaacgggcggtgggcggcgcgggttaggaagatggcggaggggtcggcgttgcggttttcgtggttttggtttagtttcggcggaggttttaggttcggtagcgtaaggaatttaggttcgcggcgattgtagcggcgggaggggttgtgattgggtcgtggagggagggggcgtgggtgtgcggggttcggtcgggcggggggcgcggaggtttgaggggtcgaggtcgcgcggggttcgggtgcgcgtcgacggg

SEQ ID NO: 17676 - DNA, 784 bp, Artificial Sequence
  chemically treated genomic DNA (Homo sapiens) CpG-island No: 17676
cccgtcgacgcgcacccgaaccccgcgcgacctcgacccctcaaacctccgcgccccccgcccgaccgaaccccgcacacccacgccccctccctccacgacccaatcacaacccctcccgccgctacaatcgccgcgaacctaaattccttacgctaccgaacctaaaacctccgccgaaactaaaccaaaaccacgaaaaccgcaacgccgacccctccgccatcttcctaacccgcgccgcccaccgcccgttacccgcgctctcaccgaccgactacgcgcgaaccgcgccgccacaatccctcatcccgacccgcgcgacgcgcgtaaaccaaccgccgctccccgacctctctactactccgccgctactaccgcgacaacccgtactatcgacgtcctccgccgccgccgccgacccaatacgcgacgaccgcgcgtcctcccgtcaccaaacgcaaccccccgcctccgactccgcccccgcgacgatcactacccgccgccaaaaaacactacctcgcgaaaccgcatcacgcatacgctaacgcgcgacataccgaaaaccgaaatcccgcgaaaaacgcgcgcgacatactaaaaaccgcctaaccccgccccgtcgccgcgccaaaaacctcccgcgcgaacctaccctataaattaacgatatcttcccgtctctttcgatacaaaacaattaccatctaacacgtctcgatataatttaatataattttaccctctcaaaccacgttaaacttcccgaatctaaaatttc

SEQ ID NO: 17677 - DNA, 624 bp, Artificial Sequence
  chemically treated genomic DNA (Homo sapiens) CpG-island No: 17677
tacgcgttaacgtttttatttcggttttttcggttttttttcgggttaggtcgggtttggtttttttattcgggtagttcggggttcggtattcggttttcgtttgggtttgcgtttatttggttcgttttgtagaattgtttttttagtttcgttatcgatatgttgtcgttcgtcgtcgagtttttcgttcggatcgcgttagcgataggttttcgggcgtcgtcgattttttgcgcgttttagtagttttcgtcggcgtcgttttcgttattcgtttgttagtttcgcgttcgtttcggcgtcgttttagtcgttcgcgcgttcgcgcggttaggatattatatggtaatcgtacgttttcggtgtcggttttcgcgcgcgttttcggttttcgcgcgcgttttcggtttcgtttgcgtacgcgcgttttttgtcggttgaagagcgtacgtgtatattgtttatcgcgggagaggtcgtttttgttagtgagttgagcggggcgagtttagaggggtcgtagtagttgtagcgttttttggagtcgtggaggtgattttaacgttttggaaaacgcgtttagtttaaatttggttagggaggttgggaagtagaaggggt

SEQ ID NO: 17678 - DNA, 624 bp, Artificial Sequence
  chemically treated genomic DNA (Homo sapiens) CpG-island No: 17678
accccttctacttcccaacctccctaaccaaatttaaactaaacgcgttttccaaaacgttaaaatcacctccacgactccaaaaaacgctacaactactacgacccctctaaactcgccccgctcaactcactaacaaaaacgacctctcccgcgataaacaatatacacgtacgctcttcaaccgacaaaaaacgcgcgtacgcaaacgaaaccgaaaacgcgcgcgaaaaccgaaaacgcgcgcgaaaaccgacaccgaaaacgtacgattaccatataatatcctaaccgcgcgaacgcgcgaacgactaaaacgacgccgaaacgaacgcgaaactaacaaacgaataacgaaaacgacgccgacgaaaactactaaaacgcgcaaaaaatcgacgacgcccgaaaacctatcgctaacgcgatccgaacgaaaaactcgacgacgaacgacaacatatcgataacgaaactaaaaaaacaattctacaaaacgaaccaaataaacgcaaacccaaacgaaaaccgaataccgaaccccgaactacccgaataaaaaaaccaaacccgacctaacccgaaaaaaaaccgaaaaaaccgaaataaaaacgttaacgcgta

SEQ ID NO: 17679 - DNA, 624 bp, Artificial Sequence
  chemically treated genomic DNA (Homo sapiens) CpG-island No: 17679
gttttttttattttttaatttttttggttaggtttaaattaagcgcgttttttaagacgttagggttatttttacgattttagggggcgttgtaattgttacggtttttttaggttcgtttcgtttaatttattgatagaggcggtttttttcgcggtagataatgtgtacgtgcgttttttagtcggtagagggcgcgcgtgcgtagacggggtcgggggcgcgcgcgggggtcgggggcgcgcgcgggggtcggtatcggaagcgtgcggttgttatgtaatattttggtcgcgcgggcgcgcgagcggttgaggcggcgtcggggcgggcgcggagttggtaagcgggtggcggaggcggcgtcgacggggattgttgaggcgcgtagagggtcggcggcgttcgggagtttgtcgttggcgcggttcgggcgggaggttcggcggcgggcggtagtatgtcggtggcggggttgaagaagtagttttataaggcgagttaggtgagcgtaggtttaggcgggagtcgagtatcgggtttcgggttgttcggatgagggagttaggttcgatttggttcgggagggggtcggggggatcgaggtggggacgttggcgcgtg

SEQ ID NO: 17680 - DNA, 624 bp, Artificial Sequence
  chemically treated genomic DNA (Homo sapiens) CpG-island No: 17680
cacgcgccaacgtccccacctcgatccccccgaccccctcccgaaccaaatcgaacctaactccctcatccgaacaacccgaaacccgatactcgactcccgcctaaacctacgctcacctaactcgccttataaaactacttcttcaaccccgccaccgacatactaccgcccgccgccgaacctcccgcccgaaccgcgccaacgacaaactcccgaacgccgccgaccctctacgcgcctcaacaatccccgtcgacgccgcctccgccacccgcttaccaactccgcgcccgccccgacgccgcctcaaccgctcgcgcgcccgcgcgaccaaaatattacataacaaccgcacgcttccgataccgacccccgcgcgcgcccccgacccccgcgcgcgcccccgaccccgtctacgcacgcgcgccctctaccgactaaaaaacgcacgtacacattatctaccgcgaaaaaaaccgcctctatcaataaattaaacgaaacgaacctaaaaaaaccgtaacaattacaacgccccctaaaatcgtaaaaataaccctaacgtcttaaaaaacgcgcttaatttaaacctaaccaaaaaaattaaaaaataaaaaaaac

SEQ ID NO: 17681 - DNA, 645 bp, Artificial Sequence
  chemically treated genomic DNA (Homo sapiens) CpG-island No: 17681
ttatcgagtgggcggttattcgggtgttttagagtagatcgagagtaggtgcgtagatttttgtggacggttattttcggtgcgtttttaataggttttcgttcggggttatcggtcgtagtgtttttttcggttttagggaagcgcggattcgtttttgttgttcgttcggcgttgttttagtatatttttgatcgtcggaggagtttttagaagtggtagtgggcgtaatggtggcggcgtgtggcggggtcgtgtttagaagcgttcgtagtttcggagcggtgggggagggtcgttgtatttcgcgttcgagtttgggcgttcgtattgtcgcgtggtcggcgaattgcgttcgagggggtggttaagataaaagcgtggggaggggttaagttttcgttgttttagttaggcgtttttttgtttcgttgatcgtttttttacggcgggaacgagaggcgtttatcggggatgtcgttaatgagttcgcggggcgacgtcgagagtggtttgtgaggggttttcgtcggagtttttggcgcgcgttttttttagtgttttttattttatttttggtcgagtgtttcgagagggtagagggcgagaaattttttgttttaaatattttttaaatgggtcgga

SEQ ID NO: 17682 - DNA, 645 bp, Artificial Sequence
  chemically treated genomic DNA (Homo sapiens) CpG-island No: 17682
tccgacccatttaaaaaatatttaaaacaaaaaatttctcgccctctaccctctcgaaacactcgaccaaaaataaaataaaaaacactaaaaaaaacgcgcgccaaaaactccgacgaaaacccctcacaaaccactctcgacgtcgccccgcgaactcattaacgacatccccgataaacgcctctcgttcccgccgtaaaaaaacgatcaacgaaacaaaaaaacgcctaactaaaacaacgaaaacttaacccctccccacgcttttatcttaaccaccccctcgaacgcaattcgccgaccacgcgacaatacgaacgcccaaactcgaacgcgaaatacaacgaccctcccccaccgctccgaaactacgaacgcttctaaacacgaccccgccacacgccgccaccattacgcccactaccacttctaaaaactcctccgacgatcaaaaatatactaaaacaacgccgaacgaacaacaaaaacgaatccgcgcttccctaaaaccgaaaaaaacactacgaccgataaccccgaacgaaaacctattaaaaacgcaccgaaaataaccgtccacaaaaatctacgcacctactctcgatctactctaaaacacccgaataaccgcccactcgataa

SEQ ID NO: 17683 - DNA, 645 bp, Artificial Sequence
  chemically treated genomic DNA (Homo sapiens) CpG-island No: 17683
ttcgatttatttaggggatgtttgaggtaaaggatttttcgttttttattttttcgaggtattcggttagaaatgaggtggaaagtattggaagaggcgcgcgttaggggtttcggcggggattttttataagttattttcggcgtcgtttcgcggatttattagcgatattttcggtgggcgtttttcgttttcgtcgtaaaggaacgattagcgaggtaaggaaacgtttggttggggtagcggggatttggtttttttttacgtttttgttttaattattttttcgggcgtaattcgtcggttacgcggtaatgcggacgtttagattcgggcgcggggtgtagcggtttttttttatcgtttcgggattgcgagcgtttttgggtacggtttcgttatacgtcgttattattgcgtttattgttatttttaggggttttttcgacggttagggatgtgttgaggtaacgtcgggcgggtagtaggggcgagttcgcgtttttttggagtcgaaaggagtattgcggtcggtgatttcgggcggaaatttgttgggagcgtatcggaagtagtcgtttatagaggtttgcgtatttgttttcggtttgttttgagatattcggatgatcgtttattcggtgg

SEQ ID NO: 17684 - DNA, 645 bp, Artificial Sequence
  chemically treated genomic DNA (Homo sapiens) CpG-island No: 17684
ccaccgaataaacgatcatccgaatatctcaaaacaaaccgaaaacaaatacgcaaacctctataaacgactacttccgatacgctcccaacaaatttccgcccgaaatcaccgaccgcaatactcctttcgactccaaaaaaacgcgaactcgcccctactacccgcccgacgttacctcaacacatccctaaccgtcgaaaaaacccctaaaaataacaataaacgcaataataacgacgtataacgaaaccgtacccaaaaacgctcgcaatcccgaaacgataaaaaaaaaccgctacaccccgcgcccgaatctaaacgtccgcattaccgcgtaaccgacgaattacgcccgaaaaaataattaaaacaaaaacgtaaaaaaaaaccaaatccccgctaccccaaccaaacgtttccttacctcgctaatcgttcctttacgacgaaaacgaaaaacgcccaccgaaaatatcgctaataaatccgcgaaacgacgccgaaaataacttataaaaaatccccgccgaaacccctaacgcgcgcctcttccaatactttccacctcatttctaaccgaatacctcgaaaaaataaaaaacgaaaaatcctttacctcaaacatcccctaaataaatcgaa

SEQ ID NO: 17685 - DNA, 1158 bp, Artificial Sequence
  chemically treated genomic DNA (Homo sapiens) CpG-island No: 17685
acggggtcgtcgggataggggttgtcgtagtgtgtagtgagtgtttcgtgaacggggtcgcggggataggggttgtcgtagtgtgtagtgggtgtttcgtgaacggggtcgtcgggataggggatgtcgtagtgtgtagtgggtgtttcgtgaacggggtcgtcgggataggggttgtcgtagtgtgtagtgggtgtttcgtgaacggggtcgtcgggataggggttgtcgtagtgtgtagtgagtgtttcgtgaacggggtcgcggggataggggttgtcgtagtgtgtagtgagtgtttcgtgaatcgggtcgtcgggataggggatgtcgtaatgtgtagtgggtgtttcgtgaacggggtcgtcgggataggggttgtcgtagtgtgtagtgagtgttttttgaacggggtcgtcgggataggggttgtcgtagtgtgtagtgagtgtttcgtgaacggggtcgcggggataggggttgtcgtagtgtgtagtgagtgattcgtgaatcgggtcgtcgggataggggatgtcgtagtgtgtagtgggtgtttcgtgaatcgggtcgtcgggataggggttgtcgtagtgtgtagtgagtgtttagtgaacggggtcgtcgggataggggttgtcgtagtgtgtagtgggtgtttcgtgaacggggtcgtcgggataggggttgtcgtagtgtgtagtgagtgtttcgtgaacggggtcgtcgggataggggttgtcgtagtgtgtagtgagtgtttcgtgaacggggtcgcggggataggggttgtcgtagtgtgtagtgggtgtttcgtgaatcgggtcgtcgggataggggttgtcgtagtgtgtagtgggtgtttcgtgaacggggtcgtcgggataggggttgtcgtagtgtgtagtgagtgtttcgtgaatcgggtcgtcgggataggggttgtcgtagtgtgtagtgagtgtttcgtgaatcgggtcgtcgggataggggttgtcgtagtgtgtagtgagtgtttcgtgaatcgggtcgtcgggacgggggatgttgcggttttgttgttcgtgtagtcgtgtcggtgtagatgtgcgggttagaggtagttttgttatataggcgagtttttattggtttttagaaggagattggggtgtgattgat

SEQ ID NO: 17686 - DNA, 1158 bp, Artificial Sequence
  chemically treated genomic DNA (Homo sapiens) CpG-island No: 17686
atcaatcacaccccaatctccttctaaaaaccaataaaaactcgcctatataacaaaactacctctaacccgcacatctacaccgacacgactacacgaacaacaaaaccgcaacatcccccgtcccgacgacccgattcacgaaacactcactacacactacgacaacccctatcccgacgacccgattcacgaaacactcactacacactacgacaacccctatcccgacgacccgattcacgaaacactcactacacactacgacaacccctatcccgacgaccccgttcacgaaacacccactacacactacgacaacccctatcccgacgacccgattcacgaaacacccactacacactacgacaacccctatccccgcgaccccgttcacgaaacactcactacacactacgacaacccctatcccgacgaccccgttcacgaaacactcactacacactacgacaacccctatcccgacgaccccgttcacgaaacacccactacacactacgacaacccctatcccgacgaccccgttcactaaacactcactacacactacgacaacccctatcccgacgacccgattcacgaaacacccactacacactacgacatcccctatcccgacgacccgattcacgaatcactcactacacactacgacaacccctatccccgcgaccccgttcacgaaacactcactacacactacgacaacccctatcccgacgaccccgttcaaaaaacactcactacacactacgacaacccctatcccgacgaccccgttcacgaaacacccactacacattacgacatcccctatcccgacgacccgattcacgaaacactcactacacactacgacaacccctatccccgcgaccccgttcacgaaacactcactacacactacgacaacccctatcccgacgaccccgttcacgaaacacccactacacactacgacaacccctatcccgacgaccccgttcacgaaacacccactacacactacgacatcccctatcccgacgaccccgttcacgaaacacccactacacactacgacaacccctatccccgcgaccccgttcacgaaacactcactacacactacgacaacccctatcccgacgaccccgt

SEQ ID NO: 17687 - DNA, 1158 bp, Artificial Sequence
  chemically treated genomic DNA (Homo sapiens) CpG-island No: 17687
attaattatattttaatttttttttgaagattagtgaagattcgtttgtgtggtaaggttgtttttaattcgtatatttgtatcgatacggttgtacgaatagtaaaatcgtagtatttttcgtttcggcggttcggtttacggagtatttattgtatattgcggtagtttttgtttcggcggttcggtttacggagtatttattgtatattgcggtagtttttgtttcggcggttcggtttacggagtatttattgtatattgcggtagtttttgtttcggcggtttcgtttacggagtatttattgtatattgcggtagtttttgtttcggcggttcggtttacggagtatttattgtatattgcggtagtttttgttttcgcggtttcgtttacggagtatttattgtatattgcggtagtttttgtttcggcggtttcgtttacggagtatttattgtatattgcggtagtttttgtttcggcggtttcgtttacggagtatttattgtatattgcggtagtttttgtttcggcggtttcgtttattgagtatttattgtatattgcggtagtttttgtttcggcggttcggtttacggagtatttattgtatattgcggtattttttgtttcggcggttcggtttacggattatttattgtatattgcggtagtttttgttttcgcggtttcgtttacggagtatttattgtatattgcggtagtttttgtttcggcggtttcgtttaaggagtatttattgtatattgcggtagtttttgtttcggcggtttcgtttacggagtatttattgtatattgcggtattttttgtttcggcggttcggtttacggagtatttattgtatattgcggtagtttttgttttcgcggtttcgtttacggagtatttattgtatattgcggtagtttttgtttcggcggtttcgtttacggagtatttattgtatattgcggtagtttttgtttcggcggtttcgtttacggagtatttattgtatattgcggtattttttgtttcggcggtttcgtttacggagtatttattgtatattgcggtagtttttgttttcgcggtttcgtttacggagtatttattgtatattgcggtagtttttgtttcggcggtttcgt

SEQ ID NO: 17688 - DNA, 1158 bp, Artificial Sequence
  chemically treated genomic DNA (Homo sapiens) CpG-island No: 17688
acgaaaccgccgaaacaaaaactaccgcaatatacaataaatactccgtaaacgaaaccgcgaaaacaaaaactaccgcaatatacaataaatactccgtaaacgaaaccgccgaaacaaaaaataccgcaatatacaataaatactccgtaaacgaaaccgccgaaacaaaaactaccgcaatatacaataaatactccgtaaacgaaaccgccgaaacaaaaactaccgcaatatacaataaatactccgtaaacgaaaccgcgaaaacaaaaactaccgcaatatacaataaatactccgtaaaccgaaccgccgaaacaaaaaataccgcaatatacaataaatactccgtaaacgaaaccgccgaaacaaaaactaccgcaatatacaataaatactccttaaacgaaaccgccgaaacaaaaactaccgcaatatacaataaatactccgtaaacgaaaccgcgaaaacaaaaactaccgcaatatacaataaataatccgtaaaccgaaccgccgaaacaaaaaataccgcaatatacaataaatactccgtaaaccgaaccgccgaaacaaaaactaccgcaatatacaataaatactcaataaacgaaaccgccgaaacaaaaactaccgcaatatacaataaatactccgtaaacgaaaccgccgaaacaaaaactaccgcaatatacaataaatactccgtaaacgaaaccgccgaaacaaaaactaccgcaatatacaataaatactccgtaaacgaaaccgcgaaaacaaaaactaccgcaatatacaataaatactccgtaaaccgaaccgccgaaacaaaaactaccgcaatatacaataaatactccgtaaacgaaaccgccgaaacaaaaactaccgcaatatacaataaatactccgtaaaccgaaccgccgaaacaaaaactaccgcaatatacaataaatactccgtaaaccgaaccgccgaaacaaaaactaccgcaatatacaataaatactccgtaaaccgaaccgccgaaacgaaaaatactacgattttactattcgtacaaccgtatcgatacaaatatacgaattaaaaacaaccttaccacacaaacgaatcttcactaatcttcaaaaaaaaattaaaatataattaat

SEQ ID NO: 17689 - DNA, 952 bp, Artificial Sequence
  chemically treated genomic DNA (Homo sapiens) CpG-island No: 17689
gttgcggcggtcgttttcggggaagggggtgggttcggggaagggtttgttatttttttttagttaaaagtaagggggaaaagagtaaacgcgcgattttagcgcgcggttatttacgtttggtgtttgttttttttagttatcggagattagagtcgttttttttgttcgagaaaggggtttagcggcggcggaagcggagggggattatcgtggagagcgcggttttagttcggttattgcggatttttgaaattaagtaagagcgtttttcgcgttatttttttttcgaagcggttcgcgagaaagcgggagcgtttttatggggtttttaggtttcgttttgcgcggggttgtttttcgatagtgtttgggggtttttaaagattttttgcggggagcgatgcgaggacgtgtaggttaacgggtttttttgtcgtttcgggcggtttcgtttaattttatttcgtacgggtcgggcgcggcgcggttgttggcgcgttcggggagcgaggcgttgggtttttggatcgtttcgagcgttcgtaattaggcgggatagagttcgttaagtttcggtgtgtgttgggcgttttggagagtgtagcgtggttttagggatagcgttttcggaattttggttttgaggagtggggtacgcgggggacgggtcgggagatagtgattgttttcggggttgtggttttggggatgtagagcgtgttgggttgggacggagtgggggcggggaattcgggggttgcgttcgggagttgtagcgtttattgtttgaattcggtttaatttttagtttgttcgaaaggttgttgggagcgcgggagcgtcgtgagttttgcgggagtagaggcgttttcggtacgttaggtatgtatttttaagtcgttttgttttttcggggattagggattttttttcgtttttattatttaga

SEQ ID NO: 17690 - DNA, 952 bp, Artificial Sequence
  chemically treated genomic DNA (Homo sapiens) CpG-island No: 17690
tctaaataataaaaacgaaaaaaaatccctaatccccgaaaaaacaaaacgacttaaaaatacatacctaacgtaccgaaaacgcctctactcccgcaaaactcacgacgctcccgcgctcccaacaacctttcgaacaaactaaaaattaaaccgaattcaaacaataaacgctacaactcccgaacgcaacccccgaattccccgcccccactccgtcccaacccaacacgctctacatccccaaaaccacaaccccgaaaacaatcactatctcccgacccgtcccccgcgtaccccactcctcaaaaccaaaattccgaaaacgctatccctaaaaccacgctacactctccaaaacgcccaacacacaccgaaacttaacgaactctatcccgcctaattacgaacgctcgaaacgatccaaaaacccaacgcctcgctccccgaacgcgccaacaaccgcgccgcgcccgacccgtacgaaataaaattaaacgaaaccgcccgaaacgacaaaaaaacccgttaacctacacgtcctcgcatcgctccccgcaaaaaatctttaaaaacccccaaacactatcgaaaaacaaccccgcgcaaaacgaaacctaaaaaccccataaaaacgctcccgctttctcgcgaaccgcttcgaaaaaaaaataacgcgaaaaacgctcttacttaatttcaaaaatccgcaataaccgaactaaaaccgcgctctccacgataatccccctccgcttccgccgccgctaaacccctttctcgaacaaaaaaaacgactctaatctccgataactaaaaaaaacaaacaccaaacgtaaataaccgcgcgctaaaatcgcgcgtttactcttttcccccttacttttaactaaaaaaaaataacaaacccttccccgaacccacccccttccccgaaaacgaccgccgcaac

SEQ ID NO: 17691 - DNA, 952 bp, Artificial Sequence
  chemically treated genomic DNA (Homo sapiens) CpG-island No: 17691
tttaggtgatgaaggcgggagagggtttttggttttcggagaggtagggcgatttgggagtgtatatttggcgtgtcgagagcgtttttgttttcgtaggatttacggcgttttcgcgtttttaatagtttttcgagtaggttgggggttgaatcgggtttaagtagtggacgttatagttttcgggcgtagttttcgggtttttcgtttttatttcgttttagtttagtacgttttatatttttaaaattatagtttcgagggtagttattgtttttcgattcgtttttcgcgtgttttattttttaaagttagaatttcggagacgttgtttttggagttacgttgtattttttaagacgtttagtatatatcgagatttgacgggttttgtttcgtttgattacgggcgttcgggacgatttagggatttagcgtttcgtttttcgggcgcgttagtagtcgcgtcgcgttcggttcgtacgaggtggggttgggcggggtcgttcggggcggtaggaggattcgttagtttgtacgttttcgtatcgtttttcgtaagaagtttttgggaatttttaggtattgtcgagaggtagtttcgcgtaggacgaagtttggagattttatagggacgttttcgttttttcgcgaatcgtttcggggagggggtggcgcgggaagcgtttttatttggttttagggattcgtagtggtcgggttgggatcgcgttttttacggtggttttttttcgttttcgtcgtcgttgagtttttttttcgagtagagggggcggttttggttttcgatggttggagaaagtaagtattaagcgtaggtagtcgcgcgttggagtcgcgcgtttattttttttttttttatttttaattagaggaggatggtaaattttttttcggatttattttttttttcgaaggcggtcgtcgtagt

SEQ ID NO: 17692 - DNA, 952 bp, Artificial Sequence
  chemically treated genomic DNA (Homo sapiens) CpG-island No: 17692
actacgacgaccgccttcgaaaaaaaaaataaatccgaaaaaaaatttaccatcctcctctaattaaaaataaaaaaaaaaaaaataaacgcgcgactccaacgcgcgactacctacgcttaatacttactttctccaaccatcgaaaaccaaaaccgccccctctactcgaaaaaaaaactcaacgacgacgaaaacgaaaaaaaaccaccgtaaaaaacgcgatcccaacccgaccactacgaatccctaaaaccaaataaaaacgcttcccgcgccaccccctccccgaaacgattcgcgaaaaaacgaaaacgtccctataaaatctccaaacttcgtcctacgcgaaactacctctcgacaatacctaaaaattcccaaaaacttcttacgaaaaacgatacgaaaacgtacaaactaacgaatcctcctaccgccccgaacgaccccgcccaaccccacctcgtacgaaccgaacgcgacgcgactactaacgcgcccgaaaaacgaaacgctaaatccctaaatcgtcccgaacgcccgtaatcaaacgaaacaaaacccgtcaaatctcgatatatactaaacgtcttaaaaaatacaacgtaactccaaaaacaacgtctccgaaattctaactttaaaaaataaaacacgcgaaaaacgaatcgaaaaacaataactaccctcgaaactataattttaaaaatataaaacgtactaaactaaaacgaaataaaaacgaaaaacccgaaaactacgcccgaaaactataacgtccactacttaaacccgattcaacccccaacctactcgaaaaactattaaaaacgcgaaaacgccgtaaatcctacgaaaacaaaaacgctctcgacacgccaaatatacactcccaaatcgccctacctctccgaaaaccaaaaaccctctcccgccttcatcacctaaa

SEQ ID NO: 17693 - DNA, 838 bp, Artificial Sequence
  chemically treated genomic DNA (Homo sapiens) CpG-island No: 17693
tcgaagaggtcgtttttattagatttcgggatttttttagggtagtttttcgttttttatttcgtaggaaggttttttttttaattatttcgcggcgtagtaagtttggtttcgtcgtatcgttcgcgttggattttgtttttttatcggtcgtttggttatcggcgtaggacgtattcgttgttcgtttggtcgttttttttggattttgtgttttaagaaagcgttattttttgtcgacggcggtacgttcggttttagtatagcgtaggcgtttaatatatagtatttagttacgaggttcggagttagagggttttgtttgtttatttatagagtttttattcgcggattaaagtcgtatttcgcgatcgtagttcggagattttcgggagcggcgcggtgcgtttcgttttcgttaggttttcggttgtcggtttcgcgtcgggtttcgtattcgggggcggtgttcgagcgtcggcgtatgcgtagatcgggggcgcgaggttttacggagttcgtagtttttcggacgggtcgttttcggtttcgcggtttcgtttttttatattataatttttacggggtagcgggcgcggttttttttatttattagttggtcgggtagggtagttatttcgcggtcgggttcgtcggttgcgggtattcgcgcgacgggcgggaagatggcggacgtggtcgtgggtaaagataagggcggggagtagcggtttatttcgttgtttttatttcgtattcgggttattatgaagagttttttcgaggtgtttagtattaattaggaggcgttggtgtttacggttaaggttacggtgag

SEQ ID NO: 17694 - DNA, 838 bp, Artificial Sequence
  chemically treated genomic DNA (Homo sapiens) CpG-island No: 17694
ctcaccgtaaccttaaccgtaaacaccaacgcctcctaattaatactaaacacctcgaaaaaactcttcataataacccgaatacgaaataaaaacaacgaaataaaccgctactccccgcccttatctttacccacgaccacgtccgccatcttcccgcccgtcgcgcgaatacccgcaaccgacgaacccgaccgcgaaataactaccctacccgaccaactaataaataaaaaaaaccgcgcccgctaccccgtaaaaattataatataaaaaaacgaaaccgcgaaaccgaaaacgacccgtccgaaaaactacgaactccgtaaaacctcgcgcccccgatctacgcatacgccgacgctcgaacaccgcccccgaatacgaaacccgacgcgaaaccgacaaccgaaaacctaacgaaaacgaaacgcaccgcgccgctcccgaaaatctccgaactacgatcgcgaaatacgactttaatccgcgaataaaaactctataaataaacaaacaaaaccctctaactccgaacctcgtaactaaatactatatattaaacgcctacgctatactaaaaccgaacgtaccgccgtcgacaaaaaataacgctttcttaaaacacaaaatccaaaaaaaacgaccaaacgaacaacgaatacgtcctacgccgataaccaaacgaccgataaaaaaacaaaatccaacgcgaacgatacgacgaaaccaaacttactacgccgcgaaataattaaaaaaaaaaccttcctacgaaataaaaaacgaaaaactaccctaaaaaaatcccgaaatctaataaaaacgacctcttcga

SEQ ID NO: 17695 - DNA, 838 bp, Artificial Sequence
  chemically treated genomic DNA (Homo sapiens) CpG-island No: 17695
tttatcgtggttttggtcgtgagtattaacgttttttggttgatgttggatatttcgggggagttttttatgatgattcggatgcgggatagaggtagcgagatgagtcgttgtttttcgtttttgtttttatttacgattacgttcgttattttttcgttcgtcgcgcgggtgttcgtagtcggcgggttcgatcgcgaagtggttgttttgttcggttagttggtgggtagggggagtcgcgttcgttgtttcgtgggagttgtagtgtggggaggcgaggtcgcgaggtcgggagcggttcgttcgggaaattacgagtttcgtgaggtttcgcgttttcgatttgcgtatgcgtcgacgttcggatatcgttttcgagtgcgaggttcggcgcggaatcggtagtcgagagtttggcgggggcggggcgtatcgcgtcgttttcgggagttttcgggttgcggtcgcggaatacgattttgattcgcgggtgagggttttgtgaatgggtaagtaaagttttttgatttcgggtttcgtggttgggtgttgtgtgttaagcgtttgcgttgtattaggatcgggcgtgtcgtcgtcggtaaaaagtgacgtttttttgaagtataaagtttaggggggacgattaagcggatagcggatgcgttttgcgtcggtagttaggcgatcggtggaagagtagagtttagcgcgggcgatgcggcggggttaggtttgttgcgtcgcggggtgattgggagaagagtttttttgcggggtggaggacgaagagttgttttgaggaggtttcggagtttggtgggaacggttttttcgg

SEQ ID NO: 17696 - DNA, 838 bp, Artificial Sequence
  chemically treated genomic DNA (Homo sapiens) CpG-island No: 17696
ccgaaaaaaccgttcccaccaaactccgaaacctcctcaaaacaactcttcgtcctccaccccgcaaaaaaactcttctcccaatcaccccgcgacgcaacaaacctaaccccgccgcatcgcccgcgctaaactctactcttccaccgatcgcctaactaccgacgcaaaacgcatccgctatccgcttaatcgtcccccctaaactttatacttcaaaaaaacgtcactttttaccgacgacgacacgcccgatcctaatacaacgcaaacgcttaacacacaacacccaaccacgaaacccgaaatcaaaaaactttacttacccattcacaaaaccctcacccgcgaatcaaaatcgtattccgcgaccgcaacccgaaaactcccgaaaacgacgcgatacgccccgcccccgccaaactctcgactaccgattccgcgccgaacctcgcactcgaaaacgatatccgaacgtcgacgcatacgcaaatcgaaaacgcgaaacctcacgaaactcgtaatttcccgaacgaaccgctcccgacctcgcgacctcgcctccccacactacaactcccacgaaacaacgaacgcgactccccctacccaccaactaaccgaacaaaacaaccacttcgcgatcgaacccgccgactacgaacacccgcgcgacgaacgaaaaaataacgaacgtaatcgtaaataaaaacaaaaacgaaaaacaacgactcatctcgctacctctatcccgcatccgaatcatcataaaaaactcccccgaaatatccaacatcaaccaaaaaacgttaatactcacgaccaaaaccacgataaa

SEQ ID NO: 17697 - DNA, 503 bp, Artificial Sequence
  chemically treated genomic DNA (Homo sapiens) CpG-island No: 17697
ttcgcgcgtcgtcggttgtttttgtcgggttcgcgcgcgtttcgttgttttcgttttacgtcggcgcgcgtttcggtgttcgcgcgtttttatattttttcgcgcgttttcgtttcgtttatttttcgtcgtttttttacgttatttagttttttcgtttcgtttatcgcgcgtttttttcgttttttgtcgttttttttcgtttcgttcgtttttttttttcgtgcgtattttcgtttcgtttattttattgttttttcgtcgtttttttcgcgtttttattcggtaaattcgtaagttttcgcgtttttttgcgcgtttttcgttttttttatttgtgcgtttacgttttttttcgcgtgcggcgtttagttttcggttttattcgtgggcgtcggcgtttagtggcgttttttttatttgggttttttgggggtttttttattcgcgattttttattttcggtttgttttttttttgttattggattgtttcgtgttttg

SEQ ID NO: 17698 - DNA, 503 bp, Artificial Sequence
  chemically treated genomic DNA (Homo sapiens) CpG-island No: 17698
caaaacacgaaacaatccaataacaaaaaaaaaacaaaccgaaaataaaaaatcgcgaataaaaaaacccccaaaaaacccaaataaaaaaaacgccactaaacgccgacgcccacgaataaaaccgaaaactaaacgccgcacgcgaaaaaaaacgtaaacgcacaaataaaaaaaacgaaaaacgcgcaaaaaaacgcgaaaacttacgaatttaccgaataaaaacgcgaaaaaaacgacgaaaaaacaataaaataaacgaaacgaaaatacgcacgaaaaaaaaaaacgaacgaaacgaaaaaaaacgacaaaaaacgaaaaaaacgcgcgataaacgaaacgaaaaaactaaataacgtaaaaaaacgacgaaaaataaacgaaacgaaaacgcgcgaaaaaatataaaaacgcgcgaacaccgaaacgcgcgccgacgtaaaacgaaaacaacgaaacgcgcgcgaacccgacaaaaacaaccgacgacgcgcgaa

SEQ ID NO: 17699 - DNA, 503 bp, Artificial Sequence
  chemically treated genomic DNA (Homo sapiens) CpG-island No: 17699
taaagtacgaagtagtttagtgataagaaaaaggtaggtcgggagtagggagtcgcgggtgaaagagtttttaaagaatttaaatgagaagagcgttattaggcgtcgacgtttacgggtagggtcggaaattgagcgtcgtacgcgagggaagacgtgagcgtataggtgggagggacgaaaggcgcgtagaggaacgcgggagtttacgggtttgtcgaatggaagcgcgagagaaacggcgggaggatagtggggtgggcggggcgaaggtgcgtacggaaggaaggggcgggcggagcgaaggaaggcgataaagggcgggagaggcgcgcggtaggcgaggcgaagaaattggataacgtgagggagcggcgaggggtgggcggggcgaagacgcgcgagaaagtgtgggggcgcgcgggtatcgaagcgcgcgtcggcgtgggacggggatagcggggcgcgcgcgagttcggtaagagtagtcggcggcgcgcggg

SEQ ID NO: 17700 - DNA, 503 bp, Artificial Sequence
  chemically treated genomic DNA (Homo sapiens) CpG-island No: 17700
cccgcgcgccgccgactactcttaccgaactcgcgcgcgccccgctatccccgtcccacgccgacgcgcgcttcgatacccgcgcgcccccacactttctcgcgcgtcttcgccccgcccacccctcgccgctccctcacgttatccaatttcttcgcctcgcctaccgcgcgcctctcccgccctttatcgccttccttcgctccgcccgccccttccttccgtacgcaccttcgccccgcccaccccactatcctcccgccgtttctctcgcgcttccattcgacaaacccgtaaactcccgcgttcctctacgcgcctttcgtccctcccacctatacgctcacgtcttccctcgcgtacgacgctcaatttccgaccctacccgtaaacgtcgacgcctaataacgctcttctcatttaaattctttaaaaactctttcacccgcgactccctactcccgacctacctttttcttatcactaaactacttcgtacttta

SEQ ID NO: 17701 - DNA, 642 bp, Artificial Sequence
  chemically treated genomic DNA (Homo sapiens) CpG-island No: 17701
ttttttttcgtttttatttttttgtttttttcgcgttttttgtaaaattcgggacggatcgggggtttaggtttggttttcgcgtacgcgtaggagtagcgtcggttcggtcgttagtcggaagcgttagtttagagtttgggaagtggtcgtagaggttgttcggtttcgttgttcgttaggtcgtgggttttcgtttcgggttcggggttatcggttgtgtaagtgtaaagcgggggggttttcggttaggtaattcggatcggttgcggggagggttgcgcggttggtcgtggagtcggcgcgtttcgcggaggggttcgttcggtttttatttgttcgggcggagttcgttatatttgttcgggttcgttgtcgggtcggggtttagcgtgtatttgttcgaggcgtttttgtttttgttggcgttttgtttatatttgtttaaggtcgtgttttatattcgttgaagattcggcggatatttgttcgggattcggtttatatttgttgttcgggtcggttttgttttttcgagttcgcggcgggggttttttttttttttgtgttttcgagttgttttcgtttggttttttttttcgggtcgttcgcggcgttggagtttttcgtttttgggtttgg

SEQ ID NO: 17702 - DNA, 642 bp, Artificial Sequence
  chemically treated genomic DNA (Homo sapiens) CpG-island No: 17702
ccaaacccaaaaacgaaaaactccaacgccgcgaacgacccgaaaaaaaaaaccaaacgaaaacaactcgaaaacacaaaaaaaaaaaaaacccccgccgcgaactcgaaaaaacaaaaccgacccgaacaacaaatataaaccgaatcccgaacaaatatccgccgaatcttcaacgaatataaaacacgaccttaaacaaatataaacaaaacgccaacaaaaacaaaaacgcctcgaacaaatacacgctaaaccccgacccgacaacgaacccgaacaaatataacgaactccgcccgaacaaataaaaaccgaacgaacccctccgcgaaacgcgccgactccacgaccaaccgcgcaaccctccccgcaaccgatccgaattacctaaccgaaaacccccccgctttacacttacacaaccgataaccccgaacccgaaacgaaaacccacgacctaacgaacaacgaaaccgaacaacctctacgaccacttcccaaactctaaactaacgcttccgactaacgaccgaaccgacgctactcctacgcgtacgcgaaaaccaaacctaaacccccgatccgtcccgaattttacaaaaaacgcgaaaaaaacaaaaaaataaaaacgaaaaaaaa

SEQ ID NO: 17703 - DNA, 642 bp, Artificial Sequence
  chemically treated genomic DNA (Homo sapiens) CpG-island No: 17703
ttaggtttaggggcggggggttttagcgtcgcggacggttcgggaggggaagttaggcggagatagttcggaggtatagaggggaaggggattttcgtcgcgagttcgggagagtagagtcggttcgggtagtaggtgtgggtcgggtttcggataggtgttcgtcgagtttttagcgggtgtgggatacggttttggatagatgtaagtagagcgttaataggagtaagggcgtttcgagtaggtgtacgttgaatttcggttcggtagcggattcggataggtgtggcgggtttcgttcggataggtgagggtcgggcgagttttttcgcgggacgcgtcgattttacggttagtcgcgtagtttttttcgtagtcggttcgaattgtttgatcgggagttttttcgttttgtatttatatagtcggtggtttcgggttcggagcgggagtttacgatttggcgggtagcggggtcgagtagtttttgcggttattttttaggttttgggttggcgttttcgattggcggtcgagtcggcgttgtttttgcgcgtgcgcggaggttaggtttgggttttcgattcgtttcgggttttgtaagagacgcgagggaagtaagggggtaggagcgagggagaa

SEQ ID NO: 17704 - DNA, 642 bp, Artificial Sequence
  chemically treated genomic DNA (Homo sapiens) CpG-island No: 17704
ttctccctcgctcctacccccttacttccctcgcgtctcttacaaaacccgaaacgaatcgaaaacccaaacctaacctccgcgcacgcgcaaaaacaacgccgactcgaccgccaatcgaaaacgccaacccaaaacctaaaaaataaccgcaaaaactactcgaccccgctacccgccaaatcgtaaactcccgctccgaacccgaaaccaccgactatataaatacaaaacgaaaaaactcccgatcaaacaattcgaaccgactacgaaaaaaactacgcgactaaccgtaaaatcgacgcgtcccgcgaaaaaactcgcccgaccctcacctatccgaacgaaacccgccacacctatccgaatccgctaccgaaccgaaattcaacgtacacctactcgaaacgcccttactcctattaacgctctacttacatctatccaaaaccgtatcccacacccgctaaaaactcgacgaacacctatccgaaacccgacccacacctactacccgaaccgactctactctcccgaactcgcgacgaaaatccccttcccctctatacctccgaactatctccgcctaacttcccctcccgaaccgtccgcgacgctaaaaccccccgcccctaaacctaa

SEQ ID NO: 17705 - DNA, 591 bp, Artificial Sequence
  chemically treated genomic DNA (Homo sapiens) CpG-island No: 17705
gatcgtcgggtgggagcggtaggcgtaagtcgggcggcggggcgcgcgggttaggcggggtcgggcggcggtagggattgcggaggtgcggcgtgagttggggcgggcggcgttatcggaggcggaggggcggagtcgcgtttatagttgttattcggtcgtcgggtttaggtagaagttattcgttcgcggtcgggtacgtatcgcgcgtagattttttgcgaataatgtttcggtcgggcggttggcggttcggagatcgacggaggggtcgggggagcgtagtttagaggtgagttcgcgacgcgttttttaaattcggtttttttttgtttggcgagcgtggtcgtagaggggagttttggaggggcgttgcgatcgtcgagcgggttattttcggggtgataggcgatcgttcgggaagtgggtagtgtcggggtcgcgtgagtttcgggtggtgttcgaggtgtagggaggcgttcggtcgggaggatcgaggagttggagggtgtttttgatttattcgagaatcgcgttttttaaaacggggaaatttttttacgagttttaggagggaggatcgattgttag

SEQ ID NO: 17706 - DNA, 591 bp, Artificial Sequence
  chemically treated genomic DNA (Homo sapiens) CpG-island No: 17706
ctaacaatcgatcctccctcctaaaactcgtaaaaaaatttccccgttttaaaaaacgcgattctcgaataaatcaaaaacaccctccaactcctcgatcctcccgaccgaacgcctccctacacctcgaacaccacccgaaactcacgcgaccccgacactacccacttcccgaacgatcgcctatcaccccgaaaataacccgctcgacgatcgcaacgcccctccaaaactcccctctacgaccacgctcgccaaacaaaaaaaaaccgaatttaaaaaacgcgtcgcgaactcacctctaaactacgctcccccgacccctccgtcgatctccgaaccgccaaccgcccgaccgaaacattattcgcaaaaaatctacgcgcgatacgtacccgaccgcgaacgaataacttctacctaaacccgacgaccgaataacaactataaacgcgactccgcccctccgcctccgataacgccgcccgccccaactcacgccgcacctccgcaatccctaccgccgcccgaccccgcctaacccgcgcgccccgccgcccgacttacgcctaccgctcccacccgacgatc

SEQ ID NO: 17707 - DNA, 591 bp, Artificial Sequence
  chemically treated genomic DNA (Homo sapiens) CpG-island No: 17707
ttaatagtcggtttttttttttggaattcgtaggaaagttttttcgttttaaagagcgcgattttcgaatgaattaaaaatattttttagtttttcggttttttcggtcgggcgtttttttgtatttcgggtattattcggggtttacgcggtttcggtattgtttatttttcgagcggtcgtttgttatttcgggggtagttcgttcggcgatcgtagcgtttttttaaagtttttttttgcgattacgttcgttagataaaaagaggtcgaatttggagagcgcgtcgcgggtttatttttgggttgcgttttttcggttttttcgtcggttttcgagtcgttagtcgttcggtcggagtattgttcgtagaaggtttgcgcgcggtgcgtgttcggtcgcgggcgggtggtttttgtttgggttcggcggtcgggtggtagttgtgagcgcggtttcgttttttcgttttcggtgacgtcgttcgttttagtttacgtcgtattttcgtagtttttgtcgtcgttcggtttcgtttggttcgcgcgtttcgtcgttcggtttgcgtttgtcgtttttattcggcggtt

SEQ ID NO: 17708 - DNA, 591 bp, Artificial Sequence
  chemically treated genomic DNA (Homo sapiens) CpG-island No: 17708
aaccgccgaataaaaacgacaaacgcaaaccgaacgacgaaacgcgcgaaccaaacgaaaccgaacgacgacaaaaactacgaaaatacgacgtaaactaaaacgaacgacgtcaccgaaaacgaaaaaacgaaaccgcgctcacaactaccacccgaccgccgaacccaaacaaaaaccacccgcccgcgaccgaacacgcaccgcgcgcaaaccttctacgaacaatactccgaccgaacgactaacgactcgaaaaccgacgaaaaaaccgaaaaaacgcaacccaaaaataaacccgcgacgcgctctccaaattcgacctctttttatctaacgaacgtaatcgcaaaaaaaaactttaaaaaaacgctacgatcgccgaacgaactacccccgaaataacaaacgaccgctcgaaaaataaacaataccgaaaccgcgtaaaccccgaataatacccgaaatacaaaaaaacgcccgaccgaaaaaaccgaaaaactaaaaaatatttttaattcattcgaaaatcgcgctctttaaaacgaaaaaactttcctacgaattccaaaaaaaaaaaccgactattaa

SEQ ID NO: 17709 - DNA, 633 bp, Artificial Sequence
  chemically treated genomic DNA (Homo sapiens) CpG-island No: 17709
tttcgagaaagcgtgtgcgtacgcgtttttagtttgttcgtttttggcgtttttagggtaagaaaaatcgaagattcgagtcggcgtttgcgtatttagttttcgttattgttgtggtttcgtgtttcgtttttcggtttttttattttttaggttaggttgagcggcggaggtggtcgtgtcgttggaagcggatagattcgagttagaggtgggggcgggggtttatcgttcgcggtcgggtcggcgttttttttttatttttttcgcgattttcgtttggtttttacggttaacggtagcgtagtcgaatacggtttacgggtagggcgtcgaagaggagtaggcgcgcgttcggggacgagtagggcgtagtgagggaggggcgcgtttattgtttcggtcggtcgatcgatatcgatttcgtttattgcggcgcggggatttttggtgagtaattagtttcgtttgcggaggaagggaggggatagggtggggtgaaggttcggaaacgtcgacggggcgtatttgcgcgcgtattcgcgatttttgatttcgtggttttagttttgattttttacgatttgattatattttttttaaattttaatttttgttggttttggttttagg

SEQ ID NO: 17710 - DNA, 633 bp, Artificial Sequence
  chemically treated genomic DNA (Homo sapiens) CpG-island No: 17710
cctaaaaccaaaaccaacaaaaattaaaatttaaaaaaaatataatcaaatcgtaaaaaatcaaaactaaaaccacgaaatcaaaaatcgcgaatacgcgcgcaaatacgccccgtcgacgtttccgaaccttcaccccaccctatcccctcccttcctccgcaaacgaaactaattactcaccaaaaatccccgcgccgcaataaacgaaatcgatatcgatcgaccgaccgaaacaataaacgcgcccctccctcactacgccctactcgtccccgaacgcgcgcctactcctcttcgacgccctacccgtaaaccgtattcgactacgctaccgttaaccgtaaaaaccaaacgaaaatcgcgaaaaaaataaaaaaaaaacgccgacccgaccgcgaacgataaacccccgcccccacctctaactcgaatctatccgcttccaacgacacgaccacctccgccgctcaacctaacctaaaaaataaaaaaaccgaaaaacgaaacacgaaaccacaacaataacgaaaactaaatacgcaaacgccgactcgaatcttcgatttttcttaccctaaaaacgccaaaaacgaacaaactaaaaacgcgtacgcacacgctttctcgaaa

SEQ ID NO: 17711 - DNA, 633 bp, Artificial Sequence
  chemically treated genomic DNA (Homo sapiens) CpG-island No: 17711
tttgaggttaaggttagtaggggttgaggtttaaaaaagatgtagttaggtcgtaaggggttagggttgaggttacggggttagaggtcgcgggtgcgcgcgtaggtacgtttcgtcggcgttttcgggtttttattttattttgtttttttttttttttcgtaggcggggttggttatttattaagggttttcgcgtcgtagtaggcggggtcggtgtcggtcggtcggtcggggtagtggacgcgttttttttttattgcgttttgttcgttttcgggcgcgcgtttgttttttttcggcgttttgttcgtgggtcgtgttcggttgcgttatcgttagtcgtgggggttagacgggggtcgcggggagggtaggaggggagcgtcggttcggtcgcgggcgatggattttcgtttttatttttaattcgggtttgttcgtttttagcggtacggttattttcgtcgtttagtttagtttagagggtggggggatcggggggcggggtacgagattatagtagtggcggagattaagtgcgtaagcgtcggttcgggttttcgattttttttgttttgggagcgttaggagcgaataagttgggagcgcgtgcgtatacgttttttcgagg

SEQ ID NO: 17712 - DNA, 633 bp, Artificial Sequence
  chemically treated genomic DNA (Homo sapiens) CpG-island No: 17712
cctcgaaaaaacgtatacgcacgcgctcccaacttattcgctcctaacgctcccaaaacaaaaaaaatcgaaaacccgaaccgacgcttacgcacttaatctccgccactactataatctcgtaccccgccccccgatccccccaccctctaaactaaactaaacgacgaaaataaccgtaccgctaaaaacgaacaaacccgaattaaaaataaaaacgaaaatccatcgcccgcgaccgaaccgacgctcccctcctaccctccccgcgacccccgtctaacccccacgactaacgataacgcaaccgaacacgacccacgaacaaaacgccgaaaaaaaacaaacgcgcgcccgaaaacgaacaaaacgcaataaaaaaaaaacgcgtccactaccccgaccgaccgaccgacaccgaccccgcctactacgacgcgaaaacccttaataaataaccaaccccgcctacgaaaaaaaaaaaaaaacaaaataaaataaaaacccgaaaacgccgacgaaacgtacctacgcgcgcacccgcgacctctaaccccgtaacctcaaccctaaccccttacgacctaactacatcttttttaaacctcaacccctactaaccttaacctcaaa

SEQ ID NO: 17713 - DNA, 553 bp, Artificial Sequence
  chemically treated genomic DNA (Homo sapiens) CpG-island No: 17713
attcggcgagagcgaggtcgatgtcgaagtagagaaggtagttggtttggtagtagaggaggttgttgatgacgcggtggtattatcgttgcgggtcgtatggattcggagtcgttagacgcgtcgattttagaataaagtcgtttagggcgcgtagcggtggtagtcgtattttcgatattttgtcggttaatgtggttggattagttaggagggggtcggattataataatcgttacgtttttcgttatcgcggggtatatcgggaaatggagtttgggttgggtagtttttttttaattttttaggtggattgcgtaggggcggcgatgtacgtgatcggaaaagtaattaatacgtcgtttaggaaagtagtaaaggttgtcgggaaattaagtttttgttacgaagcgagatgtttttaatttttaaaattgttatttattttcgcgcggggcgtcgtaggggttgtttcgggcggtgttagcggtttaagtataaagtagttagatagataagaaaggagggattgttataaggattcgagttggat

SEQ ID NO: 17714 - DNA, 553 bp, Artificial Sequence
  chemically treated genomic DNA (Homo sapiens) CpG-island No: 17714
atccaactcgaatccttataacaatccctcctttcttatctatctaactactttatacttaaaccgctaacaccgcccgaaacaacccctacgacgccccgcgcgaaaataaataacaattttaaaaattaaaaacatctcgcttcgtaacaaaaacttaatttcccgacaacctttactactttcctaaacgacgtattaattacttttccgatcacgtacatcgccgcccctacgcaatccacctaaaaaattaaaaaaaaactacccaacccaaactccatttcccgatataccccgcgataacgaaaaacgtaacgattattataatccgaccccctcctaactaatccaaccacattaaccgacaaaatatcgaaaatacgactaccaccgctacgcgccctaaacgactttattctaaaatcgacgcgtctaacgactccgaatccatacgacccgcaacgataataccaccgcgtcatcaacaacctcctctactaccaaaccaactaccttctctacttcgacatcgacctcgctctcgccgaat

SEQ ID NO: 17715 - DNA, 553 bp, Artificial Sequence
  chemically treated genomic DNA (Homo sapiens) CpG-island No: 17715
atttaattcggatttttgtgatagtttttttttttttatttgtttggttattttgtgtttgagtcgttggtatcgttcggagtagtttttgcggcgtttcgcgcgggggtggatggtagttttaagggttgggagtatttcgtttcgtggtaaaggtttgatttttcggtagtttttgttgtttttttgagcggcgtgttagttgttttttcggttacgtgtatcgtcgtttttgcgtaatttatttaggaggttaggaaaaagttgtttagtttagattttatttttcggtgtgtttcgcggtggcgaggggcgtaacggttgttgtagttcggtttttttttggttggtttagttatattaatcggtaggatgtcggaggtgcggttgttatcgttacgcgttttggacgattttgttttggggtcggcgcgtttggcggtttcggatttatgcgattcgtagcgatggtgttatcgcgttattaataattttttttattattaaattaattattttttttgtttcggtatcggtttcgttttcgtcgggt

SEQ ID NO: 17716 - DNA, 553 bp, Artificial Sequence
  chemically treated genomic DNA (Homo sapiens) CpG-island No: 17716
acccgacgaaaacgaaaccgataccgaaacaaaaaaaataattaatttaataataaaaaaaattattaataacgcgataacaccatcgctacgaatcgcataaatccgaaaccgccaaacgcgccgaccccaaaacaaaatcgtccaaaacgcgtaacgataacaaccgcacctccgacatcctaccgattaatataactaaaccaaccaaaaaaaaaccgaactacaacaaccgttacgcccctcgccaccgcgaaacacaccgaaaaataaaatctaaactaaacaactttttcctaacctcctaaataaattacgcaaaaacgacgatacacgtaaccgaaaaaacaactaacacgccgctcaaaaaaacaacaaaaactaccgaaaaatcaaacctttaccacgaaacgaaatactcccaacccttaaaactaccatccacccccgcgcgaaacgccgcaaaaactactccgaacgataccaacgactcaaacacaaaataaccaaacaaataaaaaaaaaaaaactatcacaaaaatccgaattaaat

SEQ ID NO: 17717 - DNA, 674 bp, Artificial Sequence
  chemically treated genomic DNA (Homo sapiens) CpG-island No: 17717
ttgtgttcgttttatttttgtagattaaatttaaagttatatttttcggagtgagaaacgggatagtaaatgaacgtaggaattacggtgcgtaggtatagaatttcgttgggtttgttacgaaggttgaggtggaagcgtttagcgtattaggcgttacggttcggtgtgtgattttattaatttttattagcgcgtattttgttttgtttttttacgggcgaataattttatacgaggtagtggtgtgggagttagtattcggaatcgtaaaagtacgattttttcggagtttaggtattgaatggtatttattgcgtatgttttagagcggcgacgaatgggagttcggagcgtaggggcggaggcgcgttcgggtagttatcgagaagcgttaattaattatcgattaattagattattatcgttaatcgttatcgattaattagagtttatcgcgtttcggttttaagttagttgtttgtttcgcggcgggagggttgggttaagattaagttttcgggggagagggtaacgcggtgggcgggagagaggtcgagggtcgttcgggtttgggagtgttaataggacgggatgggtacgagtatgtcgggtttcgcgcgggggaggggttttttttttattttatataaaaaggtgtgttcgggttggtt

SEQ ID NO: 17718 - DNA, 674 bp, Artificial Sequence
  chemically treated genomic DNA (Homo sapiens) CpG-island No: 17718
aaccaacccgaacacacctttttatataaaataaaaaaaaaacccctcccccgcgcgaaacccgacatactcgtacccatcccgtcctattaacactcccaaacccgaacgaccctcgacctctctcccgcccaccgcgttaccctctcccccgaaaacttaatcttaacccaaccctcccgccgcgaaacaaacaactaacttaaaaccgaaacgcgataaactctaattaatcgataacgattaacgataataatctaattaatcgataattaattaacgcttctcgataactacccgaacgcgcctccgcccctacgctccgaactcccattcgtcgccgctctaaaacatacgcaataaataccattcaatacctaaactccgaaaaaatcgtacttttacgattccgaatactaactcccacaccactacctcgtataaaattattcgcccgtaaaaaaacaaaacaaaatacgcgctaataaaaattaataaaatcacacaccgaaccgtaacgcctaatacgctaaacgcttccacctcaaccttcgtaacaaacccaacgaaattctatacctacgcaccgtaattcctacgttcatttactatcccgtttctcactccgaaaaatataactttaaatttaatctacaaaaataaaacgaacacaa

SEQ ID NO: 17719 - DNA, 674 bp, Artificial Sequence
  chemically treated genomic DNA (Homo sapiens) CpG-island No: 17719
agttaattcgggtatatttttttgtgtggggtaaggaaagagtttttttttcgcgcggggttcggtatgttcgtgtttatttcgttttgttggtatttttagattcgagcggttttcggtttttttttcgtttatcgcgttgttttttttttcgaaggtttagttttgatttaattttttcgtcgcggaataagtaattggtttaaggtcggggcgcggtgggttttgattggtcgatgacgattgacggtgatgatttgattggtcgatggttgattggcgtttttcggtagttgttcgggcgcgttttcgtttttgcgtttcgggtttttattcgtcgtcgttttggggtatgcgtagtgggtgttatttagtgtttgggtttcgggaaagtcgtgtttttacggtttcgggtattggtttttatattattgtttcgtgtggggttgttcgttcgtgaaggggtaggatagggtgcgcgttggtggaggttagtgaggttatatatcgggtcgtggcgtttggtgcgttgggcgtttttattttaattttcgtagtaaatttagcggggttttgtgtttgcgtatcgtggtttttgcgtttatttattgtttcgttttttatttcggaaagtgtggttttgagtttgatttgtaggagtaggacgggtatag

SEQ ID NO: 17720 - DNA, 674 bp, Artificial Sequence
  chemically treated genomic DNA (Homo sapiens) CpG-island No: 17720
ctatacccgtcctactcctacaaatcaaactcaaaaccacactttccgaaataaaaaacgaaacaataaataaacgcaaaaaccacgatacgcaaacacaaaaccccgctaaatttactacgaaaattaaaataaaaacgcccaacgcaccaaacgccacgacccgatatataacctcactaacctccaccaacgcgcaccctatcctaccccttcacgaacgaacaaccccacacgaaacaataatataaaaaccaatacccgaaaccgtaaaaacacgactttcccgaaacccaaacactaaataacacccactacgcataccccaaaacgacgacgaataaaaacccgaaacgcaaaaacgaaaacgcgcccgaacaactaccgaaaaacgccaatcaaccatcgaccaatcaaatcatcaccgtcaatcgtcatcgaccaatcaaaacccaccgcgccccgaccttaaaccaattacttattccgcgacgaaaaaattaaatcaaaactaaaccttcgaaaaaaaaaacaacgcgataaacgaaaaaaaaaccgaaaaccgctcgaatctaaaaataccaacaaaacgaaataaacacgaacataccgaaccccgcgcgaaaaaaaaactctttccttaccccacacaaaaaaatatacccgaattaact

SEQ ID NO: 17721 - DNA, 645 bp, Artificial Sequence
  chemically treated genomic DNA (Homo sapiens) CpG-island No: 17721
ttttcgtgttttttttttattttgcggggttggttggagcggtcgtttcggtgttgtttagtagttatagggagtcgtacggggagcgggaaagcggtcgcggttttaggcggggcggtcgggatggagcggggtcgcgagtttgtggggaaggggttgtggcggcgtttcgagcggttgtaggtatacggggtcggcggttgtgcgtagaggcgtttttgcgtttttcgttttttcgtttttcgtttttttttttttttttgtttttttgttcgttttttcggttatagagcgacgaatgacgagattaggtgtattttattgtcgtttttagtttcggggatttcgggttttcgtttttgaaggtcgtaggttttagtgcgtcggtttcgggttgcgggttcgggagcgcgggcgtagttaaggtgtagttgcgcggcgtgcggcgtcgggggaatacgtggttgttttaggaagtcgttttagggaacggttgggattcgtgggtgattttgggtttttaaattttcggtttttcgggtttcgggcgggtttcgtttttattgcggaaagggataaagttgttttcgattcggttattagcgtgttataggtattaattagatacgggtttttgtaaattta

SEQ ID NO: 17722 - DNA, 645 bp, Artificial Sequence
  chemically treated genomic DNA (Homo sapiens) CpG-island No: 17722
taaatttacaaaaacccgtatctaattaatacctataacacgctaataaccgaatcgaaaacaactttatccctttccgcaataaaaacgaaacccgcccgaaacccgaaaaaccgaaaatttaaaaacccaaaatcacccacgaatcccaaccgttccctaaaacgacttcctaaaacaaccacgtattcccccgacgccgcacgccgcgcaactacaccttaactacgcccgcgctcccgaacccgcaacccgaaaccgacgcactaaaacctacgaccttcaaaaacgaaaacccgaaatccccgaaactaaaaacgacaataaaatacacctaatctcgtcattcgtcgctctataaccgaaaaaacgaacaaaaaaacaaaaaaaaaaaaaaaaacgaaaaacgaaaaaacgaaaaacgcaaaaacgcctctacgcacaaccgccgaccccgtatacctacaaccgctcgaaacgccgccacaaccccttccccacaaactcgcgaccccgctccatcccgaccgccccgcctaaaaccgcgaccgctttcccgctccccgtacgactccctataactactaaacaacaccgaaacgaccgctccaaccaaccccgcaaaataaaaaaaaaacacgaaaa

SEQ ID NO: 17723 - DNA, 645 bp, Artificial Sequence
  chemically treated genomic DNA (Homo sapiens) CpG-island No: 17723
taagtttatagaaattcgtatttaattaatgtttgtaatacgttagtaatcgaatcggggatagttttgttttttttcgtagtgagaacggggttcgttcggagttcggggaatcgaaggtttaggagtttaaggttatttacgaattttagtcgttttttggggcgattttttggagtagttacgtgttttttcggcgtcgtacgtcgcgtagttgtattttggttgcgttcgcgttttcggattcgtagttcggagtcggcgtattagggtttgcggtttttaagggcgaggattcgaagttttcggggttgagagcgatagtggggtatatttggtttcgttattcgtcgttttgtgatcgaggaggcgggtaagaaggtagagagaagggaagggacgagaggcgaagggacgagaggcgtagggacgtttttgcgtatagtcgtcgatttcgtgtatttgtagtcgttcgaggcgtcgttatagttttttttttataggttcgcggtttcgttttatttcggtcgtttcgtttggggtcgcgatcgttttttcgtttttcgtgcggttttttatggttgttggatagtatcggagcggtcgttttagttagtttcgtaggatgaagggaggatacgaggg

SEQ ID NO: 17724 - DNA, 645 bp, Artificial Sequence
  chemically treated genomic DNA (Homo sapiens) CpG-island No: 17724
ccctcgtatcctcccttcatcctacgaaactaactaaaacgaccgctccgatactatccaacaaccataaaaaaccgcacgaaaaacgaaaaaacgatcgcgaccccaaacgaaacgaccgaaataaaacgaaaccgcgaacctataaaaaaaaaactataacgacgcctcgaacgactacaaatacacgaaatcgacgactatacgcaaaaacgtccctacgcctctcgtcccttcgcctctcgtcccttcccttctctctaccttcttacccgcctcctcgatcacaaaacgacgaataacgaaaccaaatataccccactatcgctctcaaccccgaaaacttcgaatcctcgcccttaaaaaccgcaaaccctaatacgccgactccgaactacgaatccgaaaacgcgaacgcaaccaaaatacaactacgcgacgtacgacgccgaaaaaacacgtaactactccaaaaaatcgccccaaaaaacgactaaaattcgtaaataaccttaaactcctaaaccttcgattccccgaactccgaacgaaccccgttctcactacgaaaaaaaacaaaactatccccgattcgattactaacgtattacaaacattaattaaatacgaatttctataaactta

SEQ ID NO: 17725 - DNA, 536 bp, Artificial Sequence
  chemically treated genomic DNA (Homo sapiens) CpG-island No: 17725
cgcgcggcgttttttgcgtttgcgtttcggtacgaggtggggcggcgggcgttagtatagtagagtgtgcgtcggggtggggggtaacggttagtcgttattttgagacgggcggcggcgggatggtaatagttttcggggtttcggatttgtttggtttcggagcgttttcgttcggtgtgggagtttaggcggcggcggtcgttgaggaggaggagcgagaggtggtgcgggttcgagttaaggtgaggttggcggtgagtcggtttagtcgtcgaggtattttaggggagggggaggcggtggttgttataggatggagggcgggatttgagatttcggatataatttgagcggcgaagtttgagggttaagtgatgatggcgaggggtagggagggtttgagagtttgagagcgttagcgacgtattttggggcgtgggattgaaaatagagggacgaggcgggggtttatgggatgaatgggtggagtttatagataaaggggaggggttatggggttggaggaggggtcg

SEQ ID NO: 17726 - DNA, 536 bp, Artificial Sequence
  chemically treated genomic DNA (Homo sapiens) CpG-island No: 17726
cgacccctcctccaaccccataacccctcccctttatctataaactccacccattcatcccataaacccccgcctcgtccctctattttcaatcccacgccccaaaatacgtcgctaacgctctcaaactctcaaaccctccctacccctcgccatcatcacttaaccctcaaacttcgccgctcaaattatatccgaaatctcaaatcccgccctccatcctataacaaccaccgcctccccctcccctaaaatacctcgacgactaaaccgactcaccgccaacctcaccttaactcgaacccgcaccacctctcgctcctcctcctcaacgaccgccgccgcctaaactcccacaccgaacgaaaacgctccgaaaccaaacaaatccgaaaccccgaaaactattaccatcccgccgccgcccgtctcaaaataacgactaaccgttaccccccaccccgacgcacactctactatactaacgcccgccgccccacctcgtaccgaaacgcaaacgcaaaaaacgccgcgcg

SEQ ID NO: 17727 - DNA, 536 bp, Artificial Sequence
  chemically treated genomic DNA (Homo sapiens) CpG-island No: 17727
cggttttttttttagttttatagttttttttttttgtttataagttttatttatttattttatagattttcgtttcgtttttttatttttagttttacgttttaaggtacgtcgttaacgtttttaggtttttaggttttttttatttttcgttattattatttggtttttaagtttcgtcgtttaggttatgttcgaaattttaggtttcgttttttattttatgatagttatcgttttttttttttttgggatgtttcggcggttgggtcgatttatcgttagttttattttgattcggattcgtattatttttcgttttttttttttagcggtcgtcgtcgtttgagtttttatatcgggcgggggcgtttcggagttagataagttcgaggtttcggaggttgttgttatttcgtcgtcgttcgttttagggtgacggttgatcgttgttttttatttcggcgtatattttattgtattgacgttcgtcgttttatttcgtgtcggggcgtaggcgtagagggcgtcgcgcg

SEQ ID NO: 17728 - DNA, 536 bp, Artificial Sequence
  chemically treated genomic DNA (Homo sapiens) CpG-island No: 17728
cgcgcgacgccctctacgcctacgccccgacacgaaataaaacgacgaacgtcaatacaataaaatatacgccgaaataaaaaacaacgatcaaccgtcaccctaaaacgaacgacgacgaaataacaacaacctccgaaacctcgaacttatctaactccgaaacgcccccgcccgatataaaaactcaaacgacgacgaccgctaaaaaaaaaaaacgaaaaataatacgaatccgaatcaaaataaaactaacgataaatcgacccaaccgccgaaacatcccaaaaaaaaaaaaaacgataactatcataaaataaaaaacgaaacctaaaatttcgaacataacctaaacgacgaaacttaaaaaccaaataataataacgaaaaataaaaaaaacctaaaaacctaaaaacgttaacgacgtaccttaaaacgtaaaactaaaaataaaaaaacgaaacgaaaatctataaaataaataaataaaacttataaacaaaaaaaaaaaactataaaactaaaaaaaaaaccg

SEQ ID NO: 17729 - DNA, 692 bp, Artificial Sequence
  chemically treated genomic DNA (Homo sapiens) CpG-island No: 17729
ttcggaaatattttatttcgcggagaatattgtttttttcgttttgttgtttttttttttttttattatttcgtttttgttggttttagttaattagtacgtacgtcgggacgcgtaaggggaacgtttcgggacgttttcgttacgtattttttattaatcgtttttcggcgtagtttcgtttttgttttttgtgttttttcgagttcgttgttcgttcgggttttttacgttttaatttttaggtaagttgtatatgttttgcgaaacggcggtttttcgttatatacgcgtcgcgtcggtcgtgatcggggaatagcgagtggggagagtaatggttattgatacgtaggtttggttttttttgggacgggcgggtttcgtgtttggaggtgaaatatttcggttggtgggaggtcggcgcgttgtatttgagtgtgaggtttatcgggagggattggtggcgtcggtggtggtagtgattacgcgatagtcgatatttattttttttattttacgtggtcgtcgttattttgttttgtcggcgttaagggaacgtagggatgttttgggtttgcgtagtggtataaaatgacgggcgtggcggttatgaatgtgagagtatgcgtaatgtggttttttaatggtggttgcgttgagttagttttttagattattattttattggtcgt

SEQ ID NO: 17730 - DNA, 692 bp, Artificial Sequence
  chemically treated genomic DNA (Homo sapiens) CpG-island No: 17730
acgaccaataaaataataatctaaaaaactaactcaacgcaaccaccattaaaaaaccacattacgcatactctcacattcataaccgccacgcccgtcattttataccactacgcaaacccaaaacatccctacgttcccttaacgccgacaaaacaaaataacgacgaccacgtaaaataaaaaaaataaatatcgactatcgcgtaatcactaccaccaccgacgccaccaatccctcccgataaacctcacactcaaatacaacgcgccgacctcccaccaaccgaaatatttcacctccaaacacgaaacccgcccgtcccaaaaaaaaccaaacctacgtatcaataaccattactctccccactcgctattccccgatcacgaccgacgcgacgcgtatataacgaaaaaccgccgtttcgcaaaacatatacaacttacctaaaaattaaaacgtaaaaaacccgaacgaacaacgaactcgaaaaaacacaaaaaacaaaaacgaaactacgccgaaaaacgattaataaaaaatacgtaacgaaaacgtcccgaaacgttccccttacgcgtcccgacgtacgtactaattaactaaaaccaacaaaaacgaaataataaaaaaaaaaaaaaacaacaaaacgaaaaaaacaatattctccgcgaaataaaatatttccgaa

SEQ ID NO: 17731 - DNA, 692 bp, Artificial Sequence
  chemically treated genomic DNA (Homo sapiens) CpG-island No: 17731
gcggttaataaggtggtaatttgaggagttggtttagcgtagttattattagggggttatattgcgtatgtttttatatttatagtcgttacgttcgttattttgtgttattgcgtaagtttagaatatttttgcgtttttttaacgtcggtagaataagatggcggcggttacgtgggataaggaaagtaagtgtcggttgtcgcgtggttattgttattatcgacgttattagtttttttcggtaggttttatatttagatatagcgcgtcggttttttattaatcgaaatgttttatttttaagtacgggattcgttcgttttagagaaagttaagtttacgtgttagtggttattattttttttattcgttatttttcggttacggtcggcgcggcgcgtgtgtggcgaggagtcgtcgtttcgtaggatatatgtaatttatttggaaattaaaacgtaaaaaattcggacgaatagcgagttcggaggagtataaaaaatagggacggggttgcgtcggaagacgattgataaagagtacgtagcgagaacgtttcggaacgttttttttgcgcgtttcggcgtgcgtgttgattggttgaggttagtaggggcggagtggtggggagaggaagggatagtaaagcgaagggagtagtgtttttcgcgaaatggggtgttttcgga

SEQ ID NO: 17732 - DNA, 692 bp, Artificial Sequence
  chemically treated genomic DNA (Homo sapiens) CpG-island No: 17732
tccgaaaacaccccatttcgcgaaaaacactactcccttcgctttactatcccttcctctccccaccactccgcccctactaacctcaaccaatcaacacgcacgccgaaacgcgcaaaaaaaacgttccgaaacgttctcgctacgtactctttatcaatcgtcttccgacgcaaccccgtccctattttttatactcctccgaactcgctattcgtccgaattttttacgttttaatttccaaataaattacatatatcctacgaaacgacgactcctcgccacacacgcgccgcgccgaccgtaaccgaaaaataacgaataaaaaaaataataaccactaacacgtaaacttaactttctctaaaacgaacgaatcccgtacttaaaaataaaacatttcgattaataaaaaaccgacgcgctatatctaaatataaaacctaccgaaaaaaactaataacgtcgataataacaataaccacgcgacaaccgacacttactttccttatcccacgtaaccgccgccatcttattctaccgacgttaaaaaaacgcaaaaatattctaaacttacgcaataacacaaaataacgaacgtaacgactataaatataaaaacatacgcaatataaccccctaataataactacgctaaaccaactcctcaaattaccaccttattaaccgc

SEQ ID NO: 17733 - DNA, 723 bp, Artificial Sequence
  chemically treated genomic DNA (Homo sapiens) CpG-island No: 17733
atcgtcgttgtcgttttcgttgtcgtcgtcgtttagacgtattttgggaaagcgcggcgagtattcgttttcgggatcgagtcgggcggtagggaggggttcggttacggtttttcggttggttcgcgcgggtgttgcgagtcgggagtcgcggttaataggttgcgcgttttcggttacgttcgcgcgagcgtttttttcgcgaggtcggttaggttcgaatgtcgttagtcgtggggaaagatggcggaaaatttaaaaggtgaagtagtggaggtagaggcgcgggttcgttggtcgggtcgggtgggttggaggggtggcgttgtcggttcggggtttcggcgttcgaggtttcggcgtcgggagtcggaagttcggcgcggaaaggatgaggttcggggagcgcgggtttggtgcgcggggttgggcggggtttaggggagggggcgcgcgtttcggaacgtagcgggtttggggttaagtggggacgtaggaggggggcgcgcgttgtagatcgcggtcggatcggcgcgcgtacgcgcgggggtttgtcgaggaggtcgcgttcgcgcgcgggaaaatcggtttttggtgatcgttatttattcggtgtttacgcgagacgtcggaaggggagggaagataagggggatagattttttttttagagtgcggggattgagaatttttttgggggaaagtatcgtttttcggcgtgat

SEQ ID NO: 17734 - DNA, 723 bp, Artificial Sequence
  chemically treated genomic DNA (Homo sapiens) CpG-island No: 17734
atcacgccgaaaaacgatactttcccccaaaaaaattctcaatccccgcactctaaaaaaaaaatctatcccccttatcttccctccccttccgacgtctcgcgtaaacaccgaataaataacgatcaccaaaaaccgattttcccgcgcgcgaacgcgacctcctcgacaaacccccgcgcgtacgcgcgccgatccgaccgcgatctacaacgcgcgcccccctcctacgtccccacttaaccccaaacccgctacgttccgaaacgcgcgccccctcccctaaaccccgcccaaccccgcgcaccaaacccgcgctccccgaacctcatcctttccgcgccgaacttccgactcccgacgccgaaacctcgaacgccgaaaccccgaaccgacaacgccacccctccaacccacccgacccgaccaacgaacccgcgcctctacctccactacttcaccttttaaattttccgccatctttccccacgactaacgacattcgaacctaaccgacctcgcgaaaaaaacgctcgcgcgaacgtaaccgaaaacgcgcaacctattaaccgcgactcccgactcgcaacacccgcgcgaaccaaccgaaaaaccgtaaccgaacccctccctaccgcccgactcgatcccgaaaacgaatactcgccgcgctttcccaaaatacgtctaaacgacgacgacaacgaaaacgacaacgacgat

SEQ ID NO: 17735 - DNA, 723 bp, Artificial Sequence
  chemically treated genomic DNA (Homo sapiens) CpG-island No: 17735
attacgtcgagaggcgatatttttttttagaagagtttttagttttcgtattttgaagggggggtttgttttttttatttttttttttttttcggcgtttcgcgtggatatcgaatgggtaacggttattaggggtcgattttttcgcgcgcgggcgcggttttttcgataagttttcgcgcgtgcgcgcgtcggttcggtcgcgatttgtagcgcgcgttttttttttgcgtttttatttagttttaggttcgttgcgtttcgaggcgcgcgtttttttttttgagtttcgtttagtttcgcgtattaggttcgcgtttttcgagttttatttttttcgcgtcgagttttcggttttcggcgtcggggtttcggacgtcggggtttcgagtcggtaacgttatttttttagtttattcggttcggttagcgggttcgcgtttttgtttttattgttttattttttaaatttttcgttatttttttttacggttaacgatattcgggtttagtcggtttcgcgagaagagcgttcgcgcgggcgtggtcgggaacgcgtagtttattggtcgcggttttcgattcgtagtattcgcgcggattaatcggagagtcgtgatcgaatttttttttgtcgttcggttcggtttcggaggcgggtgttcgtcgcgtttttttagagtgcgtttgggcggcggcggtagcgggagcgatagcggcggt

SEQ ID NO: 17736 - DNA, 723 bp, Artificial Sequence
  chemically treated genomic DNA (Homo sapiens) CpG-island No: 17736
accgccgctatcgctcccgctaccgccgccgcccaaacgcactctaaaaaaacgcgacgaacacccgcctccgaaaccgaaccgaacgacaaaaaaaaattcgatcacgactctccgattaatccgcgcgaatactacgaatcgaaaaccgcgaccaataaactacgcgttcccgaccacgcccgcgcgaacgctcttctcgcgaaaccgactaaacccgaatatcgttaaccgtaaaaaaaaataacgaaaaatttaaaaaataaaacaataaaaacaaaaacgcgaacccgctaaccgaaccgaataaactaaaaaaataacgttaccgactcgaaaccccgacgtccgaaaccccgacgccgaaaaccgaaaactcgacgcgaaaaaaataaaactcgaaaaacgcgaacctaatacgcgaaactaaacgaaactcaaaaaaaaaaacgcgcgcctcgaaacgcaacgaacctaaaactaaataaaaacgcaaaaaaaaaacgcgcgctacaaatcgcgaccgaaccgacgcgcgcacgcgcgaaaacttatcgaaaaaaccgcgcccgcgcgcgaaaaaatcgacccctaataaccgttacccattcgatatccacgcgaaacgccgaaaaaaaaaaaaaaataaaaaaaacaaacccccccttcaaaatacgaaaactaaaaactcttctaaaaaaaaatatcgcctctcgacgtaat

SEQ ID NO: 17737 - DNA, 961 bp, Artificial Sequence
  chemically treated genomic DNA (Homo sapiens) CpG-island No: 17737
cgttttcggtttagttataattagttcgttcgcgttacgttattacggcgcgtcgcgcgggaagtcgcggggaaaaggtaagatgtttttttttaattttttcgtttttttgtttgttttttagatatcgtcgattcgaagggtttttaagtgattggatagggacggaggggcggcggttatggtattcgggacgatagcgacgatagtcgaggtaagaaaaagtttgtatcgtagttttgtcgggaatcgtcggcgtttgttttttacgtaggcgtagtatagttggcgtagtacgtcgacgtatcgtttcgtcgtttgtgagttcgcggtgtggtttagtttagttggcgtagtacgtcgacgtatcgtttcgtcgtttgtgagttcgcgagaggtgtggttcgcgcgaggggcgcggttttgaggtacggttttttttggaggcgggatttgggcgggtagtcgagagacgaggtttaatggaaaagaaaagtttgagcgttcgcgtttttataggtcgttagaaatttggtggagcgagttaagggcggagtttgagaaaggggttgcgtttaatgagtggagcggtgagtatagcgcgtcgacggcggaggcgggaagggggcggaggtcgatcgaaggcggttagggattggttgaagagggttagcgaaacgttagcggtcgggtttgggtagggggtggagttggttgaaggaacggggtagttttttgaggagcggggttggttgaaacgttaggggcgggatttggcggagtggaaggtatcggttcggttcgataaggggtggagttaagtgaatcgttaagggtggagtcgaaatcggggtcggggtcggggtcggttgagtgaaagggtgggtgattatttcgggagataggtcgaaagggtaggttcgtgaaggaatggggtttgggttgggtttagagggtttgg

SEQ ID NO: 17738 - DNA, 961 bp, Artificial Sequence
  chemically treated genomic DNA (Homo sapiens) CpG-island No: 17738
ccaaaccctctaaacccaacccaaaccccattccttcacgaacctaccctttcgacctatctcccgaaataatcacccaccctttcactcaaccgaccccgaccccgaccccgatttcgactccacccttaacgattcacttaactccaccccttatcgaaccgaaccgataccttccactccgccaaatcccgcccctaacgtttcaaccaaccccgctcctcaaaaaactaccccgttccttcaaccaactccaccccctacccaaacccgaccgctaacgtttcgctaaccctcttcaaccaatccctaaccgccttcgatcgacctccgcccccttcccgcctccgccgtcgacgcgctatactcaccgctccactcattaaacgcaacccctttctcaaactccgcccttaactcgctccaccaaatttctaacgacctataaaaacgcgaacgctcaaacttttcttttccattaaacctcgtctctcgactacccgcccaaatcccgcctccaaaaaaaaccgtacctcaaaaccgcgcccctcgcgcgaaccacacctctcgcgaactcacaaacgacgaaacgatacgtcgacgtactacgccaactaaactaaaccacaccgcgaactcacaaacgacgaaacgatacgtcgacgtactacgccaactatactacgcctacgtaaaaaacaaacgccgacgattcccgacaaaactacgatacaaactttttcttacctcgactatcgtcgctatcgtcccgaataccataaccgccgcccctccgtccctatccaatcacttaaaaacccttcgaatcgacgatatctaaaaaacaaacaaaaaaacgaaaaaattaaaaaaaaacatcttaccttttccccgcgacttcccgcgcgacgcgccgtaataacgtaacgcgaacgaactaattataactaaaccgaaaacg

SEQ ID NO: 17739 - DNA, 961 bp, Artificial Sequence
  chemically treated genomic DNA (Homo sapiens) CpG-island No: 17739
ttagattttttaagtttagtttagattttatttttttacgaatttgttttttcggtttatttttcgggataattatttatttttttatttagtcggtttcggtttcgatttcggtttcgattttatttttaacgatttatttaattttattttttatcgggtcggatcggtattttttatttcgttagatttcgtttttagcgttttaattagtttcgttttttaggggattgtttcgtttttttaattagttttattttttgtttagattcgatcgttaacgtttcgttaattttttttagttagtttttagtcgttttcggtcggttttcgtttttttttcgttttcgtcgtcgacgcgttgtatttatcgttttatttattggacgtagttttttttttaaatttcgtttttggttcgttttattaagtttttggcgatttgtggggacgcgagcgtttaggttttttttttttattgggtttcgtttttcgattgttcgtttagatttcgtttttagaggggatcgtgttttaaggtcgcgtttttcgcgcgagttatatttttcgcgagtttataagcggcggggcggtgcgtcggcgtgttacgttagttgggttgagttatatcgcgagtttataggcgacggggcggtgcgtcggcgtgttacgttagttgtgttgcgtttacgtaaaaggtaggcgtcggcggttttcgatagggttgcggtgtaagtttttttttgtttcggttatcgtcgttgtcgtttcggatgttatagtcgtcgttttttcgtttttgtttagttatttaggagtttttcgggtcggcggtgtttggagagtaagtaaggaagcgagggaattaggaaggggtattttatttttttttcgcgatttttcgcgcgacgcgtcgtgatgacgtagcgcgggcgggttggttgtggttgggtcgagagcg

SEQ ID NO: 17740 - DNA, 961 bp, Artificial Sequence
  chemically treated genomic DNA (Homo sapiens) CpG-island No: 17740
cgctctcgacccaaccacaaccaacccgcccgcgctacgtcatcacgacgcgtcgcgcgaaaaatcgcgaaaaaaaaataaaataccccttcctaattccctcgcttccttacttactctccaaacaccgccgacccgaaaaactcctaaataactaaacaaaaacgaaaaaacgacgactataacatccgaaacgacaacgacgataaccgaaacaaaaaaaaacttacaccgcaaccctatcgaaaaccgccgacgcctaccttttacgtaaacgcaacacaactaacgtaacacgccgacgcaccgccccgtcgcctataaactcgcgatataactcaacccaactaacgtaacacgccgacgcaccgccccgccgcttataaactcgcgaaaaatataactcgcgcgaaaaacgcgaccttaaaacacgatcccctctaaaaacgaaatctaaacgaacaatcgaaaaacgaaacccaataaaaaaaaaaaacctaaacgctcgcgtccccacaaatcgccaaaaacttaataaaacgaaccaaaaacgaaatttaaaaaaaaaactacgtccaataaataaaacgataaatacaacgcgtcgacgacgaaaacgaaaaaaaaacgaaaaccgaccgaaaacgactaaaaactaactaaaaaaaattaacgaaacgttaacgatcgaatctaaacaaaaaataaaactaattaaaaaaacgaaacaatcccctaaaaaacgaaactaattaaaacgctaaaaacgaaatctaacgaaataaaaaataccgatccgacccgataaaaaataaaattaaataaatcgttaaaaataaaatcgaaaccgaaatcgaaaccgaaaccgactaaataaaaaaataaataattatcccgaaaaataaaccgaaaaaacaaattcgtaaaaaaataaaatctaaactaaacttaaaaaatctaa

SEQ ID NO: 17741 - DNA, 891 bp, Artificial Sequence
  chemically treated genomic DNA (Homo sapiens) CpG-island No: 17741
gagggcggttgcgtatgtttatttttttaatcgtcgtcggggtgtttcggggagtagcgtcgtttttcgttaggtttgttagagcgttttagcgcgttcgtttttttacggatataggtgagcgaggcgtcggtgtttttggttttgttaggtttgggggtattttcgcgtcggttttgggggatcgttttttaagcgttaagttttttttcgggcgagcggttttttattcgggtcggtcgggaggggtgtcggcgtttggttggaagcggggtcgttttattcggagtcgggatgggttttgataggatgttcgggcgacgttgtttatatcgagttcgaagtggagttttggtttcggggattttttcgtatttcgagttttgtattttattcggtttcgttcgggaaagtacgatttggcgaggtcgttttaattttaggtttcggttttttagcgcgttagttttggtgagttgggcgaagttttttaatttggttttagcggttttgagcgcgcggttacggggattcgtcgggggtttcgcgttatttgagaggatcgagtttttaattttcggcgtttttcgcgggttgaggtttcgggttagtgttttcggtacgtgtttttgcgtttcgggtttttttcgggagcggagttttggggattagggtcgcggtttttttgcgcgtcgcggggattgggcgagtgtggtttcgtttcgttaggtatttggggtggaagttgcgtttcgttattcggttaggtttcgggttttttttttttatcgtcggcgtttttagattttagtcgtttagatttcgatttaagaggtagtttcgatttcgtttttgttttttgatttatttttaaagatggtcgggtatttt

SEQ ID NO: 17742 - DNA, 891 bp, Artificial Sequence
  chemically treated genomic DNA (Homo sapiens) CpG-island No: 17742
aaaatacccgaccatctttaaaaataaatcaaaaaacaaaaacgaaatcgaaactacctcttaaatcgaaatctaaacgactaaaatctaaaaacgccgacgataaaaaaaaaaaacccgaaacctaaccgaataacgaaacgcaacttccaccccaaatacctaacgaaacgaaaccacactcgcccaatccccgcgacgcgcaaaaaaaccgcgaccctaatccccaaaactccgctcccgaaaaaaacccgaaacgcaaaaacacgtaccgaaaacactaacccgaaacctcaacccgcgaaaaacgccgaaaattaaaaactcgatcctctcaaataacgcgaaacccccgacgaatccccgtaaccgcgcgctcaaaaccgctaaaaccaaattaaaaaacttcgcccaactcaccaaaactaacgcgctaaaaaaccgaaacctaaaattaaaacgacctcgccaaatcgtactttcccgaacgaaaccgaataaaatacaaaactcgaaatacgaaaaaatccccgaaaccaaaactccacttcgaactcgatataaacaacgtcgcccgaacatcctatcaaaacccatcccgactccgaataaaacgaccccgcttccaaccaaacgccgacacccctcccgaccgacccgaataaaaaaccgctcgcccgaaaaaaaacttaacgcttaaaaaacgatcccccaaaaccgacgcgaaaatacccccaaacctaacaaaaccaaaaacaccgacgcctcgctcacctatatccgtaaaaaaacgaacgcgctaaaacgctctaacaaacctaacgaaaaacgacgctactccccgaaacaccccgacgacgattaaaaaaataaacatacgcaaccgccctc

SEQ ID NO: 17743 - DNA, 891 bp, Artificial Sequence
  chemically treated genomic DNA (Homo sapiens) CpG-island No: 17743
ggggtgttcggttatttttagggatgggttagaaggtagaggcggggtcgaggttgttttttaagtcggggtttgagcggttggagtttgggggcgtcgacggtgaggaaggaaagttcggggtttggtcgagtggcggagcgtagtttttattttaggtgtttggcgggacggggttatattcgtttagttttcgcgacgcgtagggaggtcgcggttttggtttttaaggtttcgttttcgggaggagttcgaggcgtagaggtacgtgtcgagggtattggttcggggttttagttcgcgggaggcgtcggagattgggggttcggtttttttaagtggcgcggagttttcggcgggttttcgtggtcgcgcgtttagagtcgttgggattaggttggggggtttcgtttagtttattaaggttggcgcgttaaggggtcgggatttggggttagggcggtttcgttaggtcgtgttttttcggacgaggtcgggtgaggtgtaaagttcggagtgcggaagggttttcgaaattaggattttatttcgggttcggtgtgagtagcgtcgttcgggtattttgttaagatttatttcgatttcgggtgaggcggtttcgtttttagttaagcgtcgatatttttttcggtcggttcgagtgaggggtcgttcgttcgggagaaggtttggcgtttgggggacgattttttaaagtcggcgcggggatatttttaggtttggtagggttaggggtatcggcgtttcgtttatttgtgttcgtggggaggcgggcgcgttgggacgttttgataggtttggcggggggcgacgttgtttttcggggtatttcggcggcggttgggggagtggatatgcgtagtcgttttt

SEQ ID NO: 17744 - DNA, 891 bp, Artificial Sequence
  chemically treated genomic DNA (Homo sapiens) CpG-island No: 17744
aaaaacgactacgcatatccactcccccaaccgccgccgaaataccccgaaaaacaacgtcgccccccgccaaacctatcaaaacgtcccaacgcgcccgcctccccacgaacacaaataaacgaaacgccgatacccctaaccctaccaaacctaaaaatatccccgcgccgactttaaaaaatcgtcccccaaacgccaaaccttctcccgaacgaacgacccctcactcgaaccgaccgaaaaaaatatcgacgcttaactaaaaacgaaaccgcctcacccgaaatcgaaataaatcttaacaaaatacccgaacgacgctactcacaccgaacccgaaataaaatcctaatttcgaaaacccttccgcactccgaactttacacctcacccgacctcgtccgaaaaaacacgacctaacgaaaccgccctaaccccaaatcccgaccccttaacgcgccaaccttaataaactaaacgaaaccccccaacctaatcccaacgactctaaacgcgcgaccacgaaaacccgccgaaaactccgcgccacttaaaaaaaccgaacccccaatctccgacgcctcccgcgaactaaaaccccgaaccaataccctcgacacgtacctctacgcctcgaactcctcccgaaaacgaaaccttaaaaaccaaaaccgcgacctccctacgcgtcgcgaaaactaaacgaatataaccccgtcccgccaaacacctaaaataaaaactacgctccgccactcgaccaaaccccgaactttccttcctcaccgtcgacgcccccaaactccaaccgctcaaaccccgacttaaaaaacaacctcgaccccgcctctaccttctaacccatccctaaaaataaccgaacacccc

SEQ ID NO: 17745 - DNA, 652 bp, Artificial Sequence
  chemically treated genomic DNA (Homo sapiens) CpG-island No: 17745
acgtaggcgttcgatttttttttattttttgtcgggtattttaatagttcggggtttacgtcgggtgtttcgtcgtttgtttttttagtattcgggttcgcggggtcgtcgtcgtagatcgggggtcggggtcggagcgtcgcggcggggacgggcgcggggataagttgggttgcgagggcggtagggttaaggcgggcgcggagtagagcgcgagcgagttgcgttgtaggcgcgtcggggtcgtcgtttaggtttagagtcggattagagttgcggggggcgttttagacgcgtagtagttgcgttaggacgcgcgtttgttgatttttagttttttgcgtttcggttcgcgttcgtttttgacgttcggtttttagtagatgcgttagcgttcgcgttagtttttgtatcgttttcgtcgttttatttcggggtattgatcgtcggaagcggcgaggagcgttagttttagttaagggcggagacgttgcgtttaggtcgcggggtttttgcgggaaaatgaggtgggggaaaagagtttgttagcgttcgtcgagatagggatttttagttcgggaagtttcgtaggttttaaatattttagatgttattaaaagtatcgtgattatttaaatatattcggatattt

SEQ ID NO: 17746 - DNA, 652 bp, Artificial Sequence
  chemically treated genomic DNA (Homo sapiens) CpG-island No: 17746
aaatatccgaatatatttaaataatcacgatacttttaataacatctaaaatatttaaaacctacgaaacttcccgaactaaaaatccctatctcgacgaacgctaacaaactcttttcccccacctcattttcccgcaaaaaccccgcgacctaaacgcaacgtctccgcccttaactaaaactaacgctcctcgccgcttccgacgatcaataccccgaaataaaacgacgaaaacgatacaaaaactaacgcgaacgctaacgcatctactaaaaaccgaacgtcaaaaacgaacgcgaaccgaaacgcaaaaaactaaaaatcaacaaacgcgcgtcctaacgcaactactacgcgtctaaaacgccccccgcaactctaatccgactctaaacctaaacgacgaccccgacgcgcctacaacgcaactcgctcgcgctctactccgcgcccgccttaaccctaccgccctcgcaacccaacttatccccgcgcccgtccccgccgcgacgctccgaccccgacccccgatctacgacgacgaccccgcgaacccgaatactaaaaaaacaaacgacgaaacacccgacgtaaaccccgaactattaaaatacccgacaaaaaataaaaaaaaatcgaacgcctacgt

SEQ ID NO: 17747 - DNA, 652 bp, Artificial Sequence
  chemically treated genomic DNA (Homo sapiens) CpG-island No: 17747
gggtgttcgggtatatttggatggttacggtgtttttggtggtatttgggatgtttgaggtttacgaagtttttcgggttgggggtttttgtttcgacggacgttgataaattttttttttttattttattttttcgtaggagtttcgcggtttaagcgtagcgttttcgtttttggttgagattggcgtttttcgtcgttttcggcggttagtgtttcgaggtgaggcggcgggggcggtgtaggagttggcgcgggcgttggcgtatttgttggaggtcgaacgttaggagcgggcgcgggtcgaggcgtaggaggttgaggattagtaggcgcgcgttttggcgtagttgttgcgcgtttggggcgtttttcgtaattttgattcggttttgggtttggacgacgatttcgacgcgtttgtagcgtagttcgttcgcgttttgtttcgcgttcgttttgattttgtcgttttcgtagtttagtttgttttcgcgttcgttttcgtcgcggcgtttcgatttcggttttcggtttacgacgacggtttcgcgggttcggatgttgaggaggtaggcgacgagatattcgacgtggatttcgagttgttgaggtgttcggtagggggtggggaggggtcgggcgtttgcgt

SEQ ID NO: 17748 - DNA, 652 bp, Artificial Sequence
  chemically treated genomic DNA (Homo sapiens) CpG-island No: 17748
acgcaaacgcccgacccctccccaccccctaccgaacacctcaacaactcgaaatccacgtcgaatatctcgtcgcctacctcctcaacatccgaacccgcgaaaccgtcgtcgtaaaccgaaaaccgaaatcgaaacgccgcgacgaaaacgaacgcgaaaacaaactaaactacgaaaacgacaaaatcaaaacgaacgcgaaacaaaacgcgaacgaactacgctacaaacgcgtcgaaatcgtcgtccaaacccaaaaccgaatcaaaattacgaaaaacgccccaaacgcgcaacaactacgccaaaacgcgcgcctactaatcctcaacctcctacgcctcgacccgcgcccgctcctaacgttcgacctccaacaaatacgccaacgcccgcgccaactcctacaccgcccccgccgcctcacctcgaaacactaaccgccgaaaacgacgaaaaacgccaatctcaaccaaaaacgaaaacgctacgcttaaaccgcgaaactcctacgaaaaaataaaataaaaaaaaaaaatttatcaacgtccgtcgaaacaaaaacccccaacccgaaaaacttcgtaaacctcaaacatcccaaataccaccaaaaacaccgtaaccatccaaatatacccgaacaccc

SEQ ID NO: 17749 - DNA, 739 bp, Artificial Sequence
  chemically treated genomic DNA (Homo sapiens) CpG-island No: 17749
attacggtatttttttaggatatttggaagcgtttaaattaaagaatatatatttttaaggatacgatatttttatatcgttttttttatattatacgtatatatattgatgcgcgcgcgtttttttttaaagcgttttagtgtcgtggatagcgttataggtatcgggtacggagaggtgggtagggtacggttatcggcggcgtttcggataacgttattcgtataggtagagattaagttaggttttaggtgtgtcggcgtggtttgggcgcggatcggcggtcggagttcgggttattttcgtcgattttttcgtacgtttcgggagtcggttcgggcgggggtgaggcggcgtagttttaattttaattttcgtcggtggtatttttttttaatttttatttttcgtcggattggggtcgtatttttatcggtcgcgcgtagagcgcggggggcggtcgaaataggtcgagtagtagtagtattaaaaggtcgacgttttcggttcgcggtttttagagtagcggcgatttcgttatgttgttttagcgagtcgggtttcggacgggcggattggttggtaagtgcgtagtgtcggggcgagttggcgaggttgcggcgttttgcggttgcgtacgttcggaattaggtttttttttttcgtttttattttatttattcgatcgacgtaggcgtagtttggggagttggtagttttattagatttttcgtcgtt

SEQ ID NO: 17750 - DNA, 739 bp, Artificial Sequence
  chemically treated genomic DNA (Homo sapiens) CpG-island No: 17750
aacgacgaaaaatctaataaaactaccaactccccaaactacgcctacgtcgatcgaataaataaaataaaaacgaaaaaaaaaaacctaattccgaacgtacgcaaccgcaaaacgccgcaacctcgccaactcgccccgacactacgcacttaccaaccaatccgcccgtccgaaacccgactcgctaaaacaacataacgaaatcgccgctactctaaaaaccgcgaaccgaaaacgtcgaccttttaatactactactactcgacctatttcgaccgccccccgcgctctacgcgcgaccgataaaaatacgaccccaatccgacgaaaaataaaaattaaaaaaaaataccaccgacgaaaattaaaattaaaactacgccgcctcacccccgcccgaaccgactcccgaaacgtacgaaaaaatcgacgaaaataacccgaactccgaccgccgatccgcgcccaaaccacgccgacacacctaaaacctaacttaatctctacctatacgaataacgttatccgaaacgccgccgataaccgtaccctacccacctctccgtacccgatacctataacgctatccacgacactaaaacgctttaaaaaaaaacgcgcgcgcatcaatatatatacgtataatataaaaaaaacgatataaaaatatcgtatccttaaaaatatatattctttaatttaaacgcttccaaatatcctaaaaaaataccgtaat

SEQ ID NO: 17751 - DNA, 739 bp, Artificial Sequence
  chemically treated genomic DNA (Homo sapiens) CpG-island No: 17751
ggcgacgggaggtttggtggggttgttagttttttaggttgcgtttgcgtcggtcgggtgggtggggtgggggcggggagggggggtttggtttcgggcgtgcgtagtcgtagagcgtcgtagtttcgttagttcgtttcggtattgcgtatttgttagttagttcgttcgttcggagttcggttcgttggggtagtatggcggggtcgtcgttgttttgggggtcgcgggtcgggggcgtcggttttttggtgttgttgttgttcggtttgtttcggtcgtttttcgcgttttgcgcgcggtcggtaaaggtgcgattttagttcggcgaggggtgggggttgggggaggatgttatcggcgagggttggggttggggttgcgtcgttttattttcgttcgagtcggttttcgggacgtgcggagagatcgacgagggtggttcgggtttcggtcgtcggttcgcgtttaggttacgtcggtatatttgagatttgatttggtttttgtttgtgcgggtggcgttgttcggggcgtcgtcggtaatcgtgttttgtttattttttcgtgttcggtgtttgtgacgttgtttacggtattaaggcgttttaagaaagggcgcgcgcgtattagtgtgtgtgcgtgtgatgtgaggagagcggtgtggaggtgtcgtgtttttgaaagtgtgtgttttttggtttgagcgtttttaagtgttttagaaaggtgtcgtggt

SEQ ID NO: 17752 - DNA, 739 bp, Artificial Sequence
  chemically treated genomic DNA (Homo sapiens) CpG-island No: 17752
accacgacacctttctaaaacacttaaaaacgctcaaaccaaaaaacacacactttcaaaaacacgacacctccacaccgctctcctcacatcacacgcacacacactaatacgcgcgcgccctttcttaaaacgccttaataccgtaaacaacgtcacaaacaccgaacacgaaaaaataaacaaaacacgattaccgacgacgccccgaacaacgccacccgcacaaacaaaaaccaaatcaaatctcaaatataccgacgtaacctaaacgcgaaccgacgaccgaaacccgaaccaccctcgtcgatctctccgcacgtcccgaaaaccgactcgaacgaaaataaaacgacgcaaccccaaccccaaccctcgccgataacatcctcccccaacccccacccctcgccgaactaaaatcgcacctttaccgaccgcgcgcaaaacgcgaaaaacgaccgaaacaaaccgaacaacaacaacaccaaaaaaccgacgcccccgacccgcgacccccaaaacaacgacgaccccgccatactaccccaacgaaccgaactccgaacgaacgaactaactaacaaatacgcaataccgaaacgaactaacgaaactacgacgctctacgactacgcacgcccgaaaccaaaccccccctccccgcccccaccccacccacccgaccgacgcaaacgcaacctaaaaaactaacaaccccaccaaacctcccgtcgcc

SEQ ID NO: 17753 - DNA, 506 bp, Artificial Sequence
  chemically treated genomic DNA (Homo sapiens) CpG-island No: 17753
ttttacgcgaggtttttagtttcggttttttagttcgttttttcgtttttaaacgtggtgttgttttcgttttattttaggtgatttcggttttttagtttcgttttagttagcggtcggaggaggtttcgaacgtcgtcgtaagcggttaagttattcgggtcgagggtacgtagaaggatcgtttttaggtttcgcgggtgggttcggtcgttcgtagtttggagattgcgtagttggattcgcgcgcgggagaggggcggggtttggcggtgggaggaggtgggtttagaggttgtcgagggcgggagtttgcgggtttcggggagcgtggagaggcgtagtttcggaggagtcgggtggttgtaggaaggaggtggggttcgtcgcgggtttaggggacggtgttgagcgaaacgattagggcgggttcgaggggtagggtcggagattaagggagcgtggagtttttaggattttcggaagggaagggtttttaggagtta

SEQ ID NO: 17754 - DNA, 506 bp, Artificial Sequence
  chemically treated genomic DNA (Homo sapiens) CpG-island No: 17754
taactcctaaaaacccttcccttccgaaaatcctaaaaactccacgctcccttaatctccgaccctacccctcgaacccgccctaatcgtttcgctcaacaccgtcccctaaacccgcgacgaaccccacctccttcctacaaccacccgactcctccgaaactacgcctctccacgctccccgaaacccgcaaactcccgccctcgacaacctctaaacccacctcctcccaccgccaaaccccgcccctctcccgcgcgcgaatccaactacgcaatctccaaactacgaacgaccgaacccacccgcgaaacctaaaaacgatccttctacgtaccctcgacccgaataacttaaccgcttacgacgacgttcgaaacctcctccgaccgctaactaaaacgaaactaaaaaaccgaaatcacctaaaataaaacgaaaacaacaccacgtttaaaaacgaaaaaacgaactaaaaaaccgaaactaaaaacctcgcgtaaaa

SEQ ID NO: 17755 - DNA, 506 bp, Artificial Sequence
  chemically treated genomic DNA (Homo sapiens) CpG-island No: 17755
tagtttttggaggtttttttttttcgagagttttggaggttttacgtttttttggttttcggttttgtttttcggattcgttttggtcgtttcgtttaatatcgttttttgagttcgcggcgggttttattttttttttataattattcggttttttcgaggttgcgtttttttacgtttttcgagattcgtaggttttcgttttcggtagtttttggatttatttttttttatcgttaggtttcgtttttttttcgcgcgcgggtttagttgcgtagtttttaggttgcgggcggtcggatttattcgcggggtttaggagcggtttttttgcgtgttttcggttcgggtggtttgatcgtttgcggcgacgttcggggtttttttcggtcgttggttggggcggggttggggggtcggagttatttggagtggggcgggagtagtattacgtttagaagcgagggagcgggttgggaaatcgaggttaggggtttcgcgtgaga

SEQ ID NO: 17756 - DNA, 506 bp, Artificial Sequence
  chemically treated genomic DNA (Homo sapiens) CpG-island No: 17756
tctcacgcgaaacccctaacctcgatttcccaacccgctccctcgcttctaaacgtaatactactcccgccccactccaaataactccgaccccccaaccccgccccaaccaacgaccgaaaaaaaccccgaacgtcgccgcaaacgatcaaaccacccgaaccgaaaacacgcaaaaaaaccgctcctaaaccccgcgaataaatccgaccgcccgcaacctaaaaactacgcaactaaacccgcgcgcgaaaaaaaaacgaaacctaacgataaaaaaaaataaatccaaaaactaccgaaaacgaaaacctacgaatctcgaaaaacgtaaaaaaacgcaacctcgaaaaaaccgaataattataaaaaaaaaataaaacccgccgcgaactcaaaaaacgatattaaacgaaacgaccaaaacgaatccgaaaaacaaaaccgaaaaccaaaaaaacgtaaaacctccaaaactctcgaaaaaaaaaaacctccaaaaacta

SEQ ID NO: 17757 - DNA, 901 bp, Artificial Sequence
  chemically treated genomic DNA (Homo sapiens) CpG-island No: 17757
tttttttttcgacggtgagttcgtttaattatgtttcgtttttttttaattcggtataattgggaaaaattaagagcgatcgcgggaagtatttatcgttttcgtcggtttttaataggtttattcgtgtttcgttttttattgataaaggcgatttgggaaaaattattggcggtaattttggggattttcggttaatatcgtattatttttagtcgggatggatcgtttagcgtgttttttttcgttaatagggttaggagattacgaagttaggagaaatatggcgtggttcggttttcgtcgtattttttttggttgtggttttttataacggagttcgaatgataggaatcgagtgggggtagcgggagatacgttaagagtttttcgagtttggtatatggttttgtgcggtcgatgtttttttcgttcgatttttacggttggttttggcgtcgtagtaatatttcggatgtttgtgtttattgtcgtattagggttttcgagcgtatttttttatggcgttggcgtttggtcgcgtagttaggttacgtttttagcgtagacgtatatcggcgtcggagtttttcgtttattatcgggtagcgattgggtcgttatatcgtatgttacgttaaggacgtatttttattggttaatcgagtttttgttatttgtttattgttttttgagcgtagtttagttatttttaggttcggggagtgaaggtttcgttgagagaaggttttattcggtgttttgggaagagagtcgtgtgggtttaggtatcgtagcggcgatacgagagagacgggcggtgtgatagttttttattatttgtacgagtgtattggtaacgttggggtgggtgtatttttttggagttggaggaagtgtt

SEQ ID NO: 17758 - DNA, 901 bp, Artificial Sequence
  chemically treated genomic DNA (Homo sapiens) CpG-island No: 17758
aacacttcctccaactccaaaaaaatacacccaccccaacgttaccaatacactcgtacaaataataaaaaactatcacaccgcccgtctctctcgtatcgccgctacgatacctaaacccacacgactctcttcccaaaacaccgaataaaaccttctctcaacgaaaccttcactccccgaacctaaaaataactaaactacgctcaaaaaacaataaacaaataacaaaaactcgattaaccaataaaaatacgtccttaacgtaacatacgatataacgacccaatcgctacccgataataaacgaaaaactccgacgccgatatacgtctacgctaaaaacgtaacctaactacgcgaccaaacgccaacgccataaaaaaatacgctcgaaaaccctaatacgacaataaacacaaacatccgaaatattactacgacgccaaaaccaaccgtaaaaatcgaacgaaaaaaacatcgaccgcacaaaaccatataccaaactcgaaaaactcttaacgtatctcccgctacccccactcgattcctatcattcgaactccgttataaaaaaccacaaccaaaaaaaatacgacgaaaaccgaaccacgccatatttctcctaacttcgtaatctcctaaccctattaacgaaaaaaaacacgctaaacgatccatcccgactaaaaataatacgatattaaccgaaaatccccaaaattaccgccaataatttttcccaaatcgcctttatcaataaaaaacgaaacacgaataaacctattaaaaaccgacgaaaacgataaatacttcccgcgatcgctcttaatttttcccaattataccgaattaaaaaaaaacgaaacataattaaacgaactcaccgtcgaaaaaaaaa

SEQ ID NO: 17759 - DNA, 901 bp, Artificial Sequence
  chemically treated genomic DNA (Homo sapiens) CpG-island No: 17759
agtattttttttagttttaaaagagtgtatttattttaacgttattaatatattcgtgtaggtagtggaaggttgttatatcgttcgtttttttcgtgtcgtcgttacgatatttgggtttatacgattttttttttaaaatatcgaatgagatttttttttaacgaggtttttatttttcgagtttgaaagtaattggattacgtttaggaggtaatgaataaatggtagaaattcgattggttaatgagagtgcgtttttggcgtgatatgcggtatagcgatttaatcgttgttcggtaataggcggaaagtttcgacgtcggtgtgcgtttacgttgggggcgtggtttgattgcgcggttagacgttagcgttatggaggagtacgttcgggagttttggtacggtaatgggtataggtattcggaatattgttgcgacgttaaggttagtcgtgggggtcgggcgggggaggtatcggtcgtatagagttatgtattagattcgggggatttttaacgtatttttcgttatttttattcggtttttgttattcgggtttcgttatgaggggttataattagagaaggtgcggcgaaggtcgaattacgttatgttttttttgatttcgtaattttttagttttgttaacgaaaaaagatacgttggacgatttatttcggttaggggtggtacggtgttgatcggaaatttttagagttgtcgttagtggttttttttaggtcgtttttgttagtggggggcggggtacggatgaatttgttgagggtcggcggggacggtggatgtttttcgcggtcgtttttggttttttttagttgtgtcggattgaaaaggggcggggtatggttggacgggtttatcgtcggagaagggg

SEQ ID NO: 17760 - DNA, 901 bp, Artificial Sequence
  chemically treated genomic DNA (Homo sapiens) CpG-island No: 17760
ccccttctccgacgataaacccgtccaaccataccccgccccttttcaatccgacacaactaaaaaaaaccaaaaacgaccgcgaaaaacatccaccgtccccgccgaccctcaacaaattcatccgtaccccgccccccactaacaaaaacgacctaaaaaaaaccactaacgacaactctaaaaatttccgatcaacaccgtaccacccctaaccgaaataaatcgtccaacgtatcttttttcgttaacaaaactaaaaaattacgaaatcaaaaaaaacataacgtaattcgaccttcgccgcaccttctctaattataacccctcataacgaaacccgaataacaaaaaccgaataaaaataacgaaaaatacgttaaaaatcccccgaatctaatacataactctatacgaccgatacctcccccgcccgacccccacgactaaccttaacgtcgcaacaatattccgaatacctatacccattaccgtaccaaaactcccgaacgtactcctccataacgctaacgtctaaccgcgcaatcaaaccacgcccccaacgtaaacgcacaccgacgtcgaaactttccgcctattaccgaacaacgattaaatcgctataccgcatatcacgccaaaaacgcactctcattaaccaatcgaatttctaccatttattcattacctcctaaacgtaatccaattactttcaaactcgaaaaataaaaacctcgttaaaaaaaaatctcattcgatattttaaaaaaaaaatcgtataaacccaaatatcgtaacgacgacacgaaaaaaacgaacgatataacaaccttccactacctacacgaatatattaataacgttaaaataaatacactcttttaaaactaaaaaaaatact

SEQ ID NO: 17761 - DNA, 824 bp, Artificial Sequence
  chemically treated genomic DNA (Homo sapiens) CpG-island No: 17761
atacgtcggtttatacgggatgtttttttttattttagtgaggaatattttcgatttttagcgatttcgattttcgttttttatgcgattgttcgggtagattgttttattcgtattggcggttttcggttttaatgtattcgcggaaatcgtttttggttcgggcgtcgcggtggaattattagttttaatcgttgttatgttggtatttgttcggttcgttttttcggtaatagaaaaattattttcgcgttcgttattttcgttgtcgggttatttgagtgaaggtggagcgagagtcgggatcgttagggtggtggtttttttttttcgtttttaaaagtttaatgtatgaatagtttcgggatttttaaatttcgtcggatcgggaggtcggggatacggttcgatcggtttatttattatttttatagagttttatcggtttatttttgttattagattcgttttattttgtcgttcgttcgttttattgatcgcgttttttagattatttttcgattttgttttttagatttattggtttagttattttttttatttcggttttttattggtagtttttttataaggcgtcgtttttttcgtattagaaattattaggtgttttatggttggattgaaatttcgttttttcgttttttagcgaggtttcgttttttggagagtatacgggaatttggggacgaagaaattttgatttggcggggtcggggtgagggcgtattggtattaggtgcgagttaggaatgttaagttagtagataaaagtagagtaggtgaggataaataagtgaaaatgt

SEQ ID NO: 17762 - DNA, 824 bp, Artificial Sequence
  chemically treated genomic DNA (Homo sapiens) CpG-island No: 17762
acattttcacttatttatcctcacctactctacttttatctactaacttaacattcctaactcgcacctaataccaatacgccctcaccccgaccccgccaaatcaaaatttcttcgtccccaaattcccgtatactctccaaaaaacgaaacctcgctaaaaaacgaaaaaacgaaatttcaatccaaccataaaacacctaataatttctaatacgaaaaaaacgacgccttataaaaaaactaccaataaaaaaccgaaataaaaaaaataactaaaccaataaatctaaaaaacaaaatcgaaaaataatctaaaaaacgcgatcaataaaacgaacgaacgacaaaataaaacgaatctaataacaaaaataaaccgataaaactctataaaaataataaataaaccgatcgaaccgtatccccgacctcccgatccgacgaaatttaaaaatcccgaaactattcatacattaaacttttaaaaacgaaaaaaaaaaaccaccaccctaacgatcccgactctcgctccaccttcactcaaataacccgacaacgaaaataacgaacgcgaaaataatttttctattaccgaaaaaacgaaccgaacaaataccaacataacaacgattaaaactaataattccaccgcgacgcccgaaccaaaaacgatttccgcgaatacattaaaaccgaaaaccgccaatacgaataaaacaatctacccgaacaatcgcataaaaaacgaaaatcgaaatcgctaaaaatcgaaaatattcctcactaaaataaaaaaaaacatcccgtataaaccgacgtat

SEQ ID NO: 17763 - DNA, 824 bp, Artificial Sequence
  chemically treated genomic DNA (Homo sapiens) CpG-island No: 17763
gtatttttatttgtttatttttatttgttttgtttttatttgttagtttaatatttttgattcgtatttgatgttagtacgtttttatttcgatttcgttaggttaaagttttttcgtttttagattttcgtgtgttttttagggggcgaggtttcgttggaagacgggaaagcggaattttagtttaattatgaagtatttggtagtttttgatacggaaagggcggcgttttatggagaagttgttaataaagagtcgagatgaaaggggtggttgaattaatgagtttaggagataagatcgggggatgatttggaaagcgcgattagtgaagcggacgaacggtaggataaggcgggtttagtgataggaatgggtcgatgaagttttgtagggatggtgggtaggtcgatcgggtcgtgttttcggtttttcgattcgacggaatttggaaatttcggggttatttatatattgagtttttaggagcggaggagaaaagttattattttgacgatttcggttttcgttttatttttatttaggtggttcggtagcggaagtgacgaacgcggaagtggtttttttgttgtcgaggggacgggtcgggtagatgttaatatggtagcggttggggttggtggttttatcgcggcgttcgggttaggggcggttttcgcgggtgtattggagtcggggatcgttagtgcgggtgagatagtttgttcgagtagtcgtatgggaggcggaggtcgggatcgttgggagtcgggaatgttttttattaaagtgagagggagtatttcgtgtggatcgacgtgt

SEQ ID NO: 17764 - DNA, 824 bp, Artificial Sequence
  chemically treated genomic DNA (Homo sapiens) CpG-island No: 17764
acacgtcgatccacacgaaatactccctctcactttaataaaaaacattcccgactcccaacgatcccgacctccgcctcccatacgactactcgaacaaactatctcacccgcactaacgatccccgactccaatacacccgcgaaaaccgcccctaacccgaacgccgcgataaaaccaccaaccccaaccgctaccatattaacatctacccgacccgtcccctcgacaacaaaaaaaccacttccgcgttcgtcacttccgctaccgaaccacctaaataaaaataaaacgaaaaccgaaatcgtcaaaataataacttttctcctccgctcctaaaaactcaatatataaataaccccgaaatttccaaattccgtcgaatcgaaaaaccgaaaacacgacccgatcgacctacccaccatccctacaaaacttcatcgacccattcctatcactaaacccgccttatcctaccgttcgtccgcttcactaatcgcgctttccaaatcatcccccgatcttatctcctaaactcattaattcaaccacccctttcatctcgactctttattaacaacttctccataaaacgccgccctttccgtatcaaaaactaccaaatacttcataattaaactaaaattccgctttcccgtcttccaacgaaacctcgccccctaaaaaacacacgaaaatctaaaaacgaaaaaactttaacctaacgaaatcgaaataaaaacgtactaacatcaaatacgaatcaaaaatattaaactaacaaataaaaacaaaacaaataaaaataaacaaataaaaatac

SEQ ID NO: 17765 - DNA, 854 bp, Artificial Sequence
  chemically treated genomic DNA (Homo sapiens) CpG-island No: 17765
ttatattcgtttttattgttgtagtttgcgtcgatttttttacgttcgggattgttttcgttaatcgcgttaatttcgggagtttgacgtcgtcgtttgttgtgtttaggttcggagtagtagtcgtttacgtttacggtattatttatatttattattacgttcgcggtatttatattcgtcgtcgttgcgtttagcgcgtcgtcgggatcgtcgtcgggattatttgggttttcgtaaggaggtggagaagtttgttgtggtcggggattcgttattgtattaggcggtacggttagcgtttagcgatgaagagcgttcggcggttttggtagcgggttttgaggcggtggcgaagttcgcggacgggtttttacgacgtcggagttacggtcgcgatcgtcgtcgtttacgttcgtgtcgtcgtcgtttacgtttatattttcgtcgcgtcgcggcgtcgggggtatcggttcgggcggcggcggttcgttggcggggtcggcgtcgggaggcggcggtttttttttggggagtatagttatggttgtattgtcgagtattttttaataaattcggcgcggggtacgtcgggagagaattcggatgagggggttagtgtagtgcgcgaggtacgacgggaacggcgagattcggataaagggatcgcggtatcggttcgagaattttcggcggcggaggcggcggcggcggcggcggcggcggtggcggcgcgcgggttacgtcgagaggagaattcggatgtaaagtttaagatgaaggtagtgcggcgagtttgttttagttttttttttaagtttagtaagtttattgttacgtttgtttcggttttt

SEQ ID NO: 17766 - DNA, 854 bp, Artificial Sequence
  chemically treated genomic DNA (Homo sapiens) CpG-island No: 17766
aaaaaccgaaacaaacgtaacaataaacttactaaacttaaaaaaaaaactaaaacaaactcgccgcactaccttcatcttaaactttacatccgaattctcctctcgacgtaacccgcgcgccgccaccgccgccgccgccgccgccgccgcctccgccgccgaaaattctcgaaccgataccgcgatccctttatccgaatctcgccgttcccgtcgtacctcgcgcactacactaaccccctcatccgaattctctcccgacgtaccccgcgccgaatttattaaaaaatactcgacaatacaaccataactatactccccaaaaaaaaaccgccgcctcccgacgccgaccccgccaacgaaccgccgccgcccgaaccgatacccccgacgccgcgacgcgacgaaaatataaacgtaaacgacgacgacacgaacgtaaacgacgacgatcgcgaccgtaactccgacgtcgtaaaaacccgtccgcgaacttcgccaccgcctcaaaacccgctaccaaaaccgccgaacgctcttcatcgctaaacgctaaccgtaccgcctaatacaataacgaatccccgaccacaacaaacttctccacctccttacgaaaacccaaataatcccgacgacgatcccgacgacgcgctaaacgcaacgacgacgaatataaataccgcgaacgtaataataaatataaataataccgtaaacgtaaacgactactactccgaacctaaacacaacaaacgacgacgtcaaactcccgaaattaacgcgattaacgaaaacaatcccgaacgtaaaaaaatcgacgcaaactacaacaataaaaacgaatataa

SEQ ID NO: 17767 - DNA, 854 bp, Artificial Sequence
  chemically treated genomic DNA (Homo sapiens) CpG-island No: 17767
gaaggtcggaataagcgtagtaataaatttgttggatttggagagaaggttaagataaattcgtcgtattgtttttattttggattttatattcgggtttttttttcggcgtgattcgcgcgtcgttatcgtcgtcgtcgtcgtcgtcgtcgttttcgtcgtcgagggttttcgaatcggtgtcgcgatttttttattcgggtttcgtcgttttcgtcgtgtttcgcgtattatattagtttttttattcgggttttttttcggcgtgtttcgcgtcgggtttgttggggggtattcggtagtgtagttatgattatattttttaaaaagaagtcgtcgtttttcgacgtcgatttcgttaacgagtcgtcgtcgttcgggtcgatgttttcggcgtcgcggcgcggcggaggtgtgggcgtgggcggcggcggtacgggcgtgggcggcggcgatcgcgatcgtgatttcggcgtcgtgggggttcgttcgcgagtttcgttatcgttttaaggttcgttattaggatcgtcgggcgttttttatcgttgggcgttggtcgtgtcgtttggtgtagtggcgggttttcggttataataggtttttttatttttttgcgggggtttaggtggtttcggcggcggtttcggcgacgcgttgggcgtagcggcggcgggtgtgggtgtcgcgggcgtggtggtgggtgtgggtggtgtcgtaggcgtgggcggttgttgtttcgggtttgggtatagtaagcggcgacgttaagttttcggggttggcgcggttggcgggggtagtttcgagcgtgaggaggtcggcgtaggttataatagtgaggacgagtatga

SEQ ID NO: 17768 - DNA, 854 bp, Artificial Sequence
  chemically treated genomic DNA (Homo sapiens) CpG-island No: 17768
tcatactcgtcctcactattataacctacgccgacctcctcacgctcgaaactacccccgccaaccgcgccaaccccgaaaacttaacgtcgccgcttactatacccaaacccgaaacaacaaccgcccacgcctacgacaccacccacacccaccaccacgcccgcgacacccacacccgccgccgctacgcccaacgcgtcgccgaaaccgccgccgaaaccacctaaacccccgcaaaaaaataaaaaaacctattataaccgaaaacccgccactacaccaaacgacacgaccaacgcccaacgataaaaaacgcccgacgatcctaataacgaaccttaaaacgataacgaaactcgcgaacgaacccccacgacgccgaaatcacgatcgcgatcgccgccgcccacgcccgtaccgccgccgcccacgcccacacctccgccgcgccgcgacgccgaaaacatcgacccgaacgacgacgactcgttaacgaaatcgacgtcgaaaaacgacgacttctttttaaaaaatataatcataactacactaccgaataccccccaacaaacccgacgcgaaacacgccgaaaaaaaacccgaataaaaaaactaatataatacgcgaaacacgacgaaaacgacgaaacccgaataaaaaaatcgcgacaccgattcgaaaaccctcgacgacgaaaacgacgacgacgacgacgacgacgataacgacgcgcgaatcacgccgaaaaaaaaacccgaatataaaatccaaaataaaaacaatacgacgaatttatcttaaccttctctccaaatccaacaaatttattactacgcttattccgaccttc

SEQ ID NO: 17769 - DNA, 652 bp, Artificial Sequence
  chemically treated genomic DNA (Homo sapiens) CpG-island No: 17769
ggtaatttgcgcgtcgcgtcgttgtagttacgtagtgcgtggatttagtcgttttggtcgtgttcgttgtatgtcgggaaacgtagttcgcgagtttcggatacgtcgataatagatgacggggtttacgttgtacgtttatattaggtttcggttcgtcggaatttgggcgatttacgatgtcgagtttgttacgttgcgatagtttataggtttgttttttcgggtattcgggtggattacgaatataaattgaagttttaggatttgtcgttcgtttgcgttttcgtcgaggtataggttgttcgcggattattttgtttcgaaaattaaggtgggttttggggcgcggaggataggaatgcgggcggaggttattgaggtacgtttgtattgtttcgtttgcggggaaaggagggaggttcgttttgggcgtcgtagttgtgtatggttcgggcggttggtatcgggtgggttttagatttaaggtttgtttgtagaaggggattagtagacggggtggattcgaggtggggatatgggacgtagcggtcggagtcgtttggaggggtattcggtggtttcgatggagttattatttttgaggtattgatgaggagggacggggagtgtggttagaaggttgttttgg

SEQ ID NO: 17770 - DNA, 652 bp, Artificial Sequence
  chemically treated genomic DNA (Homo sapiens) CpG-island No: 17770
ccaaaacaaccttctaaccacactccccgtccctcctcatcaatacctcaaaaataataactccatcgaaaccaccgaatacccctccaaacgactccgaccgctacgtcccatatccccacctcgaatccaccccgtctactaatccccttctacaaacaaaccttaaatctaaaacccacccgataccaaccgcccgaaccatacacaactacgacgcccaaaacgaacctccctcctttccccgcaaacgaaacaatacaaacgtacctcaataacctccgcccgcattcctatcctccgcgccccaaaacccaccttaattttcgaaacaaaataatccgcgaacaacctatacctcgacgaaaacgcaaacgaacgacaaatcctaaaacttcaatttatattcgtaatccacccgaatacccgaaaaaacaaacctataaactatcgcaacgtaacaaactcgacatcgtaaatcgcccaaattccgacgaaccgaaacctaatataaacgtacaacgtaaaccccgtcatctattatcgacgtatccgaaactcgcgaactacgtttcccgacatacaacgaacacgaccaaaacgactaaatccacgcactacgtaactacaacgacgcgacgcgcaaattacc

SEQ ID NO: 17771 - DNA, 652 bp, Artificial Sequence
  chemically treated genomic DNA (Homo sapiens) CpG-island No: 17771
ttaaaatagttttttgattatatttttcgtttttttttattaatattttaaagatgatagttttatcgggattatcgggtatttttttaggcggtttcgatcgttgcgttttatgtttttatttcgaatttatttcgtttattggtttttttttgtagataaattttgggtttagaatttattcggtgttagtcgttcgaattatatatagttacggcgtttagggcggatttttttttttttttcgtaggcgggatagtgtaggcgtgttttaatagttttcgttcgtatttttgtttttcgcgttttagggtttattttagttttcggagtagggtggttcgcgagtagtttgtgtttcggcgagagcgtaaacgggcgataagttttagggttttagtttgtgttcgtagtttattcgaatgttcgggggggtaagtttatgggttgtcgtagcgtggtaaattcggtatcgtggatcgtttaggtttcggcgggtcgggatttgatgtgaacgtataacgtgagtttcgttatttattgtcgacgtattcggggttcgcgaattgcgtttttcggtatgtaacgggtacggttaaagcggttgaatttacgtattgcgtggttgtagcgacgcgacgcgtaagttgtt

SEQ ID NO: 17772 - DNA, 652 bp, Artificial Sequence
  chemically treated genomic DNA (Homo sapiens) CpG-island No: 17772
aacaacttacgcgtcgcgtcgctacaaccacgcaatacgtaaattcaaccgctttaaccgtacccgttacataccgaaaaacgcaattcgcgaaccccgaatacgtcgacaataaataacgaaactcacgttatacgttcacatcaaatcccgacccgccgaaacctaaacgatccacgataccgaatttaccacgctacgacaacccataaacttacccccccgaacattcgaataaactacgaacacaaactaaaaccctaaaacttatcgcccgtttacgctctcgccgaaacacaaactactcgcgaaccaccctactccgaaaactaaaataaaccctaaaacgcgaaaaacaaaaatacgaacgaaaactattaaaacacgcctacactatcccgcctacgaaaaaaaaaaaaaaatccgccctaaacgccgtaactatatataattcgaacgactaacaccgaataaattctaaacccaaaatttatctacaaaaaaaaaccaataaacgaaataaattcgaaataaaaacataaaacgcaacgatcgaaaccgcctaaaaaaatacccgataatcccgataaaactatcatctttaaaatattaataaaaaaaaacgaaaaatataatcaaaaaactattttaa

SEQ ID NO: 17773 - DNA, 666 bp, Artificial Sequence
  chemically treated genomic DNA (Homo sapiens) CpG-island No: 17773
ttggcgcgttttagtttttattttaaatttaatttaggtgaaaatggcgttacgcgcgggggcggggttagaggtataaagagagtgtttattggttgggagcggtacgggtcgtttttttcgttttattattggttcgtttcgtaaggtaagagaatttattaggggatgagttcgaattagggatgtgatagagcgcgagatttagtttaaagagagttcggagttagcgtgggaggtcgttgtcgtcgcgcgttttggtgagtgttttttattcggtttttgtttttttttttagtttttttcggttacgcggttagttttcggcgtgttagcgcgagattttttgttattcgttttttttatcgtttttttgcgtttgcgcgagatttttagttatcgtacggttgtttagaggatagaagattcgtttttttattgggtagcgggattggagggttttggttcggattgatcggttttgtgtttcgttttagcgttgtacgttagatatcggttttttaatattcgttttttttttgtaggttgacggcgttgtacgttttcgcggggaggttttggttttttaaacgttggtatcgagggttgtagttttgattcgtttttttttttttgttttttagttgtagtttttaggattacgtg

SEQ ID NO: 17774 - DNA, 666 bp, Artificial Sequence
  chemically treated genomic DNA (Homo sapiens) CpG-island No: 17774
cacgtaatcctaaaaactacaactaaaaaacaaaaaaaaaaaaacgaatcaaaactacaaccctcgataccaacgtttaaaaaaccaaaacctccccgcgaaaacgtacaacgccgtcaacctacaaaaaaaaaacgaatattaaaaaaccgatatctaacgtacaacgctaaaacgaaacacaaaaccgatcaatccgaaccaaaaccctccaatcccgctacccaataaaaaaacgaatcttctatcctctaaacaaccgtacgataactaaaaatctcgcgcaaacgcaaaaaaacgataaaaaaaacgaataacaaaaaatctcgcgctaacacgccgaaaactaaccgcgtaaccgaaaaaaactaaaaaaaaaaacaaaaaccgaataaaaaacactcaccaaaacgcgcgacgacaacgacctcccacgctaactccgaactctctttaaactaaatctcgcgctctatcacatccctaattcgaactcatcccctaataaattctcttaccttacgaaacgaaccaataataaaacgaaaaaaacgacccgtaccgctcccaaccaataaacactctctttatacctctaaccccgcccccgcgcgtaacgccattttcacctaaattaaatttaaaataaaaactaaaacgcgccaa

SEQ ID NO: 17775 - DNA, 666 bp, Artificial Sequence
  chemically treated genomic DNA (Homo sapiens) CpG-island No: 17775
tacgtagttttgaaaattgtaattgggggatagaggaaagaaaacgaattagaattataattttcggtgttagcgtttggaaagttagagttttttcgcgagagcgtgtaacgtcgttaatttgtagggaagagacggatattgaaaggtcggtgtttggcgtgtagcgttagaacggaatataaagtcggttaattcgaattagaattttttagtttcgttgtttaatgagaagacggattttttgttttttggataatcgtgcggtagttgggggtttcgcgtaggcgtaaaagggcggtggggggggcgggtggtaaagggtttcgcgttggtacgtcgagggttggtcgcgtagtcggggagagttgggggagggagtaggggtcgggtggagggtatttattaaggcgcgcgacggtagcggttttttacgttggtttcgggttttttttaggttgggtttcgcgttttgttatatttttagttcgggtttattttttagtgggtttttttgttttacggagcgagttaatggtgaagcgaagaaggcggttcgtgtcgtttttaattaatagatattttttttgtatttttagtttcgttttcgcgcgtggcgttatttttatttgagttaggtttggggtggagattgggacgcgttaa

SEQ ID NO: 17776 - DNA, 666 bp, Artificial Sequence
  chemically treated genomic DNA (Homo sapiens) CpG-island No: 17776
ttaacgcgtcccaatctccaccccaaacctaactcaaataaaaataacgccacgcgcgaaaacgaaactaaaaatacaaaaaaaatatctattaattaaaaacgacacgaaccgccttcttcgcttcaccattaactcgctccgtaaaacaaaaaaacccactaaaaaataaacccgaactaaaaatataacaaaacgcgaaacccaacctaaaaaaaacccgaaaccaacgtaaaaaaccgctaccgtcgcgcgccttaataaataccctccacccgacccctactccctcccccaactctccccgactacgcgaccaaccctcgacgtaccaacgcgaaaccctttaccacccgccccccccaccgcccttttacgcctacgcgaaacccccaactaccgcacgattatccaaaaaacaaaaaatccgtcttctcattaaacaacgaaactaaaaaattctaattcgaattaaccgactttatattccgttctaacgctacacgccaaacaccgacctttcaatatccgtctcttccctacaaattaacgacgttacacgctctcgcgaaaaaactctaactttccaaacgctaacaccgaaaattataattctaattcgttttctttcctctatcccccaattacaattttcaaaactacgta

SEQ ID NO: 17777 - DNA, 555 bp, Artificial Sequence
  chemically treated genomic DNA (Homo sapiens) CpG-island No: 17777
cgtacgtatttaggtttatatgaggcgagtgggcggtcggggttgtagttggcgttggttattgaggattttttgcgcgatagtgcgatcggttgtattttttgcgataggtgtcggtcggttggcgcgtaacgtttgttagcgtatagtttggtttttgttgcgttcggcgtcgaaaaacgggaagtcgtaaagttttttttcgtggtttatgtgcggcggcggtcgggtaaaaatttaacgatatagaattgttagtttagtagtcggttatatttcgttcggttattagtaggtagcgttcgtttatgcgcgtttttggaagaattagtagtttttatcgcgagttttgattggttttgcgtgagtggtagttttttgtgacgttataagggtgcgtttttcgtgacgttataagggcgggttttcgtcgatattatagaggtgggtcgttggcgacgttagaggcgcgggtgttcggttatattattggggcgttatggtgtttggagttgggtagtttttttattagagtggggattggtaagagtgatt

SEQ ID NO: 17778 - DNA, 555 bp, Artificial Sequence
  chemically treated genomic DNA (Homo sapiens) CpG-island No: 17778
aatcactcttaccaatccccactctaataaaaaaactacccaactccaaacaccataacgccccaataatataaccgaacacccgcgcctctaacgtcgccaacgacccacctctataatatcgacgaaaacccgcccttataacgtcacgaaaaacgcacccttataacgtcacaaaaaactaccactcacgcaaaaccaatcaaaactcgcgataaaaactactaattcttccaaaaacgcgcataaacgaacgctacctactaataaccgaacgaaatataaccgactactaaactaacaattctatatcgttaaatttttacccgaccgccgccgcacataaaccacgaaaaaaaactttacgacttcccgtttttcgacgccgaacgcaacaaaaaccaaactatacgctaacaaacgttacgcgccaaccgaccgacacctatcgcaaaaaatacaaccgatcgcactatcgcgcaaaaaatcctcaataaccaacgccaactacaaccccgaccgcccactcgcctcatataaacctaaatacgtacg

SEQ ID NO: 17779 - DNA, 555 bp, Artificial Sequence
  chemically treated genomic DNA (Homo sapiens) CpG-island No: 17779
ggttatttttattagtttttattttgatgagaaaattgtttagttttaggtattatggcgttttagtgatgtagtcgaatattcgcgtttttaacgtcgttaacggtttatttttatggtgtcggcgaagattcgtttttgtgacgttacggaaggcgtatttttgtgacgttataggggattattatttacgtagagttaattagaattcgcggtgggggttgttggtttttttaggagcgcgtatgagcggacgttgtttattggtggtcgggcgggatgtaatcggttgttgagttggtagttttgtgtcgttaggtttttgttcggtcgtcgtcgtatataagttacgaggaggagttttacgatttttcgtttttcggcgtcgggcgtagtaagggttagattatgcgttagtaggcgttgcgcgttaatcggtcggtatttgtcgtagaaggtgtaatcgatcgtattgtcgcgtagaagatttttaatggttaacgttagttgtagtttcggtcgtttattcgttttatatgagtttgggtacgtgcg

SEQ ID NO: 17780 - DNA, 555 bp, Artificial Sequence
  chemically treated genomic DNA (Homo sapiens) CpG-island No: 17780
cgcacgtacccaaactcatataaaacgaataaacgaccgaaactacaactaacgttaaccattaaaaatcttctacgcgacaatacgatcgattacaccttctacgacaaataccgaccgattaacgcgcaacgcctactaacgcataatctaacccttactacgcccgacgccgaaaaacgaaaaatcgtaaaactcctcctcgtaacttatatacgacgacgaccgaacaaaaacctaacgacacaaaactaccaactcaacaaccgattacatcccgcccgaccaccaataaacaacgtccgctcatacgcgctcctaaaaaaaccaacaacccccaccgcgaattctaattaactctacgtaaataataatcccctataacgtcacaaaaatacgccttccgtaacgtcacaaaaacgaatcttcgccgacaccataaaaataaaccgttaacgacgttaaaaacgcgaatattcgactacatcactaaaacgccataatacctaaaactaaacaattttctcatcaaaataaaaactaataaaaataacc

SEQ ID NO: 17781 - DNA, 501 bp, Artificial Sequence
  chemically treated genomic DNA (Homo sapiens) CpG-island No: 17781
tagttcgcgtgtttttgtagttcgtcgggcgtttaggttacgtttttgggcgatattggtttttcgattggatagtttaatggaggtgtggtcggaagaggcgagttttattggtagaggcgggatcgacggtgtgtgcggaatatggcggagcgcggtaggaagcggtcgtgcggttcggtaagtgcgggcggcgggatttcgtgtagggtagtatggtggaggcgtgagaattagtggcgtgggggttttcgtcggggtcgggtcgcgttttttgttgtttgtttttcgttgattttaggtcggaagttttcgaaggtgtcgcgtgagttttagtaggatgggaatagcgttcgtgtttttttcggaattttttgcggttttttggttttcgttggattacggaggcgggattttgttcgttttcggatgttgaattcggagttttttcgtggtttttggagtttttttttgatttttagggcgattgtgggtagtgtt

SEQ ID NO: 17782 - DNA, 501 bp, Artificial Sequence
  chemically treated genomic DNA (Homo sapiens) CpG-island No: 17782
aacactacccacaatcgccctaaaaatcaaaaaaaaactccaaaaaccacgaaaaaactccgaattcaacatccgaaaacgaacaaaatcccgcctccgtaatccaacgaaaaccaaaaaaccgcaaaaaattccgaaaaaaacacgaacgctattcccatcctactaaaactcacgcgacaccttcgaaaacttccgacctaaaatcaacgaaaaacaaacaacaaaaaacgcgacccgaccccgacgaaaacccccacgccactaattctcacgcctccaccatactaccctacacgaaatcccgccgcccgcacttaccgaaccgcacgaccgcttcctaccgcgctccgccatattccgcacacaccgtcgatcccgcctctaccaataaaactcgcctcttccgaccacacctccattaaactatccaatcgaaaaaccaatatcgcccaaaaacgtaacctaaacgcccgacgaactacaaaaacacgcgaacta

SEQ ID NO: 17783 - DNA, 501 bp, Artificial Sequence
  chemically treated genomic DNA (Homo sapiens) CpG-island No: 17783
agtattgtttatagtcgttttggaagttagaaaagggttttagaagttacgaaagggtttcggatttagtattcggaggcgagtagggtttcgttttcgtaatttagcgggggttagggagtcgtagggagtttcggagaggatacgggcgttgtttttattttgttgaggtttacgcggtattttcgggggttttcggtttgggattagcgggaagtaggtagtaggaggcgcggttcggtttcggcgaaggtttttacgttattggtttttacgtttttattatgttgttttgtacggggtttcgtcgttcgtatttatcgggtcgtacggtcgttttttgtcgcgtttcgttatgtttcgtatatatcgtcggtttcgtttttgttaatgagattcgtttttttcggttatatttttattaagttgtttaatcggagagttaatatcgtttaggggcgtggtttgggcgttcgacgggttgtaggggtacgcgggttg

SEQ ID NO: 17784 - DNA, 501 bp, Artificial Sequence
  chemically treated genomic DNA (Homo sapiens) CpG-island No: 17784
caacccgcgtacccctacaacccgtcgaacgcccaaaccacgcccctaaacgatattaactctccgattaaacaacttaataaaaatataaccgaaaaaaacgaatctcattaacaaaaacgaaaccgacgatatatacgaaacataacgaaacgcgacaaaaaacgaccgtacgacccgataaatacgaacgacgaaaccccgtacaaaacaacataataaaaacgtaaaaaccaataacgtaaaaaccttcgccgaaaccgaaccgcgcctcctactacctacttcccgctaatcccaaaccgaaaacccccgaaaataccgcgtaaacctcaacaaaataaaaacaacgcccgtatcctctccgaaactccctacgactccctaacccccgctaaattacgaaaacgaaaccctactcgcctccgaatactaaatccgaaaccctttcgtaacttctaaaacccttttctaacttccaaaacgactataaacaatact

SEQ ID NO: 17785 - DNA, 729 bp, Artificial Sequence
  chemically treated genomic DNA (Homo sapiens) CpG-island No: 17785
  misc_feature (150)..(150): n is either a, c, g or t
gaataaatcgaggtttcgcgaggttaggcgtcggttttttatttcgcgatcggttcggggcgcgggcgttatttggggcgcgacgttgtttaggtagaacgtgtcgtttatggttttttggttttagcggtggttggcggcggcggttangtgatcgcggtcgaagttattgtcgcggtagtcggcgttggtggtacggtggtacgcgtgtatcgagtcgttttcgcggaagtcgtattcgcgtcggtcgtcgtcgtcgcggagacgttcgggtcgtagttgttttattatttagagcgcgtcgcgggtgcgcgggtcgtagtatagtacgtacgattcgcggtttttgagttgcgttagtttcggtagttcgtatttggttagttcgttcgggtcgcggggtttttcgggtatagggggtaattcggttgtcgtcgttacgggtagtacgggtagtcggtttagtagtttcggcgtcgttcgcgcgttttttcgtcgtcgtcgttagttttcgacgatcgtatttagtttcgcgtttaacgttagggttaggtcggttcgtagcgttcgtatggtcggggagcgatttagcggcgggcgattcgcgaggtttttaaaggagtcgcgtcgcgggatttaacgagggtatagggttgttggggtcgcggacgatagcgtgattttttttttatttataaatattgttaagggtttgggtttcggaattta

SEQ ID NO: 17786 - DNA, 729 bp, Artificial Sequence
  chemically treated genomic DNA (Homo sapiens) CpG-island No: 17786
  misc_feature (580)..(580): n is either a, c, g or t
taaattccgaaacccaaacccttaacaatatttataaataaaaaaaaaatcacgctatcgtccgcgaccccaacaaccctataccctcgttaaatcccgcgacgcgactcctttaaaaacctcgcgaatcgcccgccgctaaatcgctccccgaccatacgaacgctacgaaccgacctaaccctaacgttaaacgcgaaactaaatacgatcgtcgaaaactaacgacgacgacgaaaaaacgcgcgaacgacgccgaaactactaaaccgactacccgtactacccgtaacgacgacaaccgaattaccccctatacccgaaaaaccccgcgacccgaacgaactaaccaaatacgaactaccgaaactaacgcaactcaaaaaccgcgaatcgtacgtactatactacgacccgcgcacccgcgacgcgctctaaataataaaacaactacgacccgaacgtctccgcgacgacgacgaccgacgcgaatacgacttccgcgaaaacgactcgatacacgcgtaccaccgtaccaccaacgccgactaccgcgacaataacttcgaccgcgatcacntaaccgccgccgccaaccaccgctaaaaccaaaaaaccataaacgacacgttctacctaaacaacgtcgcgccccaaataacgcccgcgccccgaaccgatcgcgaaataaaaaaccgacgcctaacctcgcgaaacctcgatttattc

SEQ ID NO: 17787 - DNA, 729 bp, Artificial Sequence
  chemically treated genomic DNA (Homo sapiens) CpG-island No: 17787
  misc_feature (580)..(580): n is either a, c, g or t
tgggtttcgaggtttaagtttttggtagtgtttgtgagtggaagggaggttacgttatcgttcgcggttttagtagttttgtgttttcgttggatttcgcgacgcggtttttttaagagtttcgcgggtcgttcgtcgttaggtcgtttttcggttatgcgggcgttgcgggtcggtttgattttggcgttgggcgcggggttgggtgcggtcgtcgagggttggcggcggcggcgggaggacgcgcgggcggcgtcgggattgttgggtcggttgttcgtgttgttcgtggcggcggtagtcgagttgttttttgtgttcgggggatttcgcggttcgggcgagttggttaagtacgggttgtcggggttggcgtagtttaagagtcgcgagtcgtacgtgttgtgttacgattcgcgtattcgcggcgcgttttgggtggtggagtagttgcgattcgagcgttttcgcggcgacggcgatcggcgcgagtgcgattttcgcgaggacgattcggtgtacgcgtattatcgtgttattaacgtcgattatcgcggtagtggtttcgatcgcggttatntggtcgtcgtcgttaattatcgttggagttagaaggttatggacgatacgttttatttgagtaacgtcgcgttttaggtagcgttcgcgtttcgggtcggtcgcggaatgaggggtcggcgtttggtttcgcggggtttcggtttgttt

SEQ ID NO: 17788 - DNA, 729 bp, Artificial Sequence
  chemically treated genomic DNA (Homo sapiens) CpG-island No: 17788
  misc_feature (150)..(150): n is either a, c, g or t
aaacaaaccgaaaccccgcgaaaccaaacgccgacccctcattccgcgaccgacccgaaacgcgaacgctacctaaaacgcgacgttactcaaataaaacgtatcgtccataaccttctaactccaacgataattaacgacgacgaccanataaccgcgatcgaaaccactaccgcgataatcgacgttaataacacgataatacgcgtacaccgaatcgtcctcgcgaaaatcgcactcgcgccgatcgccgtcgccgcgaaaacgctcgaatcgcaactactccaccacccaaaacgcgccgcgaatacgcgaatcgtaacacaacacgtacgactcgcgactcttaaactacgccaaccccgacaacccgtacttaaccaactcgcccgaaccgcgaaatcccccgaacacaaaaaacaactcgactaccgccgccacgaacaacacgaacaaccgacccaacaatcccgacgccgcccgcgcgtcctcccgccgccgccgccaaccctcgacgaccgcacccaaccccgcgcccaacgccaaaatcaaaccgacccgcaacgcccgcataaccgaaaaacgacctaacgacgaacgacccgcgaaactcttaaaaaaaccgcgtcgcgaaatccaacgaaaacacaaaactactaaaaccgcgaacgataacgtaacctcccttccactcacaaacactaccaaaaacttaaacctcgaaaccca

SEQ ID NO: 17789 - DNA, 666 bp, Artificial Sequence
  chemically treated genomic DNA (Homo sapiens) CpG-island No: 17789
tatcgcgtttttcgagtttcggcgatggagtagcgtcgggtagaggcggttatttcgtattttgcggtttttaaaacgtatattcgcgttcgtatacggggttttcgagggttttatcgttttttcggttaggagtaagttcgttttatttttcgttgtagtgaggagtttcgcgtatagtattagtagttcgagaagtaggagtagcgattggaattttttttacgtagttatgtttgtagatattttatacgtacgcgatatcgatggttttttcgaggaaggtagggttatgagcggagttaaataattattcgagggtaaggcgagtcggagagagagttcggttttaaaattcgtcgcgtattcgacgttttttgaaggtttgggcgttcggttcgttttttttttatagtatcgggtttcgagttattgtagggttgagttgtttcgagcgcggagattcgggttggcggggtcggggtcggggacgagcgtcggtcgagtcgggtaggaaggtattaaggcggcgaggttgcgggagggggagaagcggggagaggagcgcgcgtagttaggagagatttggagaggaggtagttggagagagagttagcgaatgggaaatacggggaagggggcgcgggggggaggagagatttagtt

SEQ ID NO: 17790 - DNA, 666 bp, Artificial Sequence
  chemically treated genomic DNA (Homo sapiens) CpG-island No: 17790
aactaaatctctcctcccccccgcgcccccttccccgtatttcccattcgctaactctctctccaactacctcctctccaaatctctcctaactacgcgcgctcctctccccgcttctccccctcccgcaacctcgccgccttaataccttcctacccgactcgaccgacgctcgtccccgaccccgaccccgccaacccgaatctccgcgctcgaaacaactcaaccctacaataactcgaaacccgatactataaaaaaaaaacgaaccgaacgcccaaaccttcaaaaaacgtcgaatacgcgacgaattttaaaaccgaactctctctccgactcgccttaccctcgaataattatttaactccgctcataaccctaccttcctcgaaaaaaccatcgatatcgcgtacgtataaaatatctacaaacataactacgtaaaaaaaattccaatcgctactcctacttctcgaactactaatactatacgcgaaactcctcactacaacgaaaaataaaacgaacttactcctaaccgaaaaaacgataaaaccctcgaaaaccccgtatacgaacgcgaatatacgttttaaaaaccgcaaaatacgaaataaccgcctctacccgacgctactccatcgccgaaactcgaaaaacgcgata

SEQ ID NO: 17791 - DNA, 666 bp, Artificial Sequence
  chemically treated genomic DNA (Homo sapiens) CpG-island No: 17791
gattggattttttttttttttcgcgttttttttttcgtattttttattcgttggttttttttttagttgttttttttttaggttttttttggttgcgcgcgttttttttttcgtttttttttttttcgtagtttcgtcgttttggtgtttttttgttcggttcggtcggcgttcgttttcggtttcggtttcgttagttcgggttttcgcgttcggagtagtttagttttgtagtggttcgggattcgatgttatgagagggaagcgagtcgggcgtttagatttttaggaggcgtcggatgcgcggcgggttttgggatcgggtttttttttcggttcgttttgttttcgggtgattatttggtttcgtttatagttttgtttttttcggaggagttatcggtgtcgcgtgcgtgtggagtatttgtagatatgattgcgtggaggagattttagtcgttgtttttgtttttcgggttgttggtgttgtgcgcgaggttttttattgtagcgaagggtaagacggatttgtttttggtcggggaggcggtagagttttcggaggtttcgtgtgcggacgcgagtgtgcgttttggggatcgtagggtacggagtggtcgtttttgttcggcgttgttttatcgtcgaagttcggggaacgcgatg

SEQ ID NO: 17792 - DNA, 666 bp, Artificial Sequence
  chemically treated genomic DNA (Homo sapiens) CpG-island No: 17792
catcgcgttccccgaacttcgacgataaaacaacgccgaacaaaaacgaccactccgtaccctacgatccccaaaacgcacactcgcgtccgcacacgaaacctccgaaaactctaccgcctccccgaccaaaaacaaatccgtcttacccttcgctacaataaaaaacctcgcgcacaacaccaacaacccgaaaaacaaaaacaacgactaaaatctcctccacgcaatcatatctacaaatactccacacgcacgcgacaccgataactcctccgaaaaaaacaaaactataaacgaaaccaaataatcacccgaaaacaaaacgaaccgaaaaaaaaacccgatcccaaaacccgccgcgcatccgacgcctcctaaaaatctaaacgcccgactcgcttccctctcataacatcgaatcccgaaccactacaaaactaaactactccgaacgcgaaaacccgaactaacgaaaccgaaaccgaaaacgaacgccgaccgaaccgaacaaaaaaacaccaaaacgacgaaactacgaaaaaaaaaaaaacgaaaaaaaaaacgcgcgcaaccaaaaaaaacctaaaaaaaaaacaactaaaaaaaaaaccaacgaataaaaaatacgaaaaaaaaaacgcgaaaaaaaaaaaaaatccaatc

SEQ ID NO: 17793 - DNA, 528 bp, Artificial Sequence
  chemically treated genomic DNA (Homo sapiens) CpG-island No: 17793
ttttcggcggtcgtattatgcgcggggttcggtggtgtgttgggcgaggggatacgtgcgtatttagaagcgcgtaagggggtgggggttgggtaggttattgcgtttcgcgggttgggcgagtttcgtagagggagttagtcgtgattttgagggtagtgattggttcgtcgcgtttttgtattaggtattcgttcggttttttcgtgattgttttcgggtatttttggtttttttcgatttttttttttcgcgggtttttaagtttcgtaagtttgcgacgagttggttttttagggagatagcgagcgtttattttcgttttgcggttgggtgtgtgtggtgagaggaagagacgggaggaggaggcgaggtcgattcgttaacgaggaaaacggggtgagaggggagtcgggttttttaatagtcgttagggcgtttggtacgtcgtaggtgttaacgtagtgtttattgataaggttttaaggtggaaggtgatggtaggggttcggacgttttttttttttt

SEQ ID NO: 17794 - DNA, 528 bp, Artificial Sequence
  chemically treated genomic DNA (Homo sapiens) CpG-island No: 17794
aaaaaaaaaaaaacgtccgaacccctaccatcaccttccaccttaaaaccttatcaataaacactacgttaacacctacgacgtaccaaacgccctaacgactattaaaaaacccgactcccctctcaccccgttttcctcgttaacgaatcgacctcgcctcctcctcccgtctcttcctctcaccacacacacccaaccgcaaaacgaaaataaacgctcgctatctccctaaaaaaccaactcgtcgcaaacttacgaaacttaaaaacccgcgaaaaaaaaaaatcgaaaaaaaccaaaaatacccgaaaacaatcacgaaaaaaccgaacgaatacctaatacaaaaacgcgacgaaccaatcactaccctcaaaatcacgactaactccctctacgaaactcgcccaacccgcgaaacgcaataacctacccaacccccacccccttacgcgcttctaaatacgcacgtatcccctcgcccaacacaccaccgaaccccgcgcataatacgaccgccgaaaa

SEQ ID NO: 17795 - DNA, 528 bp, Artificial Sequence
  chemically treated genomic DNA (Homo sapiens) CpG-island No: 17795
gggaagaagggggcgttcgggtttttgttattattttttattttggggttttgttaatgaatattgcgttagtatttacgacgtgttaggcgttttggcgattattggaaaattcggttttttttttatttcgtttttttcgttggcgagtcggtttcgtttttttttttcgttttttttttttattatatatatttagtcgtagagcgggggtgggcgttcgttgtttttttggagaattagttcgtcgtaaatttgcggggtttggggattcgcgagggggagaagtcgggagaggttaggggtgttcggaaataattacgagaaagtcgggcgaatgtttgatgtagggacgcggcgagttagttattgtttttagggttacggttgattttttttgcgggattcgtttagttcgcgagacgtagtgatttgtttaatttttatttttttgcgcgtttttgggtgcgtacgtgttttttcgtttaatatattatcgagtttcgcgtatggtacggtcgtcgagga

SEQ ID NO: 17796 - DNA, 528 bp, Artificial Sequence
  chemically treated genomic DNA (Homo sapiens) CpG-island No: 17796
tcctcgacgaccgtaccatacgcgaaactcgataatatattaaacgaaaaaacacgtacgcacccaaaaacgcgcaaaaaaataaaaattaaacaaatcactacgtctcgcgaactaaacgaatcccgcaaaaaaaatcaaccgtaaccctaaaaacaataactaactcgccgcgtccctacatcaaacattcgcccgactttctcgtaattatttccgaacacccctaacctctcccgacttctccccctcgcgaatccccaaaccccgcaaatttacgacgaactaattctccaaaaaaacaacgaacgcccacccccgctctacgactaaatatatataataaaaaaaaaaaacgaaaaaaaaaaacgaaaccgactcgccaacgaaaaaaacgaaataaaaaaaaaaccgaattttccaataatcgccaaaacgcctaacacgtcgtaaatactaacgcaatattcattaacaaaaccccaaaataaaaaataataacaaaaacccgaacgcccccttcttccc

SEQ ID NO: 17797 - DNA, 592 bp, Artificial Sequence
  chemically treated genomic DNA (Homo sapiens) CpG-island No: 17797
ttcgcgggtttagggtataaaaagcgtatacgtatatattaaacgttatgcgtacgcgtataataaacgttatacgttacgtacgcgcgtgttgtttttttttcgtagttagttttttttttttcgggttagtgcgtattgtttatttcgtgttataggatttcgttgagcgttaggcgtagggattggacgtatacggattttcgggagtttcggaattcgcgtttttacgttagattttatttttttttgatagagacgttttcgttttatcgtcgtcgtaggcgttaggggtttttttttatcgtcgaggtttagtcgtcgttcgttcgtttttagggtagcgcggggattttttggttttcgtttagtgtttcggggtttattcgtcgtttttcgtcgttttcggaggcgagggattgttttttataagggattggagtttagggaaggattcgtttggagcgggaggcggggatgtatatgcgtagagggagaggtcgagcgttcgagttaggttggtggatgcgatgcggggtttggaagcggcgttagacggtgtttgttagttttggtcgtaatttttagttgt

SEQ ID NO: 17798 - DNA, 592 bp, Artificial Sequence
  chemically treated genomic DNA (Homo sapiens) CpG-island No: 17798
acaactaaaaattacgaccaaaactaacaaacaccgtctaacgccgcttccaaaccccgcatcgcatccaccaacctaactcgaacgctcgacctctccctctacgcatatacatccccgcctcccgctccaaacgaatccttccctaaactccaatcccttataaaaaacaatccctcgcctccgaaaacgacgaaaaacgacgaataaaccccgaaacactaaacgaaaaccaaaaaatccccgcgctaccctaaaaacgaacgaacgacgactaaacctcgacgataaaaaaaaacccctaacgcctacgacgacgataaaacgaaaacgtctctatcaaaaaaaaataaaatctaacgtaaaaacgcgaattccgaaactcccgaaaatccgtatacgtccaatccctacgcctaacgctcaacgaaatcctataacacgaaataaacaatacgcactaacccgaaaaaaaaaaaactaactacgaaaaaaaaacaacacgcgcgtacgtaacgtataacgtttattatacgcgtacgcataacgtttaatatatacgtatacgctttttataccctaaacccgcgaa

SEQ ID NO: 17799 - DNA, 592 bp, Artificial Sequence
  chemically treated genomic DNA (Homo sapiens) CpG-island No: 17799
ataattgagggttgcggttagagttgataggtatcgtttagcgtcgtttttaagtttcgtatcgtatttattagtttaattcgggcgttcggtttttttttttgcgtatgtgtattttcgtttttcgttttaggcgagtttttttttggattttagttttttgtgggaaataatttttcgttttcggaggcggcgaggagcggcgggtgagtttcggagtattgggcgagggttagggggttttcgcgttgttttgaaggcgggcgggcggcggttagatttcggcggtggggagggatttttggcgtttgcggcgacggtgggacgagggcgtttttgttagaaggggatgaggtttggcgtgggaacgcgagtttcggggttttcgggggttcgtatgcgtttagtttttgcgtttggcgtttagcgaagttttgtagtacggggtaggtaatgcgtattggttcgaaggggagggaattggttgcggggaggggatagtacgcgcgtgcgtagcgtgtgacgtttgttgtgcgcgtgcgtatggcgtttgatgtgtgcgtgtgcgttttttgtgttttgagttcgcggg

SEQ ID NO: 17800 - DNA, 592 bp, Artificial Sequence
  chemically treated genomic DNA (Homo sapiens) CpG-island No: 17800
cccgcgaactcaaaacacaaaaaacgcacacgcacacatcaaacgccatacgcacgcgcacaacaaacgtcacacgctacgcacgcgcgtactatcccctccccgcaaccaattccctccccttcgaaccaatacgcattacctaccccgtactacaaaacttcgctaaacgccaaacgcaaaaactaaacgcatacgaacccccgaaaaccccgaaactcgcgttcccacgccaaacctcatccccttctaacaaaaacgccctcgtcccaccgtcgccgcaaacgccaaaaatccctccccaccgccgaaatctaaccgccgcccgcccgccttcaaaacaacgcgaaaaccccctaaccctcgcccaatactccgaaactcacccgccgctcctcgccgcctccgaaaacgaaaaattatttcccacaaaaaactaaaatccaaaaaaaaactcgcctaaaacgaaaaacgaaaatacacatacgcaaaaaaaaaaaccgaacgcccgaattaaactaataaatacgatacgaaacttaaaaacgacgctaaacgatacctatcaactctaaccgcaaccctcaattat

SEQ ID NO: 17801 - DNA, 1587 bp, Artificial Sequence
  chemically treated genomic DNA (Homo sapiens) CpG-island No: 17801
  misc_feature (497)..(497): n is either a, c, g or t
cgtcgttttttttttagttttttttagtattatatacgcgcgcgcgcgtatatatatatatatatatatatatatatatatacgtatacgtattttatttttagtttgttttattttaatttttcggtcgtgttagtgcgattataggagagatacggaggttcggagtggggttggggtgcgggtagtcgttggggtcgcgcgaggaggaggcggaatcgagttaggtcgtatgaaattttcgggatagatatttttcgcgtcggacgtttttgttatggcggtcggtattgaggagggttacggtcgggtcgggtcgggcgtgttgcgggaagaggaaggttcgggaggtgggatgggaaggggaggtcgagggacgggggtcgtcgcgtcgtcgttgttgttagagaggagtttgcggttggtagttcggtttgggtagtacggttttcggcgttcggttcggaattcgtacgttttttcgcggcgattagagnatagttttttcggttttcgttttcgtgttggtcgtcgtcgtcgtttttttcgtcgtcgtcgcgtataaagtttttttatttcgattttcggggcgtcgtcgtcgttaaatttttagttttttattggtcgcgggtcgcggcgtttgtcgggaaatgtagtttttggttcgggacgttggggtttcggaggaagcggcgagtcggcggggcggagggggcgggagcgcgaattaggaacgttcgcggtagttagcgtttggacgattagggagatcgggcgagagggtcgaggaacgagggacggggagggattgtacgtgggagagtgatatataaaatatttcgggaagtcggaggaggcgtggaaaggtggggttcgggaggtaaaattgggatcggcgcgtttagtgaggttgattaaagaataacgcgtaattagcgttatacggcgttttttagggtgattcggttttttagtttttaagggttagaagcgattttcgtacggttttcggtgggttatcgcgcgagggcggggtagtttaggcgatttttcggtcgtttttcgttttacggttgttagggaagggtttcggtttcggtagggtttgtatttggaaagtcgggggcgatgtaagatcgttttggcgtcgttttttttttagtttcggatgagttgttcgatggtttttttttttcggttgtaagtataggagattcggtcggcggcgtcggttcgtcgagggagcgttttgattttttcggtaggcgtcggtttcgcgcgtttttttttgttttgttgcggttcggaggtttgtgggtaatcgggaggacgacgttagcgttcgtcgtattttcgggtgttttttagtcgcgggggatcgcgacggtttcgtgatcgttacgtgtcggaggtcgcggttgttcgcggttagattttcgtatcgagggacgtgagggatatttgttttagagggtttaagataagaacgagaggaagaatcgggaggtaatttttcgttattttttagtttttcgtattttaggaaacgtatggaaaataatggaaggttaagtgtgtgtatagtga

SEQ ID NO: 17802 - DNA, 1587 bp, Artificial Sequence
  chemically treated genomic DNA (Homo sapiens) CpG-island No: 17802
  misc_feature (1091)..(1091): n is either a, c, g or t
tcactatacacacacttaaccttccattattttccatacgtttcctaaaatacgaaaaactaaaaaataacgaaaaattacctcccgattcttcctctcgttcttatcttaaaccctctaaaacaaatatccctcacgtccctcgatacgaaaatctaaccgcgaacaaccgcgacctccgacacgtaacgatcacgaaaccgtcgcgatcccccgcgactaaaaaacacccgaaaatacgacgaacgctaacgtcgtcctcccgattacccacaaacctccgaaccgcaacaaaacaaaaaaaaacgcgcgaaaccgacgcctaccgaaaaaatcaaaacgctccctcgacgaaccgacgccgccgaccgaatctcctatacttacaaccgaaaaaaaaaaaccatcgaacaactcatccgaaactaaaaaaaaaacgacgccaaaacgatcttacatcgcccccgactttccaaatacaaaccctaccgaaaccgaaacccttccctaacaaccgtaaaacgaaaaacgaccgaaaaatcgcctaaactaccccgccctcgcgcgataacccaccgaaaaccgtacgaaaatcgcttctaacccttaaaaactaaaaaaccgaatcaccctaaaaaacgccgtataacgctaattacgcgttattctttaatcaacctcactaaacgcgccgatcccaattttacctcccgaaccccacctttccacgcctcctccgacttcccgaaatattttatatatcactctcccacgtacaatccctccccgtccctcgttcctcgaccctctcgcccgatctccctaatcgtccaaacgctaactaccgcgaacgttcctaattcgcgctcccgccccctccgccccgccgactcgccgcttcctccgaaaccccaacgtcccgaaccaaaaactacatttcccgacaaacgccgcgacccgcgaccaataaaaaactaaaaatttaacgacgacgacgccccgaaaatcgaaataaaaaaactttatacgcgacgacgacgaaaaaaacgacgacgacgaccaacacgaaaacgaaaaccgaaaaaactatnctctaatcgccgcgaaaaaacgtacgaattccgaaccgaacgccgaaaaccgtactacccaaaccgaactaccaaccgcaaactcctctctaacaacaacgacgacgcgacgacccccgtccctcgacctccccttcccatcccacctcccgaaccttcctcttcccgcaacacgcccgacccgacccgaccgtaaccctcctcaataccgaccgccataacaaaaacgtccgacgcgaaaaatatctatcccgaaaatttcatacgacctaactcgattccgcctcctcctcgcgcgaccccaacgactacccgcaccccaaccccactccgaacctccgtatctctcctataatcgcactaacacgaccgaaaaattaaaataaaacaaactaaaaataaaatacgtatacgtatatatatatatatatatatatatatatatatacgcgcgcgcgcgtatataatactaaaaaaaactaaaaaaaaaacgacg

SEQ ID NO: 17803 - DNA, 1587 bp, Artificial Sequence
  chemically treated genomic DNA (Homo sapiens) CpG-island No: 17803
  misc_feature (1091)..(1091): n is either a, c, g or t
ttattgtgtatatatttaattttttattgttttttatacgttttttaggatgcggggggttagaggatgacggagagttgtttttcggttttttttttcgtttttattttgggttttttaggataaatgttttttacgtttttcgatgcgaaggtttggtcgcgagtagtcgcggttttcggtacgtgacggttacggagtcgtcgcggtttttcgcggttggggggtattcggggatgcggcgggcgttgacgtcgttttttcggttatttataagttttcgggtcgtagtaaaataggaagaggcgcgcggggtcggcgtttgtcggggaggttaaggcgttttttcggcgagtcggcgtcgtcggtcgggttttttatgtttgtaatcgggggagggggattatcggatagtttattcggggttgagagggagacgacgttaaggcggttttgtatcgttttcggttttttaaatgtagattttatcggaatcggagtttttttttgatagtcgtaggacgggagacggtcgaggggtcgtttggattgtttcgttttcgcgcggtgatttatcggggatcgtgcgagggtcgtttttaatttttaagagttagagagtcgagttattttgaggagcgtcgtatggcgttggttgcgcgttgttttttaattagttttattgaacgcgtcgattttagttttatttttcgggttttatttttttacgtttttttcggtttttcggggtgttttgtgtgttatttttttacgtatagttttttttcgtttttcgtttttcggttttttcgttcggtttttttagtcgtttagacgttagttgtcgcgggcgtttttggttcgcgttttcgtttttttcgtttcgtcgattcgtcgtttttttcggagttttagcgtttcgaattagagattgtatttttcggtaggcgtcgcggttcgcggttaatgaggggttgaggatttggcggcggcggcgtttcgagagtcggggtgggggggttttgtgcgcggcggcggcgggagaggcggcggcggcggttagtacggaggcggaggtcgagggggttgtnttttagtcgtcgcggagaggcgtgcgaatttcgagtcgagcgtcgaggatcgtgttatttaggtcgggttgttagtcgtaggtttttttttggtagtagcggcggcgcggcgattttcgtttttcggttttttttttttattttatttttcgagttttttttttttcgtagtacgttcggttcggttcggtcgtggttttttttagtgtcggtcgttatggtagaggcgttcggcgcggggaatatttatttcggggattttatgcggtttagttcggtttcgtttttttttcgcgcggttttagcggttgttcgtattttagttttatttcgggttttcgtgttttttttgtgatcgtattgatacggtcggggggttagaatggaataaattgaaggtaaagtgcgtgtgcgtgtgtgtatgtgtgtgtgtgtgtgtgtgtgtgtgcgcgcgcgcgcgtgtgtagtgttaggaagggttgaggagggaacgacg

SEQ ID NO: 17804 - DNA, 1587 bp, Artificial Sequence
  chemically treated genomic DNA (Homo sapiens) CpG-island No: 17804
  misc_feature (497)..(497): n is either a, c, g or t
cgtcgttccctcctcaacccttcctaacactacacacgcgcgcgcgcgcacacacacacacacacacacacacatacacacacgcacacgcactttaccttcaatttattccattctaaccccccgaccgtatcaatacgatcacaaaaaaaacacgaaaacccgaaataaaactaaaatacgaacaaccgctaaaaccgcgcgaaaaaaaaacgaaaccgaactaaaccgcataaaatccccgaaataaatattccccgcgccgaacgcctctaccataacgaccgacactaaaaaaaaccacgaccgaaccgaaccgaacgtactacgaaaaaaaaaaaactcgaaaaataaaataaaaaaaaaaaaccgaaaaacgaaaatcgccgcgccgccgctactaccaaaaaaaaacctacgactaacaacccgacctaaataacacgatcctcgacgctcgactcgaaattcgcacgcctctccgcgacgactaaaanacaaccccctcgacctccgcctccgtactaaccgccgccgccgcctctcccgccgccgccgcgcacaaaacccccccaccccgactctcgaaacgccgccgccgccaaatcctcaacccctcattaaccgcgaaccgcgacgcctaccgaaaaatacaatctctaattcgaaacgctaaaactccgaaaaaaacgacgaatcgacgaaacgaaaaaaacgaaaacgcgaaccaaaaacgcccgcgacaactaacgtctaaacgactaaaaaaaccgaacgaaaaaaccgaaaaacgaaaaacgaaaaaaaactatacgtaaaaaaataacacacaaaacaccccgaaaaaccgaaaaaaacgtaaaaaaataaaacccgaaaaataaaactaaaatcgacgcgttcaataaaactaattaaaaaacaacgcgcaaccaacgccatacgacgctcctcaaaataactcgactctctaactcttaaaaattaaaaacgaccctcgcacgatccccgataaatcaccgcgcgaaaacgaaacaatccaaacgacccctcgaccgtctcccgtcctacgactatcaaaaaaaaactccgattccgataaaatctacatttaaaaaaccgaaaacgatacaaaaccgccttaacgtcgtctccctctcaaccccgaataaactatccgataatccccctcccccgattacaaacataaaaaacccgaccgacgacgccgactcgccgaaaaaacgccttaacctccccgacaaacgccgaccccgcgcgcctcttcctattttactacgacccgaaaacttataaataaccgaaaaaacgacgtcaacgcccgccgcatccccgaataccccccaaccgcgaaaaaccgcgacgactccgtaaccgtcacgtaccgaaaaccgcgactactcgcgaccaaaccttcgcatcgaaaaacgtaaaaaacatttatcctaaaaaacccaaaataaaaacgaaaaaaaaaaccgaaaaacaactctccgtcatcctctaaccccccgcatcctaaaaaacgtataaaaaacaataaaaaattaaatatatacacaataa

SEQ ID NO: 17805 - DNA, 650 bp, Artificial Sequence
  chemically treated genomic DNA (Homo sapiens) CpG-island No: 17805
ggtcgcgatttggtgggtcgcgttgtttttttttttttcggatttcgttcggttcgtattttgttttttttattagagtatgatttaggtttttgatagtttttagtttttatcgcgttttttttatttacgattttattttcgttagttttttagtatagcgcgaattttgaagttcggttttttttttttttttttcgtatagcgcgtttcgttttttttttcgttttaggttttgttttttttttttcggttttatttttaataatttcgattatttacgagggtcgtcgttttcgtgtttgttttattttcgtattagaaaattaaagtatattttttagatttcgtcgtatgtaggtcgcgtatatattaggcgcgtcgaagtcgtcgggcgaggaagtcgagggcgcgttttgttttcgtgtggtgatgggtaaagtcgagggagttcgggagtagcgggcgtggggcggcgttaatgcgagtgcgagtggtgttcgtcgttcgggagcgttcgggttcgagcggattaatcgtcgttttaggtgtcgttttttgttcgcgaaatattatttatcgttagtgtgggtttataggtttcgagtttttgttgaaaatgttagttttgtggttaaggtttttattta

SEQ ID NO: 17806 - DNA, 650 bp, Artificial Sequence
  chemically treated genomic DNA (Homo sapiens) CpG-island No: 17806
taaataaaaaccttaaccacaaaactaacattttcaacaaaaactcgaaacctataaacccacactaacgataaataatatttcgcgaacaaaaaacgacacctaaaacgacgattaatccgctcgaacccgaacgctcccgaacgacgaacaccactcgcactcgcattaacgccgccccacgcccgctactcccgaactccctcgactttacccatcaccacacgaaaacaaaacgcgccctcgacttcctcgcccgacgacttcgacgcgcctaatatatacgcgacctacatacgacgaaatctaaaaaatatactttaattttctaatacgaaaataaaacaaacacgaaaacgacgaccctcgtaaataatcgaaattattaaaaataaaaccgaaaaaaaaaaaacaaaacctaaaacgaaaaaaaaaacgaaacgcgctatacgaaaaaaaaaaaaaaaaaaccgaacttcaaaattcgcgctatactaaaaaactaacgaaaataaaatcgtaaataaaaaaaacgcgataaaaactaaaaactatcaaaaacctaaatcatactctaataaaaaaaacaaaatacgaaccgaacgaaatccgaaaaaaaaaaaaacaacgcgacccaccaaatcgcgacc

SEQ ID NO: 17807 - DNA, 650 bp, Artificial Sequence
  chemically treated genomic DNA (Homo sapiens) CpG-island No: 17807
tgaatagaaattttagttatagagttgatatttttaataggggttcgaaatttgtggatttatattaacggtgggtggtgtttcgcgggtaggagacgatatttgaggcggcggttaattcgttcgggttcgggcgttttcgggcggcggatattattcgtattcgtattggcgtcgttttacgttcgttgttttcgggttttttcggttttgtttattattatacgggagtaaaacgcgttttcggttttttcgttcggcggtttcggcgcgtttgatgtgtgcgcggtttgtatgcggcggggtttgggggatatgttttggttttttggtgcggaggtgggataggtacgggaacgacgattttcgtggatgatcggggttgttggaaatgaagtcgaggagaaagaagtagggtttgggacggaaaaaaggacggagcgcgttgtgcggggaagggggaagagaggtcgagttttagagttcgcgttgtgttggggaattggcggggatgaggtcgtgggtggagagagcgcggtgggaattggaagttgttagaagtttggattatgttttgatgagaggagtaggatgcggatcgagcgggattcggaggaaaaaaaggtagcgcggtttattaggtcgcggtt

SEQ ID NO: 17808 - DNA, 650 bp, Artificial Sequence
  chemically treated genomic DNA (Homo sapiens) CpG-island No: 17808
aaccgcgacctaataaaccgcgctacctttttttcctccgaatcccgctcgatccgcatcctactcctctcatcaaaacataatccaaacttctaacaacttccaattcccaccgcgctctctccacccacgacctcatccccgccaattccccaacacaacgcgaactctaaaactcgacctctcttcccccttccccgcacaacgcgctccgtccttttttccgtcccaaaccctacttctttctcctcgacttcatttccaacaaccccgatcatccacgaaaatcgtcgttcccgtacctatcccacctccgcaccaaaaaaccaaaacatatcccccaaaccccgccgcatacaaaccgcgcacacatcaaacgcgccgaaaccgccgaacgaaaaaaccgaaaacgcgttttactcccgtataataataaacaaaaccgaaaaaacccgaaaacaacgaacgtaaaacgacgccaatacgaatacgaataatatccgccgcccgaaaacgcccgaacccgaacgaattaaccgccgcctcaaatatcgtctcctacccgcgaaacaccacccaccgttaatataaatccacaaatttcgaacccctattaaaaatatcaactctataactaaaatttctattca

SEQ ID NO: 17809 - DNA, 903 bp, Artificial Sequence
  chemically treated genomic DNA (Homo sapiens) CpG-island No: 17809
tagaatttcggggttattggcgggagcgtcgcggaggaatcgaattttatttattttttcggcgcgttattattttaaagtttgagagcgtttgaggtcgagaaaatggtcgtaaaggaggaagtagtcgggcgtgtggttgtcggtagcgcgggttttcgtcggttcgggaaacgcggttttagggatttcggcgttttttcgtcggtcgtcgcggggtgatatgttttttcgttttttttttcgggttcgtcggtttatttcgttcgtcgtcgtcgttcgagttttatggtcgttcgttcgttcggtcgatcgcggagttcggcgtttatcgttcgtcggttgttggaagtttatatacgcgtagtttaaggagcggcgggtgattatgtttttgtagattcggatggagaggatgggttcggtcgggttgaatttttcgtagagtatcgtttcggttacgtcggggtggaggttttttacgtagagcgaggttatggggtagttgggggtattggggtttatttcggtacggttgttcgtagggttataggtcgcgattttttcgtgagaggaggagagcgagtgtcggggttgggggtcggagtcggggggaggggagcggggagtaagcgtagagggataaaaattaatcggaattgaaaattatttaacggtcgtagaacggggtcgatttattgtcgttggttgtcggttgtcggcggggagcgagggtggcggtgtcgggttcgggtagcgggaaggtttcggttttttggtttttttttggagttgttgcggggtcgcgggcgggcgggtcggtttcggttgttttatcgggttattttataaaagaggaagaaaaaaaataaaagttttcggcgggggagacgcggatttttt

SEQ ID NO: 17810 - DNA, 903 bp, Artificial Sequence
  chemically treated genomic DNA (Homo sapiens) CpG-island No: 17810
aaaaaatccgcgtctcccccgccgaaaacttttattttttttcttcctcttttataaaataacccgataaaacaaccgaaaccgacccgcccgcccgcgaccccgcaacaactccaaaaaaaaaccaaaaaaccgaaaccttcccgctacccgaacccgacaccgccaccctcgctccccgccgacaaccgacaaccaacgacaataaatcgaccccgttctacgaccgttaaataattttcaattccgattaatttttatccctctacgcttactccccgctcccctccccccgactccgacccccaaccccgacactcgctctcctcctctcacgaaaaaatcgcgacctataaccctacgaacaaccgtaccgaaataaaccccaatacccccaactaccccataacctcgctctacgtaaaaaacctccaccccgacgtaaccgaaacgatactctacgaaaaattcaacccgaccgaacccatcctctccatccgaatctacaaaaacataatcacccgccgctccttaaactacgcgtatataaacttccaacaaccgacgaacgataaacgccgaactccgcgatcgaccgaacgaacgaacgaccataaaactcgaacgacgacgacgaacgaaataaaccgacgaacccgaaaaaaaaaacgaaaaaacatatcaccccgcgacgaccgacgaaaaaacgccgaaatccctaaaaccgcgtttcccgaaccgacgaaaacccgcgctaccgacaaccacacgcccgactacttcctcctttacgaccattttctcgacctcaaacgctctcaaactttaaaataataacgcgccgaaaaaataaataaaattcgattcctccgcgacgctcccgccaataaccccgaaattcta

SEQ ID NO: 17811 - DNA, 903 bp, Artificial Sequence
  chemically treated genomic DNA (Homo sapiens) CpG-island No: 17811
aaaaaattcgcgtttttttcgtcggagatttttatttttttttttttttttttataaaataattcggtgaagtagtcgagatcgattcgttcgttcgcggtttcgtagtagttttaagaaggaattaagagatcgaggttttttcgttgttcggattcgatatcgttattttcgtttttcgtcggtagtcggtagttagcggtagtggatcgatttcgttttgcggtcgttgagtagtttttaatttcggttgatttttgtttttttgcgtttgtttttcgttttttttttttcggtttcggtttttagtttcggtattcgtttttttttttttacggaaaggtcgcggtttgtggttttgcgggtagtcgtgtcgagatgaattttagtgtttttagttattttatggtttcgttttacgtgggggatttttatttcgacgtgatcgaggcgatgttttacgagaagtttagttcggtcgggtttattttttttattcgggtttgtagggatatgattattcgtcgttttttgggttacgcgtatgtgaatttttagtagtcggcggacggtgagcgtcgggtttcgcggtcggtcgggcgggcgggcggttatgaggttcgggcggcggcggcgggcggggtaggtcggcgggttcggggaggggggcgggagggtatgttatttcgcgacggtcggcgggaaggcgtcggggtttttggagtcgcgtttttcgagtcggcggggattcgcgttgtcggtagttatacgttcggttatttttttttttgcgattattttttcggttttagacgtttttaaattttagggtgatgacgcgtcgggagggtgggtgagattcggttttttcgcggcgttttcgttagtggtttcgggattttg

SEQ ID NO: 17812 - DNA, 903 bp, Artificial Sequence
  chemically treated genomic DNA (Homo sapiens) CpG-island No: 17812
caaaatcccgaaaccactaacgaaaacgccgcgaaaaaaccgaatctcacccaccctcccgacgcgtcatcaccctaaaatttaaaaacgtctaaaaccgaaaaaataatcgcaaaaaaaaaaataaccgaacgtataactaccgacaacgcgaatccccgccgactcgaaaaacgcgactccaaaaaccccgacgccttcccgccgaccgtcgcgaaataacataccctcccgcccccctccccgaacccgccgacctaccccgcccgccgccgccgcccgaacctcataaccgcccgcccgcccgaccgaccgcgaaacccgacgctcaccgtccgccgactactaaaaattcacatacgcgtaacccaaaaaacgacgaataatcatatccctacaaacccgaataaaaaaaataaacccgaccgaactaaacttctcgtaaaacatcgcctcgatcacgtcgaaataaaaatcccccacgtaaaacgaaaccataaaataactaaaaacactaaaattcatctcgacacgactacccgcaaaaccacaaaccgcgacctttccgtaaaaaaaaaaaaacgaataccgaaactaaaaaccgaaaccgaaaaaaaaaaaacgaaaaacaaacgcaaaaaaacaaaaatcaaccgaaattaaaaactactcaacgaccgcaaaacgaaatcgatccactaccgctaactaccgactaccgacgaaaaacgaaaataacgatatcgaatccgaacaacgaaaaaacctcgatctcttaattccttcttaaaactactacgaaaccgcgaacgaacgaatcgatctcgactacttcaccgaattattttataaaaaaaaaaaaaaaaaaataaaaatctccgacgaaaaaaacgcgaatttttt

SEQ ID NO: 17813 - DNA, 876 bp, Artificial Sequence
  chemically treated genomic DNA (Homo sapiens) CpG-island No: 17813
cgttttttgtattttttatttatatttcgcgtcgtattcgtttcgttttcgcgcgtttgacgttagggtttttacgcgagcgttagcgtcggattaggaggagacgcggaggttagggggaggagggaagagaaaataggaagaaagagtagagaggaagggagaggtcgcgtcggtggaggttgcggtgtggggatggggttcgggcgaaggggcggggtttttgcgtaggcgttgcggtcggggaagcggagtcgcgttgcgtcgcgttcgtgggggtggggaggacggttcgcgggcggttatcgggggtgttggttgaggagttttcgtttttcgtttcgttcgtttttgtttttattaggaggagcgttaattagttatcgcggcggtgggcggtgtaaagggttttcgggttttttcgcgttaattattttttacgtgcgcggtcgtttgtggttttttttcgttgcggtcggttcggtttttttagttttagtttcgggggacgtcgggtacgggtgagcgggcgtggtttttttcgggttcggttttcgaaacgtgcgtagatggagttagcgtggttttttgtttttttttattcggatcgtattacgagttttagtcggtatcgtcgttacgcgcgtcggtcgtagaagcggtgtttgttgggagttggagtttttaacggtcgcggcgttcgttgatattaattggttgcgcgggttttggtcgttcgtttcgggattttttaatcgttttgcgcgttggatttcggtatcgttggagttttcggcgcggggttggggggtagggagagagaggggagggtttttcgggtttttcgttttttttttttttagttcgatttttttt

SEQ ID NO: 17814 - DNA, 876 bp, Artificial Sequence
  chemically treated genomic DNA (Homo sapiens) CpG-island No: 17814
aaaaaaaatcgaactaaaaaaaaaaaaaacgaaaaacccgaaaaaccctcccctctctctccctaccccccaaccccgcgccgaaaactccaacgataccgaaatccaacgcgcaaaacgattaaaaaatcccgaaacgaacgaccaaaacccgcgcaaccaattaatatcaacgaacgccgcgaccgttaaaaactccaactcccaacaaacaccgcttctacgaccgacgcgcgtaacgacgataccgactaaaactcgtaatacgatccgaataaaaaaaaacaaaaaaccacgctaactccatctacgcacgtttcgaaaaccgaacccgaaaaaaaccacgcccgctcacccgtacccgacgtcccccgaaactaaaactaaaaaaaccgaaccgaccgcaacgaaaaaaaaccacaaacgaccgcgcacgtaaaaaataattaacgcgaaaaaacccgaaaaccctttacaccgcccaccgccgcgataactaattaacgctcctcctaataaaaacaaaaacgaacgaaacgaaaaacgaaaactcctcaaccaacacccccgataaccgcccgcgaaccgtcctccccacccccacgaacgcgacgcaacgcgactccgcttccccgaccgcaacgcctacgcaaaaaccccgccccttcgcccgaaccccatccccacaccgcaacctccaccgacgcgacctctcccttcctctctactctttcttcctattttctcttccctcctccccctaacctccgcgtctcctcctaatccgacgctaacgctcgcgtaaaaaccctaacgtcaaacgcgcgaaaacgaaacgaatacgacgcgaaatataaataaaaaatacaaaaaacg

SEQ ID NO: 17815 - DNA, 876 bp, Artificial Sequence
  chemically treated genomic DNA (Homo sapiens) CpG-island No: 17815
gaggagggtcgggttggaaaagaagaggacgaggaattcgaggggtttttttttttttttttttgttttttaatttcgcgtcgggagttttagcggtgtcggggtttagcgcgtaggacggttggggggtttcggagcgggcggttaggattcgcgtagttagttggtgttagcgagcgtcgcggtcgttggggattttagtttttagtaggtatcgtttttgcggtcgacgcgcgtggcggcggtgtcggttgggattcgtagtgcggttcgggtaggagagagtagggggttacgttggttttatttacgtacgtttcggaaatcgggttcggaggggattacgttcgtttattcgtgttcggcgtttttcggagttggggttagaggagtcgggtcggtcgtagcgggaagaggttataggcggtcgcgtacgtggggggtggttagcgcggaggaattcggaagttttttgtatcgtttatcgtcgcggtgattggttaacgttttttttggtggaggtaggggcgggcggggcggaaggcggggattttttagttaatattttcgatgatcgttcgcgagtcgttttttttatttttacggacgcgacgtagcgcggtttcgttttttcggtcgtagcgtttgcgtaaaagtttcgttttttcgttcgagttttatttttatatcgtagtttttatcggcgcgatttttttttttttttttgttttttttttttgttttttttttttttttttttttggttttcgcgtttttttttaattcggcgttgacgttcgcgtaggggttttggcgttagacgcgcgggggcggggcgagtgcggcgcggggtataagtagagggtgtaggaggcg

SEQ ID NO: 17816 - DNA, 876 bp, Artificial Sequence
  chemically treated genomic DNA (Homo sapiens) CpG-island No: 17816
cgcctcctacaccctctacttataccccgcgccgcactcgccccgcccccgcgcgtctaacgccaaaacccctacgcgaacgtcaacgccgaattaaaaaaaaacgcgaaaaccaaaaaaaaaaaaaaaaaaaaaacaaaaaaaaaaaacaaaaaaaaaaaaaaaaatcgcgccgataaaaactacgatataaaaataaaactcgaacgaaaaaacgaaacttttacgcaaacgctacgaccgaaaaaacgaaaccgcgctacgtcgcgtccgtaaaaataaaaaaaacgactcgcgaacgatcatcgaaaatattaactaaaaaatccccgccttccgccccgcccgcccctacctccaccaaaaaaaacgttaaccaatcaccgcgacgataaacgatacaaaaaacttccgaattcctccgcgctaaccaccccccacgtacgcgaccgcctataacctcttcccgctacgaccgacccgactcctctaaccccaactccgaaaaacgccgaacacgaataaacgaacgtaatcccctccgaacccgatttccgaaacgtacgtaaataaaaccaacgtaaccccctactctctcctacccgaaccgcactacgaatcccaaccgacaccgccgccacgcgcgtcgaccgcaaaaacgatacctactaaaaactaaaatccccaacgaccgcgacgctcgctaacaccaactaactacgcgaatcctaaccgcccgctccgaaaccccccaaccgtcctacgcgctaaaccccgacaccgctaaaactcccgacgcgaaattaaaaaacaaaaaaaaaaaaaaaaaaacccctcgaattcctcgtcctcttcttttccaacccgaccctcctc

SEQ ID NO: 17817 - DNA, 858 bp, Artificial Sequence
  chemically treated genomic DNA (Homo sapiens) CpG-island No: 17817
ttgcgtttttcgcgggagtgttggcggcgggggtcgttttgcgcggggatattgggtagagggggcgtgcggtttttttaggaagttttttcggagttttagatattggcgaggcgtcgcgtttttttttttggatttcggcgcgttttttgaattcgggagttacgagcggagtcgtttttttttgtagtcgttttgggtttggcgcggacgtatttttcggtcgatttcgagtcgttgtagtcggcgtttttgcggtttttaattcgcgttgtttcgttcgtagcggaggtttcgtaattcgcgcgataggggtttgggtttcggacgtttagttaggagtcgagtcgttagtcgttcgtatttcgggttaatagggttcgttgtcgtttttgtagttacgtttacgcggcggcgatgcgtaggcgtagaagttcggaatattttcgtttagtttttgggttcggtcggattgagttcgttgttgtttcggtttttttcgagtcggttttaattgttaggtgggcggtcgggcgggcggtcgaggcggtagcgcgaggtcggggaggggcgcggtgcggggtcgggtttttgcgtgggcgatttcgtttattttttttttttcggttttgcgtagttcgggttggcgttatgtacgtcgtgtataaataggcgtattcgtttatcggtttggagttttttatgtattgtaatttttttaataatagcgagcgtaatttggtagtggtcgggatttcgtagttttacgtgtatcgttttaatcgcgacgtcgaggtaggtcgggttttgggagtttttttcgttgttcgcgaagtgggtgtttttatcgttttcggt

SEQ ID NO: 17818 - DNA, 858 bp, Artificial Sequence
  chemically treated genomic DNA (Homo sapiens) CpG-island No: 17818
accgaaaacgataaaaacacccacttcgcgaacaacgaaaaaaactcccaaaacccgacctacctcgacgtcgcgattaaaacgatacacgtaaaactacgaaatcccgaccactaccaaattacgctcgctattattaaaaaaattacaatacataaaaaactccaaaccgataaacgaatacgcctatttatacacgacgtacataacgccaacccgaactacgcaaaaccgaaaaaaaaaaaataaacgaaatcgcccacgcaaaaacccgaccccgcaccgcgcccctccccgacctcgcgctaccgcctcgaccgcccgcccgaccgcccacctaacaattaaaaccgactcgaaaaaaaccgaaacaacaacgaactcaatccgaccgaacccaaaaactaaacgaaaatattccgaacttctacgcctacgcatcgccgccgcgtaaacgtaactacaaaaacgacaacgaaccctattaacccgaaatacgaacgactaacgactcgactcctaactaaacgtccgaaacccaaacccctatcgcgcgaattacgaaacctccgctacgaacgaaacaacgcgaattaaaaaccgcaaaaacgccgactacaacgactcgaaatcgaccgaaaaatacgtccgcgccaaacccaaaacgactacaaaaaaaaacgactccgctcgtaactcccgaattcaaaaaacgcgccgaaatccaaaaaaaaaaacgcgacgcctcgccaatatctaaaactccgaaaaaacttcctaaaaaaaccgcacgccccctctacccaatatccccgcgcaaaacgacccccgccgccaacactcccgcgaaaaacgcaa

SEQ ID NO: 17819 - DNA, 858 bp, Artificial Sequence
  chemically treated genomic DNA (Homo sapiens) CpG-island No: 17819
atcgggggcggtgagagtatttatttcgcggatagcggggagggtttttagggttcgatttatttcggcgtcgcggttgaggcggtatacgtagagttgcgaggtttcggttattattaggttgcgttcgttgttgttgaagaagttgtagtatatggagaattttagatcggtgggcggatgcgtttgtttgtatacggcgtatatggcgttaattcgggttgcgtaaggtcgggagaggaagggtgagcggggtcgtttacgtaggagttcggtttcgtatcgcgttttttttcggtttcgcgttgtcgtttcggtcgttcgttcggtcgtttatttggtagttggagtcgattcgagaggaatcgggatagtagcgaatttagttcggtcgggtttagaagttgggcgggaatgtttcgggtttttgcgtttgcgtatcgtcgtcgcgtgagcgtggttgtaggggcgatagcgggttttattggttcgggatgcgggcggttggcggttcggtttttggttgggcgttcggaatttaaatttttatcgcgcgaattgcggggttttcgttgcgggcggagtagcgcgggttggaagtcgtaggggcgtcggttgtagcggttcggggtcggtcggggggtgcgttcgcgttagatttaggacggttgtagggagaagcgatttcgttcgtagttttcgggtttagggggcgcgtcggaatttagaagagggggcgcggcgtttcgttagtgtttggggtttcgagaaagttttttagagaggtcgtacgttttttttgtttagtgttttcgcgtagagcgattttcgtcgttaatattttcgcggaggacgtag

SEQ ID NO: 17820 - DNA, 858 bp, Artificial Sequence
  chemically treated genomic DNA (Homo sapiens) CpG-island No: 17820
ctacgtcctccgcgaaaatattaacgacgaaaatcgctctacgcgaaaacactaaacaaaaaaaacgtacgacctctctaaaaaactttctcgaaaccccaaacactaacgaaacgccgcgccccctcttctaaattccgacgcgccccctaaacccgaaaactacgaacgaaatcgcttctccctacaaccgtcctaaatctaacgcgaacgcaccccccgaccgaccccgaaccgctacaaccgacgcccctacgacttccaacccgcgctactccgcccgcaacgaaaaccccgcaattcgcgcgataaaaatttaaattccgaacgcccaaccaaaaaccgaaccgccaaccgcccgcatcccgaaccaataaaacccgctatcgcccctacaaccacgctcacgcgacgacgatacgcaaacgcaaaaacccgaaacattcccgcccaacttctaaacccgaccgaactaaattcgctactatcccgattcctctcgaatcgactccaactaccaaataaacgaccgaacgaacgaccgaaacgacaacgcgaaaccgaaaaaaaacgcgatacgaaaccgaactcctacgtaaacgaccccgctcacccttcctctcccgaccttacgcaacccgaattaacgccatatacgccgtatacaaacaaacgcatccgcccaccgatctaaaattctccatatactacaacttcttcaacaacaacgaacgcaacctaataataaccgaaacctcgcaactctacgtataccgcctcaaccgcgacgccgaaataaatcgaaccctaaaaaccctccccgctatccgcgaaataaatactctcaccgcccccgat

SEQ ID NO: 17821 - DNA, 1099 bp, Artificial Sequence
  chemically treated genomic DNA (Homo sapiens) CpG-island No: 17821
agaagcgcgttagggacgttattgtaagttgcgtgcgtagaaattaacgcgttgggtggcgggcgacgcgagtcgtcgcggatatcggttcggatagttggatcgtggcgtattaggcgttttttaaatgattgttcggagtgattcgtcgagatttcgtgtgtatataagtgggacgaggggcgggcgtatagcggttaggaagtcggggtttagcgtattttttagcggattatttcgtttcgtggggtcggataggatttcgggattacgcgggagcgatgtaaggttcgttttcgttgcgcgtatttgcggttcgtagtttcggttttgggagttgttacggtttttagggtgttttgcgtcggtgcggtcgcggcgattacgatttttagggtgttttgcgtcggcgcgttcgcggcgattacgatttttagggtgttttgcgtttcgttagtttttttaggtttcgttttaggtcggtcgcggattataaatggacgagagaggcggtcgtttattagttagcggtttcggagtaacgtagtcgttgtttttgaggtcgacgggtttgacgcgggcgggttgaacgcgttggtgaggcggttattcgggttacggcggtcggtagggggtagtggcggtcgttgtttagggttcggaggtggggtcgcgcgtttcgggcgttacgaattcggtaggtttacgtttggttgcggtcgggtgcgggttgaggttatgggcgatcgcggtagttttcggcgtcggaggatagggtcgcggttttcgagttacggcggcggcgggtttgcggcggcggaagaggaggtgcgggacgtcgttgcgggtttcgacgtgggagtcgcgggggacgcgttagtttcggtttttaataaggacggagacgtcggcgtgggtagcggttattgggagttgaggtagcggagcgtttgattttttaatttttgatttaagggtttcgcgatttttcggggttggtcgaagcgcgagtttcgagttcgagaatatgggttttgggttaagcggggatcggtgtgttttatgggttttgtggggaaattgaggtttggggagagtt

SEQ ID NO: 17822 - DNA, 1099 bp, Artificial Sequence
  chemically treated genomic DNA (Homo sapiens) CpG-island No: 17822
aactctccccaaacctcaatttccccacaaaacccataaaacacaccgatccccgcttaacccaaaacccatattctcgaactcgaaactcgcgcttcgaccaaccccgaaaaatcgcgaaacccttaaatcaaaaattaaaaaatcaaacgctccgctacctcaactcccaataaccgctacccacgccgacgtctccgtccttattaaaaaccgaaactaacgcgtcccccgcgactcccacgtcgaaacccgcaacgacgtcccgcacctcctcttccgccgccgcaaacccgccgccgccgtaactcgaaaaccgcgaccctatcctccgacgccgaaaactaccgcgatcgcccataacctcaacccgcacccgaccgcaaccaaacgtaaacctaccgaattcgtaacgcccgaaacgcgcgaccccacctccgaaccctaaacaacgaccgccactaccccctaccgaccgccgtaacccgaataaccgcctcaccaacgcgttcaacccgcccgcgtcaaacccgtcgacctcaaaaacaacgactacgttactccgaaaccgctaactaataaacgaccgcctctctcgtccatttataatccgcgaccgacctaaaacgaaacctaaaaaaactaacgaaacgcaaaacaccctaaaaatcgtaatcgccgcgaacgcgccgacgcaaaacaccctaaaaatcgtaatcgccgcgaccgcaccgacgcaaaacaccctaaaaaccgtaacaactcccaaaaccgaaactacgaaccgcaaatacgcgcaacgaaaacgaaccttacatcgctcccgcgtaatcccgaaatcctatccgaccccacgaaacgaaataatccgctaaaaaatacgctaaaccccgacttcctaaccgctatacgcccgcccctcgtcccacttatatacacacgaaatctcgacgaatcactccgaacaatcatttaaaaaacgcctaatacgccacgatccaactatccgaaccgatatccgcgacgactcgcgtcgcccgccacccaacgcgttaatttctacgcacgcaacttacaataacgtccctaacgcgcttct

SEQ ID NO: 17823 - DNA, 1099 bp, Artificial Sequence
  chemically treated genomic DNA (Homo sapiens) CpG-island No: 17823
gattttttttaagttttagtttttttatagggtttatagggtatatcgattttcgtttagtttagggtttatgttttcggattcggagttcgcgtttcggttaatttcggaaagtcgcggggtttttgggttagaggttagggggttaggcgtttcgttattttagtttttagtggtcgttgtttacgtcggcgttttcgtttttgttgggggtcggggttggcgcgtttttcgcggtttttacgtcggggttcgtagcggcgtttcgtattttttttttcgtcgtcgtaggttcgtcgtcgtcgtggttcgagggtcgcgattttgtttttcggcgtcgggagttgtcgcggtcgtttatggttttagttcgtattcggtcgtagttaagcgtgggtttgtcgggttcgtagcgttcgaggcgcgcggttttattttcgggttttagataacggtcgttattgttttttgtcggtcgtcgtagttcgggtgatcgttttattagcgcgtttaattcgttcgcgttaggttcgtcggttttaaggataacggttgcgttgtttcggagtcgttaattaatggacggtcgtttttttcgtttatttgtagttcgcggtcgatttgaggcggggtttggagaggttgacggggcgtagggtattttgggagtcgtagtcgtcgcgggcgcgtcggcgtaaagtattttgggagtcgtagtcgtcgcggtcgtatcggcgtagaatattttgggagtcgtggtagtttttagggtcggggttgcgggtcgtaagtgcgcgtagcgggaacggattttgtatcgttttcgcgtggtttcggggttttgttcggttttacggagcgggatggttcgttgaggggtgcgttgggtttcgattttttggtcgttgtgcgttcgtttttcgttttatttgtgtatatacggggtttcggcgagttatttcgggtaattatttaggaagcgtttagtgcgttacggtttagttgttcgggtcggtgttcgcggcggttcgcgtcgttcgttatttagcgcgttggtttttgcgtacgtagtttatagtaacgtttttggcgcgttttt

SEQ ID NO: 17824 - DNA, 1099 bp, Artificial Sequence
  chemically treated genomic DNA (Homo sapiens) CpG-island No: 17824
aaaaacgcgccaaaaacgttactataaactacgtacgcaaaaaccaacgcgctaaataacgaacgacgcgaaccgccgcgaacaccgacccgaacaactaaaccgtaacgcactaaacgcttcctaaataattacccgaaataactcgccgaaaccccgtatatacacaaataaaacgaaaaacgaacgcacaacgaccaaaaaatcgaaacccaacgcacccctcaacgaaccatcccgctccgtaaaaccgaacaaaaccccgaaaccacgcgaaaacgatacaaaatccgttcccgctacgcgcacttacgacccgcaaccccgaccctaaaaactaccacgactcccaaaatattctacgccgatacgaccgcgacgactacgactcccaaaatactttacgccgacgcgcccgcgacgactacgactcccaaaataccctacgccccgtcaacctctccaaaccccgcctcaaatcgaccgcgaactacaaataaacgaaaaaaacgaccgtccattaattaacgactccgaaacaacgcaaccgttatccttaaaaccgacgaacctaacgcgaacgaattaaacgcgctaataaaacgatcacccgaactacgacgaccgacaaaaaacaataacgaccgttatctaaaacccgaaaataaaaccgcgcgcctcgaacgctacgaacccgacaaacccacgcttaactacgaccgaatacgaactaaaaccataaacgaccgcgacaactcccgacgccgaaaaacaaaatcgcgaccctcgaaccacgacgacgacgaacctacgacgacgaaaaaaaaaatacgaaacgccgctacgaaccccgacgtaaaaaccgcgaaaaacgcgccaaccccgacccccaacaaaaacgaaaacgccgacgtaaacaacgaccactaaaaactaaaataacgaaacgcctaaccccctaacctctaacccaaaaaccccgcgactttccgaaattaaccgaaacgcgaactccgaatccgaaaacataaaccctaaactaaacgaaaatcgatataccctataaaccctataaaaaaactaaaacttaaaaaaaatc

SEQ ID NO: 17825 - DNA, 501 bp, Artificial Sequence
  chemically treated genomic DNA (Homo sapiens) CpG-island No: 17825
atttcgggcgtttcgggtcgggagagtttttatcggtcgttatattttcgattattgtttcgtttttttttcgttcggcgtcgtttagcgtttcgtagtttagtaggttttgcgggagggcgcgtagtgcgtacgcgtcggagttagagtttcgtttcgtgggcggtgggcgaggttggaggttacgtttcgagtcgtgtcggttttcgcggcggggtagcgttttttggcggtttttagaggtttattttttggcgttcggatcgcgttttttgagagcggagggttttagtttcgttttcggcgtattgcgtatttttcgggtaggtatttgtcggaaggatcgttgtgagaagtacgtggataattcggggagggttgagggttttttgaggtttttacggttcggtattcgtttttttttaatatttcgtgttatagtgtgattagcgtgaatttttttaattttaggattttaatttattatttgtttgtgtgagg

SEQ ID NO: 17826 - DNA, 501 bp, Artificial Sequence
  chemically treated genomic DNA (Homo sapiens) CpG-island No: 17826
cctcacacaaacaaataataaattaaaatcctaaaattaaaaaaattcacgctaatcacactataacacgaaatattaaaaaaaaacgaataccgaaccgtaaaaacctcaaaaaaccctcaaccctccccgaattatccacgtacttctcacaacgatccttccgacaaatacctacccgaaaaatacgcaatacgccgaaaacgaaactaaaaccctccgctctcaaaaaacgcgatccgaacgccaaaaaataaacctctaaaaaccgccaaaaaacgctaccccgccgcgaaaaccgacacgactcgaaacgtaacctccaacctcgcccaccgcccacgaaacgaaactctaactccgacgcgtacgcactacgcgccctcccgcaaaacctactaaactacgaaacgctaaacgacgccgaacgaaaaaaaaacgaaacaataatcgaaaatataacgaccgataaaaactctcccgacccgaaacgcccgaaat

SEQ ID NO: 17827 - DNA, 501 bp, Artificial Sequence
  chemically treated genomic DNA (Homo sapiens) CpG-island No: 17827
ttttatataggtaggtggtgagttggagttttgaggttaaagagatttacgttaattatattatagtacggagtgttaaagagaggcggatatcgggtcgtgaggattttaggaagtttttagtttttttcggattatttacgtgttttttatagcggttttttcggtaggtgtttgttcggggaatgcgtagtgcgtcgagggcgggattggaatttttcgtttttaggaggcgcggttcgggcgttaaaaggtaagtttttgggggtcgttaggggacgttgtttcgtcgcggaggtcggtacgattcggggcgtggtttttagtttcgtttatcgtttacggggcggggttttggtttcggcgcgtgcgtattacgcgttttttcgtagggtttgttgggttgcgagacgttaagcggcgtcgggcgggagaagagcggagtagtggtcggagatgtggcgatcggtgaggattttttcggttcggggcgttcgagat

SEQ ID NO: 17828 - DNA, 501 bp, Artificial Sequence
  chemically treated genomic DNA (Homo sapiens) CpG-island No: 17828
atctcgaacgccccgaaccgaaaaaatcctcaccgatcgccacatctccgaccactactccgctcttctcccgcccgacgccgcttaacgtctcgcaacccaacaaaccctacgaaaaaacgcgtaatacgcacgcgccgaaaccaaaaccccgccccgtaaacgataaacgaaactaaaaaccacgccccgaatcgtaccgacctccgcgacgaaacaacgtcccctaacgacccccaaaaacttaccttttaacgcccgaaccgcgcctcctaaaaacgaaaaattccaatcccgccctcgacgcactacgcattccccgaacaaacacctaccgaaaaaaccgctataaaaaacacgtaaataatccgaaaaaaactaaaaacttcctaaaatcctcacgacccgatatccgcctctctttaacactccgtactataatataattaacgtaaatctctttaacctcaaaactccaactcaccacctacctatataaaa

SEQ ID NO: 17829 - DNA, 1134 bp, Artificial Sequence
  chemically treated genomic DNA (Homo sapiens) CpG-island No: 17829
ttttcggcgtcgtttttgaagtaggtcgattcgtagtgtttgttgagataggatttgagcgcgaagttttttttgtagcgtttgtattggaagtgtttgaaggtcgaatgcgtttgtatgtgcgcgcgtaggttggagcggtcggcgaaggttttgtcgtagtgcgcgtagtcgaagggtttttcgtcggtgtgcgagcgtatgtggttttgtagtagttagggtcgcgagaaggttttgtcgtatacgtcgtatttgtggcgtaggtcgtgcgtgagtaggtgtatggttatggtcggtatggatacgtatattttgtcgtacgtcgggtagcgtcgcgttagttggttgtttaggttgcggtgcgtttgtttgtggcggtttaggttcgacgacgtggcgtatgttttgtcgtattcgtcgtacgcgtgtcggtcgttagtatttgcggtttttggtttcgcgcgcgtttcggtgtttgttttcgtacgcgtgtcgtttcggtttttcggttcggattttaagatgagttcgttcgttcggttttcgttttaggagtagtcgtcgggggtcgtcgtcgaggttgtggagggagcggcggtagaatcggtattggaagttttacgtcgcgagcgttcgtcggtgatgaagaaggagttcgtcgcgtagttttcgttgacggtcgcgtcgtcgttgatgtagtcgttcgtagcggtggttagtttcgggcgcggggtgggcggcggcgtagattttgtagtcgtcggatttagttttttacgtatagttgttgcgtatatgggtttcggcgacggttttttgagtagcgtagtttcggcgtcgttatcgtagacggacgagggttttacgtagtcgttgaggtattttgcgggcggaggcggacggatagcgggaagggaatggggcggcggtaggatatatacgggggatgggggggcgggagatattatacgtcgatcgggagattcgggttcgggagagaggcgaatagggaggaggataaaggagaggaagtcgagggatcgtcgggtagcgaggatggagatagtatggaggggaagagaggggaggagaggatgagatagggtcgggttacgtttcgtttttttcggt

SEQ ID NO: 17830 - DNA, 1134 bp, Artificial Sequence
  chemically treated genomic DNA (Homo sapiens) CpG-island No: 17830
accgaaaaaaacgaaacgtaacccgaccctatctcatcctctcctcccctctcttcccctccatactatctccatcctcgctacccgacgatccctcgacttcctctcctttatcctcctccctattcgcctctctcccgaacccgaatctcccgatcgacgtataatatctcccgcccccccatcccccgtatatatcctaccgccgccccattcccttcccgctatccgtccgcctccgcccgcaaaatacctcaacgactacgtaaaaccctcgtccgtctacgataacgacgccgaaactacgctactcaaaaaaccgtcgccgaaacccatatacgcaacaactatacgtaaaaaactaaatccgacgactacaaaatctacgccgccgcccaccccgcgcccgaaactaaccaccgctacgaacgactacatcaacgacgacgcgaccgtcaacgaaaactacgcgacgaactccttcttcatcaccgacgaacgctcgcgacgtaaaacttccaataccgattctaccgccgctccctccacaacctcgacgacgacccccgacgactactcctaaaacgaaaaccgaacgaacgaactcatcttaaaatccgaaccgaaaaaccgaaacgacacgcgtacgaaaacaaacaccgaaacgcgcgcgaaaccaaaaaccgcaaatactaacgaccgacacgcgtacgacgaatacgacaaaacatacgccacgtcgtcgaacctaaaccgccacaaacaaacgcaccgcaacctaaacaaccaactaacgcgacgctacccgacgtacgacaaaatatacgtatccataccgaccataaccatacacctactcacgcacgacctacgccacaaatacgacgtatacgacaaaaccttctcgcgaccctaactactacaaaaccacatacgctcgcacaccgacgaaaaacccttcgactacgcgcactacgacaaaaccttcgccgaccgctccaacctacgcgcgcacatacaaacgcattcgaccttcaaacacttccaatacaaacgctacaaaaaaaacttcgcgctcaaatcctatctcaacaaacactacgaatcgacctacttcaaaaacgacgccgaaaa

SEQ ID NO: 17831 - DNA, 1134 bp, Artificial Sequence
  chemically treated genomic DNA (Homo sapiens) CpG-island No: 17831
gtcggggggggcggagcgtggttcggttttgttttattttttttttttttttttttttttttatgttgtttttattttcgttgttcggcggtttttcggtttttttttttttgtttttttttttgttcgtttttttttcggattcgggtttttcggtcggcgtatgatgtttttcgtttttttatttttcgtgtgtgttttgtcgtcgttttatttttttttcgttgttcgttcgttttcgttcgtagggtattttagcgattacgtggggttttcgttcgtttacgatggcgacgtcgaggttgcgttgtttaaagggtcgtcgtcggagtttatgtacgtagtagttgtgcgtggagagttgggttcggcggttgtagggtttgcgtcgtcgtttatttcgcgttcggagttggttatcgttgcgggcggttatattaacggcgacgcggtcgttagcgagggttacgcggcggattttttttttattatcgacgggcgttcgcggcgtaaggtttttaatgtcggttttgtcgtcgttttttttatagtttcggcggcggttttcgacggttatttttgaggcgggggtcgggcgggcgggtttattttgggattcgggtcggggggtcggggcggtacgcgtgcgggggtaggtatcgaggcgcgcgcggggttaggggtcgtaggtgttggcggtcggtacgcgtgcggcgagtgcggtaaaatatacgttacgtcgtcgaatttgagtcgttataagtagacgtatcgtagtttggatagttagttggcgcggcgttgttcgacgtgcggtaaggtgtacgtgtttatgtcggttatggttatgtatttgtttacgtacgatttgcgttataagtgcggcgtgtgcggtaaagttttttcgcggttttggttgttgtagggttatatgcgttcgtatatcggcgagaaatttttcggttgcgcgtattgcggtaaggttttcgtcgatcgttttaatttgcgcgcgtatatgtagacgtattcggtttttaagtatttttagtgtaagcgttgtaagaagagtttcgcgtttaagttttattttaataagtattacgagtcggtttgttttaagggcggcgtcggagg

SEQ ID NO: 17832 - DNA, 1134 bp, Artificial Sequence
  chemically treated genomic DNA (Homo sapiens) CpG-island No: 17832
cctccgacgccgcccttaaaacaaaccgactcgtaatacttattaaaataaaacttaaacgcgaaactcttcttacaacgcttacactaaaaatacttaaaaaccgaatacgtctacatatacgcgcgcaaattaaaacgatcgacgaaaaccttaccgcaatacgcgcaaccgaaaaatttctcgccgatatacgaacgcatataaccctacaacaaccaaaaccgcgaaaaaactttaccgcacacgccgcacttataacgcaaatcgtacgtaaacaaatacataaccataaccgacataaacacgtacaccttaccgcacgtcgaacaacgccgcgccaactaactatccaaactacgatacgtctacttataacgactcaaattcgacgacgtaacgtatattttaccgcactcgccgcacgcgtaccgaccgccaacacctacgacccctaaccccgcgcgcgcctcgatacctacccccgcacgcgtaccgccccgaccccccgacccgaatcccaaaataaacccgcccgcccgacccccgcctcaaaaataaccgtcgaaaaccgccgccgaaactataaaaaaaacgacgacaaaaccgacattaaaaaccttacgccgcgaacgcccgtcgataataaaaaaaaaatccgccgcgtaaccctcgctaacgaccgcgtcgccgttaatataaccgcccgcaacgataaccaactccgaacgcgaaataaacgacgacgcaaaccctacaaccgccgaacccaactctccacgcacaactactacgtacataaactccgacgacgaccctttaaacaacgcaacctcgacgtcgccatcgtaaacgaacgaaaaccccacgtaatcgctaaaataccctacgaacgaaaacgaacgaacaacgaaaaaaaaataaaacgacgacaaaacacacacgaaaaataaaaaaacgaaaaacatcatacgccgaccgaaaaacccgaatccgaaaaaaaaacgaacaaaaaaaaaaacaaaaaaaaaaaaaccgaaaaaccgccgaacaacgaaaataaaaacaacataaaaaaaaaaaaaaaaaaaaaaaaaataaaacaaaaccgaaccacgctccgccccccccgac

SEQ ID NO: 17833 - DNA, 661 bp, Artificial Sequence
  chemically treated genomic DNA (Homo sapiens) CpG-island No: 17833
ggggacgatagggttacggtgtgttagagcgcgggttgggaagcggttttttgttagcggcggtatacgcgcgtagttttgggaggatagcgtgttgagggtgtcggttttttcgtaggcgatgtttttttttcgtagcgtagtagatatttcggtttaaagtcgggtttttgggattttaattgggcgtttaaggggttgcgttttcggattgagcggtgcgcgtttcgatgttttcgtttttcgttttcgttcgggttatcgttcggattacgtttggtttaagtcgttacgttcggcggcgggttcggtattagcgttatttgtttaggaagggtatggggtcgttcgtcgttattaataattcgaaaatttgtattaggatttttaagggaatgcggtttttttagttcgcgtcgggttttttttcgggcgtgggcgtgggtgtcggtgcgggtgcgggcgcggtcgtcgtttcggatttgagttcggttttgggtttggtcgcggcgttggggtttcggggcggttgtcggggaatgcggcgggaatcgcgtcgttgtgcgcggggtcgggcggggtttggtttagatagtattagtagtatgttgtcggattgtagtaggtggtatttcgagtttttcggcgttagtcggtttta

SEQ ID NO: 17834 - DNA, 661 bp, Artificial Sequence
  chemically treated genomic DNA (Homo sapiens) CpG-island No: 17834
taaaaccgactaacgccgaaaaactcgaaataccacctactacaatccgacaacatactactaatactatctaaaccaaaccccgcccgaccccgcgcacaacgacgcgattcccgccgcattccccgacaaccgccccgaaaccccaacgccgcgaccaaacccaaaaccgaactcaaatccgaaacgacgaccgcgcccgcacccgcaccgacacccacgcccacgcccgaaaaaaaacccgacgcgaactaaaaaaaccgcattcccttaaaaatcctaatacaaattttcgaattattaataacgacgaacgaccccatacccttcctaaacaaataacgctaataccgaacccgccgccgaacgtaacgacttaaaccaaacgtaatccgaacgataacccgaacgaaaacgaaaaacgaaaacatcgaaacgcgcaccgctcaatccgaaaacgcaaccccttaaacgcccaattaaaatcccaaaaacccgactttaaaccgaaatatctactacgctacgaaaaaaaaacatcgcctacgaaaaaaccgacaccctcaacacgctatcctcccaaaactacgcgcgtataccgccgctaacaaaaaaccgcttcccaacccgcgctctaacacaccgtaaccctatcgtcccc

SEQ ID NO: 17835 - DNA, 661 bp, Artificial Sequence
  chemically treated genomic DNA (Homo sapiens) CpG-island No: 17835
tgggatcggttggcgtcgaggggttcggggtattatttgttgtagttcgatagtatgttgttggtgttgtttgaattaggtttcgttcggtttcgcgtatagcggcgcgattttcgtcgtatttttcggtagtcgtttcggggttttagcgtcgcggttaagtttaaggtcgggtttaggttcgaggcggcggtcgcgttcgtattcgtatcggtatttacgtttacgttcgaggaagggttcgacgcgggttggggagatcgtatttttttggaaattttggtgtagattttcgggttgttggtggcggcggacggttttatgttttttttgggtaggtaacgttggtgtcgggttcgtcgtcgagcgtagcggtttgggttagacgtggttcgagcggtggttcgggcgggggcggagggcgaaagtatcggagcgcgtatcgtttagttcgagagcgtagttttttaggcgtttagttggagttttaggagttcggttttgagtcggggtgtttattgcgttgcgagaggggggtatcgtttacggaggggtcggtatttttagtacgttgtttttttagggttgcgcgcgtgtgtcgtcgttggtaggaggtcgttttttaattcgcgttttggtatatcgtgattttgtcgttttt

SEQ ID NO: 17836 - DNA, 661 bp, Artificial Sequence
  chemically treated genomic DNA (Homo sapiens) CpG-island No: 17836
aaaaacgacaaaatcacgatataccaaaacgcgaattaaaaaacgacctcctaccaacgacgacacacgcgcgcaaccctaaaaaaacaacgtactaaaaataccgacccctccgtaaacgatacccccctctcgcaacgcaataaacaccccgactcaaaaccgaactcctaaaactccaactaaacgcctaaaaaactacgctctcgaactaaacgatacgcgctccgatactttcgccctccgcccccgcccgaaccaccgctcgaaccacgtctaacccaaaccgctacgctcgacgacgaacccgacaccaacgttacctacccaaaaaaaacataaaaccgtccgccgccaccaacaacccgaaaatctacaccaaaatttccaaaaaaatacgatctccccaacccgcgtcgaacccttcctcgaacgtaaacgtaaataccgatacgaatacgaacgcgaccgccgcctcgaacctaaacccgaccttaaacttaaccgcgacgctaaaaccccgaaacgactaccgaaaaatacgacgaaaatcgcgccgctatacgcgaaaccgaacgaaacctaattcaaacaacaccaacaacatactatcgaactacaacaaataataccccgaacccctcgacgccaaccgatccca

SEQ ID NO: 17837 - DNA, 582 bp, Artificial Sequence
  chemically treated genomic DNA (Homo sapiens) CpG-island No: 17837
ggtcgagcggggtcgcggcgttgttcgggttttgcgtcggatttgtcgggaggttggggtagttatgattatcgacggcgttcggggaagttttagggagcggaacgggcgaggtttatagatcgattatttttcggttttttttaacgttcgttcgttcgtcgattagttttcggggcgggattttcggtcgtgggttatgtcgggggcgggttcggaatcgttacgggtgagtcgggtcgtggttgttgtcgggttttgcgcgtttcggattgaggtggcgtttttgggtcggacggcggtgtttcggcgtggcgggaagtcggtattggagcgggagcgtattgggcgcgggatcgggaggcgtagggatcggacggttttcgagtcgtttatttgacggtatcgagagggcggcgttttttcgagtagagtcgtttcggttatttttttgggatttgatttggtttttgcggtcgcgggtatcgtgaagttttggggtgtgcgtggttttttttggtaggcgttttttttcggcgttcggtttggggtggtggtggcgttgattttagtttcgttttt

SEQ ID NO: 17838 - DNA, 582 bp, Artificial Sequence
  chemically treated genomic DNA (Homo sapiens) CpG-island No: 17838
aaaaacgaaactaaaatcaacgccaccaccaccccaaaccgaacgccgaaaaaaaacgcctaccaaaaaaaaccacgcacaccccaaaacttcacgatacccgcgaccgcaaaaaccaaatcaaatcccaaaaaaataaccgaaacgactctactcgaaaaaacgccgccctctcgataccgtcaaataaacgactcgaaaaccgtccgatccctacgcctcccgatcccgcgcccaatacgctcccgctccaataccgacttcccgccacgccgaaacaccgccgtccgacccaaaaacgccacctcaatccgaaacgcgcaaaacccgacaacaaccacgacccgactcacccgtaacgattccgaacccgcccccgacataacccacgaccgaaaatcccgccccgaaaactaatcgacgaacgaacgaacgttaaaaaaaaccgaaaaataatcgatctataaacctcgcccgttccgctccctaaaacttccccgaacgccgtcgataatcataactaccccaacctcccgacaaatccgacgcaaaacccgaacaacgccgcgaccccgctcgacc

SEQ ID NO: 17839 - DNA, 582 bp, Artificial Sequence
  chemically treated genomic DNA (Homo sapiens) CpG-island No: 17839
agaggcggggttggagttaacgttattattattttaagtcggacgtcgggaaagggcgtttattaggaggagttacgtatattttagggttttacggtgttcgcgatcgtaagagttaagttagattttaggggagtggtcgggacggttttgttcggaggggcgtcgttttttcggtatcgttaggtgggcgattcgggagtcgttcggtttttgcgtttttcggtttcgcgtttagtgcgttttcgttttagtgtcggtttttcgttacgtcgggatatcgtcgttcggtttagggacgttattttagttcggagcgcgtaggattcggtagtagttacgattcgatttattcgtggcggtttcgggttcgttttcggtatggtttacgatcggaagtttcgtttcggaagttggtcggcgggcgggcgggcgttgagaggaatcggggggtagtcggtttataagtttcgttcgtttcgttttttggggttttttcgagcgtcgtcggtggttatggttgttttagtttttcggtaggttcgacgtagagttcgggtagcgtcgcggtttcgttcggtt

SEQ ID NO: 17840 - DNA, 582 bp, Artificial Sequence
  chemically treated genomic DNA (Homo sapiens) CpG-island No: 17840
aaccgaacgaaaccgcgacgctacccgaactctacgtcgaacctaccgaaaaactaaaacaaccataaccaccgacgacgctcgaaaaaaccccaaaaaacgaaacgaacgaaacttataaaccgactaccccccgattcctctcaacgcccgcccgcccgccgaccaacttccgaaacgaaacttccgatcgtaaaccataccgaaaacgaacccgaaaccgccacgaataaatcgaatcgtaactactaccgaatcctacgcgctccgaactaaaataacgtccctaaaccgaacgacgatatcccgacgtaacgaaaaaccgacactaaaacgaaaacgcactaaacgcgaaaccgaaaaacgcaaaaaccgaacgactcccgaatcgcccacctaacgataccgaaaaaacgacgcccctccgaacaaaaccgtcccgaccactcccctaaaatctaacttaactcttacgatcgcgaacaccgtaaaaccctaaaatatacgtaactcctcctaataaacgccctttcccgacgtccgacttaaaataataataacgttaactccaaccccgcctct

SEQ ID NO: 17841 - DNA, 590 bp, Artificial Sequence
  chemically treated genomic DNA (Homo sapiens) CpG-island No: 17841
gtttagcggcgggcgtatgtttagttatcgtgaggttgcgtttgttcggggttcgcgtttttttatttcggggatcgttttcgggtcgttcgttttatttggcgcgttattttcgcgtgtatggttttgttgtttcgagttttgagcgtcggcgcgggatcgagttggcggcgggcggcgcgcgtttttcgaggttttttgttgtttttgttcgagttcgcggtttttacgcgcgttttttttcgtgttatggtttgtaggtaggagtcgtagtcgtagggttcgtcgttcgttgttggcgtcgtggttttttatgattatttggtgatcgggggcggttcgggcgggttggttagcgcgcgtagggcggtcgagttgggtgttagggtcgtcgtggtggagagttataagttgggtggtatttgcgtgagtatcgtcggtttgttcgggcggggggcgtttttttgtttcggtttttcgggggatagtttgtgttcgtttttatggcgattttgtttttcggcgttgggttttttttttttttattttcgtaattttttatttcgaagttaggaatttagtaggtggag

SEQ ID NO: 17842 - DNA, 590 bp, Artificial Sequence
  chemically treated genomic DNA (Homo sapiens) CpG-island No: 17842
ctccacctactaaattcctaacttcgaaataaaaaattacgaaaataaaaaaaaaaaaaacccaacgccgaaaaacaaaatcgccataaaaacgaacacaaactatcccccgaaaaaccgaaacaaaaaaacgccccccgcccgaacaaaccgacgatactcacgcaaataccacccaacttataactctccaccacgacgaccctaacacccaactcgaccgccctacgcgcgctaaccaacccgcccgaaccgcccccgatcaccaaataatcataaaaaaccacgacgccaacaacgaacgacgaaccctacgactacgactcctacctacaaaccataacacgaaaaaaaacgcgcgtaaaaaccgcgaactcgaacaaaaacaacaaaaaacctcgaaaaacgcgcgccgcccgccgccaactcgatcccgcgccgacgctcaaaactcgaaacaacaaaaccatacacgcgaaaataacgcgccaaataaaacgaacgacccgaaaacgatccccgaaataaaaaaacgcgaaccccgaacaaacgcaacctcacgataactaaacatacgcccgccgctaaac

SEQ ID NO: 17843 - DNA, 590 bp, Artificial Sequence
  chemically treated genomic DNA (Homo sapiens) CpG-island No: 17843
ttttatttgttgggtttttggtttcggaatggggagttgcgggggtggaaaagaggaaagtttagcgtcgggggataggatcgttataggaacgagtataggttgtttttcgaaagatcgagataaagaggcgtttttcgttcgaataaatcggcggtatttacgtaagtgttatttagtttgtggttttttattacggcggttttggtatttagttcggtcgttttgcgcgcgttggttagttcgttcgagtcgttttcgattattaggtagttataggaggttacggcgttagtagcgggcggcgggttttgcggttgcggtttttgtttgtaggttatggtacgggagagggcgcgcgtgagggtcgcgggttcgggtagaagtagtaggaagtttcggaaggcgcgcgtcgttcgtcgttagttcggtttcgcgtcggcgtttagggttcggggtagtagggttatgtacgcggaagtggcgcgttaagtggggcgggcggttcgggggcggttttcggggtaggggggcgcgggtttcgggtaagcgtagttttacggtgattaagtatgcgttcgtcgttaggt

SEQ ID NO: 17844 - DNA, 590 bp, Artificial Sequence
  chemically treated genomic DNA (Homo sapiens) CpG-island No: 17844
acctaacgacgaacgcatacttaatcaccgtaaaactacgcttacccgaaacccgcgcccccctaccccgaaaaccgcccccgaaccgcccgccccacttaacgcgccacttccgcgtacataaccctactaccccgaaccctaaacgccgacgcgaaaccgaactaacgacgaacgacgcgcgccttccgaaacttcctactacttctacccgaacccgcgaccctcacgcgcgccctctcccgtaccataacctacaaacaaaaaccgcaaccgcaaaacccgccgcccgctactaacgccgtaacctcctataactacctaataatcgaaaacgactcgaacgaactaaccaacgcgcgcaaaacgaccgaactaaataccaaaaccgccgtaataaaaaaccacaaactaaataacacttacgtaaataccgccgatttattcgaacgaaaaacgcctctttatctcgatctttcgaaaaacaacctatactcgttcctataacgatcctatcccccgacgctaaactttcctcttttccacccccgcaactccccattccgaaaccaaaaacccaacaaataaaa

SEQ ID NO: 17845 - DNA, 606 bp, Artificial Sequence
  chemically treated genomic DNA (Homo sapiens) CpG-island No: 17845
atagtttcgttttcgcggtattagaggcggggtacgtaatgacgtatgcgttcgtttggttgttttggcgtcgcggtggttgtcgggattgagtttttagtattcgatcgggaagtggcgggcggagtttcgggtttagtcgtcgttttagttatcgtcgttgtcgtcgtcgtcgtcgttatcgttagtggtgagatttcgatttggcgggttagcgttgggcgtgcgtgcgggtaggcgggggcgttgacgagaagtaggaagagggtgtagtgtcggcgtgggcggtcggtcgaggcggaggcgtaggaagggggcggcgagtcgtgcgaggttgttttttttatttaggtaggggttgcggtcgtcgggtgtggggcgtagagtttcggtttgttgttttttgggacgtaggcgcgtcgtcgtttttcgggaggttgagcgtgatttttattttacgggaagttgggatcgtcgttttcgaagcgaaatatttagtacgcgaatcgtttttcggagtattgtttttaggttagaggtttattgagtaaatttttgggttggaaagagggaaaattcgcggtttgtcgtttgattgtgtttttt

SEQ ID NO: 17846 - DNA, 606 bp, Artificial Sequence
  chemically treated genomic DNA (Homo sapiens) CpG-island No: 17846
aaaaaacacaatcaaacgacaaaccgcgaattttccctctttccaacccaaaaatttactcaataaacctctaacctaaaaacaatactccgaaaaacgattcgcgtactaaatatttcgcttcgaaaacgacgatcccaacttcccgtaaaataaaaatcacgctcaacctcccgaaaaacgacgacgcgcctacgtcccaaaaaacaacaaaccgaaactctacgccccacacccgacgaccgcaacccctacctaaataaaaaaaacaacctcgcacgactcgccgcccccttcctacgcctccgcctcgaccgaccgcccacgccgacactacaccctcttcctacttctcgtcaacgcccccgcctacccgcacgcacgcccaacgctaacccgccaaatcgaaatctcaccactaacgataacgacgacgacgacgacaacgacgataactaaaacgacgactaaacccgaaactccgcccgccacttcccgatcgaatactaaaaactcaatcccgacaaccaccgcgacgccaaaacaaccaaacgaacgcatacgtcattacgtaccccgcctctaataccgcgaaaacgaaactat

SEQ ID NO: 17847 - DNA, 606 bp, Artificial Sequence
  chemically treated genomic DNA (Homo sapiens) CpG-island No: 17847
aagaggtatagttaggcggtagatcgcgaattttttttttttttaatttaaaagtttgtttaatgaatttttggtttaaagataatgtttcggggaacggttcgcgtgttgggtgtttcgtttcgagaacggcggttttagtttttcgtgaggtggaggttacgtttagtttttcgggaggcggcggcgcgtttgcgttttagggaatagtaagtcggggttttgcgttttatattcggcggtcgtagtttttatttgagtgagaagggtagtttcgtacgattcgtcgttttttttttgcgttttcgtttcggtcggtcgtttacgtcggtattgtattttttttttgtttttcgttagcgttttcgtttgttcgtacgtacgtttagcgttgattcgttaggtcggggttttattattggcggtggcggcggcggcggcggtagcggcggtagttgaggcggcgattggattcgggatttcgttcgttatttttcgatcgggtgttaggagtttagtttcggtagttatcgcggcgttagggtagttaagcgagcgtatgcgttattgcgtgtttcgtttttggtgtcgcgggagcggaattat

SEQ ID NO: 17848 - DNA, 606 bp, Artificial Sequence
  chemically treated genomic DNA (Homo sapiens) CpG-island No: 17848
ataattccgctcccgcgacaccaaaaacgaaacacgcaataacgcatacgctcgcttaactaccctaacgccgcgataactaccgaaactaaactcctaacacccgatcgaaaaataacgaacgaaatcccgaatccaatcgccgcctcaactaccgccgctaccgccgccgccgccgccaccgccaataataaaaccccgacctaacgaatcaacgctaaacgtacgtacgaacaaacgaaaacgctaacgaaaaacaaaaaaaaaatacaataccgacgtaaacgaccgaccgaaacgaaaacgcaaaaaaaaaacgacgaatcgtacgaaactacccttctcactcaaataaaaactacgaccgccgaatataaaacgcaaaaccccgacttactattccctaaaacgcaaacgcgccgccgcctcccgaaaaactaaacgtaacctccacctcacgaaaaactaaaaccgccgttctcgaaacgaaacacccaacacgcgaaccgttccccgaaacattatctttaaaccaaaaattcattaaacaaacttttaaattaaaaaaaaaaaaaattcgcgatctaccgcctaactatacctctt

SEQ ID NO: 17849 - DNA, 561 bp, Artificial Sequence
  chemically treated genomic DNA (Homo sapiens) CpG-island No: 17849
tttttttttgttttaagtgcgcggttatagcggtttttttttatggtaacgttttcgcgtttcgggtttcgtttcgattcgttattagaatcggaagttgttgtatagttggtagtttttcggttttttttcgacggcgtcgggaggtgagattcgaggtttttttagggtttttaagttgcggttagaggcggtggttttcgggtggtggaagggggacgcggagaagcggtcgcggattcgtcgttattttttttttcgcgcgtaagtgtagtatttttatatcgttttagatttttaggtttttttttttcgttgtttgtttttgagttcgcgtatttttttttatcgttttttttcggcggatttcgggcgtttgttttgttaggtgaattcgcgttatttgtcgttcgtttcggcggtttttagtttgggaggcgcgcggcgcggcgcggtgggcgcgggaggtcgggagatggtcggaagttagtttttttagagtcggtttattatagtagggtagagtcgagagcggcgttttttgtagaaagatttttgcgt

SEQ ID NO: 17850 - DNA, 561 bp, Artificial Sequence
  chemically treated genomic DNA (Homo sapiens) CpG-island No: 17850
acgcaaaaatctttctacaaaaaacgccgctctcgactctaccctactataataaaccgactctaaaaaaactaacttccgaccatctcccgacctcccgcgcccaccgcgccgcgccgcgcgcctcccaaactaaaaaccgccgaaacgaacgacaaataacgcgaattcacctaacaaaacaaacgcccgaaatccgccgaaaaaaaacgataaaaaaaaatacgcgaactcaaaaacaaacaacgaaaaaaaaaaacctaaaaatctaaaacgatataaaaatactacacttacgcgcgaaaaaaaaaataacgacgaatccgcgaccgcttctccgcgtcccccttccaccacccgaaaaccaccgcctctaaccgcaacttaaaaaccctaaaaaaacctcgaatctcacctcccgacgccgtcgaaaaaaaaccgaaaaactaccaactatacaacaacttccgattctaataacgaatcgaaacgaaacccgaaacgcgaaaacgttaccataaaaaaaaaccgctataaccgcgcacttaaaacaaaaaaaaa

SEQ ID NO: 17851 - DNA, 561 bp, Artificial Sequence
  chemically treated genomic DNA (Homo sapiens) CpG-island No: 17851
acgtaggggtttttttgtaggggacgtcgttttcggttttattttgttgtggtgggtcggttttgggaaggttggttttcgattatttttcgatttttcgcgtttatcgcgtcgcgtcgcgcgttttttaggttgggaatcgtcggggcgaacggtaggtggcgcgggtttatttggtagggtaggcgttcggggttcgtcggggaaagacgatgggaaggggtgcgcggatttaggggtaggtagcggaggggaggggtttggggatttgggacggtgtaagggtgttgtatttgcgcgcgaagggaggggtggcgacgagttcgcggtcgttttttcgcgttttttttttattattcggggattatcgtttttgatcgtagtttgggggttttaaagaggtttcgggttttatttttcgacgtcgtcggggagaaatcggggaattgttagttgtgtaataattttcggttttggtggcgggtcggggcggggttcggaacgcggggacgttgttatggagaagagtcgttgtggtcgcgtatttgggatagggaaaga

SEQ ID NO: 17852 - DNA, 561 bp, Artificial Sequence
  chemically treated genomic DNA (Homo sapiens) CpG-island No: 17852
tctttccctatcccaaatacgcgaccacaacgactcttctccataacaacgtccccgcgttccgaaccccgccccgacccgccaccaaaaccgaaaattattacacaactaacaattccccgatttctccccgacgacgtcgaaaaataaaacccgaaacctctttaaaacccccaaactacgatcaaaaacgataatccccgaataataaaaaaaaaacgcgaaaaaacgaccgcgaactcgtcgccacccctcccttcgcgcgcaaatacaacacccttacaccgtcccaaatccccaaacccctcccctccgctacctacccctaaatccgcgcaccccttcccatcgtctttccccgacgaaccccgaacgcctaccctaccaaataaacccgcgccacctaccgttcgccccgacgattcccaacctaaaaaacgcgcgacgcgacgcgataaacgcgaaaaatcgaaaaataatcgaaaaccaaccttcccaaaaccgacccaccacaacaaaataaaaccgaaaacgacgtcccctacaaaaaaacccctacgt

SEQ ID NO: 17853 - DNA, 594 bp, Artificial Sequence
  chemically treated genomic DNA (Homo sapiens) CpG-island No: 17853
gcgatttcgcgggtcgtttaattcgcgatcggtttacgcggtattcgtttttttttaggttttcgttttgtcggttcgcgcgcgttcgacgggagtatgcggggcggtgggcgtagggttattttgggcggcgtagataaaggcgggcgcgcgtacgttttgacgtagtttgggttcgcggcggcggtaagggcgggagggagcggtcgtcgcgggatttggagttgtttagtttcgcggtcggtgagtaggagggagttggttttttattttaaagttttcgattttcggggagtcgagagcgggacgtgggagtcgggtttgggcggtcgcgcggggtttgcggtttgggacgtttcggagacgttgcgtcggcgttaggaggtattatcgtcgcgtttcggggattttcggcgggtggagcgggtgtttttcgttcgggatggaacggttagagttcgtttcgaatttcggtcgttcgtttattcgttcgtttgttattcgagttcggtttatcggagtttttcgttttttttaagttttaggtgtgagtagttttttcgtttcgggagttcggggatgtgggtggcgagg

SEQ ID NO: 17854 - DNA, 594 bp, Artificial Sequence
  chemically treated genomic DNA (Homo sapiens) CpG-island No: 17854
cctcgccacccacatccccgaactcccgaaacgaaaaaactactcacacctaaaacttaaaaaaaacgaaaaactccgataaaccgaactcgaataacaaacgaacgaataaacgaacgaccgaaattcgaaacgaactctaaccgttccatcccgaacgaaaaacacccgctccacccgccgaaaatccccgaaacgcgacgataatacctcctaacgccgacgcaacgtctccgaaacgtcccaaaccgcaaaccccgcgcgaccgcccaaacccgactcccacgtcccgctctcgactccccgaaaatcgaaaactttaaaataaaaaaccaactccctcctactcaccgaccgcgaaactaaacaactccaaatcccgcgacgaccgctccctcccgcccttaccgccgccgcgaacccaaactacgtcaaaacgtacgcgcgcccgcctttatctacgccgcccaaaataaccctacgcccaccgccccgcatactcccgtcgaacgcgcgcgaaccgacaaaacgaaaacctaaaaaaaaacgaataccgcgtaaaccgatcgcgaattaaacgacccgcgaaatcgc

SEQ ID NO: 17855 - DNA, 594 bp, Artificial Sequence
  chemically treated genomic DNA (Homo sapiens) CpG-island No: 17855
tttcgttatttatattttcggattttcggggcgggagggttgtttatatttgggatttgggggaggcgaggggtttcgatgaatcgggttcggatagtaggcgagcggataggcgggcggtcggggttcggggcgggttttgatcgttttatttcggacggggggtattcgttttattcgtcggggattttcggggcgcggcgatggtgttttttgacgtcggcgtagcgttttcggggcgttttagatcgtaggtttcgcgcggtcgtttaagttcggtttttacgtttcgttttcggtttttcggaggtcggagattttgaggtaaggggttagtttttttttatttatcgatcgcgaggttaggtagttttaaatttcgcggcgatcgttttttttcgtttttgtcgtcgtcgcgggtttaagttgcgttaggacgtgcgcgcgttcgtttttgtttgcgtcgtttaaagtgattttgcgtttatcgtttcgtatgttttcgtcgggcgcgcgcgggtcggtagggcgggggtttagggagaggcgggtgtcgcgtggatcggtcgcgggttgggcgattcgcggagtcgt

SEQ ID NO: 17856 - DNA, 594 bp, Artificial Sequence
  chemically treated genomic DNA (Homo sapiens) CpG-island No: 17856
acgactccgcgaatcgcccaacccgcgaccgatccacgcgacacccgcctctccctaaacccccgccctaccgacccgcgcgcgcccgacgaaaacatacgaaacgataaacgcaaaatcactttaaacgacgcaaacaaaaacgaacgcgcgcacgtcctaacgcaacttaaacccgcgacgacgacaaaaacgaaaaaaaacgatcgccgcgaaatttaaaactacctaacctcgcgatcgataaataaaaaaaaactaaccccttacctcaaaatctccgacctccgaaaaaccgaaaacgaaacgtaaaaaccgaacttaaacgaccgcgcgaaacctacgatctaaaacgccccgaaaacgctacgccgacgtcaaaaaacaccatcgccgcgccccgaaaatccccgacgaataaaacgaataccccccgtccgaaataaaacgatcaaaacccgccccgaaccccgaccgcccgcctatccgctcgcctactatccgaacccgattcatcgaaacccctcgcctcccccaaatcccaaatataaacaaccctcccgccccgaaaatccgaaaatataaataacgaaa

SEQ ID NO: 17857 - DNA, 563 bp, Artificial Sequence
  chemically treated genomic DNA (Homo sapiens) CpG-island No: 17857
aggcgatttttggttttatttacgtcggagtcggttcgcgtttatttttacgttttaattcgtattaagaaatatcgttttagcgtttttcggggcgtcgtcgcgtaggttgcgtcgttttcgattggttaaacgcggtatagcgttatttcggtttatcgcgcggtgcgcgtttttattggtcggcggcggtaggagtaggggtagggggcggggtagtacgcggggcgcgcggtatgggcggattagagtttgagtttcgttttcggattttcgtttgggtcgagttcgtttagttggttgaaacgagtggagtttggcggcgagtgggggcgtgcgacggttattttggttattggggtcgcgtcgcgttggcgagagtcgtcgttcgcgagggatgttggtgaggaagtcgtcgggagtcgtcgtcgttatttgagggaggtattttggaaattattttttatcggtggggaagtgtagtcgcggtgggcggttttgggggttaacgaaataggaggtttttaaatttttaggttggggttgtattgttttggagtcgt

SEQ ID NO: 17858 - DNA, 563 bp, Artificial Sequence
  chemically treated genomic DNA (Homo sapiens) CpG-island No: 17858
acgactccaaaacaatacaaccccaacctaaaaatttaaaaacctcctatttcgttaacccccaaaaccgcccaccgcgactacacttccccaccgataaaaaataatttccaaaatacctccctcaaataacgacgacgactcccgacgacttcctcaccaacatccctcgcgaacgacgactctcgccaacgcgacgcgaccccaataaccaaaataaccgtcgcacgcccccactcgccgccaaactccactcgtttcaaccaactaaacgaactcgacccaaacgaaaatccgaaaacgaaactcaaactctaatccgcccataccgcgcgccccgcgtactaccccgccccctacccctactcctaccgccgccgaccaataaaaacgcgcaccgcgcgataaaccgaaataacgctataccgcgtttaaccaatcgaaaacgacgcaacctacgcgacgacgccccgaaaaacgctaaaacgatatttcttaatacgaattaaaacgtaaaaataaacgcgaaccgactccgacgtaaataaaaccaaaaatcgcct

SEQ ID NO: 17859 - DNA, 563 bp, Artificial Sequence
  chemically treated genomic DNA (Homo sapiens) CpG-island No: 17859
gcggttttagggtaatgtagttttaatttaaagatttagaggttttttgtttcgttggtttttagagtcgtttatcgcgattgtatttttttatcgataaaaggtggtttttagggtattttttttagatggcggcggcggttttcgacggtttttttattagtatttttcgcgggcggcggttttcgttagcgcggcgcggttttagtaattagagtaatcgtcgtacgtttttattcgtcgttaggttttattcgttttagttagttgggcgggttcggtttagacgagggttcgggggcggggtttaggttttagttcgtttatatcgcgcgtttcgcgtgttgtttcgttttttatttttgtttttgtcgtcgtcggttaatgagggcgcgtatcgcgcggtaggtcgagatggcgttatgtcgcgtttggttaatcggaggcggcgtaatttgcgcggcgacgtttcgaaaggcgttagggcgatgttttttggtgcgggttggggcgtggggatgggcgcgggtcggtttcggcgtgggtggggttaagggtcgttt

SEQ ID NO: 17860 - DNA, 563 bp, Artificial Sequence
  chemically treated genomic DNA (Homo sapiens) CpG-island No: 17860
aaacgacccttaaccccacccacgccgaaaccgacccgcgcccatccccacgccccaacccgcaccaaaaaacatcgccctaacgcctttcgaaacgtcgccgcgcaaattacgccgcctccgattaaccaaacgcgacataacgccatctcgacctaccgcgcgatacgcgccctcattaaccgacgacgacaaaaacaaaaataaaaaacgaaacaacacgcgaaacgcgcgatataaacgaactaaaacctaaaccccgcccccgaaccctcgtctaaaccgaacccgcccaactaactaaaacgaataaaacctaacgacgaataaaaacgtacgacgattactctaattactaaaaccgcgccgcgctaacgaaaaccgccgcccgcgaaaaatactaataaaaaaaccgtcgaaaaccgccgccgccatctaaaaaaaataccctaaaaaccaccttttatcgataaaaaaatacaatcgcgataaacgactctaaaaaccaacgaaacaaaaaacctctaaatctttaaattaaaactacattaccctaaaaccgc

SEQ ID NO: 17861 - DNA, 901 bp, Artificial Sequence
  chemically treated genomic DNA (Homo sapiens) CpG-island No: 17861
tcggcgatttaaagtcgggggaagaagtgtaggaatttttagaaaggggattttacgggtcgttgtcgaatcggtaaagagttgttattagtcgagagaagatttgtcggttttaagttttcgaaataattcggggagtagtagttatatattaagtttcgagggcgcgcggtcgggttagggttatacgttttttagttttagcgtggtgagggttttttttgcggggaattttttcggaaatcgcgtacgtgtgggcggttttagttagttcgaacggttagcgtggtaagattgtgtagagttttagcgatcgcgtttttcgggagtttagtcgtcgtcgaagttagcggtgttcgttatttcgtttttttcgttttagcgtcgttagtagtcggggtcgggtacgcggttggagtagcgggcggtgcggggtaaggatcgggtattttcgcggggtcggcggaaggcgcggcgtttaggttgcgcgtagttgtttttgaggcgatttcggttagtcgcggttttggggagagttcggtttcgggacgttgtttcgaggttgtcggcgcgcgggatgtaaatgcgcgcgcgcgtttttttttcgttcgttgcgttttcgaagttttttcgcgttttatttttatcgagtttatcgggtatatgatcgagtgttttaggatttcggttatcgtttttgttgttatgtgggtggatacggaggcgttagtcggtaggttttcgtagttttttcgattcggtggcggtttttgtcgtcgtcgttatttcggttgtttttatttatttttcgggttatcgtttggttgtttaagttttcgcggcgtagttttattcgttagttcggcggggcgtaggaggttgtaggaggtgggtagggagg

SEQ ID NO: 17862 - DNA, 901 bp, Artificial Sequence
  chemically treated genomic DNA (Homo sapiens) CpG-island No: 17862
cctccctacccacctcctacaacctcctacgccccgccgaactaacgaataaaactacgccgcgaaaacttaaacaaccaaacgataacccgaaaaataaataaaaacaaccgaaataacgacgacgacaaaaaccgccaccgaatcgaaaaaactacgaaaacctaccgactaacgcctccgtatccacccacataacaacaaaaacgataaccgaaatcctaaaacactcgatcatatacccgataaactcgataaaaataaaacgcgaaaaaacttcgaaaacgcaacgaacgaaaaaaaaacgcgcgcgcgcatttacatcccgcgcgccgacaacctcgaaacaacgtcccgaaaccgaactctccccaaaaccgcgactaaccgaaatcgcctcaaaaacaactacgcgcaacctaaacgccgcgccttccgccgaccccgcgaaaatacccgatccttaccccgcaccgcccgctactccaaccgcgtacccgaccccgactactaacgacgctaaaacgaaaaaaacgaaataacgaacaccgctaacttcgacgacgactaaactcccgaaaaacgcgatcgctaaaactctacacaatcttaccacgctaaccgttcgaactaactaaaaccgcccacacgtacgcgatttccgaaaaaattccccgcaaaaaaaaccctcaccacgctaaaactaaaaaacgtataaccctaacccgaccgcgcgccctcgaaacttaatatataactactactccccgaattatttcgaaaacttaaaaccgacaaatcttctctcgactaataacaactctttaccgattcgacaacgacccgtaaaatcccctttctaaaaattcctacacttcttcccccgactttaaatcgccga

SEQ ID NO: 17863 - DNA, 901 bp, Artificial Sequence
  chemically treated genomic DNA (Homo sapiens) CpG-island No: 17863
tttttttgtttattttttgtagttttttgcgtttcgtcgagttggcggatggagttgcgtcgcgggagtttgggtagttaggcggtggttcggaggatggatggggatagtcgagatggcggcggcggtaaggatcgttatcgggtcgggaggattacgagaatttgtcgattagcgttttcgtgtttatttatatgatagtaggagcgatggtcgggattttggagtattcggttatgtattcggtggattcggtgaaggtgaggcgcggggagatttcggggacgtaacgagcggagaaggagcgcgcgcgcgtatttgtatttcgcgcgtcggtagtttcggggtagcgtttcgaaatcgagttttttttaggatcgcggttggtcggggtcgttttaggagtagttgcgcgtagtttgggcgtcgcgtttttcgtcgatttcgcgagggtgttcggtttttgtttcgtatcgttcgttgttttagtcgcgtgttcggtttcggttgttggcggcgttgaggcgggggaggcggagtggcgagtatcgttggtttcggcggcgattgggttttcgggggacgcgatcgttgaagttttgtatagttttattacgttggtcgttcgggttggttggggtcgtttatacgtgcgcggttttcgagggagtttttcgtaggggaagtttttattacgttggagttgagaaacgtgtggttttggttcggtcgcgcgttttcgggatttggtgtgtggttgttgtttttcgggttatttcgggaatttggggtcggtaagttttttttcgattagtggtagttttttatcggttcgatagcggttcgtgggattttttttttgagggtttttgtattttttttttcgattttgggtcgtcga

SEQ ID NO: 17864 - DNA, 901 bp, Artificial Sequence
  chemically treated genomic DNA (Homo sapiens) CpG-island No: 17864
tcgacgacccaaaatcgaaaaaaaaaatacaaaaaccctcaaaaaaaaaatcccacgaaccgctatcgaaccgataaaaaactaccactaatcgaaaaaaaacttaccgaccccaaattcccgaaataacccgaaaaacaacaaccacacaccaaatcccgaaaacgcgcgaccgaaccaaaaccacacgtttctcaactccaacgtaataaaaacttcccctacgaaaaactccctcgaaaaccgcgcacgtataaacgaccccaaccaacccgaacgaccaacgtaataaaactatacaaaacttcaacgatcgcgtcccccgaaaacccaatcgccgccgaaaccaacgatactcgccactccgcctcccccgcctcaacgccgccaacaaccgaaaccgaacacgcgactaaaacaacgaacgatacgaaacaaaaaccgaacaccctcgcgaaatcgacgaaaaacgcgacgcccaaactacgcgcaactactcctaaaacgaccccgaccaaccgcgatcctaaaaaaaactcgatttcgaaacgctaccccgaaactaccgacgcgcgaaatacaaatacgcgcgcgcgctccttctccgctcgttacgtccccgaaatctccccgcgcctcaccttcaccgaatccaccgaatacataaccgaatactccaaaatcccgaccatcgctcctactatcatataaataaacacgaaaacgctaatcgacaaattctcgtaatcctcccgacccgataacgatccttaccgccgccgccatctcgactatccccatccatcctccgaaccaccgcctaactacccaaactcccgcgacgcaactccatccgccaactcgacgaaacgcaaaaaactacaaaaaataaacaaaaaaa

SEQ ID NO: 17865 - DNA, 581 bp, Artificial Sequence
  chemically treated genomic DNA (Homo sapiens) CpG-island No: 17865
  misc_feature (34)..(34): n is either a, c, g or t
ggcggtagcgatggttttaggcgcggaaaggtanggattattttttttagggtttttgcgtttttttttttagtttcggtcgtttcgattattttttcgttgttacgtttttttcgggtgcggcgcgcgttgatgacgttatcgcgtttttgggttacgttttcgttgtcgttagaggtgaagacgggtggaaaagattcggggtttcgagggtcgtagatcgttagttttacgttattttcgttttttttttcgtagggcgggtaattcgaacgttttttgtagcgagtggttttttcggttggcgcgcgttcggggcggcggcgttggaggagttcgagacggagtttagttatgtttgggaggcgaacgcggttcggaggagtcgtttagcgtttcggtgagcggagggcgcgcgggagacgtgaggtcgagtcgtttgggggacgtagttcggtgaaagattattttttttttttcgttgtcgtcgtcggaggagacgtttttaaaagggtttgtttgggaattttttcgttgtttttagaatttgttttttggattttaaggtttagagttttttt

SEQ ID NO: 17866 - DNA, 581 bp, Artificial Sequence
  chemically treated genomic DNA (Homo sapiens) CpG-island No: 17866
  misc_feature (548)..(548): n is either a, c, g or t
aaaaaaactctaaaccttaaaatccaaaaaacaaattctaaaaacaacgaaaaaattcccaaacaaacccttttaaaaacgtctcctccgacgacgacaacgaaaaaaaaaaaataatctttcaccgaactacgtcccccaaacgactcgacctcacgtctcccgcgcgccctccgctcaccgaaacgctaaacgactcctccgaaccgcgttcgcctcccaaacataactaaactccgtctcgaactcctccaacgccgccgccccgaacgcgcgccaaccgaaaaaaccactcgctacaaaaaacgttcgaattacccgccctacgaaaaaaaaaacgaaaataacgtaaaactaacgatctacgaccctcgaaaccccgaatcttttccacccgtcttcacctctaacgacaacgaaaacgtaacccaaaaacgcgataacgtcatcaacgcgcgccgcacccgaaaaaaacgtaacaacgaaaaaataatcgaaacgaccgaaactaaaaaaaaaaacgcaaaaaccctaaaaaaaataatccntacctttccgcgcctaaaaccatcgctaccgcc

SEQ ID NO: 17867 - DNA, 581 bp, Artificial Sequence
  chemically treated genomic DNA (Homo sapiens) CpG-island No: 17867
  misc_feature (548)..(548): n is either a, c, g or t
aggaggattttagattttagagtttagagaataggttttagagatagcgagaagatttttaaataagtttttttaagggcgtttttttcggcggcggtagcgggagggaagaggtgattttttatcggattgcgttttttaaacggttcgattttacgtttttcgcgcgtttttcgtttatcggagcgttgagcggttttttcggatcgcgttcgttttttagatataattaggtttcgtttcgagtttttttagcgtcgtcgtttcgggcgcgcgttaatcgggaaggttattcgttgtaaaaaacgttcgaattattcgttttgcgggaaaggaagcggaagtgacgtagggttagcggtttgcggttttcggaatttcgagttttttttattcgtttttatttttagcggtagcggaggcgtggtttaggggcgcgatggcgttattagcgcgcgtcgtattcggaagagacgtggtagcggagggataatcggggcggtcggggttgaagggagaggcgtaggagttttggggagagtggtttntgttttttcgcgtttagagttatcgttatcgtt

SEQ ID NO: 17868 - DNA, 581 bp, Artificial Sequence
  chemically treated genomic DNA (Homo sapiens) CpG-island No: 17868
  misc_feature (34)..(34): n is either a, c, g or t
aacgataacgataactctaaacgcgaaaaaacanaaaccactctccccaaaactcctacgcctctcccttcaaccccgaccgccccgattatccctccgctaccacgtctcttccgaatacgacgcgcgctaataacgccatcgcgcccctaaaccacgcctccgctaccgctaaaaataaaaacgaataaaaaaaactcgaaattccgaaaaccgcaaaccgctaaccctacgtcacttccgcttcctttcccgcaaaacgaataattcgaacgttttttacaacgaataaccttcccgattaacgcgcgcccgaaacgacgacgctaaaaaaactcgaaacgaaacctaattatatctaaaaaacgaacgcgatccgaaaaaaccgctcaacgctccgataaacgaaaaacgcgcgaaaaacgtaaaatcgaaccgtttaaaaaacgcaatccgataaaaaatcacctcttccctcccgctaccgccgccgaaaaaaacgcccttaaaaaaacttatttaaaaatcttctcgctatctctaaaacctattctctaaactctaaaatctaaaatcctcct

SEQ ID NO: 17869 - DNA, 551 bp, Artificial Sequence
  chemically treated genomic DNA (Homo sapiens) CpG-island No: 17869
  misc_feature (209)..(209): n is either a, c, g or t
  misc_feature (258)..(258): n is either a, c, g or t
  misc_feature (356)..(356): n is either a, c, g or t
  misc_feature (499)..(499): n is either a, c, g or t
  misc_feature (518)..(519): n is either a, c, g or t
  misc_feature (531)..(531): n is either a, c, g or t
  misc_feature (534)..(534): n is either a, c, g or t
ggcgaagcgttcgttagatttattttttcgttttttgcgttatcgtatagggcggggttcgtatttgacgttcggtttttgggtttgttttcgttttattagggaaaggggtggggtttggttttcgggcgtgggcggaaattgtcgaaaattttcggaagttttgcgaaaatatagcgcgtcgtcggtcgcgttgcgaatcggaagtnatcgaagaagtttcggaagtttcgaattattatcggcgtgcgttcgtangtatatcgcggtgttagttgttatggagtcggtcgggttttgtggtttttgttcggcgggggatgtttagttagcgcgttatatttgttttcgttgtnatgcgttttattgttcgttgcgttgttatcggacgtatggtatttgcgtaaaaaatttttatcgtgattatgtgttgggagagtttcgcggttgtagcgttttttttagtcgtttaataagcgtttttacgtcggttgcgttngtaacgcgagatcgaagannaatttggggaantanggtttattttcggttcg

SEQ ID NO: 17870 - DNA, 551 bp, Artificial Sequence
  chemically treated genomic DNA (Homo sapiens) CpG-island No: 17870
  misc_feature (18)..(18): n is either a, c, g or t
  misc_feature (21)..(21): n is either a, c, g or t
  misc_feature (33)..(34): n is either a, c, g or t
  misc_feature (53)..(53): n is either a, c, g or t
  misc_feature (196)..(196): n is either a, c, g or t
  misc_feature (294)..(294): n is either a, c, g or t
  misc_feature (343)..(343): n is either a, c, g or t
cgaaccgaaaataaaccntanttccccaaattnntcttcgatctcgcgttacnaacgcaaccgacgtaaaaacgcttattaaacgactaaaaaaaacgctacaaccgcgaaactctcccaacacataatcacgataaaaattttttacgcaaataccatacgtccgataacaacgcaacgaacaataaaacgcatnacaacgaaaacaaatataacgcgctaactaaacatcccccgccgaacaaaaaccacaaaacccgaccgactccataacaactaacaccgcgatatacntacgaacgcacgccgataataattcgaaacttccgaaacttcttcgatnacttccgattcgcaacgcgaccgacgacgcgctatattttcgcaaaacttccgaaaattttcgacaatttccgcccacgcccgaaaaccaaaccccacccctttccctaataaaacgaaaacaaacccaaaaaccgaacgtcaaatacgaaccccgccctatacgataacgcaaaaaacgaaaaaataaatctaacgaacgcttcgcc

SEQ ID NO: 17871 - DNA, 551 bp, Artificial Sequence
  chemically treated genomic DNA (Homo sapiens) CpG-island No: 17871
  misc_feature (18)..(18): n is either a, c, g or t
  misc_feature (21)..(21): n is either a, c, g or t
  misc_feature (33)..(34): n is either a, c, g or t
  misc_feature (53)..(53): n is either a, c, g or t
  misc_feature (196)..(196): n is either a, c, g or t
  misc_feature (294)..(294): n is either a, c, g or t
  misc_feature (343)..(343): n is either a, c, g or t
cgggtcggagatgagttntgnttttttaggttnnttttcggtttcgcgttgtngacgtagtcggcgtaggggcgtttgttaggcggttgggaggagcgttgtaatcgcggagtttttttagtatatggttacggtagaagttttttgcgtaggtgttatgcgttcggtagtagcgtagcgagtagtagggcgtatnatagcgagggtaggtgtaacgcgttggttggatatttttcgtcgggtagaagttatagggttcggtcggttttatggtaattggtatcgcgatatatntgcgaacgtacgtcggtggtagttcgaaattttcggggttttttcgatnattttcggttcgtagcgcggtcgacggcgcgttgtgttttcgtaaagttttcgaggattttcggtaattttcgtttacgttcgaaagttaagttttatttttttttttagtagggcgagagtaggtttagaagtcgggcgttaggtacgagtttcgttttatgcgatgacgtaaggagcgaaaaaatgggtttggcgagcgtttcgtt

SEQ ID NO: 17872 - DNA, 551 bp, Artificial Sequence
  chemically treated genomic DNA (Homo sapiens) CpG-island No: 17872
  misc_feature (209)..(209): n is either a, c, g or t
  misc_feature (258)..(258): n is either a, c, g or t
  misc_feature (356)..(356): n is either a, c, g or t
  misc_feature (499)..(499): n is either a, c, g or t
  misc_feature (518)..(519): n is either a, c, g or t
  misc_feature (531)..(531): n is either a, c, g or t
  misc_feature (534)..(534): n is either a, c, g or t
aacgaaacgctcgccaaacccattttttcgctccttacgtcatcgcataaaacgaaactcgtacctaacgcccgacttctaaacctactctcgccctactaaaaaaaaaaataaaacttaactttcgaacgtaaacgaaaattaccgaaaatcctcgaaaactttacgaaaacacaacgcgccgtcgaccgcgctacgaaccgaaaatnatcgaaaaaaccccgaaaatttcgaactaccaccgacgtacgttcgcanatatatcgcgataccaattaccataaaaccgaccgaaccctataacttctacccgacgaaaaatatccaaccaacgcgttacacctaccctcgctatnatacgccctactactcgctacgctactaccgaacgcataacacctacgcaaaaaacttctaccgtaaccatatactaaaaaaactccgcgattacaacgctcctcccaaccgcctaacaaacgcccctacgccgactacgtcnacaacgcgaaaccgaaaannaacctaaaaaancanaactcatctccgacccg

SEQ ID NO: 17873 - DNA, 515 bp, Artificial Sequence
  chemically treated genomic DNA (Homo sapiens) CpG-island No: 17873
ggttgtttttgaattgtttcgagattgagtagtttaatttatattcgtttattcgttttttttaggaagtttttcgttcgttttttttagttttttttttatttgttcggttttttagttcggtgttttcggcgcgggagggggcggttcgtagatttttaggtttcggtttttcggatttttttcgtttatttatttttcggttttcggttttcggtattggtaggcgttgtggttttcgcgtagtggttgtagtatttaaatgttcggtatttagggagaggggtgtagtcgcggagtagtcgttgttttcggtatttagaggggtttaaattttcgcgtgtttaggtcgagtttcgcgcgtagtttacgtgggttgagggattgagtattggtttttcggtagttgtaatcgcgtatagttggagttggcggggcggagggcgggtcgggatttcgcggggaaggaggttttttttttatttttttgttgttcggaaattttttcggttttt

SEQ ID NO: 17874 - DNA, 515 bp, Artificial Sequence
  chemically treated genomic DNA (Homo sapiens) CpG-island No: 17874
aaaaaccgaaaaaatttccgaacaacaaaaaaataaaaaaaaaacctccttccccgcgaaatcccgacccgccctccgccccgccaactccaactatacgcgattacaactaccgaaaaaccaatactcaatccctcaacccacgtaaactacgcgcgaaactcgacctaaacacgcgaaaatttaaacccctctaaataccgaaaacaacgactactccgcgactacacccctctccctaaataccgaacatttaaatactacaaccactacgcgaaaaccacaacgcctaccaataccgaaaaccgaaaaccgaaaaataaataaacgaaaaaaatccgaaaaaccgaaacctaaaaatctacgaaccgccccctcccgcgccgaaaacaccgaactaaaaaaccgaacaaataaaaaaaaaactaaaaaaaacgaacgaaaaacttcctaaaaaaaacgaataaacgaatataaattaaactactcaatctcgaaacaattcaaaaacaacc

SEQ ID NO: 17875 - DNA, 515 bp, Artificial Sequence
  chemically treated genomic DNA (Homo sapiens) CpG-island No: 17875
gagagtcggggggattttcgggtagtaggaggatgggaaggaagttttttttttcgcggggtttcggttcgtttttcgtttcgttagttttagttgtgcgcggttgtagttgtcggagggttaatatttagttttttagtttacgtgggttgcgcgcggggttcggtttgggtacgcgggggtttgggtttttttagatgtcgggagtagcggttgtttcgcgattgtatttttttttttaagtgtcggatatttaaatgttgtagttattgcgcggaagttatagcgtttgttagtgtcgggagtcggggatcggggagtgagtaggcgggggagattcgggaagtcgagatttgggggtttgcgagtcgttttttttcgcgtcgagagtatcgggttaggaggtcggataggtggggaaggaattggaggaagcgggcgggaggttttttggggagggcgggtgggcgagtgtgagttaaattgtttagtttcggagtagtttaggggtagtt

SEQ ID NO: 17876 - DNA, 515 bp, Artificial Sequence
  chemically treated genomic DNA (Homo sapiens) CpG-island No: 17876
aactacccctaaactactccgaaactaaacaatttaactcacactcgcccacccgccctccccaaaaaacctcccgcccgcttcctccaattccttccccacctatccgacctcctaacccgatactctcgacgcgaaaaaaaacgactcgcaaacccccaaatctcgacttcccgaatctcccccgcctactcactccccgatccccgactcccgacactaacaaacgctataacttccgcgcaataactacaacatttaaatatccgacacttaaaaaaaaaaatacaatcgcgaaacaaccgctactcccgacatctaaaaaaacccaaacccccgcgtacccaaaccgaaccccgcgcgcaacccacgtaaactaaaaaactaaatattaaccctccgacaactacaaccgcgcacaactaaaactaacgaaacgaaaaacgaaccgaaaccccgcgaaaaaaaaaacttccttcccatcctcctactacccgaaaatccccccgactctc

SEQ ID NO: 17877 - DNA, 575 bp, Artificial Sequence
  chemically treated genomic DNA (Homo sapiens) CpG-island No: 17877
tttcgagaaagtagaagcgagttttgtttcggggagttttataggagcggggatttgggaagagaaatttgcggacgagggagttagagtcgtggattttcggttttcgttcgggcgttttgcgtcggaggagggtttttgggtcgggtaggggttattttttggttcgttttttgtcgttggacgttcgaagattgggttattttttttgtcgcgtttttatcgtatatcggggtgcgttcggttcggttcggttcgttttatttagtttttcgttcgcgttcggagaggaggggtcgttggcgtagcgtttcgggatttcgagaggtcgtcgcggtatatttagattttcgtcgttttcgcgtttttttaattattttgggattttcgggtttattcgatttagcggcgcgattttggtttttcgggatttttcgttgattttatcgcgtatttttcgggatttttatatatattttagtttttcggtcgatttttttttattcggtgtcgggtgtttttcgttttttttaggttcggatttttttttttaggttttcgggtcggttttagtt

SEQ ID NO: 17878 - DNA, 575 bp, Artificial Sequence
  chemically treated genomic DNA (Homo sapiens) CpG-island No: 17878
aactaaaaccgacccgaaaacctaaaaaaaaaaatccgaacctaaaaaaaacgaaaaacacccgacaccgaataaaaaaaaatcgaccgaaaaactaaaatatatataaaaatcccgaaaaatacgcgataaaatcaacgaaaaatcccgaaaaaccaaaatcgcgccgctaaatcgaataaacccgaaaatcccaaaataattaaaaaaacgcgaaaacgacgaaaatctaaatataccgcgacgacctctcgaaatcccgaaacgctacgccaacgacccctcctctccgaacgcgaacgaaaaactaaataaaacgaaccgaaccgaaccgaacgcaccccgatatacgataaaaacgcgacaaaaaaaataacccaatcttcgaacgtccaacgacaaaaaacgaaccaaaaaataacccctacccgacccaaaaaccctcctccgacgcaaaacgcccgaacgaaaaccgaaaatccacgactctaactccctcgtccgcaaatttctcttcccaaatccccgctcctataaaactccccgaaacaaaactcgcttctactttctcgaaa

SEQ ID NO: 17879 - DNA, 575 bp, Artificial Sequence
  chemically treated genomic DNA (Homo sapiens) CpG-island No: 17879
ggttggggtcgattcggggatttgggggaggagattcgggtttggagagggcggggggtattcggtatcgagtagggagggatcggtcggagggttgggatgtgtgtgggggtttcgggaagtgcgcggtggagttagcggagggtttcggagggttagggtcgcgtcgttgggtcgggtgggttcgggaattttaggatggttgagagggcgcgggagcggcggaggtttggatgtgtcgcggcggtttttcggggtttcggggcgttgcgttagcggtttttttttttcgggcgcgagcggagggttgggtggggcgggtcgggtcgggtcgggcgtatttcgatatgcggtaagggcgcggtaagggaaatggtttaattttcggacgtttagcgataaggggcgggttaagaggtggtttttgttcgatttagagattttttttcgacgtaggacgttcgggcgggggtcgggggtttacggttttaattttttcgttcgtaagtttttttttttagattttcgtttttgtgggatttttcggggtagggttcgtttttgttttttcgaag

SEQ ID NO: 17880 - DNA, 575 bp, Artificial Sequence
  chemically treated genomic DNA (Homo sapiens) CpG-island No: 17880
cttcgaaaaaacaaaaacgaaccctaccccgaaaaatcccacaaaaacgaaaatctaaaaaaaaaaacttacgaacgaaaaaattaaaaccgtaaacccccgacccccgcccgaacgtcctacgtcgaaaaaaaatctctaaatcgaacaaaaaccacctcttaacccgccccttatcgctaaacgtccgaaaattaaaccatttcccttaccgcgcccttaccgcatatcgaaatacgcccgacccgacccgacccgccccacccaaccctccgctcgcgcccgaaaaaaaaaaaccgctaacgcaacgccccgaaaccccgaaaaaccgccgcgacacatccaaacctccgccgctcccgcgccctctcaaccatcctaaaattcccgaacccacccgacccaacgacgcgaccctaaccctccgaaaccctccgctaactccaccgcgcacttcccgaaacccccacacacatcccaaccctccgaccgatccctccctactcgataccgaataccccccgccctctccaaacccgaatctcctcccccaaatccccgaatcgaccccaacc

SEQ ID NO: 17881 - DNA, 569 bp, Artificial Sequence
  chemically treated genomic DNA (Homo sapiens) CpG-island No: 17881
ttggcggaaggcgggttaagttagtatagcgtttcgcgggcgtgggtgcgtaggtggcgtagtaggtgggagttgcggttgaagttgcggttatattgcgtgtaggagtagggtttggcgttcgtgtgtattagtaggtgtcgtagtagattgtagttgcggttgaagtttttttcgtattttacgtatttttgcgggggttcggtttgtttttgttcgggtttcgtatgggtagttaggtgtcgtcgtagatgcgcgttgcgtcggaagttgcgatcgtacgtttgatagttgtagggtcgttcgttcgtgtggttgcggcgatggcgggttaggttggagttattgcggaaacggtggtcgtaggtgtcgtaggcgtggggttttttttttgtgtggatgcgttggtggcgcgttaggtgggcgttttggttgaagtttttatcgtattcgttgtagcggtagggtttttcgttcgtgtggttgcgttggtggcgggttagattttgggtttggtcgaaatttttttcgtattgggtgtagtggtggggtcgagggttatcgtgggt

SEQ ID NO: 17882 - DNA, 569 bp, Artificial Sequence
  chemically treated genomic DNA (Homo sapiens) CpG-island No: 17882
acccacgataaccctcgaccccaccactacacccaatacgaaaaaaatttcgaccaaacccaaaatctaacccgccaccaacgcaaccacacgaacgaaaaaccctaccgctacaacgaatacgataaaaacttcaaccaaaacgcccacctaacgcgccaccaacgcatccacacaaaaaaaaaaccccacgcctacgacacctacgaccaccgtttccgcaataactccaacctaacccgccatcgccgcaaccacacgaacgaacgaccctacaactatcaaacgtacgatcgcaacttccgacgcaacgcgcatctacgacgacacctaactacccatacgaaacccgaacaaaaacaaaccgaacccccgcaaaaatacgtaaaatacgaaaaaaacttcaaccgcaactacaatctactacgacacctactaatacacacgaacgccaaaccctactcctacacgcaatataaccgcaacttcaaccgcaactcccacctactacgccacctacgcacccacgcccgcgaaacgctatactaacttaacccgccttccgccaa

SEQ ID NO: 17883 - DNA, 569 bp, Artificial Sequence
  chemically treated genomic DNA (Homo sapiens) CpG-island No: 17883
atttacggtggttttcggttttattattgtatttagtgcgggaagagtttcggttagatttaggatttggttcgttattagcgtagttatacgggcgagaagttttgtcgttgtagcgagtgcggtgagggttttagttagagcgtttatttggcgcgttattagcgtatttatataggggagaagttttacgtttgcgatatttgcggttatcgttttcgtaatagttttaatttggttcgttatcgtcgtagttatacgggcgagcggttttatagttgttagacgtgcggtcgtagttttcggcgtaacgcgtatttgcggcggtatttggttatttatgcggagttcgggtaggagtaggtcgagttttcgtaggagtgcgtggagtgcgggaagagttttagtcgtagttgtaatttgttgcgatatttgttggtgtatacgggcgttaggttttatttttgtacgtagtgtggtcgtagttttagtcgtaatttttatttgttgcgttatttgcgtatttacgttcgcgagacgttgtattagtttggttcgtttttcgttag

SEQ ID NO: 17884 - DNA, 569 bp, Artificial Sequence
  chemically treated genomic DNA (Homo sapiens) CpG-island No: 17884
ctaacgaaaaacgaaccaaactaatacaacgtctcgcgaacgtaaatacgcaaataacgcaacaaataaaaattacgactaaaactacgaccacactacgtacaaaaataaaacctaacgcccgtatacaccaacaaatatcgcaacaaattacaactacgactaaaactcttcccgcactccacgcactcctacgaaaactcgacctactcctacccgaactccgcataaataaccaaataccgccgcaaatacgcgttacgccgaaaactacgaccgcacgtctaacaactataaaaccgctcgcccgtataactacgacgataacgaaccaaattaaaactattacgaaaacgataaccgcaaatatcgcaaacgtaaaacttctcccctatataaatacgctaataacgcgccaaataaacgctctaactaaaaccctcaccgcactcgctacaacgacaaaacttctcgcccgtataactacgctaataacgaaccaaatcctaaatctaaccgaaactcttcccgcactaaatacaataataaaaccgaaaaccaccgtaaat

SEQ ID NO: 17885 - DNA, 805 bp, Artificial Sequence
  chemically treated genomic DNA (Homo sapiens) CpG-island No: 17885
aaagcgtttttcgtattgcggataggcgtagggtttttcgttcgtgtgtattcgttggtggttgattagttgcgagttttgcgtgaagttgcggtcgtaagtttggtaggagaagggtcgttcgttcgtgtgtatttttcggtgggttattaggtgttcgttgcgtcggaaggttttgtcgtagtcgttgtatacgaagggttttcggtcggagtttcggcggcggttgtcggagttttcggaggatcggcggtttttgtttttggcgtggattcgtaggtggcgtttgaggttggagcggcgttggaagttttggtcgtagtgggagtataggatatcggttagtggcggcgtttcggttttatttttaggagcgtagggcggtttttggttttgggcgtgcgttagtaggtgttgtataaggttggcgcggcgttggaagtcgcggtcgtattttgcgtataggaaggcgggttcggaggagtgggttagtaggtgtttgtttaggtgcgagttttggcggaagcggtggtcgtataggtggtaggcgtgcggtcgttcgttcgtgtgagtgcgtatgtgtagtttgagaatggagttgcggtcgaagtttttttcgtagtaaaggtataggaaggagcgtttagtcgggtgcgagcgtagttggtgcgtttttaggcgagatagttgcgggaagtttatttcgtagttcgcgtagatgaattgtaatttcggattgggttcggggacgtttttagttattttgatttttaaaattttattgttgttaagaagggatttattt

SEQ ID NO: 17886 - DNA, 805 bp, Artificial Sequence
  chemically treated genomic DNA (Homo sapiens) CpG-island No: 17886
aaataaatcccttcttaacaacaataaaattttaaaaatcaaaataactaaaaacgtccccgaacccaatccgaaattacaattcatctacgcgaactacgaaataaacttcccgcaactatctcgcctaaaaacgcaccaactacgctcgcacccgactaaacgctccttcctatacctttactacgaaaaaaacttcgaccgcaactccattctcaaactacacatacgcactcacacgaacgaacgaccgcacgcctaccacctatacgaccaccgcttccgccaaaactcgcacctaaacaaacacctactaacccactcctccgaacccgccttcctatacgcaaaatacgaccgcgacttccaacgccgcgccaaccttatacaacacctactaacgcacgcccaaaaccaaaaaccgccctacgctcctaaaaataaaaccgaaacgccgccactaaccgatatcctatactcccactacgaccaaaacttccaacgccgctccaacctcaaacgccacctacgaatccacgccaaaaacaaaaaccgccgatcctccgaaaactccgacaaccgccgccgaaactccgaccgaaaacccttcgtatacaacgactacgacaaaaccttccgacgcaacgaacacctaataacccaccgaaaaatacacacgaacgaacgacccttctcctaccaaacttacgaccgcaacttcacgcaaaactcgcaactaatcaaccaccaacgaatacacacgaacgaaaaaccctacgcctatccgcaatacgaaaaacgcttt

SEQ ID NO: 17887 - DNA, 805 bp, Artificial Sequence
  chemically treated genomic DNA (Homo sapiens) CpG-island No: 17887
agatgggtttttttttggtagtagtgaaattttggaggttaaagtggttgagggcgttttcgagtttaattcggagttgtagtttatttgcgcggattgcggggtgagtttttcgtagttgtttcgtttgaaggcgtattagttgcgttcgtattcggttgggcgtttttttttgtgtttttgttgcgggaagagtttcggtcgtagttttatttttaagttgtatatgcgtatttatacggacgagcggtcgtacgtttgttatttgtgcggttatcgttttcgttagagttcgtatttgagtaagtatttgttgatttattttttcgaattcgtttttttgtgcgtagagtgcggtcgcggtttttagcgtcgcgttagttttgtgtagtatttgttggcgtacgtttaggattagaagtcgttttgcgtttttgagagtaaggtcgaagcgtcgttattgatcgatgttttgtgtttttattgcggttagagtttttagcgtcgttttagttttaagcgttatttgcggatttacgttagggataaggatcgtcggtttttcgaaggtttcggtagtcgtcgtcgggatttcgatcggaggtttttcgtgtgtagcgattgcggtaaggtttttcggcgtagcgagtatttggtggtttatcggagggtgtatacgggcgagcggttttttttttgttaggtttgcggtcgtagttttacgtagagttcgtagttggttagttattaacgggtgtatacgggcgagaagttttacgtttgttcgtagtgcgggaagcgtttt

SEQ ID NO: 17888 - DNA, 805 bp, Artificial Sequence
  chemically treated genomic DNA (Homo sapiens) CpG-island No: 17888
aaaacgcttcccgcactacgaacaaacgtaaaacttctcgcccgtatacacccgttaataactaaccaactacgaactctacgtaaaactacgaccgcaaacctaacaaaaaaaaaaccgctcgcccgtatacaccctccgataaaccaccaaatactcgctacgccgaaaaaccttaccgcaatcgctacacacgaaaaacctccgatcgaaatcccgacgacgactaccgaaaccttcgaaaaaccgacgatccttatccctaacgtaaatccgcaaataacgcttaaaactaaaacgacgctaaaaactctaaccgcaataaaaacacaaaacatcgatcaataacgacgcttcgaccttactctcaaaaacgcaaaacgacttctaatcctaaacgtacgccaacaaatactacacaaaactaacgcgacgctaaaaaccgcgaccgcactctacgcacaaaaaaacgaattcgaaaaaataaatcaacaaatacttactcaaatacgaactctaacgaaaacgataaccgcacaaataacaaacgtacgaccgctcgtccgtataaatacgcatatacaacttaaaaataaaactacgaccgaaactcttcccgcaacaaaaacacaaaaaaaaacgcccaaccgaatacgaacgcaactaatacgccttcaaacgaaacaactacgaaaaactcaccccgcaatccgcgcaaataaactacaactccgaattaaactcgaaaacgccctcaaccactttaacctccaaaatttcactactaccaaaaaaaaacccatct

SEQ ID NO: 17889 - DNA, 520 bp, Artificial Sequence
  chemically treated genomic DNA (Homo sapiens) CpG-island No: 17889
aagtcgattcgagggtggggtgttttcgtttcgtttgttttttacggcgattgttttcgcgtttcgggttggataggtggggcgtcgcgaaaaggttcggtaagtcggaagttgtaatggggtagtcggacgtaaaacgcggggatatcggtcgggattcgttaagttagggtgagttgtcgatcggggacgcgaacgggagcgcgtaggtgagggcggcggggcggggttggggcgggggcggggttattgaggttgcggttaattatcggcgtttttcgtgggcggggcggggtcgttgtttgggcgataggttttagcgtttgcgttttgtgaatttagtcgttgggttgtgcggataggttcgcgtggggtttttgggtttttcgtagtcgcgtaggtttcgggaatcgggtcgtttttttgttttcggatttttacgcgttggtgttcggtggttttgggaaatttttttttttaataatgtgtattttttgggttttatttatttaatattttt

SEQ ID NO: 17890 - DNA, 520 bp, Artificial Sequence
  chemically treated genomic DNA (Homo sapiens) CpG-island No: 17890
aaaaatattaaataaataaaacccaaaaaatacacattattaaaaaaaaaaatttcccaaaaccaccgaacaccaacgcgtaaaaatccgaaaacaaaaaaacgacccgattcccgaaacctacgcgactacgaaaaacccaaaaaccccacgcgaacctatccgcacaacccaacgactaaattcacaaaacgcaaacgctaaaacctatcgcccaaacaacgaccccgccccgcccacgaaaaacgccgataattaaccgcaacctcaataaccccgcccccgccccaaccccgccccgccgccctcacctacgcgctcccgttcgcgtccccgatcgacaactcaccctaacttaacgaatcccgaccgatatccccgcgttttacgtccgactaccccattacaacttccgacttaccgaaccttttcgcgacgccccacctatccaacccgaaacgcgaaaacaatcgccgtaaaaaacaaacgaaacgaaaacaccccaccctcgaatcgactt

SEQ ID NO: 17891 - DNA, 520 bp, Artificial Sequence
  chemically treated genomic DNA (Homo sapiens) CpG-island No: 17891
agaagtgttagataggtaggatttaaggaatatatattgttaaaagaaaagattttttagggttatcggatattagcgcgtgagaattcggaggtagggaggcgattcggttttcgaaatttacgcggttgcgggaggtttaggagttttacgcgaatttgttcgtatagtttagcggttaggtttatagaacgtagacgttggagtttgtcgtttaagtaacggtttcgtttcgtttacgggaggcgtcggtgattggtcgtagttttagtggtttcgttttcgttttagtttcgtttcgtcgtttttatttgcgcgttttcgttcgcgttttcgatcggtagtttattttagtttggcggatttcggtcggtgttttcgcgttttgcgttcggttgttttattgtaattttcggtttgtcgggttttttcgcggcgttttatttgtttagttcggggcgcgggggtaatcgtcgtgaggagtaggcggggcgagggtattttattttcgagtcggttt

SEQ ID NO: 17892 - DNA, 520 bp, Artificial Sequence
  chemically treated genomic DNA (Homo sapiens) CpG-island No: 17892
aaaccgactcgaaaataaaataccctcgccccgcctactcctcacgacgattacccccgcgccccgaactaaacaaataaaacgccgcgaaaaaacccgacaaaccgaaaattacaataaaacaaccgaacgcaaaacgcgaaaacaccgaccgaaatccgccaaactaaaataaactaccgatcgaaaacgcgaacgaaaacgcgcaaataaaaacgacgaaacgaaactaaaacgaaaacgaaaccactaaaactacgaccaatcaccgacgcctcccgtaaacgaaacgaaaccgttacttaaacgacaaactccaacgtctacgttctataaacctaaccgctaaactatacgaacaaattcgcgtaaaactcctaaacctcccgcaaccgcgtaaatttcgaaaaccgaatcgcctccctacctccgaattctcacgcgctaatatccgataaccctaaaaaatcttttcttttaacaatatatattccttaaatcctacctatctaacacttct

SEQ ID NO: 17893 - DNA, 872 bp, Artificial Sequence
  chemically treated genomic DNA (Homo sapiens) CpG-island No: 17893
gttgcgttttcggacgtttttaaagtttagggcggcgattggtacgattgttaggggcgcgtttgttaagaggatagggggtttcgtttcggtatagtcgttttttttaggatttttttcgtcgacgttttacggattttacgttcgagcggagatcggcgcgagttcggggttttcggttcggtagtttttttttggttcggcgttttaaagggaagcggtttgggggaggagacgtgtggaaagagcggtagaagataaagaggaagtagcggtagagaataaaaaggaattgttcgtagtgtgttcggacgcggggaggcgttggggttaagcgagattcgatttgtacgtaattttcgtcggggtttcggtttgtttgcgggagggaaaggatttagggcggtttttgttaaaagtgcggtttttgtcgaaagtgcgttttttgtcgaggggtttatataaggcgcgatagatattttagttcgatttcgacgtttcgtttttacgtatgtatatgcgcggaatatttttagaaatatattttttagagcgtttcgggagtacgcgagttaattggagggcggattagcgggggtttacgttttttagaggttttcgagtcgcggttttgttggtttgattggtagtcgtaatagtttatagttgtttttcgtcggaggggttacgcgtcgtttgtcgggattgagtcgttgttgtcgttggtatttcgggagtagcgtcggtaagtggagtcgtcgtatttcgggcggttcgcggtttacggggatgggacgtttcggggttgtgttgattttaaaatttttttatattttattagtttgtcgttttttttttatgtttatagtaaa

SEQ ID NO: 17894 - DNA, 872 bp, Artificial Sequence
  chemically treated genomic DNA (Homo sapiens) CpG-island No: 17894
tttactataaacataaaaaaaaaacgacaaactaataaaatataaaaaaattttaaaatcaacacaaccccgaaacgtcccatccccgtaaaccgcgaaccgcccgaaatacgacgactccacttaccgacgctactcccgaaataccaacgacaacaacgactcaatcccgacaaacgacgcgtaacccctccgacgaaaaacaactataaactattacgactaccaatcaaaccaacaaaaccgcgactcgaaaacctctaaaaaacgtaaacccccgctaatccgccctccaattaactcgcgtactcccgaaacgctctaaaaaatatatttctaaaaatattccgcgcatatacatacgtaaaaacgaaacgtcgaaatcgaactaaaatatctatcgcgccttatataaacccctcgacaaaaaacgcactttcgacaaaaaccgcacttttaacaaaaaccgccctaaatcctttccctcccgcaaacaaaccgaaaccccgacgaaaattacgtacaaatcgaatctcgcttaaccccaacgcctccccgcgtccgaacacactacgaacaattcctttttattctctaccgctacttcctctttatcttctaccgctctttccacacgtctcctcccccaaaccgcttccctttaaaacgccgaaccaaaaaaaaactaccgaaccgaaaaccccgaactcgcgccgatctccgctcgaacgtaaaatccgtaaaacgtcgacgaaaaaaatcctaaaaaaaacgactataccgaaacgaaaccccctatcctcttaacaaacgcgcccctaacaatcgtaccaatcgccgccctaaactttaaaaacgtccgaaaacgcaac

SEQ ID NO: 17895 - DNA, 872 bp, Artificial Sequence
  chemically treated genomic DNA (Homo sapiens) CpG-island No: 17895
tttgttgtaaatatgaaagaagggcgataggttaataaagtgtggaagggttttggggttagtatagtttcgggacgttttattttcgtgggtcgcgggtcgttcggaatacgacgattttatttgtcggcgttgttttcgggatattagcgataatagcggtttagtttcggtaaacggcgcgtggttttttcggcgaaaagtagttataggttgttgcggttgttaattagattaatagagtcgcgattcggagatttttgggagacgtgggttttcgttaattcgttttttaattggttcgcgtgttttcggggcgttttgggagatgtgtttttgggagtgtttcgcgtatgtgtatgcgtgagggcggggcgtcggggtcgggttggagtgtttgtcgcgttttatgtgggtttttcggtagaagacgtattttcggtagaagtcgtatttttggtagaagtcgttttgggttttttttttttcgtaggtaggtcgggatttcggcgggaattgcgtgtaggtcgggtttcgtttgattttagcgttttttcgcgttcgggtatattgcggatagtttttttttattttttatcgttattttttttttattttttgtcgttttttttatacgtttttttttttaggtcgtttttttttggggcgtcgggttagggaggggttgtcggatcggagatttcggattcgcgtcggttttcgttcgggcgtggggttcgtggggcgtcggcgggaggggttttggaggagacggttgtgtcggggcgggattttttgtttttttaatagacgcgtttttgatagtcgtgttagtcgtcgttttgggttttggggacgttcgaggacgtagt

SEQ ID NO: 17896 - DNA, 872 bp, Artificial Sequence
  chemically treated genomic DNA (Homo sapiens) CpG-island No: 17896
actacgtcctcgaacgtccccaaaacccaaaacgacgactaacacgactatcaaaaacgcgtctattaaaaaaacaaaaaatcccgccccgacacaaccgtctcctccaaaacccctcccgccgacgccccacgaaccccacgcccgaacgaaaaccgacgcgaatccgaaatctccgatccgacaacccctccctaacccgacgccccaaaaaaaaacgacctaaaaaaaaaaacgtataaaaaaaacgacaaaaaataaaaaaaaaataacgataaaaaataaaaaaaaactatccgcaatatacccgaacgcgaaaaaacgctaaaatcaaacgaaacccgacctacacgcaattcccgccgaaatcccgacctacctacgaaaaaaaaaaaacccaaaacgacttctaccaaaaatacgacttctaccgaaaatacgtcttctaccgaaaaacccacataaaacgcgacaaacactccaacccgaccccgacgccccgccctcacgcatacacatacgcgaaacactcccaaaaacacatctcccaaaacgccccgaaaacacgcgaaccaattaaaaaacgaattaacgaaaacccacgtctcccaaaaatctccgaatcgcgactctattaatctaattaacaaccgcaacaacctataactacttttcgccgaaaaaaccacgcgccgtttaccgaaactaaaccgctattatcgctaatatcccgaaaacaacgccgacaaataaaatcgtcgtattccgaacgacccgcgacccacgaaaataaaacgtcccgaaactatactaaccccaaaacccttccacactttattaacctatcgcccttctttcatatttacaacaaa

SEQ ID NO: 17897 - DNA, 1037 bp, Artificial Sequence
  chemically treated genomic DNA (Homo sapiens) CpG-island No: 17897
gcgtttttcgaagtttagcgttagcgtcgcgtaatttgtcgtaggggcggttttcgggttaggtagttaggcgcgttttcgttttattcgggaacgttaggttcgcgtagggaggggcggggttttatggcggtttcgtttcgtcgttcggagggttataatgtagggttagggcggtcggcgggcggggttttgcgggggaggagtcgtcgggcgggggcggggatggcgcgtgggggaggggagggaggaggattcgcggagggaggaggataacgttatttcgggcggtcgtttttttcgtttttttttttttttttttaaagtagttcgcggatcggtagtaaaggaacgtgcgaacgcgtgacgtcgttcgattggttcgcgttttttcgtgtttcggcgtttttcgttcgtttatggttcgggtcgtcgcggacgagcggcgttgaggcgggtcgcgtggagacgtgaggcggtcgtcgtggtttttatagtcggcgtttcgtcgtttgttcgcggtgttcgcgtacgtcggtcgttatcgttttcgcgtttggttggcgggggcgttgtttttttaggtcgttcgcgtcgttttttggagttcggcggagcgcggtagttagggtcggcggaggcgcgaggagtcgggcgttatcgtcgtcgtcgtcgtcgtcgtcgcgggggttatgatcgtggagtagaacgtgttgtagtagagcgcggcgtagaaggtgaggcgagttcgttagtcggcgggttttattttttttttcgacgggttgttttttttcgttgcggtcgggcgtttcggtttcgtcgtcgtcgttttttcgggtttttttttcggttattttcggtttttgtttatcgtttcgggggcgtcgcgtttagagtttagttgcgtgtgggaagtagagtgtagtttgcgggttttaatttatttttttttgtcgattgttttttcgtagtagacggtgttaggtattgagagcgatttttatatttttatagtgttttgtgtggtattttaa

SEQ ID NO: 17898 - DNA, 1037 bp, Artificial Sequence
  chemically treated genomic DNA (Homo sapiens) CpG-island No: 17898
ttaaaataccacacaaaacactataaaaatataaaaatcgctctcaatacctaacaccgtctactacgaaaaaacaatcgacaaaaaaaaataaattaaaacccgcaaactacactctacttcccacacgcaactaaactctaaacgcgacgcccccgaaacgataaacaaaaaccgaaaataaccgaaaaaaaaacccgaaaaaacgacgacgacgaaaccgaaacgcccgaccgcaacgaaaaaaaacaacccgtcgaaaaaaaaaataaaacccgccgactaacgaactcgcctcaccttctacgccgcgctctactacaacacgttctactccacgatcataacccccgcgacgacgacgacgacgacgacgataacgcccgactcctcgcgcctccgccgaccctaactaccgcgctccgccgaactccaaaaaacgacgcgaacgacctaaaaaaacaacgcccccgccaaccaaacgcgaaaacgataacgaccgacgtacgcgaacaccgcgaacaaacgacgaaacgccgactataaaaaccacgacgaccgcctcacgtctccacgcgacccgcctcaacgccgctcgtccgcgacgacccgaaccataaacgaacgaaaaacgccgaaacacgaaaaaacgcgaaccaatcgaacgacgtcacgcgttcgcacgttcctttactaccgatccgcgaactactttaaaaaaaaaaaaaaaaaaacgaaaaaaacgaccgcccgaaataacgttatcctcctccctccgcgaatcctcctccctcccctcccccacgcgccatccccgcccccgcccgacgactcctcccccgcaaaaccccgcccgccgaccgccctaaccctacattataaccctccgaacgacgaaacgaaaccgccataaaaccccgcccctccctacgcgaacctaacgttcccgaataaaacgaaaacgcgcctaactacctaacccgaaaaccgcccctacgacaaattacgcgacgctaacgctaaacttcgaaaaacgc

SEQ ID NO: 17899 - DNA, 1037 bp, Artificial Sequence
  chemically treated genomic DNA (Homo sapiens) CpG-island No: 17899
ttaagatgttatatagagtattgtaggaatgtgagggtcgtttttaatatttggtatcgtttgttacgggaaaataatcggtagaaggaagtggattgaagttcgtaaattatattttgttttttatacgtagttgggttttgggcgcgacgttttcgaggcgatgggtaggggtcgggggtgatcggggaggaagttcgggaaggcggcggcggcgaggtcggggcgttcggtcgtagcgggagaggatagttcgtcggaaggagaagtggggttcgtcggttggcggattcgttttattttttgcgtcgcgttttgttgtagtacgttttgttttacggttatggttttcgcggcggcggcggcggcggcggcggtggcgttcggtttttcgcgttttcgtcggttttggttgtcgcgtttcgtcgagttttagggagcggcgcggacggtttgggaggatagcgttttcgttagttaggcgcgaaggcgatggcggtcggcgtgcgcgggtatcgcgggtaggcggcgaaacgtcgattgtgagggttacggcggtcgttttacgtttttacgcggttcgttttagcgtcgttcgttcgcggcggttcgggttatgagcgggcggaggacgtcggggtacgggagagcgcgagttagtcgggcggcgttacgcgttcgtacgtttttttgttgtcggttcgcgggttgttttggggaagggagagaggggacggagggagcggtcgttcggaatggcgttgttttttttttttcgcgagtttttttttttttttttttttacgcgttattttcgttttcgttcggcggtttttttttcgtagagtttcgttcgtcggtcgttttaattttatattgtgatttttcgggcggcggggcggggtcgttatggagtttcgtttttttttgcgcgggtttggcgttttcgggtggggcgagggcgcgtttggttgtttggttcgggagtcgtttttgcggtaggttgcgcgacgttggcgttgggtttcggggagcgt

SEQ ID NO: 17900 - DNA, 1037 bp, Artificial Sequence
  chemically treated genomic DNA (Homo sapiens) CpG-island No: 17900
acgctccccgaaacccaacgccaacgtcgcgcaacctaccgcaaaaacgactcccgaaccaaacaaccaaacgcgccctcgccccacccgaaaacgccaaacccgcgcaaaaaaaaacgaaactccataacgaccccgccccgccgcccgaaaaatcacaatataaaattaaaacgaccgacgaacgaaactctacgaaaaaaaaaccgccgaacgaaaacgaaaataacgcgtaaaaaaaaaaaaaaaaaaaaactcgcgaaaaaaaaaaaacaacgccattccgaacgaccgctccctccgtcccctctctcccttccccaaaacaacccgcgaaccgacaacaaaaaaacgtacgaacgcgtaacgccgcccgactaactcgcgctctcccgtaccccgacgtcctccgcccgctcataacccgaaccgccgcgaacgaacgacgctaaaacgaaccgcgtaaaaacgtaaaacgaccgccgtaaccctcacaatcgacgtttcgccgcctacccgcgatacccgcgcacgccgaccgccatcgccttcgcgcctaactaacgaaaacgctatcctcccaaaccgtccgcgccgctccctaaaactcgacgaaacgcgacaaccaaaaccgacgaaaacgcgaaaaaccgaacgccaccgccgccgccgccgccgccgccgcgaaaaccataaccgtaaaacaaaacgtactacaacaaaacgcgacgcaaaaaataaaacgaatccgccaaccgacgaaccccacttctccttccgacgaactatcctctcccgctacgaccgaacgccccgacctcgccgccgccgccttcccgaacttcctccccgatcacccccgacccctacccatcgcctcgaaaacgtcgcgcccaaaacccaactacgtataaaaaacaaaatataatttacgaacttcaatccacttccttctaccgattattttcccgtaacaaacgataccaaatattaaaaacgaccctcacattcctacaatactctatataacatcttaa

SEQ ID NO: 17901 - DNA, 602 bp, Artificial Sequence
  chemically treated genomic DNA (Homo sapiens) CpG-island No: 17901
ggacgggaaacgtttcgaaagtagttagattcggcgattgaaatgaggcggaggagtttggcgaggggaggcgtaggttcggaaaggcgcgcgaggttttaggttttttttcgatttatcgtttttttcgttgattttcgagttattttcggaagttttcgttattgtcgggcgaatagattttcgcggatttttaagcgcgcggggtcggggttttagtttaggttttcgttgtttttttaagggttttcgaaatttttttttcggtattagatgagtttcgttatattcgttggtcgtggtcgttggggcgtttttcgaggaaattcgggattcgagtttttcggggaagaggcgcggtttgagttcggcgagggtggggagggtaggcgtaggtggatttcggcgtttttcgagtttcgttgtgattttggtcgcgggggaggggttgggtcgttgcggggtagtcgcggtcgttagagggggtagcggagaagaatttgtttaatttggcggcgcgggttggggcggttttgcgttttcgcgttcgttttttcgggtttcgtttttttttttttcgcgagtttttttttttttcgcga

SEQ ID NO: 17902 - DNA, 602 bp, Artificial Sequence
  chemically treated genomic DNA (Homo sapiens) CpG-island No: 17902
tcgcgaaaaaaaaaaaaactcgcgaaaaaaaaaaaaacgaaacccgaaaaaacgaacgcgaaaacgcaaaaccgccccaacccgcgccgccaaattaaacaaattcttctccgctaccccctctaacgaccgcgactaccccgcaacgacccaacccctcccccgcgaccaaaatcacaacgaaactcgaaaaacgccgaaatccacctacgcctaccctccccaccctcgccgaactcaaaccgcgcctcttccccgaaaaactcgaatcccgaatttcctcgaaaaacgccccaacgaccacgaccaacgaatataacgaaactcatctaataccgaaaaaaaaatttcgaaaacccttaaaaaaacaacgaaaacctaaactaaaaccccgaccccgcgcgcttaaaaatccgcgaaaatctattcgcccgacaataacgaaaacttccgaaaataactcgaaaatcaacgaaaaaaacgataaatcgaaaaaaaacctaaaacctcgcgcgcctttccgaacctacgcctcccctcgccaaactcctccgcctcatttcaatcgccgaatctaactactttcgaaacgtttcccgtcc

SEQ ID NO: 17903 - DNA, 602 bp, Artificial Sequence
  chemically treated genomic DNA (Homo sapiens) CpG-island No: 17903
tcgcgggaggggaggaggttcgcgggaggggagaaggcggagttcggggaggcgggcgcggaggcgtagagtcgttttagttcgcgtcgttaagttgggtaagttttttttcgttgttttttttggcggtcgcgattgtttcgtagcggtttagtttttttttcgcggttaaggttatagcggggttcggggggcgtcggggtttatttgcgtttgttttttttattttcgtcgggtttaggtcgcgtttttttttcgggaaattcgagtttcgaattttttcggaaagcgttttagcggttacggttaacggatgtgacgaggtttatttgatatcggggggaaagtttcgagaatttttaaaggggtagcgagggtttgaattagggtttcggtttcgcgcgtttgggggttcgcgggggtttattcgttcggtagtggcgggagttttcgggggtgattcggaggttagcgaggagagcggtggatcgggaaggagtttggagtttcgcgcgttttttcgagtttgcgttttttttcgttaagttttttcgttttattttagtcgtcgggtttggttgttttcgaggcgtttttcgttt

SEQ ID NO: 17904 - DNA, 602 bp, Artificial Sequence
  chemically treated genomic DNA (Homo sapiens) CpG-island No: 17904
aaacgaaaaacgcctcgaaaacaaccaaacccgacgactaaaataaaacgaaaaaacttaacgaaaaaaaacgcaaactcgaaaaaacgcgcgaaactccaaactccttcccgatccaccgctctcctcgctaacctccgaatcacccccgaaaactcccgccactaccgaacgaataaacccccgcgaacccccaaacgcgcgaaaccgaaaccctaattcaaaccctcgctacccctttaaaaattctcgaaactttccccccgatatcaaataaacctcgtcacatccgttaaccgtaaccgctaaaacgctttccgaaaaaattcgaaactcgaatttcccgaaaaaaaaacgcgacctaaacccgacgaaaataaaaaaaacaaacgcaaataaaccccgacgccccccgaaccccgctataaccttaaccgcgaaaaaaaaactaaaccgctacgaaacaatcgcgaccgccaaaaaaaacaacgaaaaaaaacttacccaacttaacgacgcgaactaaaacgactctacgcctccgcgcccgcctccccgaactccgccttctcccctcccgcgaacctcctcccctcccgcga

SEQ ID NO: 17905 - DNA, 1220 bp, Artificial Sequence
  chemically treated genomic DNA (Homo sapiens) CpG-island No: 17905
tttagacgtttgttttcgagtcgatttcgtgtattcgatataggatttcgtatttagggcgatgtcgggggagagggcgattttaattagtaatgatttaggagaggagtacgtaaagacgtttcggggatattgttggggcgggattcgagggcgtcgcgttttgtaggagtagtagcgcggggttcgatatcgggcgtttaaggaggcgttgggcgcgcgtttttttagttggggaggagacgggcgtggagcggaggcgtggttaggttcggagggggcggagttcgcggtatagcgcgtttcgcgggggtagagggggcgtattttgggcgggtttatttaggggcggggttttagagggcggggaggggcggagtttgttaggggcgggacgcggggcggagtcggggtgggggcggagtcgggttgggggcgggacgttcgcgatagacgcgcgtgtaggcggggtcgtcgcgtttattttgggttttttttcggatatggttgcgcgagcggcgcggggaggcggcgcgggggaagtagcgcggagcgggcgagttacgttttcggtttcgtcgttttttcgtcgtaattgtgcgcggggtcgcgttttattttttaaatttcggcgtattcgttggtcggtacgggggttacgtggttgcgcgcgtttacgaggcgcgtttttcggggcgtcgggcgcgcgtaggtcgggtcgcggttttgggcggttggagatgcgttacggggcgggtttcgcgcgatttcgtcgggcgcggaagttttagggcgttgtggggcgcgggttaggagcgtttacggggagttcgggttttggggatttttgttcgttttttcgcgtcgttcgggtttcgattttttttttgggggtcgcgtttttggggcgtcgggaagtgaggtcggggtcgtcgtttatggtcgtagggatttggggcggaggagggaggacgttgggggtgacgtttttttttaggagtcgcggatagagcggagaaggcggttcgcggggtttcgttcgcgggggtcgcgcgaatcgggttagtattttagacgattgggggcgttattcgtttttttgtcgtcgcggttttttgttagttttaggtcgggtttttttggttaacgtttttacggggttgtttcgggttttttatattcgtttttaagaagattcgttttatttgtgaagaaattga

SEQ ID NO: 17906 - DNA, 1220 bp, Artificial Sequence
  chemically treated genomic DNA (Homo sapiens) CpG-island No: 17906
tcaatttcttcacaaataaaacgaatcttcttaaaaacgaatataaaaaacccgaaacaaccccgtaaaaacgttaaccaaaaaaacccgacctaaaactaacaaaaaaccgcgacgacaaaaaaacgaataacgcccccaatcgtctaaaatactaacccgattcgcgcgacccccgcgaacgaaaccccgcgaaccgccttctccgctctatccgcgactcctaaaaaaaaacgtcacccccaacgtcctccctcctccgccccaaatccctacgaccataaacgacgaccccgacctcacttcccgacgccccaaaaacgcgacccccaaaaaaaaaatcgaaacccgaacgacgcgaaaaaacgaacaaaaatccccaaaacccgaactccccgtaaacgctcctaacccgcgccccacaacgccctaaaacttccgcgcccgacgaaatcgcgcgaaacccgccccgtaacgcatctccaaccgcccaaaaccgcgacccgacctacgcgcgcccgacgccccgaaaaacgcgcctcgtaaacgcgcgcaaccacgtaacccccgtaccgaccaacgaatacgccgaaatttaaaaaataaaacgcgaccccgcgcacaattacgacgaaaaaacgacgaaaccgaaaacgtaactcgcccgctccgcgctacttcccccgcgccgcctccccgcgccgctcgcgcaaccatatccgaaaaaaaacccaaaataaacgcgacgaccccgcctacacgcgcgtctatcgcgaacgtcccgcccccaacccgactccgcccccaccccgactccgccccgcgtcccgcccctaacaaactccgcccctccccgccctctaaaaccccgcccctaaataaacccgcccaaaatacgccccctctacccccgcgaaacgcgctataccgcgaactccgccccctccgaacctaaccacgcctccgctccacgcccgtctcctccccaactaaaaaaacgcgcgcccaacgcctccttaaacgcccgatatcgaaccccgcgctactactcctacaaaacgcgacgccctcgaatcccgccccaacaatatccccgaaacgtctttacgtactcctctcctaaatcattactaattaaaatcgccctctcccccgacatcgccctaaatacgaaatcctatatcgaatacacgaaatcgactcgaaaacaaacgtctaaa

SEQ ID NO: 17907 - DNA, 1220 bp, Artificial Sequence
  chemically treated genomic DNA (Homo sapiens) CpG-island No: 17907
ttagtttttttataggtaaaacgggtttttttgaggacgggtgtggagggttcggggtagtttcgtaggagcgttggttaaaggagttcggtttggggttgataggaaatcgcggcggtagggaggcgggtggcgtttttaatcgtttagggtgttggttcgattcgcgcggttttcgcggacgggatttcgcgggtcgtttttttcgttttgttcgcggtttttgagagggaacgttatttttagcgttttttttttttcgttttaggtttttgcggttatgggcggcggtttcggttttatttttcggcgttttaggaacgcggtttttaggaaaggagtcggggttcgggcgacgcggggaggcgggtaagggtttttagggttcgggtttttcgtaaacgtttttggttcgcgttttatagcgttttagggttttcgcgttcgacggggtcgcgcgggattcgtttcgtgacgtatttttaatcgtttagagtcgcggttcggtttgcgcgcgttcgacgtttcggggagcgcgtttcgtgaacgcgcgtagttacgtgattttcgtgtcggttaacgggtgcgtcgggatttgggggataaagcgcggtttcgcgtatagttgcggcgggagagcggcggggtcgagagcgtgattcgttcgtttcgcgttgtttttttcgcgtcgttttttcgcgtcgttcgcgtagttatgttcgaggagaagtttaaggtaagcgcggcgatttcgtttgtacgcgcgtttatcgcgggcgtttcgtttttagttcggtttcgtttttatttcgatttcgtttcgcgtttcgtttttgataggtttcgttttttttcgttttttagagtttcgtttttaagtgggttcgtttaaggtgcgttttttttgttttcgcgaagcgcgttgtgtcgcgagtttcgtttttttcgggtttggttacgttttcgttttacgttcgttttttttttagttgggaaggcgcgcgtttagcgtttttttgagcgttcggtgtcgggtttcgcgttgttgtttttgtagagcgcggcgttttcggatttcgttttagtagtgttttcgaagcgtttttgcgtgttttttttttgagttattgttggttggggtcgttttttttttcggtatcgttttgggtgcgggattttgtgtcgagtgtacggagtcggttcgggaataagcgtttggg

SEQ ID NO: 17908 - DNA, 1220 bp, Artificial Sequence
  chemically treated genomic DNA (Homo sapiens) CpG-island No: 17908
cccaaacgcttattcccgaaccgactccgtacactcgacacaaaatcccgcacccaaaacgataccgaaaaaaaaaacgaccccaaccaacaataactcaaaaaaaaaacacgcaaaaacgcttcgaaaacactactaaaacgaaatccgaaaacgccgcgctctacaaaaacaacaacgcgaaacccgacaccgaacgctcaaaaaaacgctaaacgcgcgccttcccaactaaaaaaaaaacgaacgtaaaacgaaaacgtaaccaaacccgaaaaaaacgaaactcgcgacacaacgcgcttcgcgaaaacaaaaaaaacgcaccttaaacgaacccacttaaaaacgaaactctaaaaaacgaaaaaaaacgaaacctatcaaaaacgaaacgcgaaacgaaatcgaaataaaaacgaaaccgaactaaaaacgaaacgcccgcgataaacgcgcgtacaaacgaaatcgccgcgcttaccttaaacttctcctcgaacataactacgcgaacgacgcgaaaaaacgacgcgaaaaaaacaacgcgaaacgaacgaatcacgctctcgaccccgccgctctcccgccgcaactatacgcgaaaccgcgctttatcccccaaatcccgacgcacccgttaaccgacacgaaaatcacgtaactacgcgcgttcacgaaacgcgctccccgaaacgtcgaacgcgcgcaaaccgaaccgcgactctaaacgattaaaaatacgtcacgaaacgaatcccgcgcgaccccgtcgaacgcgaaaaccctaaaacgctataaaacgcgaaccaaaaacgtttacgaaaaacccgaaccctaaaaacccttacccgcctccccgcgtcgcccgaaccccgactcctttcctaaaaaccgcgttcctaaaacgccgaaaaataaaaccgaaaccgccgcccataaccgcaaaaacctaaaacgaaaaaaaaaaaacgctaaaaataacgttccctctcaaaaaccgcgaacaaaacgaaaaaaacgacccgcgaaatcccgtccgcgaaaaccgcgcgaatcgaaccaacaccctaaacgattaaaaacgccacccgcctccctaccgccgcgatttcctatcaaccccaaaccgaactcctttaaccaacgctcctacgaaactaccccgaaccctccacacccgtcctcaaaaaaacccgttttacctataaaaaaactaa

SEQ ID NO: 17909 - DNA, 518 bp, Artificial Sequence
  chemically treated genomic DNA (Homo sapiens) CpG-island No: 17909
ggcgggaacgtaattttagtattttgcggttttcgttacggggtcgcgttttttttttgatatttagagtttgcggtttttagaggcgttttcggaataaatcggggcgcgtagagtttttttcgtcgttgtttgggggtcgtaggattgttttagggttcgtgattgacggattagttttcggtattgagttttgtgtttttttagttataggcgatgttgtcggaaacgtgtgtttttttatttaggagttagtttgtcgtagatcgatttttggatcgtcgaggtcgtttattttttttagaagtttgttttttttcgattcgatcggtgggaggtcgcgttttcgacgtttgttaggagtttcgtttgtagtcgaggcgtttttttcgcgtcgcgggtttttgtggtaacggtcgtttttcggttggttttttttttgttttttgttttttcgttggcgattggggaggttcgtggttaacgaggttttagcgattatttgggggacgttttgt

SEQ ID NO: 17910 - DNA, 518 bp, Artificial Sequence
  chemically treated genomic DNA (Homo sapiens) CpG-island No: 17910
acaaaacgtcccccaaataatcgctaaaacctcgttaaccacgaacctccccaatcgccaacgaaaaaacaaaaaacaaaaaaaaaaccaaccgaaaaacgaccgttaccacaaaaacccgcgacgcgaaaaaaacgcctcgactacaaacgaaactcctaacaaacgtcgaaaacgcgacctcccaccgatcgaatcgaaaaaaaacaaacttctaaaaaaaataaacgacctcgacgatccaaaaatcgatctacgacaaactaactcctaaataaaaaaacacacgtttccgacaacatcgcctataactaaaaaaacacaaaactcaataccgaaaactaatccgtcaatcacgaaccctaaaacaatcctacgacccccaaacaacgacgaaaaaaactctacgcgccccgatttattccgaaaacgcctctaaaaaccgcaaactctaaatatcaaaaaaaaaacgcgaccccgtaacgaaaaccgcaaaatactaaaattacgttcccgcc

SEQ ID NO: 17911 - DNA, 518 bp, Artificial Sequence
  chemically treated genomic DNA (Homo sapiens) CpG-island No: 17911
ataggacgttttttaggtgatcgttggggtttcgttgattacgggtttttttagtcgttaacgggaaggtagaaggtagaaaagaggttagtcgggaggcggtcgttgttataggagttcgcggcgcggggaggacgtttcggttgtaggcggggtttttggtaagcgtcggggacgcggttttttatcggtcgggtcgggagggagtaggtttttggggagagtgggcgatttcggcgatttaggaatcggtttgcgatagattgatttttagataggaaaatatacgttttcggtagtatcgtttgtaattggaaagatataaggtttaatgtcggggattggttcgttaattacgggttttgggatagttttgcggtttttagatagcggcgaagaaagttttgcgcgtttcggtttgtttcgggagcgtttttgggagtcgtaggttttggatattagagggagggcgcgatttcgtggcgggagtcgtagggtgttggggttgcgttttcgtt

SEQ ID NO: 17912 - DNA, 518 bp, Artificial Sequence
  chemically treated genomic DNA (Homo sapiens) CpG-island No: 17912
aacgaaaacgcaaccccaacaccctacgactcccgccacgaaatcgcgccctccctctaatatccaaaacctacgactcccaaaaacgctcccgaaacaaaccgaaacgcgcaaaactttcttcgccgctatctaaaaaccgcaaaactatcccaaaacccgtaattaacgaaccaatccccgacattaaaccttatatctttccaattacaaacgatactaccgaaaacgtatattttcctatctaaaaatcaatctatcgcaaaccgattcctaaatcgccgaaatcgcccactctccccaaaaacctactccctcccgacccgaccgataaaaaaccgcgtccccgacgcttaccaaaaaccccgcctacaaccgaaacgtcctccccgcgccgcgaactcctataacaacgaccgcctcccgactaacctcttttctaccttctaccttcccgttaacgactaaaaaaacccgtaatcaacgaaaccccaacgatcacctaaaaaacgtcctat

SEQ ID NO: 17913 - DNA, 731 bp, Artificial Sequence
  chemically treated genomic DNA (Homo sapiens) CpG-island No: 17913
gaggggatggcggggtttagatggaggggacggcggggtttagatggaggggacggcggggtttagatggaggggatggcggggtttagatggaggggacggcggggtttagatggaggggacggcggggtttagatggaggggacgtcggggttttagatggaggggacggcgggagtttagatggaggggacggcggggtttagatggaggggacggcggggtttagatggaggggacggcggggtttagatggaggggacgtcggggttttagatggaggggacggcgggagtttagatggaggggacggcgtggtttagatggaggggacggcggggtttagatggaggggacgtcggggttttagatggaggggacggcgggggtttagatggaggggacggcggggtttagatggaggggacggcggggtttagatggaggggacggcggggtttagatggaggggacggcggggtttagatggaggggacggcggggtttagatggaggggacggcgggagtttagatggaggggacggcgtggtttagatggaggggacggcggggtttagatggaggggacgtcggggttttagatggaggggacggcggggtttagatggaggggatgtcggggtttagatggaagggacggcggggtttagtaggtaggtttcggtcgtgtagggtgtggattgtttcgggggcgttgggggtttttgag

SEQ ID NO: 17914 - DNA, 731 bp, Artificial Sequence
  chemically treated genomic DNA (Homo sapiens) CpG-island No: 17914
ctcaaaaacccccaacgcccccgaaacaatccacaccctacacgaccgaaacctacctactaaaccccgccgtcccttccatctaaaccccgacatcccctccatctaaaccccgccgtcccctccatctaaaaccccgacgtcccctccatctaaaccccgccgtcccctccatctaaaccacgccgtcccctccatctaaactcccgccgtcccctccatctaaaccccgccgtcccctccatctaaaccccgccgtcccctccatctaaaccccgccgtcccctccatctaaaccccgccgtcccctccatctaaaccccgccgtcccctccatctaaacccccgccgtcccctccatctaaaaccccgacgtcccctccatctaaaccccgccgtcccctccatctaaaccacgccgtcccctccatctaaactcccgccgtcccctccatctaaaaccccgacgtcccctccatctaaaccccgccgtcccctccatctaaaccccgccgtcccctccatctaaaccccgccgtcccctccatctaaactcccgccgtcccctccatctaaaaccccgacgtcccctccatctaaaccccgccgtcccctccatctaaaccccgccgtcccctccatctaaaccccgccatcccctccatctaaaccccgccgtcccctccatctaaaccccgccgtcccctccatctaaaccccgccatcccctc

SEQ ID NO: 17915 - DNA, 731 bp, Artificial Sequence
  chemically treated genomic DNA (Homo sapiens) CpG-island No: 17915
tttagaagtttttagcgttttcgggatagtttatattttgtacggtcggagtttgtttgttggatttcgtcgttttttttatttggatttcgatattttttttatttggatttcgtcgttttttttatttggagtttcgacgttttttttatttggatttcgtcgttttttttatttggattacgtcgttttttttatttggattttcgtcgttttttttatttggatttcgtcgttttttttatttggatttcgtcgttttttttatttggatttcgtcgttttttttatttggatttcgtcgttttttttatttggatttcgtcgttttttttatttggattttcgtcgttttttttatttggagtttcgacgttttttttatttggatttcgtcgttttttttatttggattacgtcgttttttttatttggattttcgtcgttttttttatttggagtttcgacgttttttttatttggatttcgtcgttttttttatttggatttcgtcgttttttttatttggatttcgtcgttttttttatttggattttcgtcgttttttttatttggagtttcgacgttttttttatttggatttcgtcgttttttttatttggatttcgtcgttttttttatttggatttcgttattttttttatttggatttcgtcgttttttttatttggatttcgtcgttttttttatttggatttcgttattttttt

SEQ ID NO: 17916 - DNA, 731 bp, Artificial Sequence
  chemically treated genomic DNA (Homo sapiens) CpG-island No: 17916
aaaaaaataacgaaatccaaataaaaaaaacgacgaaatccaaataaaaaaaacgacgaaatccaaataaaaaaaataacgaaatccaaataaaaaaaacgacgaaatccaaataaaaaaaacgacgaaatccaaataaaaaaaacgtcgaaactccaaataaaaaaaacgacgaaaatccaaataaaaaaaacgacgaaatccaaataaaaaaaacgacgaaatccaaataaaaaaaacgacgaaatccaaataaaaaaaacgtcgaaactccaaataaaaaaaacgacgaaaatccaaataaaaaaaacgacgtaatccaaataaaaaaaacgacgaaatccaaataaaaaaaacgtcgaaactccaaataaaaaaaacgacgaaaatccaaataaaaaaaacgacgaaatccaaataaaaaaaacgacgaaatccaaataaaaaaaacgacgaaatccaaataaaaaaaacgacgaaatccaaataaaaaaaacgacgaaatccaaataaaaaaaacgacgaaaatccaaataaaaaaaacgacgtaatccaaataaaaaaaacgacgaaatccaaataaaaaaaacgtcgaaactccaaataaaaaaaacgacgaaatccaaataaaaaaaatatcgaaatccaaataaaaaaaacgacgaaatccaacaaacaaactccgaccgtacaaaatataaactatcccgaaaacgctaaaaacttctaaa

SEQ ID NO: 17917 - DNA, 769 bp, Artificial Sequence
  chemically treated genomic DNA (Homo sapiens) CpG-island No: 17917
tgcgtttcgggggaggtgggcggggaggggcggcggggcggggcgggttcgggacgcgggttgggagttggagtttatagcgtgaagcgttcgtcgttcgggtttcgtagggttaggcgaggcgagggggggcggggcgggcgttacgggaaggggaggtcgcgcggatcgggagtcgtatcgtttagtcggttgtagcggtcgcgtattaaggttgcgatggggttggagacggagaaggcggacgtatagttttttatggacgacgatttttatagttattatagcggtttcgagtacgtcgatttcgagaagttcgcggattcggattaggatcgggatttttatcggtttaattcgtattttaaggtgaagttcggggtgggcgggtttaagttttcgttgaggtcgggaggtgcgggcgttttttagtttcgttttaattcgttttattattgttatcgggttggtttcgtagggtttgagattcgtattttttttcggttttattcgttattaggtcgttcgcgtagttaggaatttttagttaggtttttgtgcgtttatcgtgattttaagagaagaggcggacgttttggtacgttttttttttttgtttttttcgtttaaagcgttttcggttttcggggcgttaggttggttgatagttcggggtttttgcgttttgtttttttagttgggtttcgaggatgtgatcgtagagtcggtgattacgtatttttttgataaagtgtggatttgtagttat

SEQ ID NO: 17918 - DNA, 769 bp, Artificial Sequence
  chemically treated genomic DNA (Homo sapiens) CpG-island No: 17918
ataactacaaatccacactttatcaaaaaaatacgtaatcaccgactctacgatcacatcctcgaaacccaactaaaaaaacaaaacgcaaaaaccccgaactatcaaccaacctaacgccccgaaaaccgaaaacgctttaaacgaaaaaaacaaaaaaaaaaaacgtaccaaaacgtccgcctcttctcttaaaatcacgataaacgcacaaaaacctaactaaaaattcctaactacgcgaacgacctaataacgaataaaaccgaaaaaaaatacgaatctcaaaccctacgaaaccaacccgataacaataataaaacgaattaaaacgaaactaaaaaacgcccgcacctcccgacctcaacgaaaacttaaacccgcccaccccgaacttcaccttaaaatacgaattaaaccgataaaaatcccgatcctaatccgaatccgcgaacttctcgaaatcgacgtactcgaaaccgctataataactataaaaatcgtcgtccataaaaaactatacgtccgccttctccgtctccaaccccatcgcaaccttaatacgcgaccgctacaaccgactaaacgatacgactcccgatccgcgcgacctccccttcccgtaacgcccgccccgccccccctcgcctcgcctaaccctacgaaacccgaacgacgaacgcttcacgctataaactccaactcccaacccgcgtcccgaacccgccccgccccgccgcccctccccgcccacctcccccgaaacgca

SEQ ID NO: 17919 - DNA, 769 bp, Artificial Sequence
  chemically treated genomic DNA (Homo sapiens) CpG-island No: 17919
atggttgtagatttatattttgttaaaggagtgcgtagttatcggttttgcgattatattttcgaagtttagttgaggagataggacgtagggatttcgaattgttagttaatttgacgtttcgggaatcgggagcgttttgggcgggggaagtaggagggaaggacgtgttagggcgttcgtttttttttttagggttacggtgggcgtataggaatttggttaagaatttttggttacgcgggcggtttggtgacgggtgggatcggggaagggtgcgggttttagattttgcggggttaattcggtggtaatggtgggacgggttagggcggggttgaggggcgttcgtatttttcggttttagcggggatttgggttcgtttatttcgggttttattttgagatgcgagttgagtcggtggggatttcggttttggttcgagttcgcgaatttttcggggtcggcgtattcgaggtcgttgtggtggttgtaggagtcgtcgtttatgaagagttgtacgttcgtttttttcgtttttagttttatcgtagttttggtgcgcggtcgttgtagtcggttgggcggtgcggttttcggttcgcgcggtttttttttttcgtagcgttcgtttcgttttttttcgtttcgtttagttttgcgaggttcgggcggcggacgttttacgttgtgggttttagtttttagttcgcgtttcgagttcgtttcgtttcgtcgttttttttcgtttatttttttcggggcgta

SEQ ID NO: 17920 - DNA, 769 bp, Artificial Sequence
  chemically treated genomic DNA (Homo sapiens) CpG-island No: 17920
tacgccccgaaaaaaataaacgaaaaaaaacgacgaaacgaaacgaactcgaaacgcgaactaaaaactaaaacccacaacgtaaaacgtccgccgcccgaacctcgcaaaactaaacgaaacgaaaaaaaacgaaacgaacgctacgaaaaaaaaaaaccgcgcgaaccgaaaaccgcaccgcccaaccgactacaacgaccgcgcaccaaaactacgataaaactaaaaacgaaaaaaacgaacgtacaactcttcataaacgacgactcctacaaccaccacaacgacctcgaatacgccgaccccgaaaaattcgcgaactcgaaccaaaaccgaaatccccaccgactcaactcgcatctcaaaataaaacccgaaataaacgaacccaaatccccgctaaaaccgaaaaatacgaacgcccctcaaccccgccctaacccgtcccaccattaccaccgaattaaccccgcaaaatctaaaacccgcacccttccccgatcccacccgtcaccaaaccgcccgcgtaaccaaaaattcttaaccaaattcctatacgcccaccgtaaccctaaaaaaaaaaacgaacgccctaacacgtccttccctcctacttcccccgcccaaaacgctcccgattcccgaaacgtcaaattaactaacaattcgaaatccctacgtcctatctcctcaactaaacttcgaaaatataatcgcaaaaccgataactacgcactcctttaacaaaatataaatctacaaccat

SEQ ID NO: 17921 - DNA, 946 bp, Artificial Sequence
  chemically treated genomic DNA (Homo sapiens) CpG-island No: 17921
gaggagggggcggggttaagcgggatagatgatacgagcggggttaagtaggtgggttcgggcgggggtgggggtgggggcgggggcgtaggcgggggcgggggcgcggataggttaagttagggggtgaggcggaggtagggttaggtcggttcgtgagggagagggcgggttaaatcggtgggcgcgggtagggacgttttgtgcgcgtcggatcggcgggggcggggcgtgtaggcgggggcggggtacgtcgttttatgggatcggttttcggttattgtttttttcggtttcgtttcgagcgttcgggttgggtcggtagcggtttttcgcggcggggttggtagtagtggttgttcgtattgcgttcgggcgttcgttttcgttgtagttttcggtgtcgtcgttcgggtcggtttttcggtaggtttttttcgttatggtcgcggtttttttttcgtttagggtcgaaaggaagcgttggggttggggtcgtttgttaggcgttcggcggggtagcgcgggtttggttaaaaaatgttttttttcgttggaattggcggagggcggttcggcgggcggcgcgttttacgcgtttatcgcgttcggcgttttaggtttcgcgttttatgtgttttcggtcgcgttcgtcgcgtttttagttgttttcgattttggttcgcggtcgtcggtgagtttagattcgcgcgtttttatatatagtacgcgtcgttcggtgttggcgcgaatttacgtttagggtcgcgtttataattttttcgagcgttttatcggttggaaatgtttcgtttattatttcgtcgtgtgagtatcgttatcggcgacggtcggtacgaaggtgttttttgagagttggtgtgggggagttttgttttagcgttatttgtttcgtcggagttgcgatttcggagtagaggaggga

SEQ ID NO: 17922 - DNA, 946 bp, Artificial Sequence
  chemically treated genomic DNA (Homo sapiens) CpG-island No: 17922
tccctcctctactccgaaatcgcaactccgacgaaacaaataacgctaaaacaaaactcccccacaccaactctcaaaaaacaccttcgtaccgaccgtcgccgataacgatactcacacgacgaaataataaacgaaacatttccaaccgataaaacgctcgaaaaaattataaacgcgaccctaaacgtaaattcgcgccaacaccgaacgacgcgtactatatataaaaacgcgcgaatctaaactcaccgacgaccgcgaaccaaaatcgaaaacaactaaaaacgcgacgaacgcgaccgaaaacacataaaacgcgaaacctaaaacgccgaacgcgataaacgcgtaaaacgcgccgcccgccgaaccgccctccgccaattccaacgaaaaaaaacattttttaaccaaacccgcgctaccccgccgaacgcctaacaaacgaccccaaccccaacgcttcctttcgaccctaaacgaaaaaaaaaccgcgaccataacgaaaaaaacctaccgaaaaaccgacccgaacgacgacaccgaaaactacaacgaaaacgaacgcccgaacgcaatacgaacaaccactactaccaaccccgccgcgaaaaaccgctaccgacccaacccgaacgctcgaaacgaaaccgaaaaaaacaataaccgaaaaccgatcccataaaacgacgtaccccgcccccgcctacacgccccgcccccgccgatccgacgcgcacaaaacgtccctacccgcgcccaccgatttaacccgccctctccctcacgaaccgacctaaccctacctccgcctcaccccctaacttaacctatccgcgcccccgcccccgcctacgcccccgcccccacccccacccccgcccgaacccacctacttaaccccgctcgtatcatctatcccgcttaaccccgccccctcctc

SEQ ID NO: 17923 - DNA, 946 bp, Artificial Sequence
  chemically treated genomic DNA (Homo sapiens) CpG-island No: 17923
ttttttttttgtttcggggtcgtagtttcgacggggtaggtggcgttgggatagagtttttttatattagtttttaggaagtattttcgtgtcggtcgtcgtcggtggcgatatttatacggcgaagtggtaaacgaagtatttttagtcggtgggacgttcgaggaagttgtagacgcggttttggacgtgggttcgcgttaatatcgggcggcgcgtgttgtatatggagacgcgcgggtttaggtttatcggcggtcgcgggttaaggtcggaagtaattgggggcgcggcgggcgcggtcggggatatatggggcgcgggatttggggcgtcgggcgcgatgggcgcgtagagcgcgtcgttcgtcgggtcgtttttcgttagttttagcgagaaggggtattttttggttaggttcgcgttgtttcgtcgggcgtttggtaggcggttttaattttagcgttttttttcggttttgggcggggaggaggtcgcggttataacgaggagggtttgtcggggggtcggttcgagcggcggtatcgggagttgtagcgaaggcgagcgttcgggcgtagtgcgggtagttattgttgttagtttcgtcgcggggggtcgttgtcggtttagttcgggcgttcggggcggggtcggagggggtagtggtcgagggtcggttttatgggacggcgtgtttcgttttcgtttgtacgtttcgttttcgtcggttcggcgcgtatagggcgtttttgttcgcgtttatcggtttggttcgtttttttttttacggatcggtttggttttgttttcgttttattttttggtttggtttgttcgcgttttcgttttcgtttgcgttttcgtttttatttttattttcgttcgagtttatttgtttagtttcgttcgtgttatttatttcgtttggtttcgtttttttttt

SEQ ID NO: 17924 - DNA, 946 bp, Artificial Sequence
  chemically treated genomic DNA (Homo sapiens) CpG-island No: 17924
aaaaaaaaaacgaaaccaaacgaaataaataacacgaacgaaactaaacaaataaactcgaacgaaaataaaaataaaaacgaaaacgcaaacgaaaacgaaaacgcgaacaaaccaaaccaaaaaataaaacgaaaacaaaaccaaaccgatccgtaaaaaaaaaaacgaaccaaaccgataaacgcgaacaaaaacgccctatacgcgccgaaccgacgaaaacgaaacgtacaaacgaaaacgaaacacgccgtcccataaaaccgaccctcgaccactaccccctccgaccccgccccgaacgcccgaactaaaccgacaacgaccccccgcgacgaaactaacaacaataactacccgcactacgcccgaacgctcgccttcgctacaactcccgataccgccgctcgaaccgaccccccgacaaaccctcctcgttataaccgcgacctcctccccgcccaaaaccgaaaaaaaacgctaaaattaaaaccgcctaccaaacgcccgacgaaacaacgcgaacctaaccaaaaaataccccttctcgctaaaactaacgaaaaacgacccgacgaacgacgcgctctacgcgcccatcgcgcccgacgccccaaatcccgcgccccatatatccccgaccgcgcccgccgcgcccccaattacttccgaccttaacccgcgaccgccgataaacctaaacccgcgcgtctccatatacaacacgcgccgcccgatattaacgcgaacccacgtccaaaaccgcgtctacaacttcctcgaacgtcccaccgactaaaaatacttcgtttaccacttcgccgtataaatatcgccaccgacgacgaccgacacgaaaatacttcctaaaaactaatataaaaaaactctatcccaacgccacctaccccgtcgaaactacgaccccgaaacaaaaaaaaaa

SEQ ID NO: 17925 - DNA, 607 bp, Artificial Sequence
  chemically treated genomic DNA (Homo sapiens) CpG-island No: 17925
tcgtttcgcgtcgttcgtttaggttcgtgttgatcgtgtttaaatttttttagagagatggggagggtcgcgttgaggagagtttgggagaatcgtattgaggagtcgtcgggagagtgtcgcgttgaggagttttcggggagagtgtcgcgttgaggaggtttagggaggatcgcgcggaggagaattatgttgaggagttttcggggagaatagaatcgcggcgagaggttttcggagagaatcgcgtcgaagaattttcggggagaatcgcgtcgaagaattttcggggagaatcgcgtcgaagaattttcggggagaatcgcgtcgaaaagtttcgggtgtttcgaggagaacggcgtcgaggagttttcggggagaattgcgtcgaggagtttttagaagagcgtcgcgttgaggagtttcgaggagaatcgcgtcgaggggcgcgtcggggagaattacgatgattgacgtatcgaggaggatcgcgttgaggggcgtatcgggagaatcgtgttgaggagtttcggggaggattacgttgagaggtatttcggtagaatcgcgttgaggggcgttttggtaggattttgttgaggagttt

SEQ ID NO: 17926 - DNA, 607 bp, Artificial Sequence
  chemically treated genomic DNA (Homo sapiens) CpG-island No: 17926
aaactcctcaacaaaatcctaccaaaacgcccctcaacgcgattctaccgaaatacctctcaacgtaatcctccccgaaactcctcaacacgattctcccgatacgcccctcaacgcgatcctcctcgatacgtcaatcatcgtaattctccccgacgcgcccctcgacgcgattctcctcgaaactcctcaacgcgacgctcttctaaaaactcctcgacgcaattctccccgaaaactcctcgacgccgttctcctcgaaacacccgaaacttttcgacgcgattctccccgaaaattcttcgacgcgattctccccgaaaattcttcgacgcgattctccccgaaaattcttcgacgcgattctctccgaaaacctctcgccgcgattctattctccccgaaaactcctcaacataattctcctccgcgcgatcctccctaaacctcctcaacgcgacactctccccgaaaactcctcaacgcgacactctcccgacgactcctcaatacgattctcccaaactctcctcaacgcgaccctccccatctctctaaaaaaatttaaacacgatcaacacgaacctaaacgaacgacgcgaaacga

SEQ ID NO: 17927 - DNA, 607 bp, Artificial Sequence
  chemically treated genomic DNA (Homo sapiens) CpG-island No: 17927
gagttttttagtaagattttgttagggcgttttttagcgcgattttgtcggggtgttttttagcgtggtttttttcggggttttttagtacgattttttcggtgcgttttttagcgcggtttttttcggtgcgttagttatcgtggtttttttcggcgcgtttttcggcgcggtttttttcggggttttttagcgcggcgtttttttgggggtttttcggcgtagtttttttcggggatttttcggcgtcgtttttttcggggtattcggggtttttcggcgcggtttttttcgggggtttttcggcgcggtttttttcgggggtttttcggcgcggtttttttcgggggtttttcggcgcggtttttttcgggggtttttcgtcgcggttttgtttttttcgggggttttttagtatggttttttttcgcgcggttttttttgggtttttttagcgcggtatttttttcgggggttttttagcgcggtattttttcggcggttttttagtgcggtttttttagattttttttagcgcggttttttttatttttttgggagggtttgaatacggttagtacggatttgggcggacggcgcgggacgg

SEQ ID NO: 17928 - DNA, 607 bp, Artificial Sequence
  chemically treated genomic DNA (Homo sapiens) CpG-island No: 17928
ccgtcccgcgccgtccgcccaaatccgtactaaccgtattcaaaccctcccaaaaaaataaaaaaaaccgcgctaaaaaaaatctaaaaaaaccgcactaaaaaaccgccgaaaaaataccgcgctaaaaaacccccgaaaaaaataccgcgctaaaaaaacccaaaaaaaaccgcgcgaaaaaaaaccatactaaaaaacccccgaaaaaaacaaaaccgcgacgaaaaacccccgaaaaaaaccgcgccgaaaaacccccgaaaaaaaccgcgccgaaaaacccccgaaaaaaaccgcgccgaaaaacccccgaaaaaaaccgcgccgaaaaaccccgaataccccgaaaaaaacgacgccgaaaaatccccgaaaaaaactacgccgaaaaacccccaaaaaaacgccgcgctaaaaaaccccgaaaaaaaccgcgccgaaaaacgcgccgaaaaaaaccacgataactaacgcaccgaaaaaaaccgcgctaaaaaacgcaccgaaaaaatcgtactaaaaaaccccgaaaaaaaccacgctaaaaaacaccccgacaaaatcgcgctaaaaaacgccctaacaaaatcttactaaaaaactc

SEQ ID NO: 17929 - DNA, 510 bp, Artificial Sequence
  chemically treated genomic DNA (Homo sapiens) CpG-island No: 17929
aacgcgcggttggtgtgttgtatttgtcgtttggcgatgaaagcgggtaatataggtttggtaatagtgttggtagcgtagatgtttgtcgattattagattatcgtttcggtaattattttattggcgaataattttaatacggtattgattttcgcgcgtataattggcgcgatcgattttattcgttaaatggcggcggtggcgtttgttagtgtggcgcggtaggatgttgagaatgtacggttgatgattttatcgtttgtttaggcgtagtagtttaatgaagattagatttaggacgtgcgcgatatcgtcgtttggcgtttgatgggtaacgatgttatcgacgagtaggcgaaatggcgcgatgacgttattatgcgttcgtaatttatttcgtttattgaacgtcgtgtacgaatggcgtttggtatcggcgatcgtcgcggtttgaatatttgttggcgcgtttgtttatggaagcgaaagagaaagatgaatggcgtt

SEQ ID NO: 17930 - DNA, 510 bp, Artificial Sequence
  chemically treated genomic DNA (Homo sapiens) CpG-island No: 17930
aacgccattcatctttctctttcgcttccataaacaaacgcgccaacaaatattcaaaccgcgacgatcgccgataccaaacgccattcgtacacgacgttcaataaacgaaataaattacgaacgcataataacgtcatcgcgccatttcgcctactcgtcgataacatcgttacccatcaaacgccaaacgacgatatcgcgcacgtcctaaatctaatcttcattaaactactacgcctaaacaaacgataaaatcatcaaccgtacattctcaacatcctaccgcgccacactaacaaacgccaccgccgccatttaacgaataaaatcgatcgcgccaattatacgcgcgaaaatcaataccgtattaaaattattcgccaataaaataattaccgaaacgataatctaataatcgacaaacatctacgctaccaacactattaccaaacctatattacccgctttcatcgccaaacgacaaatacaacacaccaaccgcgcgtt

SEQ ID NO: 17931 - DNA, 510 bp, Artificial Sequence
  chemically treated genomic DNA (Homo sapiens) CpG-island No: 17931
aacgttatttatttttttttttcgtttttataggtagacgcgttagtaggtatttaggtcgcgacgatcgtcggtgttaagcgttattcgtatacggcgtttaataagcgaagtagattgcgagcgtataatggcgttatcgcgttatttcgtttgttcgtcggtgatatcgttgtttattaaacgttaggcgacgatatcgcgtacgttttgaatttgatttttattaagttgttgcgtttgggtaagcgatgggattattagtcgtgtatttttagtattttgtcgcgttatattggtaaacgttatcgtcgttatttgacgggtaaaatcggtcgcgttagttgtacgcgcgaaggttagtatcgtattagggttgttcgttagtgaaatgattgtcgaggcgatagtttggtaatcggtaggtatttgcgttgttagtattgttattaggtttgtgttattcgtttttatcgttaagcggtagatgtaatatattaatcgcgcgtt

SEQ ID NO: 17932 - DNA, 510 bp, Artificial Sequence
  chemically treated genomic DNA (Homo sapiens) CpG-island No: 17932
aacgcgcgattaatatattacatctaccgcttaacgataaaaacgaataacacaaacctaataacaatactaacaacgcaaatacctaccgattaccaaactatcgcctcgacaatcatttcactaacgaacaaccctaatacgatactaaccttcgcgcgtacaactaacgcgaccgattttacccgtcaaataacgacgataacgtttaccaatataacgcgacaaaatactaaaaatacacgactaataatcccatcgcttacccaaacgcaacaacttaataaaaatcaaattcaaaacgtacgcgatatcgtcgcctaacgtttaataaacaacgatatcaccgacgaacaaacgaaataacgcgataacgccattatacgctcgcaatctacttcgcttattaaacgccgtatacgaataacgcttaacaccgacgatcgtcgcgacctaaatacctactaacgcgtctacctataaaaacgaaaaaaaaaaataaataacgtt

SEQ ID NO: 17933 - DNA, 756 bp, Artificial Sequence
  chemically treated genomic DNA (Homo sapiens) CpG-island No: 17933
atcggtcgttaatagttaggagtcgttattcgtcgtttgtagtttcggggcgaagttcgtttgtagtttttggggtagaaggttgggggtggcgggcgggagcgagaaggaatggggtgggagttaggagaaacgtatttatttattttaagcgtaagtttcggcggcgtttttaggtgttgttttttcgttttttcgttaggtgttcggtttcgtcgggcgttgttagtgttcgggatttagggcgtttcggtcgatttttgcgggaaacgattgtaaatttatattattgttcgagttgtcgttcgggttttcgtattgttttttttcggttgttggtagcggtgttttaaatcggcggtcgtcggaggtaggaatcgaatttagttattattgtattagcggacgatcgttgttagaagggtgtttgcgtttagggttttatgtgtgtgcgagagagtgtgaatacgtgtgtgtgtgtgagtgaaagagagtgttcgtgtgtgagagagtagaaggggtgagtttagttttcggggtattcggaggtgaatttcgggttgagtcgaagttcgtcgcgttttcgggtgttgggcgtttgttcggttgatggttgggttgatgttgtcgtggtcgtcgtcgtcgcgttttaaggttggtcgcggtggtgtaaaaaatgttttttcgttattcgagattaaaaaatttgttttgtttattgagtatgttcggtttgatagttttatagtcgaggtt

SEQ ID NO: 17934 - DNA, 756 bp, Artificial Sequence
  chemically treated genomic DNA (Homo sapiens) CpG-island No: 17934
aacctcgactataaaactatcaaaccgaacatactcaataaacaaaacaaattttttaatctcgaataacgaaaaaacattttttacaccaccgcgaccaaccttaaaacgcgacgacgacgaccacgacaacatcaacccaaccatcaaccgaacaaacgcccaacacccgaaaacgcgacgaacttcgactcaacccgaaattcacctccgaataccccgaaaactaaactcaccccttctactctctcacacacgaacactctctttcactcacacacacacacgtattcacactctctcgcacacacataaaaccctaaacgcaaacacccttctaacaacgatcgtccgctaatacaataataactaaattcgattcctacctccgacgaccgccgatttaaaacaccgctaccaacaaccgaaaaaaaacaatacgaaaacccgaacgacaactcgaacaataatataaatttacaatcgtttcccgcaaaaatcgaccgaaacgccctaaatcccgaacactaacaacgcccgacgaaaccgaacacctaacgaaaaaacgaaaaaacaacacctaaaaacgccgccgaaacttacgcttaaaataaataaatacgtttctcctaactcccaccccattccttctcgctcccgcccgccacccccaaccttctaccccaaaaactacaaacgaacttcgccccgaaactacaaacgacgaataacgactcctaactattaacgaccgat

SEQ ID NO: 17935 - DNA, 756 bp, Artificial Sequence
  chemically treated genomic DNA (Homo sapiens) CpG-island No: 17935
aatttcggttgtgaagttgttaaatcgggtatgtttagtagatagggtaggttttttggtttcgagtagcggagaaatattttttgtattatcgcgattagttttagagcgcggcggcggcggttacggtaatattagtttagttattagtcgagtagacgtttagtattcgggagcgcggcgagtttcggtttagttcggagtttattttcgagtgtttcgggggttgagtttattttttttgtttttttatatacgaatatttttttttatttatatatatatacgtatttatattttttcgtatatatataggattttgggcgtaagtatttttttggtagcggtcgttcgttggtgtaatagtagttaggttcggtttttgttttcggcggtcgtcggtttagagtatcgttgttagtagtcggaggagagtaatgcgggggttcgagcggtagttcgaatagtaatgtggatttatagtcgtttttcgtaggagtcggtcgagacgttttaagtttcgggtattggtagcgttcggcggagtcgagtatttggcgagggggcgggggaatagtatttggggacgtcgtcgaaatttgcgtttggaataggtaggtgcgttttttttggtttttattttattttttttcgttttcgttcgttatttttaattttttattttaaggattataggcgaatttcgtttcgaggttgtaggcggcggatggcggtttttggttgttagcggtcggt

SEQ ID NO: 17936 - DNA, 756 bp, Artificial Sequence
  chemically treated genomic DNA (Homo sapiens) CpG-island No: 17936
accgaccgctaacaaccaaaaaccgccatccgccgcctacaacctcgaaacgaaattcgcctataatccttaaaataaaaaattaaaaataacgaacgaaaacgaaaaaaaataaaataaaaaccaaaaaaaacgcacctacctattccaaacgcaaatttcgacgacgtccccaaatactattcccccgccccctcgccaaatactcgactccgccgaacgctaccaatacccgaaacttaaaacgtctcgaccgactcctacgaaaaacgactataaatccacattactattcgaactaccgctcgaacccccgcattactctcctccgactactaacaacgatactctaaaccgacgaccgccgaaaacaaaaaccgaacctaactactattacaccaacgaacgaccgctaccaaaaaaatacttacgcccaaaatcctatatatatacgaaaaaatataaatacgtatatatatataaataaaaaaaaatattcgtatataaaaaaacaaaaaaaataaactcaacccccgaaacactcgaaaataaactccgaactaaaccgaaactcgccgcgctcccgaatactaaacgtctactcgactaataactaaactaatattaccgtaaccgccgccgccgcgctctaaaactaatcgcgataatacaaaaaatatttctccgctactcgaaaccaaaaaacctaccctatctactaaacatacccgatttaacaacttcacaaccgaaatt

SEQ ID NO: 17937 - DNA, 1111 bp, Artificial Sequence
  chemically treated genomic DNA (Homo sapiens) CpG-island No: 17937
tacgagttacgtgaatttcggcgttacgtgatagtttttttttcgttttttttttggtttttacggatttggggggcggtggcggttaatgtcgggttaaggttcgcgggtttcgtagatcgtagttcgggcgtacgcgattagatgattttgttgtggacggttaagttgtaggcgggatggttgagaaagcggcgttaggattttcgggtagaggttcggggaagggagttaggggggaaatgttttataaggtcgttttgcggttattattattgttcgtcgtttaaaatagttttcggcgttagttggtttgttttatggtcgagagatggttgttgttttcgagttcgtggattcgggtgtattttggggattcgagcgttcggagtttttttttattcgtttttatcgggtgtacggtgttaatattcgcgtggatttttttgggacgcgggttatacgcgtggagagtttcgtttacggcgtgtgttttagtcgcgagtcgttggtttcgggttaggtttttttggtcgagatcgaggagaaagagttgggttggtgcggatatttgcgtttcggtttgatcgcgttggatttcgttagtttggttttcgttttcgagttttttttgttcgatttggttaatttgggttatatttgggttttcgttattacgcgttattataatcgcgtgtttcgggagggtcgttcggaggcggaggtagcggtttttagtcgatttttaatttttttcgtggaattatatttgcgtattgagtagtttcgtatttttcgggatcgtttggtgggtcgtagtcggttagggttttatagttattttttggattagttttatgagttgaacgtgttgttttcgatcgcgcgtcgtagtcgtttgggtgtttttttttgttcgcgtttcgatggtacggtcgatatgtatattattattaacggcgaggatatgggttcgagcgttcggggattgttagttgcgtagtttttttacgcggtggtggacgtgtttgtttttataaagagcgtgcgttttgtttagttcgagtatggttgtaggtatttttgggtagcgattttttttggtttagtg

SEQ ID NO: 17938 - DNA, 1111 bp, Artificial Sequence
  chemically treated genomic DNA (Homo sapiens) CpG-island No: 17938
cactaaaccaaaaaaaatcgctacccaaaaatacctacaaccatactcgaactaaacaaaacgcacgctctttataaaaacaaacacgtccaccaccgcgtaaaaaaactacgcaactaacaatccccgaacgctcgaacccatatcctcgccgttaataataatatacatatcgaccgtaccatcgaaacgcgaacaaaaaaaaacacccaaacgactacgacgcgcgatcgaaaacaacacgttcaactcataaaactaatccaaaaaataactataaaaccctaaccgactacgacccaccaaacgatcccgaaaaatacgaaactactcaatacgcaaatataattccacgaaaaaaattaaaaatcgactaaaaaccgctacctccgcctccgaacgaccctcccgaaacacgcgattataataacgcgtaataacgaaaacccaaatataacccaaattaaccaaatcgaacaaaaaaaactcgaaaacgaaaaccaaactaacgaaatccaacgcgatcaaaccgaaacgcaaatatccgcaccaacccaactctttctcctcgatctcgaccaaaaaaacctaacccgaaaccaacgactcgcgactaaaacacacgccgtaaacgaaactctccacgcgtataacccgcgtcccaaaaaaatccacgcgaatattaacaccgtacacccgataaaaacgaataaaaaaaaactccgaacgctcgaatccccaaaatacacccgaatccacgaactcgaaaacaacaaccatctctcgaccataaaacaaaccaactaacgccgaaaactattttaaacgacgaacaataataataaccgcaaaacgaccttataaaacatttcccccctaactcccttccccgaacctctacccgaaaatcctaacgccgctttctcaaccatcccgcctacaacttaaccgtccacaacaaaatcatctaatcgcgtacgcccgaactacgatctacgaaacccgcgaaccttaacccgacattaaccgccaccgccccccaaatccgtaaaaaccaaaaaaaaaacgaaaaaaaaactatcacgtaacgccgaaattcacgtaactcgta

SEQ ID NO: 17939 - DNA, 1111 bp, Artificial Sequence
  chemically treated genomic DNA (Homo sapiens) CpG-island No: 17939
tattgagttaggaggggtcgttgtttagggatatttatagttatattcgagttggataaggcgtacgttttttgtggaagtaaatacgtttattatcgcgtagaggggttgcgtagttggtagttttcgggcgttcgggtttatgttttcgtcgttgatgatgatgtgtatgtcggtcgtgttatcggggcgcgggtaaaagaggatatttaggcggttacggcgcgcggtcggaggtagtacgtttagtttatagagttggtttaagagatggttgtagagttttggtcggttgcggtttattaggcggtttcggggaatgcgaaattgtttaatgcgtagatatggttttacgaggagggttggaggtcggttgggggtcgttgttttcgttttcgggcggttttttcggggtacgcggttgtggtggcgcgtgatggcgaagatttaggtgtggtttaggttgattagatcgggtagagaaaattcgggaacgggggttagattggcggggtttagcgcggttagatcgagacgtagatgttcgtattagtttagtttttttttttcgatttcgattaggaagatttggttcggggttagcggttcgcggttgaagtatacgtcgtgggcgaagttttttacgcgtgtggttcgcgttttagaggggtttacgcggatgttggtatcgtgtattcgatggaagcgggtgggagggggtttcgggcgttcgagtttttagagtgtattcgaatttacgggttcggaggtagtagttatttttcggttatagggtaggttagttggcgtcgggggttattttgggcggcgggtaatgatggtgatcgtaaggcgattttgtaaggtattttttttttgattttttttttcgagtttttgttcgggggttttagcgtcgtttttttagttatttcgtttataatttagtcgtttataataggattatttgatcgcgtgcgttcgggttacgatttgcgaggttcgcggattttgattcggtattgatcgttatcgttttttaggttcgtagggattaaagaaggggcgggaggaagattgttacgtggcgtcggagtttacgtgattcgta

SEQ ID NO: 17940 - DNA, 1111 bp, Artificial Sequence
  chemically treated genomic DNA (Homo sapiens) CpG-island No: 17940
tacgaatcacgtaaactccgacgccacgtaacaatcttcctcccgccccttctttaatccctacgaacctaaaaaacgataacgatcaataccgaatcaaaatccgcgaacctcgcaaatcgtaacccgaacgcacgcgatcaaataatcctattataaacgactaaattataaacgaaataactaaaaaaacgacgctaaaacccccgaacaaaaactcgaaaaaaaaaatcaaaaaaaaaataccttacaaaatcgccttacgatcaccatcattacccgccgcccaaaataacccccgacgccaactaacctaccctataaccgaaaaataactactacctccgaacccgtaaattcgaatacactctaaaaactcgaacgcccgaaaccccctcccacccgcttccatcgaatacacgataccaacatccgcgtaaacccctctaaaacgcgaaccacacgcgtaaaaaacttcgcccacgacgtatacttcaaccgcgaaccgctaaccccgaaccaaatcttcctaatcgaaatcgaaaaaaaaaaactaaactaatacgaacatctacgtctcgatctaaccgcgctaaaccccgccaatctaacccccgttcccgaattttctctacccgatctaatcaacctaaaccacacctaaatcttcgccatcacgcgccaccacaaccgcgtaccccgaaaaaaccgcccgaaaacgaaaacaacgacccccaaccgacctccaaccctcctcgtaaaaccatatctacgcattaaacaatttcgcattccccgaaaccgcctaataaaccgcaaccgaccaaaactctacaaccatctcttaaaccaactctataaactaaacgtactacctccgaccgcgcgccgtaaccgcctaaatatcctcttttacccgcgccccgataacacgaccgacatacacatcatcatcaacgacgaaaacataaacccgaacgcccgaaaactaccaactacgcaacccctctacgcgataataaacgtatttacttccacaaaaaacgtacgccttatccaactcgaatataactataaatatccctaaacaacgacccctcctaactcaata

SEQ ID NO: 17941 - DNA, 1391 bp, Artificial Sequence
  chemically treated genomic DNA (Homo sapiens) CpG-island No: 17941
agattcgtatttttttttcggggtcgtttcgtttttatcggaatttggacgttatcgagtttagtatacgttcggggacggtgatttattcgcggtttttttcgcgggtttaggtcgtttttgtttttttgatttaatcgattttttgataatttttcggtttttttttcgttgttgggagaagtcgcggcggtttcggggcggcggggagggcggcgttcgggtgttttcggtaggttttttgggggaggcgttgcgggagggtgggggcgtttcgacgggggatcgggtcgcgtcgttaatttcgattcggattggcgggaaaagcgaaattaatttagtcgagcggggtttcgtttttttcgggttaaaggggggacgggtcggcggtttcggagcgttttagttttttttcgggatcgtaattcgttgcgacggttttcgcgtttcgagattttcgtcgcgtttcgtttcgggattttttgttttgtagcggcggtagcgcggggcgggtttgggttttttttttaggagtcgcggcgagggaggcgttttcggagttatcgcgggaggggtcgcgtttcgagtttttatttcgtattttattcgttttttcgcgttcggtttcgcgttatttattcggttttttagcggcgcgattttcgcgttcgttttcgttcggtttttcgcgtttttttttttcgggtcggtcgtttatttatcggggttttaggtgtttcgcgtcgtttatcgcgttcggggtgtcgtcgtcgtcgttgttttttaaggtcgaggaggttcgggcgttcgggtcgcgttcgtcgtagggagcgaagtcgtttttttttcgcggtttcggtttcggcgtcggcgtttggagtttggtttttgttgcgagcgcgtaggttgttcgagcgcgatttttgtgcggaggagaaaaagtaatcgacggttttaaagtgaaaaaaaagagaaaagcgtcggtgggcggggtcgtttttgtttcgtttcgtttcgtttcgttttcgatttcgggcgtacggattatttagtattgtagggaaggtcgggggcgcggggcgcggggcgcggggcgcgttagttcggcgttggttcggtcgtttttttcgtttttttagttcgtagttttttttcgagtcgtcgttttggtgttgtcggttcgaagttcgggttttttcggaggcgtttttgggaaacgcgtggcgtagggtttgggttgtagtcgtgggaggttggagtgggggcgggggttttacgagaaggagaaattttcgcggagagtggggttgttttaggaatttcgagtaaggtttcgtcggttttttttgaagtgtttagcggggacgagtgggtagtcgtcgggggtttag

SEQ ID NO: 17942 - DNA, 1391 bp, Artificial Sequence
  chemically treated genomic DNA (Homo sapiens) CpG-island No: 17942
ctaaacccccgacgactacccactcgtccccgctaaacacttcaaaaaaaaccgacgaaaccttactcgaaattcctaaaacaaccccactctccgcgaaaatttctccttctcgtaaaacccccgcccccactccaacctcccacgactacaacccaaaccctacgccacgcgtttcccaaaaacgcctccgaaaaaacccgaacttcgaaccgacaacaccaaaacgacgactcgaaaaaaaactacgaactaaaaaaacgaaaaaaacgaccgaaccaacgccgaactaacgcgccccgcgccccgcgccccgcgcccccgaccttccctacaatactaaataatccgtacgcccgaaatcgaaaacgaaacgaaacgaaacgaaacaaaaacgaccccgcccaccgacgcttttctcttttttttcactttaaaaccgtcgattactttttctcctccgcacaaaaatcgcgctcgaacaacctacgcgctcgcaacaaaaaccaaactccaaacgccgacgccgaaaccgaaaccgcgaaaaaaaaacgacttcgctccctacgacgaacgcgacccgaacgcccgaacctcctcgaccttaaaaaacaacgacgacgacgacaccccgaacgcgataaacgacgcgaaacacctaaaaccccgataaataaacgaccgacccgaaaaaaaaaaacgcgaaaaaccgaacgaaaacgaacgcgaaaatcgcgccgctaaaaaaccgaataaataacgcgaaaccgaacgcgaaaaaacgaataaaatacgaaataaaaactcgaaacgcgacccctcccgcgataactccgaaaacgcctccctcgccgcgactcctaaaaaaaaaacccaaacccgccccgcgctaccgccgctacaaaacaaaaaatcccgaaacgaaacgcgacgaaaatctcgaaacgcgaaaaccgtcgcaacgaattacgatcccgaaaaaaaactaaaacgctccgaaaccgccgacccgtcccccctttaacccgaaaaaaacgaaaccccgctcgactaaattaatttcgcttttcccgccaatccgaatcgaaattaacgacgcgacccgatcccccgtcgaaacgcccccaccctcccgcaacgcctcccccaaaaaacctaccgaaaacacccgaacgccgccctccccgccgccccgaaaccgccgcgacttctcccaacaacgaaaaaaaaaccgaaaaattatcaaaaaatcgattaaatcaaaaaaacaaaaacgacctaaacccgcgaaaaaaaccgcgaataaatcaccgtccccgaacgtatactaaactcgataacgtccaaattccgataaaaacgaaacgaccccgaaaaaaaaatacgaatct

SEQ ID NO: 17943 - DNA, 1391 bp, Artificial Sequence
  chemically treated genomic DNA (Homo sapiens) CpG-island No: 17943
ttggattttcggcggttgtttattcgttttcgttgggtattttagaggaggtcggcgaggttttgttcggggtttttgggataattttatttttcgcgaagatttttttttttcgtaagattttcgtttttattttagttttttacggttgtaatttaggttttgcgttacgcgttttttaaagacgttttcggagggattcgagtttcgggtcggtaatattagggcggcggttcgggagagggttgcggattaagggggcggagggggcggtcgaattagcgtcgggttgacgcgtttcgcgtttcgcgtttcgcgttttcggttttttttgtagtgttgagtggttcgtgcgttcgaggtcgggggcggggcggggcggggcggggtagggacggtttcgtttatcggcgtttttttttttttttttattttaaagtcgtcggttgttttttttttttcgtatagaagtcgcgttcgggtagtttgcgcgttcgtagtaggaattaggttttaggcgtcggcgtcggggtcggggtcgcggggaggaggcgatttcgttttttgcggcgggcgcggttcgggcgttcgagttttttcggttttggagagtagcggcggcggcggtatttcgggcgcggtaggcggcgcggggtatttgggatttcgatgggtgggcgatcggttcgggagggggaggcgcggggggtcgggcgagggcggacgcggggatcgcgtcgttgggggatcgagtgggtggcgcggggtcgggcgcgggggagcgggtggagtacgggatggggattcggggcgcggtttttttcgcggtggtttcgggggcgtttttttcgtcgcggtttttgggagaggggtttaggttcgtttcgcgttgtcgtcgttgtagggtagggggtttcggggcgaggcgcggcgggggtttcggggcgcggggatcgtcgtaacgagttgcggtttcgaggaggggttggggcgtttcggggtcgtcgattcgttttttttttagttcggggaaagcgggatttcgttcggttgagttagtttcgtttttttcgttagttcgagtcgggattggcggcgcggttcggtttttcgtcggggcgtttttattttttcgtagcgttttttttagggagtttgtcggggatattcgagcgtcgtttttttcgtcgtttcggagtcgtcgcggttttttttagtagcggagggagagtcggagggttgttaggaaatcgattaaattagaaaaataagggcggtttgggttcgcgggaggaatcgcggatgggttatcgttttcgggcgtgtattgggttcggtggcgtttaggtttcggtgaggacgggacggtttcgagaggagggtgcgggttt

SEQ ID NO: 17944 - DNA, 1391 bp, Artificial Sequence
  chemically treated genomic DNA (Homo sapiens) CpG-island No: 17944
aaacccgcaccctcctctcgaaaccgtcccgtcctcaccgaaacctaaacgccaccgaacccaatacacgcccgaaaacgataacccatccgcgattcctcccgcgaacccaaaccgcccttatttttctaatttaatcgatttcctaacaaccctccgactctccctccgctactaaaaaaaaccgcgacgactccgaaacgacgaaaaaaacgacgctcgaatatccccgacaaactccctaaaaaaaacgctacgaaaaaataaaaacgccccgacgaaaaaccgaaccgcgccgccaatcccgactcgaactaacgaaaaaaacgaaactaactcaaccgaacgaaatcccgctttccccgaactaaaaaaaaaacgaatcgacgaccccgaaacgccccaacccctcctcgaaaccgcaactcgttacgacgatccccgcgccccgaaacccccgccgcgcctcgccccgaaaccccctaccctacaacgacgacaacgcgaaacgaacctaaacccctctcccaaaaaccgcgacgaaaaaaacgcccccgaaaccaccgcgaaaaaaaccgcgccccgaatccccatcccgtactccacccgctcccccgcgcccgaccccgcgccacccactcgatcccccaacgacgcgatccccgcgtccgccctcgcccgaccccccgcgcctccccctcccgaaccgatcgcccacccatcgaaatcccaaataccccgcgccgcctaccgcgcccgaaataccgccgccgccgctactctccaaaaccgaaaaaactcgaacgcccgaaccgcgcccgccgcaaaaaacgaaatcgcctcctccccgcgaccccgaccccgacgccgacgcctaaaacctaattcctactacgaacgcgcaaactacccgaacgcgacttctatacgaaaaaaaaaaaacaaccgacgactttaaaataaaaaaaaaaaaaaaaacgccgataaacgaaaccgtccctaccccgccccgccccgccccgcccccgacctcgaacgcacgaaccactcaacactacaaaaaaaaccgaaaacgcgaaacgcgaaacgcgaaacgcgtcaacccgacgctaattcgaccgccccctccgcccccttaatccgcaaccctctcccgaaccgccgccctaatattaccgacccgaaactcgaatccctccgaaaacgtctttaaaaaacgcgtaacgcaaaacctaaattacaaccgtaaaaaactaaaataaaaacgaaaatcttacgaaaaaaaaaaatcttcgcgaaaaataaaattatcccaaaaaccccgaacaaaacctcgccgacctcctctaaaatacccaacgaaaacgaataaacaaccgccgaaaatccaa

SEQ ID NO: 17945 - DNA, 627 bp, Artificial Sequence
  chemically treated genomic DNA (Homo sapiens) CpG-island No: 17945
ttagtcgagcgtagtcgtttagtcggatttcggagttatttcggttttttatggcgatacgttattaattgttttttgagaaatagttcgggtgttatcggagttttcggtttttaaggaataagtatttaacgttgttttattttcgtggtgggacgtttgaatattaggtttcgtagagtttttttatcgtttaggtttggcgtcgcggatttcgcgtattttttcggatttcggcggttttaggggtttattacgcgttagcgttagtattggtttttcgcggtttagagtttcgtcgtagcgttttaggcgtcgtttttgtttttttagtttagttcggttttcgcgtgtgatttttgtattttttttttaatttcgggagatcgtcgcggtttatagtttttcgttcggtcgtcgttaataggttaacgatcgttgcgtcgtttttattttgcgggagacgcgagcgggaggcggggcgggcgcgattggttttggtagttgcgcgttgcgatttcggggttcgttcgtttcggggtcgagaatgtgttatcgtaggtaatgtgtttttcgaggtttattttcgaaatattttagattattattttagttttttatatttgt

SEQ ID NO: 17946 - DNA, 627 bp, Artificial Sequence
  chemically treated genomic DNA (Homo sapiens) CpG-island No: 17946
acaaatataaaaaactaaaataataatctaaaatatttcgaaaataaacctcgaaaaacacattacctacgataacacattctcgaccccgaaacgaacgaaccccgaaatcgcaacgcgcaactaccaaaaccaatcgcgcccgccccgcctcccgctcgcgtctcccgcaaaataaaaacgacgcaacgatcgttaacctattaacgacgaccgaacgaaaaactataaaccgcgacgatctcccgaaattaaaaaaaaaatacaaaaatcacacgcgaaaaccgaactaaactaaaaaaacaaaaacgacgcctaaaacgctacgacgaaactctaaaccgcgaaaaaccaatactaacgctaacgcgtaataaacccctaaaaccgccgaaatccgaaaaaatacgcgaaatccgcgacgccaaacctaaacgataaaaaaactctacgaaacctaatattcaaacgtcccaccacgaaaataaaacaacgttaaatacttattccttaaaaaccgaaaactccgataacacccgaactatttctcaaaaaacaattaataacgtatcgccataaaaaaccgaaataactccgaaatccgactaaacgactacgctcgactaa

SEQ ID NO: 17947 - DNA, 627 bp, Artificial Sequence
  chemically treated genomic DNA (Homo sapiens) CpG-island No: 17947
gtaagtgtggaaaattgaaatagtgatttgaggtgtttcgaaaataaatttcggaaagtatattgtttacggtgatatattttcggtttcggggcgggcgagtttcggggtcgtagcgcgtagttgttagaattagtcgcgttcgtttcgtttttcgttcgcgtttttcgtaaggtggaggcggcgtagcggtcgttgatttgttggcggcggtcgggcgggaggttgtgggtcgcggcggtttttcggggttgaggggaggatgtaggagttatacgcggaggtcggattggattaagggggtaggagcggcgtttggggcgttgcggcggggttttagatcgcgggaagttagtgttagcgttggcgcgtggtgggtttttgaggtcgtcggagttcggagaggtacgcggaattcgcggcgttaggtttgagcggtgggagggttttgcggggtttggtgtttaggcgttttattacgagggtggagtagcgttggatatttgttttttagggatcgaaggtttcggtggtattcgggttattttttagaggataattagtaacgtgtcgttatgaggagtcggagtaatttcggggttcggttggacggttacgttcgattgg

SEQ ID NO: 17948 - DNA, 627 bp, Artificial Sequence
  chemically treated genomic DNA (Homo sapiens) CpG-island No: 17948
ccaatcgaacgtaaccgtccaaccgaaccccgaaattactccgactcctcataacgacacgttactaattatcctctaaaaaataacccgaataccaccgaaaccttcgatccctaaaaaacaaatatccaacgctactccaccctcgtaataaaacgcctaaacaccaaaccccgcaaaaccctcccaccgctcaaacctaacgccgcgaattccgcgtacctctccgaactccgacgacctcaaaaacccaccacgcgccaacgctaacactaacttcccgcgatctaaaaccccgccgcaacgccccaaacgccgctcctacccccttaatccaatccgacctccgcgtataactcctacatcctcccctcaaccccgaaaaaccgccgcgacccacaacctcccgcccgaccgccgccaacaaatcaacgaccgctacgccgcctccaccttacgaaaaacgcgaacgaaaaacgaaacgaacgcgactaattctaacaactacgcgctacgaccccgaaactcgcccgccccgaaaccgaaaatatatcaccgtaaacaatatactttccgaaatttattttcgaaacacctcaaatcactatttcaattttccacacttac

SEQ ID NO: 17949 - DNA, 551 bp, Artificial Sequence
  chemically treated genomic DNA (Homo sapiens) CpG-island No: 17949
cgcggcgagagggggtcgacggtttcgggtttatttatttcggataggtcgtttcggtttttcgtgttttgttcgtttagtattttttttagtttgtttattgcggtttagtttttattagttttagttttttagcggtagtttgttgcgttcgttaagttgacggttttttcgggtgttaggtagtcgtttagtcgtttaggcgttaatcgcggcgcgtttcgtttaggtatttgtttatcggggggttttcggtatgtttcgcgcgttcgcgttcgttttcgtttgttttggtttcggggggcgcggcgggtcggaggggttgggattgaagattattaggcgttgttaaatattaattcggcgtttagagtagttttaaatcggaacgggtcgcgttttttcgttttatttgatttagttaacgaatgtcgagtatttattacgtgtaaggtttcggagatataaagacgggggagaagttttgtgtagacgggaataaaggttgtggtttatttatattgcgatcgtgtttatataggaaaagattt

SEQ ID NO: 17950 - DNA, 551 bp, Artificial Sequence
  chemically treated genomic DNA (Homo sapiens) CpG-island No: 17950
aaatcttttcctatataaacacgatcgcaatataaataaaccacaacctttattcccgtctacacaaaacttctcccccgtctttatatctccgaaaccttacacgtaataaatactcgacattcgttaactaaatcaaataaaacgaaaaaacgcgacccgttccgatttaaaactactctaaacgccgaattaatatttaacaacgcctaataatcttcaatcccaacccctccgacccgccgcgccccccgaaaccaaaacaaacgaaaacgaacgcgaacgcgcgaaacataccgaaaaccccccgataaacaaatacctaaacgaaacgcgccgcgattaacgcctaaacgactaaacgactacctaacacccgaaaaaaccgtcaacttaacgaacgcaacaaactaccgctaaaaaactaaaactaataaaaactaaaccgcaataaacaaactaaaaaaaatactaaacgaacaaaacacgaaaaaccgaaacgacctatccgaaataaataaacccgaaaccgtcgaccccctctcgccgcg

SEQ ID NO: 17951 - DNA, 551 bp, Artificial Sequence
  chemically treated genomic DNA (Homo sapiens) CpG-island No: 17951
aaatttttttttgtgtaggtacgatcgtaatatggatgaattatagtttttgttttcgtttgtataaggtttttttttcgtttttgtgttttcggagttttgtacgtggtaggtgttcggtattcgttgattggattaagtagggcgagggagcgcggttcgtttcggtttgaaattgttttggacgtcgaattagtgtttggtagcgtttggtggtttttaattttagttttttcggttcgtcgcgtttttcgggattaaaataagcggaggcgagcgcgggcgcgcggggtatgtcgggagtttttcggtgggtaggtgtttgggcggggcgcgtcgcggttggcgtttgggcggttgggcggttgtttagtattcggaagagtcgttaatttagcgagcgtaataggttgtcgttgaggagttggagttggtggggattgggtcgtaatggataagttgaagaaggtgttgagcgggtaggatacggaggatcggagcggtttgttcgaggtgagtgagttcggggtcgtcggttttttttcgtcgcg

SEQ ID NO: 17952 - DNA, 551 bp, Artificial Sequence
  chemically treated genomic DNA (Homo sapiens) CpG-island No: 17952
cgcgacgaaaaaaaaccgacgaccccgaactcactcacctcgaacaaaccgctccgatcctccgtatcctacccgctcaacaccttcttcaacttatccattacgacccaatccccaccaactccaactcctcaacgacaacctattacgctcgctaaattaacgactcttccgaatactaaacaaccgcccaaccgcccaaacgccaaccgcgacgcgccccgcccaaacacctacccaccgaaaaactcccgacataccccgcgcgcccgcgctcgcctccgcttattttaatcccgaaaaacgcgacgaaccgaaaaaactaaaattaaaaaccaccaaacgctaccaaacactaattcgacgtccaaaacaatttcaaaccgaaacgaaccgcgctccctcgccctacttaatccaatcaacgaataccgaacacctaccacgtacaaaactccgaaaacacaaaaacgaaaaaaaaaccttatacaaacgaaaacaaaaactataattcatccatattacgatcgtacctacacaaaaaaaaattt

SEQ ID NO: 17953 - DNA, 1287 bp, Artificial Sequence
  chemically treated genomic DNA (Homo sapiens) CpG-island No: 17953
tttgttcgcgttttttatcgaaattttttcgtttcgttagcgaggaaggcgcgatcgttttcggaatatagacgggagatcggaggttcggggatcgtcggacgatcgcggtcgggcggttttttatattattcgggcggttttttcgacggcgcgcggcgtttatttttaggcggtcgatgcggtttcgtagggcgcgtacggcgttttttagttttagaatgagcgtaggcgagttttagggttcgtcggttatggtgtcgcggcggggttcggcgttttggaggtcgcgcggtaggtcgttttcgtagcggtttagtttgtcggtgagtttacggatggtgttttggtcggcgcggatgcgcgttttttgttgtagcgtcgtttggcgtagttgttcggtcgtgttttgtagtagtagtagtttttcgcgttcgttcggcgtagcgttcgtcgcgtttttttgttgggttttcgacgggtaggtagtagttagcggcgtgtataggaagcggttgaataggggttcgggcggtagcgggtgcgcgttggtcgcgggtgtttcgggtagcgcggggggttcggttgaatcgttcgcgtcgtgtagcgcgtttaggtttcgttgcgggttcggggacgcggcggcgttcgaggcgatcgaagtattgtcggcgtcgtcgggtagcgttcgcgtcgggttggtcgttaggggtacgttggcgatgatgtagatgacggtatcgaggaacgttagtatgttcgcggttagtagtacggttaggaattttagcgtgaggcgggcggcgggggcgttcgaggttttcggtaggcgcggcggcggggtcggggcgcggagttcgggcgcgttgggtcgagcggggtaggcgcgggagtcggagtcggagtcggagtcggagtcggagttggagttgtcgtcgcggtcgttgttgtcgtcgttttgagttcgggcggcgggaggaggagaagacggtaggcggcggggagggggagcgggcgcggcggtttcgttttattcgttttttcgggtcggttttggtttcggtttagtttcgtattcgtttagtgtcgggcgttcggttgggggcgtcgtcggggatgcggcgaggagcgagggtagcgtttgggattttatttcgtcgcggttatagcgtaggggtcggcgattcgagggtcgcgcggcggggtttttgggtgatttttattttagttttttcgtgttcgggttttttttttaagtcggttatgtttatatttattcgggaggga

SEQ ID NO: 17954 - DNA, 1287 bp, Artificial Sequence
  chemically treated genomic DNA (Homo sapiens) CpG-island No: 17954
tccctcccgaataaatataaacataaccgacttaaaaaaaaaacccgaacacgaaaaaactaaaataaaaatcacccaaaaaccccgccgcgcgaccctcgaatcgccgacccctacgctataaccgcgacgaaataaaatcccaaacgctaccctcgctcctcgccgcatccccgacgacgcccccaaccgaacgcccgacactaaacgaatacgaaactaaaccgaaaccaaaaccgacccgaaaaaacgaataaaacgaaaccgccgcgcccgctccccctccccgccgcctaccgtcttctcctcctcccgccgcccgaactcaaaacgacgacaacaacgaccgcgacgacaactccaactccgactccgactccgactccgactccgactcccgcgcctaccccgctcgacccaacgcgcccgaactccgcgccccgaccccgccgccgcgcctaccgaaaacctcgaacgcccccgccgcccgcctcacgctaaaattcctaaccgtactactaaccgcgaacatactaacgttcctcgataccgtcatctacatcatcgccaacgtacccctaacgaccaacccgacgcgaacgctacccgacgacgccgacaatacttcgatcgcctcgaacgccgccgcgtccccgaacccgcaacgaaacctaaacgcgctacacgacgcgaacgattcaaccgaaccccccgcgctacccgaaacacccgcgaccaacgcgcacccgctaccgcccgaacccctattcaaccgcttcctatacacgccgctaactactacctacccgtcgaaaacccaacaaaaaaacgcgacgaacgctacgccgaacgaacgcgaaaaactactactactacaaaacacgaccgaacaactacgccaaacgacgctacaacaaaaaacgcgcatccgcgccgaccaaaacaccatccgtaaactcaccgacaaactaaaccgctacgaaaacgacctaccgcgcgacctccaaaacgccgaaccccgccgcgacaccataaccgacgaaccctaaaactcgcctacgctcattctaaaactaaaaaacgccgtacgcgccctacgaaaccgcatcgaccgcctaaaaataaacgccgcgcgccgtcgaaaaaaccgcccgaataatataaaaaaccgcccgaccgcgatcgtccgacgatccccgaacctccgatctcccgtctatattccgaaaacgatcgcgccttcctcgctaacgaaacgaaaaaatttcgataaaaaacgcgaacaaa

SEQ ID NO: 17955 - DNA, 1287 bp, Artificial Sequence
  chemically treated genomic DNA (Homo sapiens) CpG-island No: 17955
tttttttcgggtggatgtgaatataatcggtttggggagggggttcgagtacgggagggttgggatgggggttatttaggagtttcgtcgcgcggttttcgggtcgtcggtttttgcgttgtgatcgcggcgagataaggttttaggcgttgttttcgtttttcgtcgtattttcggcggcgtttttagtcgggcgttcggtattgaacgggtgcggggttgggtcggggttagggtcggttcggggaagcgagtggggcggggtcgtcgcgttcgtttttttttttcgtcgtttgtcgttttttttttttttcgtcgttcgggtttagagcggcggtagtagcggtcgcggcgatagttttagtttcggtttcggtttcggtttcggtttcggttttcgcgtttgtttcgttcggtttagcgcgttcgggtttcgcgtttcgatttcgtcgtcgcgtttgtcgggggtttcgggcgttttcgtcgttcgttttacgttgaagtttttggtcgtgttgttggtcgcgggtatgttggcgtttttcggtgtcgttatttgtattatcgttagcgtgtttttggcggttagttcggcgcgggcgttgttcggcggcgtcgataatgtttcggtcgtttcgggcgtcgtcgcgttttcgggttcgtagcggagtttgagcgcgttgtacggcgcgggcggtttagtcgggtttttcgcgttgttcggggtattcgcggttagcgcgtattcgttgtcgttcgggtttttgtttagtcgttttttgtgtacgtcgttggttgttgtttgttcgtcgggggtttagtagggggacgcggcgggcgttgcgtcgggcgagcgcgaagagttgttgttgttgtagagtacggtcgagtagttgcgttagacggcgttgtagtaggaggcgcgtattcgcgtcgattaggatattattcgtgagtttatcggtaagttgggtcgttgcgagagcggtttgtcgcgcggtttttagggcgtcgggtttcgtcgcgatattatggtcgacgggttttgggattcgtttgcgtttattttggagttggaggacgtcgtgcgcgttttgcgggatcgtatcgatcgtttggaggtgagcgtcgcgcgtcgtcgggggagtcgttcgggtggtgtgaggggtcgttcggtcgcggtcgttcggcggttttcgagttttcggtttttcgtttgtgtttcggggacgatcgcgtttttttcgttggcgaggcggggggatttcgatagggaacgcgggtagg

SEQ ID NO: 17956 - DNA, 1287 bp, Artificial Sequence
  chemically treated genomic DNA (Homo sapiens) CpG-island No: 17956
cctacccgcgttccctatcgaaatccccccgcctcgccaacgaaaaaaacgcgatcgtccccgaaacacaaacgaaaaaccgaaaactcgaaaaccgccgaacgaccgcgaccgaacgacccctcacaccacccgaacgactcccccgacgacgcgcgacgctcacctccaaacgatcgatacgatcccgcaaaacgcgcacgacgtcctccaactccaaaataaacgcaaacgaatcccaaaacccgtcgaccataatatcgcgacgaaacccgacgccctaaaaaccgcgcgacaaaccgctctcgcaacgacccaacttaccgataaactcacgaataatatcctaatcgacgcgaatacgcgcctcctactacaacgccgtctaacgcaactactcgaccgtactctacaacaacaacaactcttcgcgctcgcccgacgcaacgcccgccgcgtccccctactaaacccccgacgaacaaacaacaaccaacgacgtacacaaaaaacgactaaacaaaaacccgaacgacaacgaatacgcgctaaccgcgaataccccgaacaacgcgaaaaacccgactaaaccgcccgcgccgtacaacgcgctcaaactccgctacgaacccgaaaacgcgacgacgcccgaaacgaccgaaacattatcgacgccgccgaacaacgcccgcgccgaactaaccgccaaaaacacgctaacgataatacaaataacgacaccgaaaaacgccaacatacccgcgaccaacaacacgaccaaaaacttcaacgtaaaacgaacgacgaaaacgcccgaaacccccgacaaacgcgacgacgaaatcgaaacgcgaaacccgaacgcgctaaaccgaacgaaacaaacgcgaaaaccgaaaccgaaaccgaaaccgaaaccgaaactaaaactatcgccgcgaccgctactaccgccgctctaaacccgaacgacgaaaaaaaaaaaaaacgacaaacgacgaaaaaaaaaaacgaacgcgacgaccccgccccactcgcttccccgaaccgaccctaaccccgacccaaccccgcacccgttcaataccgaacgcccgactaaaaacgccgccgaaaatacgacgaaaaacgaaaacaacgcctaaaaccttatctcgccgcgatcacaacgcaaaaaccgacgacccgaaaaccgcgcgacgaaactcctaaataacccccatcccaaccctcccgtactcgaaccccctccccaaaccgattatattcacatccacccgaaaaaaa

SEQ ID NO: 17957 - DNA, 978 bp, Artificial Sequence
  chemically treated genomic DNA (Homo sapiens) CpG-island No: 17957
gagttataaacgtataaaattaggatgaagattagagagggataggtacgcggcgagagtaagagcgcgtatttttattttaggtttcggtgttcgttgttttttttttcgcgacgttttcggatttcgcgatatttatttgatcgtttattttttttattttattaggtattcgatgcgtttttgaaaaatagaggggagaaaaacgggggtgggggtggggaggatgcggggacgcgaggaggcggcggcgcggggttgggcgagggagtcgggttagcgggatcgtttcgtttcgagggttttcggtttcggtttcggttgcggatagcggcggttcgtttcgggcggcggtttatttttcggattcgtcgtttgatgatggattcggtcgcgaagattcgttcgtttattgtagatagttttattttgtttagcggtatttatagtttataatattttttgcgttcgcggtcggtgcggtatcgttcgcgtacgcgtcgtagcgtttaggtttcggcgggcgggagcgcggcggggcgcgcgttcgcgttttagttgcgggtcgttacgtgattttcgcggttggcgcgcggttgttaggatttttttttttttcggggcggttgttagggaaagtcggcgttcgcggggcgggggcgcgcgttggtttttaaaggggtcgcgcgggcggagggagtaattgtcggtcgattcgatgggtgttcggtttgtgggtacgttgcggttttacgtttattatttttttttatattttgtcggcgttcgatcgttgatattttttttttgttttttaatttttacgcgagtttcgttaggtttcgggcggagaagggttgtggagttcgagtttcgtcgttatcgcgtatttttcgtagtagtttgtaaatagttaaatatgatgtagtagaaatgtagttgttgttgttttgttaggttttgcgggaatttttttaa

SEQ ID NO: 17958 - DNA, 978 bp, Artificial Sequence
  chemically treated genomic DNA (Homo sapiens) CpG-island No: 17958
ttaaaaaaattcccgcaaaacctaacaaaacaacaacaactacatttctactacatcatatttaactatttacaaactactacgaaaaatacgcgataacgacgaaactcgaactccacaacccttctccgcccgaaacctaacgaaactcgcgtaaaaattaaaaaacaaaaaaaaaatatcaacgatcgaacgccgacaaaatataaaaaaaaataataaacgtaaaaccgcaacgtacccacaaaccgaacacccatcgaatcgaccgacaattactccctccgcccgcgcgacccctttaaaaaccaacgcgcgcccccgccccgcgaacgccgactttccctaacaaccgccccgaaaaaaaaaaaaatcctaacaaccgcgcgccaaccgcgaaaatcacgtaacgacccgcaactaaaacgcgaacgcgcgccccgccgcgctcccgcccgccgaaacctaaacgctacgacgcgtacgcgaacgataccgcaccgaccgcgaacgcaaaaaatattataaactataaataccgctaaacaaaataaaactatctacaataaacgaacgaatcttcgcgaccgaatccatcatcaaacgacgaatccgaaaaataaaccgccgcccgaaacgaaccgccgctatccgcaaccgaaaccgaaaccgaaaaccctcgaaacgaaacgatcccgctaacccgactccctcgcccaaccccgcgccgccgcctcctcgcgtccccgcatcctccccacccccacccccgtttttctcccctctatttttcaaaaacgcatcgaatacctaataaaataaaaaaaataaacgatcaaataaatatcgcgaaatccgaaaacgtcgcgaaaaaaaaaacaacgaacaccgaaacctaaaataaaaatacgcgctcttactctcgccgcgtacctatccctctctaatcttcatcctaattttatacgtttataactc

SEQ ID NO: 17959 - DNA, 978 bp, Artificial Sequence
  chemically treated genomic DNA (Homo sapiens) CpG-island No: 17959
ttaaagaaattttcgtaaggtttggtaaggtaatagtaattgtatttttgttgtattatatttaattgtttgtaggttgttgcgggagatgcgcggtggcggcgagattcgggttttatagttttttttcgttcggggtttggcgagattcgcgtggggattaagaggtaaggagagggtgttagcgatcgggcgtcggtaagatgtgagggggggtgataagcgtaaggtcgtagcgtgtttataagtcgggtatttatcgggtcggtcggtaattgtttttttcgttcgcgcggtttttttaagagttagcgcgcgttttcgtttcgcgagcgtcgattttttttagtaatcgtttcgggggagggggaggttttggtaatcgcgcgttagtcgcgaggattacgtgacggttcgtagttggaacgcgagcgcgcgtttcgtcgcgttttcgttcgtcggggtttgggcgttgcggcgcgtgcgcgagcggtgtcgtatcggtcgcgggcgtagggagtattatgggttgtgggtgtcgttgagtaagatggagttgtttgtagtgggcgagcgggttttcgcggtcgaatttattattaaacggcggattcgaaaggtgagtcgtcgttcggggcgggtcgtcgttgttcgtagtcggggtcggggtcgggggttttcggggcgaagcggtttcgttagttcggttttttcgtttagtttcgcgtcgtcgttttttcgcgttttcgtattttttttatttttattttcgttttttttttttttgttttttagggacgtatcgagtatttggtgaaatggaaggggtgggcgattaagtgagtgtcgcggggttcgggggcgtcgcgggaggggaggtagcgggtatcggggtttggggtgggggtgcgcgtttttgttttcgtcgcgtgtttgtttttttttggtttttattttgattttgtgcgtttgtgattt

SEQ ID NO: 17960 - DNA, 978 bp, Artificial Sequence
  chemically treated genomic DNA (Homo sapiens) CpG-island No: 17960
aaatcacaaacgcacaaaatcaaaataaaaaccaaaaaaaaacaaacacgcgacgaaaacaaaaacgcgcacccccaccccaaaccccgatacccgctacctcccctcccgcgacgcccccgaaccccgcgacactcacttaatcgcccaccccttccatttcaccaaatactcgatacgtccctaaaaaacaaaaaaaaaaaaaacgaaaataaaaataaaaaaaatacgaaaacgcgaaaaaacgacgacgcgaaactaaacgaaaaaaccgaactaacgaaaccgcttcgccccgaaaacccccgaccccgaccccgactacgaacaacgacgacccgccccgaacgacgactcacctttcgaatccgccgtttaataataaattcgaccgcgaaaacccgctcgcccactacaaacaactccatcttactcaacgacacccacaacccataatactccctacgcccgcgaccgatacgacaccgctcgcgcacgcgccgcaacgcccaaaccccgacgaacgaaaacgcgacgaaacgcgcgctcgcgttccaactacgaaccgtcacgtaatcctcgcgactaacgcgcgattaccaaaacctccccctcccccgaaacgattactaaaaaaaatcgacgctcgcgaaacgaaaacgcgcgctaactcttaaaaaaaccgcgcgaacgaaaaaaacaattaccgaccgacccgataaatacccgacttataaacacgctacgaccttacgcttatcaccccccctcacatcttaccgacgcccgatcgctaacaccctctccttacctcttaatccccacgcgaatctcgccaaaccccgaacgaaaaaaaactataaaacccgaatctcgccgccaccgcgcatctcccgcaacaacctacaaacaattaaatataatacaacaaaaatacaattactattaccttaccaaaccttacgaaaatttctttaa

SEQ ID NO: 17961 - DNA, 1479 bp, Artificial Sequence
  chemically treated genomic DNA (Homo sapiens) CpG-island No: 17961
cgttatcgaatttttatttatttgttttttatttcgagtttaaacggttgttgtagttttttttttttcgtatcgttttcgtatttgcgtttttatagggtagacgatgtttggttgcgcggcgcggcgcggggcgaagaggcgaggattttgttcggcgtgtgggtgcgggggtgatgtgtggacgcgcgtgattgtgttagcggttcgagttggtcggtttcggagagggtgcgcgggggagttcgcgtgtgttagtcgcgggcgtgtgttaggcgcgggcgtgcgcgtgagggtgtgtgtacggtcgaggcggagcgttcgggcgggcggcggcggcggcggcggcggtaacggcggcggcgttaggattcgggggatatcgtttttcgtttttcgcgtttcgttttcgtttagtttttcgttttagttcgcgtcgcgtttcggtttggaacgtaggagcgtcggtttcgggagttcgagcggagttagtcgcgcgtatagttagcggtcgcgtcggcgatgcggggttatttcgcgttcgttttagtttcggtttcggttttcgcgggaaggggttgagttgttcgtcgtcgttcggatggcgagtttcgtcgcgttcgtttttagtttgtttttgaggttgtagttgtcgttattgttcggcgttcgggtttagagcgtcgtaggtgagtgcgttcgttcggtttttttgggtttttcgtttttttttggatgcgcgcgggtttttagtcgcggggttttcggaggagaaagttgtgtgggttcgcgggggcgcgggtttttatggtcggaattcgggttttagtttgtaggcgcgggaagtagtgttttcgcgcgtttcggttagcgagttcggtttttcgcgtttttcggtagttcgcgtttggcgaagtttttcgttttagttttttgtcggtttttcgggttggagtaatttttcgcggttgttgcgaatatttttatttgttgttttttatttgtcggaatttgttatttgagtgtttggggcggcgagacgaggagcggtatcgacgttcggggtggagcgttttttttcgggtagtttttcgggtagcgcgcgtttttagtggggaggataggtttttagtaggtcgaggttgtcggggcggcggtttttttttttttttcggagatataggaagttttttatttgttttgaatacgttgtttttttaagtaggtcgttgtaggtattcgaggggatgtttgcgttgatgatcgagagtaatattttcgttttattcgttggttttttttcgaggtagttgggcgttcgtgttaaggtttttggaggggagtggatttgattcgtgagcgcgttcgtttttgaaaagttcggggaatttatatttgggtttggttacgggaaggcggtgagtagaggtagttttttagagtagggggagcgggggcgggggggtggtgtttgtcgtg

SEQ ID NO: 17962 - DNA, 1479 bp, Artificial Sequence
  chemically treated genomic DNA (Homo sapiens) CpG-island No: 17962
cacgacaaacaccacccccccgcccccgctccccctactctaaaaaactacctctactcaccgccttcccgtaaccaaacccaaatataaattccccgaacttttcaaaaacgaacgcgctcacgaatcaaatccactcccctccaaaaaccttaacacgaacgcccaactacctcgaaaaaaaaccaacgaataaaacgaaaatattactctcgatcatcaacgcaaacatcccctcgaatacctacaacgacctacttaaaaaaacaacgtattcaaaacaaataaaaaacttcctatatctccgaaaaaaaaaaaaaaaccgccgccccgacaacctcgacctactaaaaacctatcctccccactaaaaacgcgcgctacccgaaaaactacccgaaaaaaaacgctccaccccgaacgtcgataccgctcctcgtctcgccgccccaaacactcaaataacaaattccgacaaataaaaaacaacaaataaaaatattcgcaacaaccgcgaaaaattactccaacccgaaaaaccgacaaaaaactaaaacgaaaaacttcgccaaacgcgaactaccgaaaaacgcgaaaaaccgaactcgctaaccgaaacgcgcgaaaacactacttcccgcgcctacaaactaaaacccgaattccgaccataaaaacccgcgcccccgcgaacccacacaactttctcctccgaaaaccccgcgactaaaaacccgcgcgcatccaaaaaaaaacgaaaaacccaaaaaaaccgaacgaacgcactcacctacgacgctctaaacccgaacgccgaacaataacgacaactacaacctcaaaaacaaactaaaaacgaacgcgacgaaactcgccatccgaacgacgacgaacaactcaaccccttcccgcgaaaaccgaaaccgaaactaaaacgaacgcgaaataaccccgcatcgccgacgcgaccgctaactatacgcgcgactaactccgctcgaactcccgaaaccgacgctcctacgttccaaaccgaaacgcgacgcgaactaaaacgaaaaactaaacgaaaacgaaacgcgaaaaacgaaaaacgatatcccccgaatcctaacgccgccgccgttaccgccgccgccgccgccgccgcccgcccgaacgctccgcctcgaccgtacacacaccctcacgcgcacgcccgcgcctaacacacgcccgcgactaacacacgcgaactcccccgcgcaccctctccgaaaccgaccaactcgaaccgctaacacaatcacgcgcgtccacacatcacccccgcacccacacgccgaacaaaatcctcgcctcttcgccccgcgccgcgccgcgcaaccaaacatcgtctaccctataaaaacgcaaatacgaaaacgatacgaaaaaaaaaaaactacaacaaccgtttaaactcgaaataaaaaacaaataaataaaaattcgataacg

SEQ ID NO: 17963 - DNA, 1479 bp, Artificial Sequence
  chemically treated genomic DNA (Homo sapiens) CpG-island No: 17963
tacggtaggtattattttttcgttttcgttttttttattttggggaattatttttgtttatcgttttttcgtggttaaatttaaatatgagtttttcgaattttttaggagcggacgcgtttacgggttaaatttatttttttttaagggttttaatacgggcgtttagttatttcggagaaaagttagcgggtagggcggaggtattgttttcggttattaacgtaaatattttttcgggtgtttatagcggtttgtttaggggagtagcgtgtttagagtaaatggagagttttttgtattttcgaggaaaaaagaaaagtcgtcgtttcggtagtttcggtttgttggggatttgttttttttattaaaagcgcgcgttgttcgaggagttgttcgggagagaacgttttatttcgggcgtcggtgtcgtttttcgtttcgtcgttttaaatatttaagtggtagatttcgataagtgggaggtagtaagtggaaatattcgtaataatcgcggaaagttattttagttcggggggtcggtaggaaattgaagcggggaatttcgttaaacgcgggttgtcgagggacgcgaggggtcgggttcgttggtcggggcgcgcggggatattgtttttcgcgtttgtaagttgagattcgggtttcggttatggggattcgcgttttcgcgagtttatataattttttttttcgagggtttcgcggttgggggttcgcgcgtatttaggagggagcggggagtttaggggagtcgggcgggcgtatttatttgcggcgttttgagttcgggcgtcgggtagtggcggtagttgtagttttaggagtaggttgagggcgagcgcggcgaggttcgttattcgggcggcggcgggtagtttagttttttttcgcgggggtcggggtcgggattggggcgggcgcggggtggtttcgtatcgtcggcgcggtcgttggttgtgcgcgcggttggtttcgttcgggttttcggagtcggcgtttttgcgttttaagtcgaggcgcggcgcgaattgaggcgggaggttgggcgggggcgggacgcggggggcggggggcggtgtttttcgagttttaacgtcgtcgtcgttgtcgtcgtcgtcgtcgtcgtcgttcgttcgggcgtttcgtttcggtcgtgtatatatttttacgcgtacgttcgcgtttggtatacgttcgcggttggtatacgcgggttttttcgcgtatttttttcggggtcgattagttcgggtcgttggtatagttacgcgcgtttatatattattttcgtatttatacgtcgggtagggttttcgttttttcgtttcgcgtcgcgtcgcgtagttaagtatcgtttgttttgtgggggcgtaggtacgggggcggtgcggggaggaggaagttgtagtagtcgtttgaattcggggtggggaataggtgaatgggggttcggtggcg

SEQ ID NO: 17964 - DNA, 1479 bp, Artificial Sequence
  chemically treated genomic DNA (Homo sapiens) CpG-island No: 17964
cgccaccgaacccccattcacctattccccaccccgaattcaaacgactactacaacttcctcctccccgcaccgcccccgtacctacgcccccacaaaacaaacgatacttaactacgcgacgcgacgcgaaacgaaaaaacgaaaaccctacccgacgtataaatacgaaaataatatataaacgcgcgtaactataccaacgacccgaactaatcgaccccgaaaaaaatacgcgaaaaaacccgcgtataccaaccgcgaacgtataccaaacgcgaacgtacgcgtaaaaatatatacacgaccgaaacgaaacgcccgaacgaacgacgacgacgacgacgacgacaacgacgacgacgttaaaactcgaaaaacaccgccccccgccccccgcgtcccgcccccgcccaacctcccgcctcaattcgcgccgcgcctcgacttaaaacgcaaaaacgccgactccgaaaacccgaacgaaaccaaccgcgcgcacaaccaacgaccgcgccgacgatacgaaaccaccccgcgcccgccccaatcccgaccccgacccccgcgaaaaaaaactaaactacccgccgccgcccgaataacgaacctcgccgcgctcgccctcaacctactcctaaaactacaactaccgccactacccgacgcccgaactcaaaacgccgcaaataaatacgcccgcccgactcccctaaactccccgctccctcctaaatacgcgcgaacccccaaccgcgaaaccctcgaaaaaaaaaattatataaactcgcgaaaacgcgaatccccataaccgaaacccgaatctcaacttacaaacgcgaaaaacaatatccccgcgcgccccgaccaacgaacccgacccctcgcgtccctcgacaacccgcgtttaacgaaattccccgcttcaatttcctaccgaccccccgaactaaaataactttccgcgattattacgaatatttccacttactacctcccacttatcgaaatctaccacttaaatatttaaaacgacgaaacgaaaaacgacaccgacgcccgaaataaaacgttctctcccgaacaactcctcgaacaacgcgcgcttttaataaaaaaaacaaatccccaacaaaccgaaactaccgaaacgacgacttttcttttttcctcgaaaatacaaaaaactctccatttactctaaacacgctactcccctaaacaaaccgctataaacacccgaaaaaatatttacgttaataaccgaaaacaatacctccgccctacccgctaacttttctccgaaataactaaacgcccgtattaaaacccttaaaaaaaaataaatttaacccgtaaacgcgtccgctcctaaaaaattcgaaaaactcatatttaaatttaaccacgaaaaaacgataaacaaaaataattccccaaaataaaaaaaacgaaaacgaaaaaataatacctaccgta

SEQ ID NO: 17965 - DNA, 594 bp, Artificial Sequence
  chemically treated genomic DNA (Homo sapiens) CpG-island No: 17965
tcgtagcgttcgtagtttggaagaggggaaagtggtcggagcgttatttttttttaagaatttagaaggggcggcggttaaattggaaggcggcgagttttatttttcgggtagtgaagttcgggtcggtttgttaatttagtaacgttttgaatgtagttttcggtttttttttttttttacgttttaatatcgttaggtacgcgggttggtttttgtttagcgtttcgggttggagcgtagaattcggtttttcgtttcggggtcggtttttttttcgttttgtcggtttagttcgttcgtttttaattaagcggtaggatcgtagcgagtcgtcgggacgtgttgtaatatgatgaattgtttttgtgcggatgttatcgaaagcgtttttgataaggcgaagttacgaaggattaaaagggcggtcgcggttcgttcgttttttatttttttttagtcgttgttcggttttgagtattcgttttttcggttcgtgttttttcgcgggttgtttttaggtttcgttggtttttttgattcgtttgttttagggttagtttttcggtgattttgtatttttttgtttttttt

SEQ ID NO: 17966 - DNA, 594 bp, Artificial Sequence
  chemically treated genomic DNA (Homo sapiens) CpG-island No: 17966
aaaaaaaacaaaaaaatacaaaatcaccgaaaaactaaccctaaaacaaacgaatcaaaaaaaccaacgaaacctaaaaacaacccgcgaaaaaacacgaaccgaaaaaacgaatactcaaaaccgaacaacgactaaaaaaaaataaaaaacgaacgaaccgcgaccgcccttttaatccttcgtaacttcgccttatcaaaaacgctttcgataacatccgcacaaaaacaattcatcatattacaacacgtcccgacgactcgctacgatcctaccgcttaattaaaaacgaacgaactaaaccgacaaaacgaaaaaaaaaccgaccccgaaacgaaaaaccgaattctacgctccaacccgaaacgctaaacaaaaaccaacccgcgtacctaacgatattaaaacgtaaaaaaaaaaaaaaaccgaaaactacattcaaaacgttactaaattaacaaaccgacccgaacttcactacccgaaaaataaaactcgccgccttccaatttaaccgccgccccttctaaattcttaaaaaaaaataacgctccgaccactttcccctcttccaaactacgaacgctacga

SEQ ID NO: 17967 - DNA, 594 bp, Artificial Sequence
  chemically treated genomic DNA (Homo sapiens) CpG-island No: 17967
aagaaagataaagagatgtagaattatcgagagattggttttgggataggcggattaggagagttagcgggatttagagatagttcgcgggagagtacgggtcgagagggcgagtgtttaaagtcgggtagcggttaggggaagataggaggcgggcgagtcgcggtcgtttttttgatttttcgtggtttcgttttattagaagcgttttcggtgatattcgtataaaggtagtttattatattatagtacgtttcggcggttcgttgcgattttgtcgtttaattagaggcgagcgagttgggtcggtagggcgggagggaggtcgatttcgaggcgggaggtcgggttttgcgttttaattcggggcgttgggtaggggttagttcgcgtgtttggcggtgttgggacgtggagagagggagaggtcgggaattgtatttagagcgttgttaaattaataggtcggttcgggttttattgttcggagagtgaagttcgtcgttttttaatttagtcgtcgttttttttaagtttttgggaagggatggcgtttcggttattttttttttttttaggttgcgaacgttgcgg

SEQ ID NO: 17968 - DNA, 594 bp, Artificial Sequence
  chemically treated genomic DNA (Homo sapiens) CpG-island No: 17968
ccgcaacgttcgcaacctaaaaaaaaaaaaaataaccgaaacgccatcccttcccaaaaacttaaaaaaaacgacgactaaattaaaaaacgacgaacttcactctccgaacaataaaacccgaaccgacctattaatttaacaacgctctaaatacaattcccgacctctccctctctccacgtcccaacaccgccaaacacgcgaactaacccctacccaacgccccgaattaaaacgcaaaacccgacctcccgcctcgaaatcgacctccctcccgccctaccgacccaactcgctcgcctctaattaaacgacaaaatcgcaacgaaccgccgaaacgtactataatataataaactacctttatacgaatatcaccgaaaacgcttctaataaaacgaaaccacgaaaaatcaaaaaaacgaccgcgactcgcccgcctcctatcttcccctaaccgctacccgactttaaacactcgccctctcgacccgtactctcccgcgaactatctctaaatcccgctaactctcctaatccgcctatcccaaaaccaatctctcgataattctacatctctttatctttctt

SEQ ID NO: 17969 - DNA, 511 bp, Artificial Sequence
  chemically treated genomic DNA (Homo sapiens) CpG-island No: 17969
ttataaataattgatcgacgtcgagagtagtagttaaaacgttagttcgggaggacgtatttttcgtagtattggggtagattaggcgcgtagtttcgtagtcgggttttttcgggatttataggtcgttcgtgttcggtttttatagcgtaaagaaggcgcgggtttcgtatttagtcggtattcggggtgcgtatcgagggggcgttgtcggtaaagtttgagcggtttttagttgtttcgtagtatgagagttttttcgttggagttttggtcgtttgtttcggcggcgggagcgaattattggttcgtatatcggagcgtgggaaaattcgggttggggtttcgtagtttagggaagttttttatttttgtcgtttaggatgtcgtcgatgttgtgtttggtttttttttcgtcgtcgtttttttttttgttcgttttatttttttttttttttttttcgaatttgattttgagtacgcggttaatcgaatttattaaattttagaa

SEQ ID NO: 17970 - DNA, 511 bp, Artificial Sequence
  chemically treated genomic DNA (Homo sapiens) CpG-island No: 17970
ttctaaaatttaataaattcgattaaccgcgtactcaaaatcaaattcgaaaaaaaaaaaaaaaaaaataaaacgaacaaaaaaaaaaacgacgacgaaaaaaaaaccaaacacaacatcgacgacatcctaaacgacaaaaataaaaaacttccctaaactacgaaaccccaacccgaattttcccacgctccgatatacgaaccaataattcgctcccgccgccgaaacaaacgaccaaaactccaacgaaaaaactctcatactacgaaacaactaaaaaccgctcaaactttaccgacaacgccccctcgatacgcaccccgaataccgactaaatacgaaacccgcgccttctttacgctataaaaaccgaacacgaacgacctataaatcccgaaaaaacccgactacgaaactacgcgcctaatctaccccaatactacgaaaaatacgtcctcccgaactaacgttttaactactactctcgacgtcgatcaattatttataa

SEQ ID NO: 17971 - DNA, 511 bp, Artificial Sequence
  chemically treated genomic DNA (Homo sapiens) CpG-island No: 17971
ttttgaggtttagtgagttcgattagtcgcgtgtttagaattaagttcgggaagaaagaggaggaggatgaagcggataagaaggaggacgacggcgaaaagaaggttaaatatagtatcgacggtattttgggcgataaaggtagggaatttttttgggttgcgaggttttagttcgggtttttttacgtttcggtgtgcgggttagtggttcgttttcgtcgtcggagtaggcgattagaattttagcggagaaatttttatgttgcggggtagttgggagtcgtttaggttttgtcgatagcgttttttcggtgcgtatttcggatgtcggttagatgcgaagttcgcgttttttttgcgttatggaggtcgggtacggacggtttgtgagtttcgggagagttcggttgcggggttgcgcgtttggtttattttaatattgcggggagtgcgttttttcgggttggcgttttggttgttattttcggcgtcgattaattatttatag

SEQ ID NO: 17972 - DNA, 511 bp, Artificial Sequence
  chemically treated genomic DNA (Homo sapiens) CpG-island No: 17972
ctataaataattaatcgacgccgaaaataacaaccaaaacgccaacccgaaaaaacgcactccccgcaatattaaaataaaccaaacgcgcaaccccgcaaccgaactctcccgaaactcacaaaccgtccgtacccgacctccataacgcaaaaaaaacgcgaacttcgcatctaaccgacatccgaaatacgcaccgaaaaaacgctatcgacaaaacctaaacgactcccaactaccccgcaacataaaaatttctccgctaaaattctaatcgcctactccgacgacgaaaacgaaccactaacccgcacaccgaaacgtaaaaaaacccgaactaaaacctcgcaacccaaaaaaattccctacctttatcgcccaaaataccgtcgatactatatttaaccttcttttcgccgtcgtcctccttcttatccgcttcatcctcctcctctttcttcccgaacttaattctaaacacgcgactaatcgaactcactaaacctcaaaa

SEQ ID NO: 17973 - DNA, 687 bp, Artificial Sequence
  chemically treated genomic DNA (Homo sapiens) CpG-island No: 17973
tacgaaggcgaagggtacgaggtcgtgtcggtttttgagttcgatttcgcggatgcggtcgtatttgtagaataggttttttaagtttttttcgcgtacgtcggtcggaaggttttttacgtagatgcgttcgtcgttttcgtcgtcgcgttcgttcgtttagttcgatattcgtatcgttcgacgtcgcgggttcgtcgtagtttacgtcgtcgtcgtcgttttagtacgggttttttcgtagcgttttcgcgggtttcgaggcgtttagtcgtattgtattgtgggaacgcggagcggaagcgaaggggtcggcggaggtaaaaggagtttttttaaagagaacgcggttgcgattattgcgcgtgcgcgtaggtcggcgttttttggaggtgcgaagggttttcgggcgttgatagggagagtttggggtcgggtcgtgtggatgttattttcgagcgcggttcgcgttcggttgaggcgttggataagtggtttgggttttcgcgttttagtttttttttgtggcgtcgtttattttatagatttgtgagtatttattgacgtgggtagcgtttagggtttgcggggcgtaggagagttggagttaggcggagatcgtaggttgatttcgtagcggtcgggttgtcgcggtttttattttaggttagtaggttttcgggttat

SEQ ID NO: 17974 - DNA, 687 bp, Artificial Sequence
  chemically treated genomic DNA (Homo sapiens) CpG-island No: 17974
ataacccgaaaacctactaacctaaaataaaaaccgcgacaacccgaccgctacgaaatcaacctacgatctccgcctaactccaactctcctacgccccgcaaaccctaaacgctacccacgtcaataaatactcacaaatctataaaataaacgacgccacaaaaaaaaactaaaacgcgaaaacccaaaccacttatccaacgcctcaaccgaacgcgaaccgcgctcgaaaataacatccacacgacccgaccccaaactctccctatcaacgcccgaaaacccttcgcacctccaaaaaacgccgacctacgcgcacgcgcaataatcgcaaccgcgttctctttaaaaaaactccttttacctccgccgaccccttcgcttccgctccgcgttcccacaatacaatacgactaaacgcctcgaaacccgcgaaaacgctacgaaaaaacccgtactaaaacgacgacgacgacgtaaactacgacgaacccgcgacgtcgaacgatacgaatatcgaactaaacgaacgaacgcgacgacgaaaacgacgaacgcatctacgtaaaaaaccttccgaccgacgtacgcgaaaaaaacttaaaaaacctattctacaaatacgaccgcatccgcgaaatcgaactcaaaaaccgacacgacctcgtacccttcgccttcgta

SEQ ID NO: 17975 - DNA, 687 bp, Artificial Sequence
  chemically treated genomic DNA (Homo sapiens) CpG-island No: 17975
gtggttcgggggtttattgatttgaggtgggggtcgcgatagttcggtcgttgcggggttagtttgcggttttcgtttgattttagtttttttgcgtttcgtaggttttgggcgttatttacgttagtgagtgtttataagtttgtgaggtaggcggcgttatagagagaaattgaggcgcgggagtttaagttatttgtttagcgttttagtcgagcgcgaatcgcgttcggggatggtatttatacggttcggttttaggttttttttgttagcgttcgaaggtttttcgtatttttagggggcgtcggtttgcgcgtacgcgtaatggtcgtagtcgcgttttttttaagaggattttttttgttttcgtcgattttttcgttttcgtttcgcgtttttataatgtagtgcggttgagcgtttcggagttcgcggggacgttgcggggggattcgtgttgaggcggcggcggcgacgtgggttgcggcgggttcgcggcgtcgggcggtgcggatgtcgggttgggcggacgagcgcggcggcgagggcgacgggcgtatttacgtggggaatttttcgatcgacgtgcgcgagaaggatttggaggatttgttttataagtacggtcgtattcgcgagatcgagtttaagaatcggtacggtttcgtgtttttcgttttcgtg

SEQ ID NO: 17976 - DNA, 687 bp, Artificial Sequence
  chemically treated genomic DNA (Homo sapiens) CpG-island No: 17976
cacgaaaacgaaaaacacgaaaccgtaccgattcttaaactcgatctcgcgaatacgaccgtacttataaaacaaatcctccaaatccttctcgcgcacgtcgatcgaaaaattccccacgtaaatacgcccgtcgccctcgccgccgcgctcgtccgcccaacccgacatccgcaccgcccgacgccgcgaacccgccgcaacccacgtcgccgccgccgcctcaacacgaatccccccgcaacgtccccgcgaactccgaaacgctcaaccgcactacattataaaaacgcgaaacgaaaacgaaaaaatcgacgaaaacaaaaaaaatcctcttaaaaaaaacgcgactacgaccattacgcgtacgcgcaaaccgacgccccctaaaaatacgaaaaaccttcgaacgctaacaaaaaaaacctaaaaccgaaccgtataaataccatccccgaacgcgattcgcgctcgactaaaacgctaaacaaataacttaaactcccgcgcctcaatttctctctataacgccgcctacctcacaaacttataaacactcactaacgtaaataacgcccaaaacctacgaaacgcaaaaaaactaaaatcaaacgaaaaccgcaaactaaccccgcaacgaccgaactatcgcgacccccacctcaaatcaataaacccccgaaccac

SEQ ID NO: 17977 - DNA, 736 bp, Artificial Sequence
  chemically treated genomic DNA (Homo sapiens) CpG-island No: 17977
gaggcgtcggcggaggacggggggagggcgtttttttaaggtcgtttttttcgtgtttcggtttttttcgcggtttatcgcggtatttgcgtttatcgtcgtcggagtttttatttgtagcgttggcgttttttttgatttagttcgttcgttttagcgaggtcgcggcgggggcgtgggagcgagtcgcgtcggtcggggtggggttgcgtttttagggttttcgggggatcgacgggttttgggagtcgggaacgaggaagaggcgggaggcggaagtgggggaggggcggtggcgggtttattcgttcgtagttcgttcggcggtcggaggtagtttttgcgagcgcggttattggtatttttaaggcggttaaaaagttattcgtatttatttttttttttttcgtttagtcggatttttttgtattattttcgttatcgacgtcggtgcgttagttttcgttcgttcggatgtatttgttgcgttttcgtttcgcgtagattcgcggcgggcgttcgcgtcggttttgtttacgtatatttgatgttttgcgttttttgggtagcgtttacgtaacgattacgtattcgaattttgttttcggtatttttggttatattcgttatatttatacgcgcgtatttttttagaggacgtacgatgggaaagagagagttgggattcgtaggagggggtagggtattgattcggtgtcgtttagtagggtaggtg

SEQ ID NO: 17978 - DNA, 736 bp, Artificial Sequence
  chemically treated genomic DNA (Homo sapiens) CpG-island No: 17978
cacctaccctactaaacgacaccgaatcaataccctaccccctcctacgaatcccaactctctctttcccatcgtacgtcctctaaaaaaatacgcgcgtataaatataacgaatataaccaaaaataccgaaaacaaaattcgaatacgtaatcgttacgtaaacgctacccaaaaaacgcaaaacatcaaatatacgtaaacaaaaccgacgcgaacgcccgccgcgaatctacgcgaaacgaaaacgcaacaaatacatccgaacgaacgaaaactaacgcaccgacgtcgataacgaaaataatacaaaaaaatccgactaaacgaaaaaaaaaaaaataaatacgaataactttttaaccgccttaaaaataccaataaccgcgctcgcaaaaactacctccgaccgccgaacgaactacgaacgaataaacccgccaccgcccctcccccacttccgcctcccgcctcttcctcgttcccgactcccaaaacccgtcgatcccccgaaaaccctaaaaacgcaaccccaccccgaccgacgcgactcgctcccacgcccccgccgcgacctcgctaaaacgaacgaactaaatcaaaaaaaacgccaacgctacaaataaaaactccgacgacgataaacgcaaataccgcgataaaccgcgaaaaaaaccgaaacacgaaaaaaacgaccttaaaaaaacgccctccccccgtcctccgccgacgcctc

SEQ ID NO: 17979 - DNA, 736 bp, Artificial Sequence
  chemically treated genomic DNA (Homo sapiens) CpG-island No: 17979
tatttgttttgttgggcggtatcgggttagtgttttgtttttttttgcgggttttaatttttttttttttatcgtgcgttttttggagaagtgcgcgcgtgtaagtgtggcgagtgtggttaagggtgtcggaggtagggttcgggtgcgtagtcgttgcgtgggcgttgtttaaaaggcgtagagtattaagtgtgcgtgggtagaatcggcgcgggcgttcgtcgcgggtttgcgcggggcgggggcgtagtaagtgtattcgagcgagcggagattagcgtatcggcgtcggtggcgagggtggtgtagaggagttcggttgggcggagggaggaaggatgggtgcgggtaattttttgatcgttttggaagtattagtagtcgcgttcgtaggggttgttttcgatcgtcgggcgagttgcgagcgagtgagttcgttatcgttttttttttattttcgtttttcgtttttttttcgttttcggtttttagggttcgtcggtttttcgggagttttggaggcgtagttttatttcggtcggcgcggttcgtttttacgttttcgtcgcggtttcgttggagcggacggattgagttagagggggcgttagcgttgtaggtaggggtttcggcggcggtgggcgtaggtgtcgcggtggatcgcggaggggatcggagtacgaggggaacggttttgggggagcgtttttttttcgtttttcgtcgacgtttt

SEQ ID NO: 17980 - DNA, 736 bp, Artificial Sequence
  chemically treated genomic DNA (Homo sapiens) CpG-island No: 17980
aaaacgtcgacgaaaaacgaaaaaaaaacgctcccccaaaaccgttcccctcgtactccgatcccctccgcgatccaccgcgacacctacgcccaccgccgccgaaacccctacctacaacgctaacgccccctctaactcaatccgtccgctccaacgaaaccgcgacgaaaacgtaaaaacgaaccgcgccgaccgaaataaaactacgcctccaaaactcccgaaaaaccgacgaaccctaaaaaccgaaaacgaaaaaaaaacgaaaaacgaaaataaaaaaaaaacgataacgaactcactcgctcgcaactcgcccgacgatcgaaaacaacccctacgaacgcgactactaatacttccaaaacgatcaaaaaattacccgcacccatccttcctccctccgcccaaccgaactcctctacaccaccctcgccaccgacgccgatacgctaatctccgctcgctcgaatacacttactacgcccccgccccgcgcaaacccgcgacgaacgcccgcgccgattctacccacgcacacttaatactctacgccttttaaacaacgcccacgcaacgactacgcacccgaaccctacctccgacacccttaaccacactcgccacacttacacgcgcgcacttctccaaaaaacgcacgataaaaaaaaaaaaattaaaacccgcaaaaaaaaacaaaacactaacccgataccgcccaacaaaacaaata

SEQ ID NO: 17981 - DNA, 596 bp, Artificial Sequence
  chemically treated genomic DNA (Homo sapiens) CpG-island No: 17981
ttggggtttttaatttcgcgggcgggcgtagtgtttcgtaggtttcgtttttattggggaatttcgggcggggtgcgggcggcggggcgggggcgggtcggggcggggtcggtaggtcgtttataagatgggtggcgcgttcgttcggggttattcgtcgtagtttgcgcgttttttttagttcgcggtgttatggttttcgttcgtttgttcgcgttgttgttgtttttcgtaggcggagtcgtcgagtcggtgggtgtttggaggttttcgggttgggggcgaagcgggggcgtaggtcggtgttttttttgttcgtcggagcgtgggatgggggggggtagatcgggggtacgttatttttaatcggatatcgaggttcgggaaattttgttggaaattttgtttcggggttacgggttagttttcgggatggttttacgcgtcgtgcgtttttcgtttgttgtttttttcgttttttcgggttttagtttcgtcgcgggttacgggttcgttagtgattaagtcggtgttaattttttaatttttatattttcgttttttttttggtgattttggggtaggtttggagcgtt

SEQ ID NO: 17982 - DNA, 596 bp, Artificial Sequence
  chemically treated genomic DNA (Homo sapiens) CpG-island No: 17982
aacgctccaaacctaccccaaaatcaccaaaaaaaaaacgaaaatataaaaattaaaaaattaacaccgacttaatcactaacgaacccgtaacccgcgacgaaactaaaacccgaaaaaacgaaaaaaacaacaaacgaaaaacgcacgacgcgtaaaaccatcccgaaaactaacccgtaaccccgaaacaaaatttccaacaaaatttcccgaacctcgatatccgattaaaaataacgtacccccgatctacccccccccatcccacgctccgacgaacaaaaaaaacaccgacctacgcccccgcttcgcccccaacccgaaaacctccaaacacccaccgactcgacgactccgcctacgaaaaacaacaacaacgcgaacaaacgaacgaaaaccataacaccgcgaactaaaaaaaacgcgcaaactacgacgaataaccccgaacgaacgcgccacccatcttataaacgacctaccgaccccgccccgacccgcccccgccccgccgcccgcaccccgcccgaaattccccaataaaaacgaaacctacgaaacactacgcccgcccgcgaaattaaaaaccccaa

SEQ ID NO: 17983 - DNA, 596 bp, Artificial Sequence
  chemically treated genomic DNA (Homo sapiens) CpG-island No: 17983
agcgttttaagtttgttttagggttattagggaagggacgagggtgtgggagttgaagagttgatatcggtttagttattaacgagttcgtagttcgcggcggggttgaggttcggggaggcgggaagagtaataggcgaggggcgtacggcgcgtgaagttatttcggaggttggttcgtgatttcggagtaaagtttttaataaagtttttcgggtttcggtgttcggttgggggtagcgtattttcgatttgtttttttttattttacgtttcgacgaataaaggaggtatcggtttgcgttttcgtttcgtttttagttcgggaatttttaagtatttatcgattcggcgatttcgtttacgaagaatagtagtagcgcgaatagacgggcgggggttatggtatcgcggattggagaaggcgcgtaggttgcggcgagtggtttcgggcgggcgcgttatttattttataggcggtttatcggtttcgtttcggttcgttttcgtttcgtcgttcgtatttcgttcggaattttttagtggaagcgaggtttgcggggtattgcgttcgttcgcggagttggaaattttaa

SEQ ID NO: 17984 - DNA, 596 bp, Artificial Sequence
  chemically treated genomic DNA (Homo sapiens) CpG-island No: 17984
ttaaaatttccaactccgcgaacgaacgcaataccccgcaaacctcgcttccactaaaaaattccgaacgaaatacgaacgacgaaacgaaaacgaaccgaaacgaaaccgataaaccgcctataaaataaataacgcgcccgcccgaaaccactcgccgcaacctacgcgccttctccaatccgcgataccataacccccgcccgtctattcgcgctactactattcttcgtaaacgaaatcgccgaatcgataaatacttaaaaattcccgaactaaaaacgaaacgaaaacgcaaaccgatacctcctttattcgtcgaaacgtaaaataaaaaaaaacaaatcgaaaatacgctacccccaaccgaacaccgaaacccgaaaaactttattaaaaactttactccgaaatcacgaaccaacctccgaaataacttcacgcgccgtacgcccctcgcctattactcttcccgcctccccgaacctcaaccccgccgcgaactacgaactcgttaataactaaaccgatatcaactcttcaactcccacaccctcgtcccttccctaataaccctaaaacaaacttaaaacgct

SEQ ID NO: 17985 - DNA, 547 bp, Artificial Sequence
  chemically treated genomic DNA (Homo sapiens) CpG-island No: 17985
tcgagttcgagattatgcggtagttttttatgggtttttttcgaggtttgaacgtgggttttaacgttacgcgcgttggcgtgatttagtattcgagttaagtgtagagcgtttttttttttcgcgcgttttttcgtcgcgaggatatggagcgcgttattcgcgatttggtgtttttggcgtaaggtattatgacgggattggtaatttagtacgttatgaacgtggtttttagtgtggtcgagggcgcgcgatcgttagaggagcgcgtgtcgcgtgtcgttgttatcgtgatagacgggcggttttaggatcgcgtggtcgaggtggcggtataggcgcgcgttcgcggtattgaaatttacgcggtgggggtgtagcgcgcggacgtgggttttttgcgcgttatggtatcgttttcgttagacgagtacgtttttttcgtagagtttttcgattttatttaggagttcggtttgtagttttagagtcggttgtgtggtgagttaggagggcgttggagtgaagttcgaatttttaatttaaa

SEQ ID NO: 17986 - DNA, 547 bp, Artificial Sequence
  chemically treated genomic DNA (Homo sapiens) CpG-island No: 17986
tttaaattaaaaattcgaacttcactccaacgccctcctaactcaccacacaaccgactctaaaactacaaaccgaactcctaaataaaatcgaaaaactctacgaaaaaaacgtactcgtctaacgaaaacgataccataacgcgcaaaaaacccacgtccgcgcgctacacccccaccgcgtaaatttcaataccgcgaacgcgcgcctataccgccacctcgaccacgcgatcctaaaaccgcccgtctatcacgataacaacgacacgcgacacgcgctcctctaacgatcgcgcgccctcgaccacactaaaaaccacgttcataacgtactaaattaccaatcccgtcataataccttacgccaaaaacaccaaatcgcgaataacgcgctccatatcctcgcgacgaaaaaacgcgcgaaaaaaaaaaacgctctacacttaactcgaatactaaatcacgccaacgcgcgtaacgttaaaacccacgttcaaacctcgaaaaaaacccataaaaaactaccgcataatctcgaactcga

SEQ ID NO: 17987 - DNA, 547 bp, Artificial Sequence
  chemically treated genomic DNA (Homo sapiens) CpG-island No: 17987
tttggattgagagttcgagttttattttagcgtttttttaatttattatatagtcggttttggaattgtaggtcgaatttttggatgaggtcgaaggattttacgaggaagacgtgttcgtttagcgggggcgatgttatggcgcgtagggagtttacgttcgcgcgttgtatttttatcgcgtaaattttaatgtcgcgggcgcgcgtttgtgtcgttatttcggttacgcggttttggggtcgttcgtttgttacgatgatagcgatacgcggtacgcgtttttttggcggtcgcgcgttttcggttatattgaaggttacgtttatggcgtattggattgttagtttcgttatggtgttttgcgttagaggtattaggtcgcggatggcgcgttttatgttttcgcggcgagagaacgcgcggagagggaagacgttttgtatttgattcgaatattggattacgttaacgcgcgtggcgttgggatttacgtttaggtttcggaggaggtttatgaggaattgtcgtatggtttcgaattcga

SEQ ID NO: 17988 - DNA, 547 bp, Artificial Sequence
  chemically treated genomic DNA (Homo sapiens) CpG-island No: 17988
tcgaattcgaaaccatacgacaattcctcataaacctcctccgaaacctaaacgtaaatcccaacgccacgcgcgttaacgtaatccaatattcgaatcaaatacaaaacgtcttccctctccgcgcgttctctcgccgcgaaaacataaaacgcgccatccgcgacctaatacctctaacgcaaaacaccataacgaaactaacaatccaatacgccataaacgtaaccttcaatataaccgaaaacgcgcgaccgccaaaaaaacgcgtaccgcgtatcgctatcatcgtaacaaacgaacgaccccaaaaccgcgtaaccgaaataacgacacaaacgcgcgcccgcgacattaaaatttacgcgataaaaatacaacgcgcgaacgtaaactccctacgcgccataacatcgcccccgctaaacgaacacgtcttcctcgtaaaatccttcgacctcatccaaaaattcgacctacaattccaaaaccgactatataataaattaaaaaaacgctaaaataaaactcgaactctcaatccaaa

SEQ ID NO: 17989 - DNA, 561 bp, Artificial Sequence
  chemically treated genomic DNA (Homo sapiens) CpG-island No: 17989
taggttggcgttgggaattttcgcgtcggttattttttttttcggtggtagaggtcgggcggggtagcgtatgcgcgtggcgggtaggcggtaggaggcgggtgggttaaggtaattttgggttatagagtttttgttgggggttcggggagcgtttggatttcggtttttgggacgcgttaggtacgttttcgagttcggcgtcgtcggttagcgttgtttgggtttattcgggggttcgagttgagtaggacgttcgggtttcgtttggagagaggttttaggagggtttggggaaggggacggaggtcgggcgatttcgggcggtggtcgtttttttttgtgtgttttcgcggttgtgaattggggcggtaattttttttcgtaggtcgtcgtgaagatgattgtatgagatcgtgcgtgtgaacgtttgttgatagttgttatttgagttcgatagttttgggggtcgtgtatttgcgtaatatggttatttttgaattttttgggggatacgtatatttttgagaattcgatgaaaattagagatttcgtttttgt

SEQ ID NO: 17990 - DNA, 561 bp, Artificial Sequence
  chemically treated genomic DNA (Homo sapiens) CpG-island No: 17990
acaaaaacgaaatctctaattttcatcgaattctcaaaaatatacgtatcccccaaaaaattcaaaaataaccatattacgcaaatacacgacccccaaaactatcgaactcaaataacaactatcaacaaacgttcacacgcacgatctcatacaatcatcttcacgacgacctacgaaaaaaaattaccgccccaattcacaaccgcgaaaacacacaaaaaaaaacgaccaccgcccgaaatcgcccgacctccgtccccttccccaaaccctcctaaaacctctctccaaacgaaacccgaacgtcctactcaactcgaacccccgaataaacccaaacaacgctaaccgacgacgccgaactcgaaaacgtacctaacgcgtcccaaaaaccgaaatccaaacgctccccgaacccccaacaaaaactctataacccaaaattaccttaacccacccgcctcctaccgcctacccgccacgcgcatacgctaccccgcccgacctctaccaccgaaaaaaaaaataaccgacgcgaaaattcccaacgccaaccta

SEQ ID NO: 17991 - DNA, 561 bp, Artificial Sequence
  chemically treated genomic DNA (Homo sapiens) CpG-island No: 17991
ataagggcggaatttttggtttttatcggatttttaaagatatacgtgttttttaaggagtttagaggtagttatgttacgtagatgtacggtttttagggttgtcggatttaagtaatagttgttaataaacgtttatacgtacgattttatgtaattatttttacggcgatttacggggaggaattatcgttttaatttataatcgcggagatatatagaggagggcggttatcgttcggggtcgttcggttttcgtttttttttttaggtttttttgaagtttttttttaggcgaggttcggacgttttatttagttcgggttttcgagtgaatttaggtagcgttggtcggcgacgtcggattcggagacgtatttgacgcgttttagaagtcggggtttaagcgtttttcgaatttttagtaaggattttgtagtttagagttattttgatttattcgttttttgtcgtttgttcgttacgcgtatgcgttgtttcgttcggtttttattatcgaggaaaggggtaatcggcgcgggggtttttagcgttagtttg

SEQ ID NO: 17992 - DNA, 561 bp, Artificial Sequence
  chemically treated genomic DNA (Homo sapiens) CpG-island No: 17992
caaactaacgctaaaaacccccgcgccgattacccctttcctcgataataaaaaccgaacgaaacaacgcatacgcgtaacgaacaaacgacaaaaaacgaataaatcaaaataactctaaactacaaaatccttactaaaaattcgaaaaacgcttaaaccccgacttctaaaacgcgtcaaatacgtctccgaatccgacgtcgccgaccaacgctacctaaattcactcgaaaacccgaactaaataaaacgtccgaacctcgcctaaaaaaaaacttcaaaaaaacctaaaaaaaaaaacgaaaaccgaacgaccccgaacgataaccgccctcctctatatatctccgcgattataaattaaaacgataattcctccccgtaaatcgccgtaaaaataattacataaaatcgtacgtataaacgtttattaacaactattacttaaatccgacaaccctaaaaaccgtacatctacgtaacataactacctctaaactccttaaaaaacacgtatatctttaaaaatccgataaaaaccaaaaattccgcccttat

SEQ ID NO: 17993 - DNA, 1141 bp, Artificial Sequence
  chemically treated genomic DNA (Homo sapiens) CpG-island No: 17993
cgagtcgagtagttagcgcgggtcggtaggcgtgggatcgcgagtcgcgcgggggtttcgggggtagttttttattttttcgggtacggtggggttcgtagggcgcggttttttcggaaggcgcggattttagttttttggtcgcggttttgcggaggaggagataatttcggttagcggcgagcgggcgcgggaagtgagcggcggggtcggtttttgttcgagggaaggtttcgcgcggcgaagggttggttcgcgaggggtggggtcggatagttagtttcgcgttttcgggttcgcgtttattcggttcgtagtttttatataaattttttcgttcgttacgtgagcgtaggtttagacgttttttcgtcgcgttttcggtcgtagattttagggtcgtcgggattgttcgtcgttggcggtttttttatcgtagtcggtcgttatttggagtgcgcgtcgttaattgggtcgtgcgggcgggcgcgcgtatttgagttcgacgttagcggttttcgttcggcgcgtgtttcggaaacgttttttcgcgtcgtttttattttttttagtcgtggcgttacgtttgacgtaagtttgacgttatcggtatcggtttgggagtcgtagacgtcgggcgtgtaggggcgtagtttaacggttggggtgttgtaaaggtcgtgggtgtggggttgcgggttgcgtatttcggcggcggtcggtagggttggggtttagtcgtttcgttcggcgcggtttttggcggggcggtttgagggagttttatttggacgttagtttgtttttttttcgggcgtgggcgttgtttcggggcggtagttaggttagcggttgtagttcgcggtttttagtattttttttttttttgtgtcgggtttttcggtcgaacgttttcgttttttttgcgttgattgttttatgtgtggttaacgcgcggtttattaggggggattttgaagtatttgattcggtcgggcgtaaattgttttggttagtgggttcgatcgtgtcgtattgtttagggagcgttaagggtaggtgtttcgttgggagttatattttaagtggaaaggagaattttgttgtagttttttggtgtcgtatttcggtttattatata

SEQ ID NO: 17994 - DNA, 1141 bp, Artificial Sequence
  chemically treated genomic DNA (Homo sapiens) CpG-island No: 17994
tatataataaaccgaaatacgacaccaaaaaactacaacaaaattctcctttccacttaaaatataactcccaacgaaacacctacccttaacgctccctaaacaatacgacacgatcgaacccactaaccaaaacaatttacgcccgaccgaatcaaatacttcaaaatcccccctaataaaccgcgcgttaaccacacataaaacaatcaacgcaaaaaaaacgaaaacgttcgaccgaaaaacccgacacaaaaaaaaaaaaaatactaaaaaccgcgaactacaaccgctaacctaactaccgccccgaaacaacgcccacgcccgaaaaaaaaacaaactaacgtccaaataaaactccctcaaaccgccccgccaaaaaccgcgccgaacgaaacgactaaaccccaaccctaccgaccgccgccgaaatacgcaacccgcaaccccacacccacgacctttacaacaccccaaccgttaaactacgcccctacacgcccgacgtctacgactcccaaaccgataccgataacgtcaaacttacgtcaaacgtaacgccacgactaaaaaaaataaaaacgacgcgaaaaaacgtttccgaaacacgcgccgaacgaaaaccgctaacgtcgaactcaaatacgcgcgcccgcccgcacgacccaattaacgacgcgcactccaaataacgaccgactacgataaaaaaaccgccaacgacgaacaatcccgacgaccctaaaatctacgaccgaaaacgcgacgaaaaaacgtctaaacctacgctcacgtaacgaacgaaaaaatttatataaaaactacgaaccgaataaacgcgaacccgaaaacgcgaaactaactatccgaccccacccctcgcgaaccaacccttcgccgcgcgaaaccttccctcgaacaaaaaccgaccccgccgctcacttcccgcgcccgctcgccgctaaccgaaattatctcctcctccgcaaaaccgcgaccaaaaaactaaaatccgcgccttccgaaaaaaccgcgccctacgaaccccaccgtacccgaaaaaataaaaaactacccccgaaacccccgcgcgactcgcgatcccacgcctaccgacccgcgctaactactcgactcg

SEQ ID NO: 17995 - DNA, 1141 bp, Artificial Sequence
  chemically treated genomic DNA (Homo sapiens) CpG-island No: 17995
tgtgtagtgaatcgaaatgcgatattaaggaattgtaataggatttttttttttatttgaaatgtgatttttagcgagatatttatttttgacgttttttggatagtgcggtacggtcgggtttattaattaaggtaatttgcgttcgatcgaattaggtgttttaaaattttttttggtgagtcgcgcgttaattatatataaaatagttaacgtagaaggagcgagaacgttcggtcgaaaagttcggtatagagaagggaggggtgttgaaagtcgcggattgtagtcgttggtttggttgtcgtttcgaaataacgtttacgttcgggagaagggtaggttggcgtttaggtaggatttttttaggtcgtttcgttaggggtcgcgtcgagcggagcggttggattttaattttgtcggtcgtcgtcgaggtgcgtagttcgtagttttatatttacggtttttgtaatattttaatcgttgaattgcgtttttatacgttcggcgtttgcggtttttaggtcggtgtcgatgacgttagatttacgttaggcgtgacgttacggttgggaggagtgaggacggcgcgggagggcgttttcggagtacgcgtcgggcgggggtcgttgacgtcgggtttaggtgcgcgcgttcgttcgtacggtttagttggcggcgcgtattttaggtggcggtcggttgcggtgaggggatcgttagcggcgagtagtttcggcggttttggggtttgcggtcgggggcgcggcgggagggcgtttgggtttgcgtttacgtgacgggcggggaggtttgtgtaggggttgcgagtcgggtgggcgcgggttcgggagcgcgaggttgattgttcggttttatttttcgcgggttagtttttcgtcgcgcggaattttttttcgggtaggggtcggtttcgtcgtttatttttcgcgttcgttcgtcgttgatcggagttgttttttttttcgtagggtcgcggttagagggttagaattcgcgtttttcgagggagtcgcgttttgcgggttttatcgtattcgaggggatggagggttgttttcgaggttttcgcgcggttcgcggttttacgtttgtcggttcgcgttagttattcgattcg

SEQ ID NO: 17996 - DNA, 1141 bp, Artificial Sequence
  chemically treated genomic DNA (Homo sapiens) CpG-island No: 17996
cgaatcgaataactaacgcgaaccgacaaacgtaaaaccgcgaaccgcgcgaaaacctcgaaaacaaccctccatcccctcgaatacgataaaacccgcaaaacgcgactccctcgaaaaacgcgaattctaaccctctaaccgcgaccctacgaaaaaaaaaacaactccgatcaacgacgaacgaacgcgaaaaataaacgacgaaaccgacccctacccgaaaaaaaattccgcgcgacgaaaaactaacccgcgaaaaataaaaccgaacaatcaacctcgcgctcccgaacccgcgcccacccgactcgcaacccctacacaaacctccccgcccgtcacgtaaacgcaaacccaaacgccctcccgccgcgcccccgaccgcaaaccccaaaaccgccgaaactactcgccgctaacgatcccctcaccgcaaccgaccgccacctaaaatacgcgccgccaactaaaccgtacgaacgaacgcgcgcacctaaacccgacgtcaacgacccccgcccgacgcgtactccgaaaacgccctcccgcgccgtcctcactcctcccaaccgtaacgtcacgcctaacgtaaatctaacgtcatcgacaccgacctaaaaaccgcaaacgccgaacgtataaaaacgcaattcaacgattaaaatattacaaaaaccgtaaatataaaactacgaactacgcacctcgacgacgaccgacaaaattaaaatccaaccgctccgctcgacgcgacccctaacgaaacgacctaaaaaaatcctacctaaacgccaacctacccttctcccgaacgtaaacgttatttcgaaacgacaaccaaaccaacgactacaatccgcgactttcaacacccctcccttctctataccgaacttttcgaccgaacgttctcgctccttctacgttaactattttatatataattaacgcgcgactcaccaaaaaaaattttaaaacacctaattcgatcgaacgcaaattaccttaattaataaacccgaccgtaccgcactatccaaaaaacgtcaaaaataaatatctcgctaaaaatcacatttcaaataaaaaaaaaaatcctattacaattccttaatatcgcatttcgattcactacaca

SEQ ID NO: 17997 - DNA, 811 bp, Artificial Sequence
  chemically treated genomic DNA (Homo sapiens) CpG-island No: 17997
aaagatggcgacggagcgtagtcgtttcgcgatggattcgtcggtttcggtttttatgttcgttttcgagtttagtttttcgggggcggttagggtcgcggcggtcgtcgttcgattttacggcggttttgattcggattgtagcgaggacggcgaggcgtttaacggcgagttagagttggattttattagtaaggtaggttcgggcggcggcggcgggcgttgaggggagcgggcggttggtcgagtagtttttcgggcgacggcggggttagcggtcgttttgttcgcggggagcgcggaacgggaagaaggggtcgagttcgtttatttgttagttttcgggacgtgcgggggttcgcggcgcgaggggtcgtttttatggttttcgtatttattttggttttttcgcgtcgttaatttagtttttcgttttttcgtttttcgtcgagatcgtaatttttcggttttgttacgtggaacgggggcgttcgatgttagttgcgtttcgcgcgttttttgttttcgtttagtgttttttttcgtttttcgggtttttatttgaggggattcggagatcgagagttttttttttttggatcgcgcgggatagtagaggggcgagggggttcgggtagggggtcgagacgtttatgaagataggtagtcggaggttagggtagggtggtcgtcgcgtttttttttagattcgggaaaggaaatagaaagtagtcgtttagttggggaggagtatgttcgagaatgtttatttttcgaggttattcgaaataaaatggaaagatggttaggt

SEQ ID NO: 17998 - DNA, 811 bp, Artificial Sequence
  chemically treated genomic DNA (Homo sapiens) CpG-island No: 17998
acctaaccatctttccattttatttcgaataacctcgaaaaataaacattctcgaacatactcctccccaactaaacgactactttctatttcctttcccgaatctaaaaaaaaacgcgacgaccaccctaccctaacctccgactacctatcttcataaacgtctcgaccccctacccgaaccccctcgcccctctactatcccgcgcgatccaaaaaaaaaaaactctcgatctccgaatcccctcaaataaaaacccgaaaaacgaaaaaaaacactaaacgaaaacaaaaaacgcgcgaaacgcaactaacatcgaacgcccccgttccacgtaacaaaaccgaaaaattacgatctcgacgaaaaacgaaaaaacgaaaaactaaattaacgacgcgaaaaaaccaaaataaatacgaaaaccataaaaacgacccctcgcgccgcgaacccccgcacgtcccgaaaactaacaaataaacgaactcgaccccttcttcccgttccgcgctccccgcgaacaaaacgaccgctaaccccgccgtcgcccgaaaaactactcgaccaaccgcccgctcccctcaacgcccgccgccgccgcccgaacctaccttactaataaaatccaactctaactcgccgttaaacgcctcgccgtcctcgctacaatccgaatcaaaaccgccgtaaaatcgaacgacgaccgccgcgaccctaaccgcccccgaaaaactaaactcgaaaacgaacataaaaaccgaaaccgacgaatccatcgcgaaacgactacgctccgtcgccatcttt

SEQ ID NO: 17999 - DNA, 811 bp, Artificial Sequence
  chemically treated genomic DNA (Homo sapiens) CpG-island No: 17999
gtttgattatttttttattttgtttcgggtggtttcgaaaagtagatattttcggatatgtttttttttagttgagcgattattttttgttttttttttcgagtttgggaagagacgcggcggttattttgttttggttttcgattatttgtttttatgagcgtttcggttttttgttcgggttttttcgtttttttgttgtttcgcgcggtttagggagaggagattttcggttttcgaatttttttaagtggggattcgaagaacggggaggggtattgagcggggatagggaacgcgcggagcgtagttggtatcgggcgttttcgttttacgtggtagagtcgaggggttacgatttcggcgggagacgggagggcgggaggttgggttggcgacgcgggggagttaaggtgggtgcggggattatggggacggtttttcgcgtcgcgaattttcgtacgtttcggagattagtaggtgggcgggttcggtttttttttttcgtttcgcgtttttcgcggatagggcggtcgttggtttcgtcgtcgttcgggagattgttcggttagtcgttcgttttttttagcgttcgtcgtcgtcgttcgggtttattttgttggtgaggtttagttttggttcgtcgttgagcgtttcgtcgttttcgttgtagttcgagttaaagtcgtcgtggagtcgggcggcggtcgtcgcggttttggtcgttttcggggagttgggttcgggggcgaatatagaggtcgggatcggcgagtttatcgcggagcgattgcgtttcgtcgttattttt

SEQ ID NO: 18000 - DNA, 811 bp, Artificial Sequence
  chemically treated genomic DNA (Homo sapiens) CpG-island No: 18000
aaaaataacgacgaaacgcaatcgctccgcgataaactcgccgatcccgacctctatattcgcccccgaacccaactccccgaaaacgaccaaaaccgcgacgaccgccgcccgactccacgacgactttaactcgaactacaacgaaaacgacgaaacgctcaacgacgaaccaaaactaaacctcaccaacaaaataaacccgaacgacgacgacgaacgctaaaaaaaacgaacgactaaccgaacaatctcccgaacgacgacgaaaccaacgaccgccctatccgcgaaaaacgcgaaacgaaaaaaaaaaaccgaacccgcccacctactaatctccgaaacgtacgaaaattcgcgacgcgaaaaaccgtccccataatccccgcacccaccttaactcccccgcgtcgccaacccaacctcccgccctcccgtctcccgccgaaatcgtaacccctcgactctaccacgtaaaacgaaaacgcccgataccaactacgctccgcgcgttccctatccccgctcaatacccctccccgttcttcgaatccccacttaaaaaaattcgaaaaccgaaaatctcctctccctaaaccgcgcgaaacaacaaaaaaacgaaaaaacccgaacaaaaaaccgaaacgctcataaaaacaaataatcgaaaaccaaaacaaaataaccgccgcgtctcttcccaaactcgaaaaaaaaaacaaaaaataatcgctcaactaaaaaaaaacatatccgaaaatatctacttttcgaaaccacccgaaacaaaataaaaaaataatcaaac

SEQ ID NO: 18001 - DNA, 812 bp, Artificial Sequence
  chemically treated genomic DNA (Homo sapiens) CpG-island No: 18001
ttcgggaagtttcgttcgtagatatcgttttttcggttgattagtggcgcggtaggcggggcgggggttaggaggtgagttagggcgcgggtcgcggattcgggtggaggttggattcggtttagtacgtttcggagaggaggaagtaggtttggcggcgcggtttcgttcgagtggttcgacggtgattcggggttaggtcgggtcgcggttttttaatttttttttgagttcgttcgtatttatttgttgtcgcggcggtttttagttcggtcgggggcgttcgaggttaggtcgtcgtcggggcgcgtttttttttcgcgtggggatttcgcgggcggcgtttcgtttagggcgatatagcggtcgggttcggggcgcgcgggtacgcgaagagcggcgacgcgggataaggcgggcgggcggataatgcggtcggcggaggttcgcgttgcgcgagtggggtcgggcggcgcgcgtgtggtcgattttgtatgtgtgcgtttgttagttaacgttgataggtcgtagtttattggttaggtttcgtcggtcgttatcgtttatcgtcgttatttattggtcggtttgaatataaagtttcggttcgtttcgttttcgcgtgggtttcgttgttttgcgcgtttagtttaggagttcgcgcgtgggaggcgttgggcgggcggggatttcgggttgcgggaggacgcgacgggagtttgtgttggggttcgggtttagtagggtattggattttcgatttggcggtttagaatatttgagatagttttgagcgtttttacgcgcgtttg

SEQ ID NO: 18002 - DNA, 812 bp, Artificial Sequence
  chemically treated genomic DNA (Homo sapiens) CpG-island No: 18002
caaacgcgcgtaaaaacgctcaaaactatctcaaatattctaaaccgccaaatcgaaaatccaataccctactaaacccgaaccccaacacaaactcccgtcgcgtcctcccgcaacccgaaatccccgcccgcccaacgcctcccacgcgcgaactcctaaactaaacgcgcaaaacaacgaaacccacgcgaaaacgaaacgaaccgaaactttatattcaaaccgaccaataaataacgacgataaacgataacgaccgacgaaacctaaccaataaactacgacctatcaacgttaactaacaaacgcacacatacaaaatcgaccacacgcgcgccgcccgaccccactcgcgcaacgcgaacctccgccgaccgcattatccgcccgcccgccttatcccgcgtcgccgctcttcgcgtacccgcgcgccccgaacccgaccgctatatcgccctaaacgaaacgccgcccgcgaaatccccacgcgaaaaaaaaacgcgccccgacgacgacctaacctcgaacgcccccgaccgaactaaaaaccgccgcgacaacaaataaatacgaacgaactcaaaaaaaaattaaaaaaccgcgacccgacctaaccccgaatcaccgtcgaaccactcgaacgaaaccgcgccgccaaacctacttcctcctctccgaaacgtactaaaccgaatccaacctccacccgaatccgcgacccgcgccctaactcacctcctaacccccgccccgcctaccgcgccactaatcaaccgaaaaaacgatatctacgaacgaaacttcccgaa

SEQ ID NO: 18003 - DNA, 812 bp, Artificial Sequence
  chemically treated genomic DNA (Homo sapiens) CpG-island No: 18003
taggcgcgcgtgggagcgtttagagttgttttaggtgttttgagtcgttagatcgggagtttagtgttttgttgagttcgagttttagtataggttttcgtcgcgttttttcgtagttcggggttttcgttcgtttagcgttttttacgcgcggatttttaggttgagcgcgtagggtagcggggtttacgcgagggcggggcgagtcggggttttgtgtttaaatcggttaatgggtggcggcggtgggcggtgacggtcggcggggtttgattaatgggttgcggtttgttagcgttgattgataggcgtatatatatagagtcggttatacgcgcgtcgttcggttttattcgcgtagcgcgggttttcgtcggtcgtattgttcgttcgttcgttttgtttcgcgtcgtcgtttttcgcgtgttcgcgcgtttcgggttcggtcgttgtgtcgttttgagcggagcgtcgttcgcgggatttttacgcggaaagggggcgcgtttcggcggcggtttggtttcggacgttttcggtcgggttagaagtcgtcgcggtagtaggtgagtgcgggcgagtttaggagagggttggggggtcgcggttcggtttgatttcgggttatcgtcgggttattcgggcggggtcgcgtcgttaggtttgttttttttttttcgggacgtgttgggtcggatttagtttttattcgggttcgcggttcgcgttttgatttattttttggttttcgtttcgtttgtcgcgttattggttagtcgggagggcggtgtttgcgggcgggatttttcggg

SEQ ID NO: 18004 - DNA, 812 bp, Artificial Sequence
  chemically treated genomic DNA (Homo sapiens) CpG-island No: 18004
cccgaaaaatcccgcccgcaaacaccgccctcccgactaaccaataacgcgacaaacgaaacgaaaaccaaaaaataaatcaaaacgcgaaccgcgaacccgaataaaaactaaatccgacccaacacgtcccgaaaaaaaaaaaacaaacctaacgacgcgaccccgcccgaataacccgacgataacccgaaatcaaaccgaaccgcgaccccccaaccctctcctaaactcgcccgcactcacctactaccgcgacgacttctaacccgaccgaaaacgtccgaaaccaaaccgccgccgaaacgcgccccctttccgcgtaaaaatcccgcgaacgacgctccgctcaaaacgacacaacgaccgaacccgaaacgcgcgaacacgcgaaaaacgacgacgcgaaacaaaacgaacgaacgaacaatacgaccgacgaaaacccgcgctacgcgaataaaaccgaacgacgcgcgtataaccgactctatatatatacgcctatcaatcaacgctaacaaaccgcaacccattaatcaaaccccgccgaccgtcaccgcccaccgccgccacccattaaccgatttaaacacaaaaccccgactcgccccgccctcgcgtaaaccccgctaccctacgcgctcaacctaaaaatccgcgcgtaaaaaacgctaaacgaacgaaaaccccgaactacgaaaaaacgcgacgaaaacctatactaaaactcgaactcaacaaaacactaaactcccgatctaacgactcaaaacacctaaaacaactctaaacgctcccacgcgcgccta

SEQ ID NO: 18005 - DNA, 643 bp, Artificial Sequence
  chemically treated genomic DNA (Homo sapiens) CpG-island No: 18005
cgttttacggtagcgggtttcgttttcgtgcgttatcgagggcgggaaggaggcgtgcggtacgagttagttagttcgcgttattatttttggttttgcgttttgttattggtcgagagtcgggcggcgcggcgcggtcgtaaggcgtggtcgggtgtcgtgaggcgggttttcgggttggttcgtcgtcggttgtcggggggttggtcggggtgttattggttttgggaagcggtagtagaggtagggattattcggggtttggtgtcggtatagttatggcgggcgcgttggtgcggaaagcggcggattatgttcgaagtaaggattttcgggattattttatgaggtgacgagcgtcgtaggtcgaatttcgtaattcggaggggttttcgggaggttgcgattcgtgtagttcgcgacgagggcggtcgcgaggacgcggtggtttcgggtagcgggtgggtcggggtttaggcgagagggtgcgtttgttaggggggttttattcggatttttttcggatcgttatatttcgaagcggacggcgtagagagtcggtgatagtgggcgttttttagggcgggggtgatagtgggcgttttttagggcgggggtgatagtgggtgttttttttcggtag

SEQ ID NO: 18006 - DNA, 643 bp, Artificial Sequence
  chemically treated genomic DNA (Homo sapiens) CpG-island No: 18006
ctaccgaaaaaaaacacccactatcacccccgccctaaaaaacgcccactatcacccccgccctaaaaaacgcccactatcaccgactctctacgccgtccgcttcgaaatataacgatccgaaaaaaatccgaataaaacccccctaacaaacgcaccctctcgcctaaaccccgacccacccgctacccgaaaccaccgcgtcctcgcgaccgccctcgtcgcgaactacacgaatcgcaacctcccgaaaacccctccgaattacgaaattcgacctacgacgctcgtcacctcataaaataatcccgaaaatccttacttcgaacataatccgccgctttccgcaccaacgcgcccgccataactataccgacaccaaaccccgaataatccctacctctactaccgcttcccaaaaccaataacaccccgaccaaccccccgacaaccgacgacgaaccaacccgaaaacccgcctcacgacacccgaccacgccttacgaccgcgccgcgccgcccgactctcgaccaataacaaaacgcaaaaccaaaaataataacgcgaactaactaactcgtaccgcacgcctccttcccgccctcgataacgcacgaaaacgaaacccgctaccgtaaaacg

SEQ ID NO: 18007 - DNA, 643 bp, Artificial Sequence
  chemically treated genomic DNA (Homo sapiens) CpG-island No: 18007
ttgtcgggagaggatatttattgttattttcgttttgaggggcgtttattgttattttcgttttgaaaggcgtttattgttatcggttttttacgtcgttcgtttcggggtgtggcggttcgggagggattcgggtggggtttttttgataagcgtattttttcgtttgggtttcggtttattcgttgttcggggttatcgcgttttcgcggtcgttttcgtcgcggattgtacgggtcgtagtttttcgggagttttttcgggttgcggggttcggtttgcggcgttcgttattttatgaggtagtttcggaaatttttgtttcggatatagttcgtcgtttttcgtattaacgcgttcgttatggttgtgtcgatattagatttcgagtggtttttgtttttgttgtcgttttttagagttaatgatatttcggttaatttttcggtagtcgacggcgagttagttcgaaggttcgttttacgatattcggttacgttttacggtcgcgtcgcgtcgttcggttttcggttaatgatagggcgtagggttagagatggtggcgcggattggttggttcgtgtcgtacgtttttttttcgttttcggtggcgtacgggggcggggttcgttgtcgtaaaacg

SEQ ID NO: 18008 - DNA, 643 bp, Artificial Sequence
  chemically treated genomic DNA (Homo sapiens) CpG-island No: 18008
cgttttacgacaacgaaccccgcccccgtacgccaccgaaaacgaaaaaaaaacgtacgacacgaaccaaccaatccgcgccaccatctctaaccctacgccctatcattaaccgaaaaccgaacgacgcgacgcgaccgtaaaacgtaaccgaatatcgtaaaacgaaccttcgaactaactcgccgtcgactaccgaaaaattaaccgaaatatcattaactctaaaaaacgacaacaaaaacaaaaaccactcgaaatctaatatcgacacaaccataacgaacgcgttaatacgaaaaacgacgaactatatccgaaacaaaaatttccgaaactacctcataaaataacgaacgccgcaaaccgaaccccgcaacccgaaaaaactcccgaaaaactacgacccgtacaatccgcgacgaaaacgaccgcgaaaacgcgataaccccgaacaacgaataaaccgaaacccaaacgaaaaaatacgcttatcaaaaaaaccccacccgaatccctcccgaaccgccacaccccgaaacgaacgacgtaaaaaaccgataacaataaacgcctttcaaaacgaaaataacaataaacgcccctcaaaacgaaaataacaataaatatcctctcccgacaa

SEQ ID NO: 18009 - DNA, 557 bp, Artificial Sequence
  chemically treated genomic DNA (Homo sapiens) CpG-island No: 18009
acgtttatcgtttgtgttatttaatttttataaggacgtttattcgtggttttatgattttacggtttcgtaaattttcgttatttttttcgtttttttttttttcgattaaaattattattattttattttttcgtttattttattgtcgatagtttgaaattttaggggcggatgataatagttagtgtgaacgaagcgttatttttcgggttagtcgagtattttcgttttttatagttttttgggaacgtgaagttaaagtaatgcgtacgcgtagtggttttgaaggcggggtaataaagtttgtggtcgatgtggcgtttttcggttcgcgttttagtggttatgatagtgttcgttttaaggggagaaggaatgtgtgattatttttaacggtaagtcgtataaaaggttcggggaggcgtatttgggcggcgagaggcgagagaatttcgcgcgggttttttagtgtttaggtttttgtcggtttcgaagtcgaaatttttttttttatttcgtttttttgtagtggacgtggggtgtttttatttttt

SEQ ID NO: 18010 - DNA, 557 bp, Artificial Sequence
  chemically treated genomic DNA (Homo sapiens) CpG-island No: 18010
aaaaaataaaaacaccccacgtccactacaaaaaaacgaaataaaaaaaaaaatttcgacttcgaaaccgacaaaaacctaaacactaaaaaacccgcgcgaaattctctcgcctctcgccgcccaaatacgcctccccgaaccttttatacgacttaccgttaaaaataatcacacattccttctccccttaaaacgaacactatcataaccactaaaacgcgaaccgaaaaacgccacatcgaccacaaactttattaccccgccttcaaaaccactacgcgtacgcattactttaacttcacgttcccaaaaaactataaaaaacgaaaatactcgactaacccgaaaaataacgcttcgttcacactaactattatcatccgcccctaaaatttcaaactatcgacaataaaataaacgaaaaaataaaataataataattttaatcgaaaaaaaaaaaaacgaaaaaaataacgaaaatttacgaaaccgtaaaatcataaaaccacgaataaacgtccttataaaaattaaataacacaaacgataaacgt

SEQ ID NO: 18011 - DNA, 557 bp, Artificial Sequence
  chemically treated genomic DNA (Homo sapiens) CpG-island No: 18011
gaggggtgggaatattttacgtttattgtaagagaacgaagtggaagaagggatttcggtttcggagtcggtaggggtttgggtattggaaagttcgcgcggagttttttcgtttttcgtcgtttaggtacgttttttcggattttttgtacgatttatcgttggaaatggttatatattttttttttttttagagcgaatattgttataattattgaagcgcgggtcgaggagcgttatatcggttataggttttgttgtttcgtttttaaagttattgcgcgtgcgtattgttttgattttacgtttttagggggttgtgggaagcggaaatgttcggttgattcggagggtggcgtttcgtttatattggttgttgttattcgtttttgaggttttaggttgtcggtagtgaagtaagcgggagggtgaggtggtgatggttttgatcgggggaaggggggacgggaggaatgacgggagtttacggggtcgtggggttatggggttacgggtgagcgtttttgtggggattgagtgatataggcggtgggcgt

SEQ ID NO: 18012 - DNA, 557 bp, Artificial Sequence
  chemically treated genomic DNA (Homo sapiens) CpG-island No: 18012
acgcccaccgcctatatcactcaatccccacaaaaacgctcacccgtaaccccataaccccacgaccccgtaaactcccgtcattcctcccgtccccccttcccccgatcaaaaccatcaccacctcaccctcccgcttacttcactaccgacaacctaaaacctcaaaaacgaataacaacaaccaatataaacgaaacgccaccctccgaatcaaccgaacatttccgcttcccacaaccccctaaaaacgtaaaatcaaaacaatacgcacgcgcaataactttaaaaacgaaacaacaaaacctataaccgatataacgctcctcgacccgcgcttcaataattataacaatattcgctctaaaaaaaaaaaaaatatataaccatttccaacgataaatcgtacaaaaaatccgaaaaaacgtacctaaacgacgaaaaacgaaaaaactccgcgcgaactttccaatacccaaacccctaccgactccgaaaccgaaatcccttcttccacttcgttctcttacaataaacgtaaaatattcccacccctc

SEQ ID NO: 18013 - DNA, 1791 bp, Artificial Sequence
  chemically treated genomic DNA (Homo sapiens) CpG-island No: 18013
aggcggggcgggcggttgttaagtcggttaataggcggtttttcggttgttaagtcgagagggtaggggcgtcgttagtagtattatcgttttttaagtttttttttgtggatgcgcggtttcgcggttttgtttttttcggcgtagaggggtcgggagaggttataggagcggatttggtacgggatttttgaggaacgggagaagattggcgttcgattcgttttggagggtcggtgaacgatgaagggtcggcggcggcgacgtcgagagtattgtaagttcgcgttgttgttggtgttgtatacgttggtgttgttgttcgtttttttcgtattggacggcggtcgcgacggggataagggcgtcgagtattgtttcggtttgtagcgtagtttgggagtgtggagtttggaggcggcggcggtcggcgaacgcgagtagggagcggaggcgcgggtcgtcgaggaagggggcgcgaattagttttttcggtttttaagtaattttagcggcgttgtcggggaggtagtgtttcgcgagaagtagtatatttacgtgtatgttatttggcgtatcggttcgttttttttgggcgaattttttaattagtattcggacgttttttatttgtatgagtttatgtggtatttatggtaggcgttgtattcgggcgacgtcgagagtttgtagggcgcgttgcgcgatatgttgcgttcgttttttcgttgcgattttttcgtgttgcggttgtacgcgtcgtcgggggatttcgttgcgcgcgtttcggatacggttaattttattacggtcgttttttttcgttggcggattaataaggttatttgttcgtcgttattgtgttttggcgtatttcgtgttcgggtcgaggtgggtttcgtcgaggatatcgtttgcgagcgtagttgtttattcgtggcgatacgcgttttggaggtcgagtgtcgaaagtattcggtggtggttattaaggacgtgcgtttgttcgatttgggcgtgttggtgtttttgttgcgtgatttaggttttaatttgaaggtggtgtagttttttcgcgattcgagggcggtgtataattcgcgttttaagtttaggtagggattgttgcgcgagagtatttaggtgttgcgtattcgttagaggggcgatcgtttttatcgtgtgttgttggcgtacggcgtgggtgttcgtttcgggggttagtttcgcgcgttgttcgtcgcgtcgcgcgtcgatttttttttgatcggtgcgttcgaggtgatttgcgaagtttggttgcgcgatttgtttttcgcgcgcggcgcgttcgtttggttgcggcgtcgttatttgaggttgcgttatgaggatttggtgcggtagttacgcgtttagttgcgtcgtttgttgcgttttttcgggttacgcgcgttcgtagcgttcgatgttttcgcgtttaatatgattcgcggcgcggtttacggcgtcgatcggtttttttatttgttagcgcgcgacgttcgggaggcggtgtacgtttggcgcgagcgtttgagtcgagagtaggtgcgttaggtggaggtcgtttgcgttttagttatgcgtttgttcgtttattttcgtagcggagaggagggcgacgcggagtagtttagggaaggggagacgtcgttggagatggatgtcgacggcgttacgtagttttttatttttgttttcggtacggattcgggtaaggtggttcggggtaaggtagggatcgggattggtttttcgggagtttggaat

SEQ ID NO: 18014 - DNA, 1791 bp, Artificial Sequence
  chemically treated genomic DNA (Homo sapiens) CpG-island No: 18014
attccaaactcccgaaaaaccaatcccgatccctaccttaccccgaaccaccttacccgaatccgtaccgaaaacaaaaataaaaaactacgtaacgccgtcgacatccatctccaacgacgtctccccttccctaaactactccgcgtcgccctcctctccgctacgaaaataaacgaacaaacgcataactaaaacgcaaacgacctccacctaacgcacctactctcgactcaaacgctcgcgccaaacgtacaccgcctcccgaacgtcgcgcgctaacaaataaaaaaaccgatcgacgccgtaaaccgcgccgcgaatcatattaaacgcgaaaacatcgaacgctacgaacgcgcgtaacccgaaaaaacgcaacaaacgacgcaactaaacgcgtaactaccgcaccaaatcctcataacgcaacctcaaataacgacgccgcaaccaaacgaacgcgccgcgcgcgaaaaacaaatcgcgcaaccaaacttcgcaaatcacctcgaacgcaccgatcaaaaaaaaatcgacgcgcgacgcgacgaacaacgcgcgaaactaacccccgaaacgaacacccacgccgtacgccaacaacacacgataaaaacgatcgcccctctaacgaatacgcaacacctaaatactctcgcgcaacaatccctacctaaacttaaaacgcgaattatacaccgccctcgaatcgcgaaaaaactacaccaccttcaaattaaaacctaaatcacgcaacaaaaacaccaacacgcccaaatcgaacaaacgcacgtccttaataaccaccaccgaatactttcgacactcgacctccaaaacgcgtatcgccacgaataaacaactacgctcgcaaacgatatcctcgacgaaacccacctcgacccgaacacgaaatacgccaaaacacaataacgacgaacaaataaccttattaatccgccaacgaaaaaaaacgaccgtaataaaattaaccgtatccgaaacgcgcgcaacgaaatcccccgacgacgcgtacaaccgcaacacgaaaaaatcgcaacgaaaaaacgaacgcaacatatcgcgcaacgcgccctacaaactctcgacgtcgcccgaatacaacgcctaccataaataccacataaactcatacaaataaaaaacgtccgaatactaattaaaaaattcgcccaaaaaaaacgaaccgatacgccaaataacatacacgtaaatatactacttctcgcgaaacactacctccccgacaacgccgctaaaattacttaaaaaccgaaaaaactaattcgcgcccccttcctcgacgacccgcgcctccgctccctactcgcgttcgccgaccgccgccgcctccaaactccacactcccaaactacgctacaaaccgaaacaatactcgacgcccttatccccgtcgcgaccgccgtccaatacgaaaaaaacgaacaacaacaccaacgtatacaacaccaacaacaacgcgaacttacaatactctcgacgtcgccgccgccgacccttcatcgttcaccgaccctccaaaacgaatcgaacgccaatcttctcccgttcctcaaaaatcccgtaccaaatccgctcctataacctctcccgacccctctacgccgaaaaaaacaaaaccgcgaaaccgcgcatccacaaaaaaaaacttaaaaaacgataatactactaacgacgcccctaccctctcgacttaacaaccgaaaaaccgcctattaaccgacttaacaaccgcccgccccgcct

SEQ ID NO: 18015 - DNA, 1791 bp, Artificial Sequence
  chemically treated genomic DNA (Homo sapiens) CpG-island No: 18015
attttaggttttcggaagattagtttcggtttttgttttgtttcgggttattttattcggattcgtgtcggggatagggatgggaggttacgtggcgtcgtcggtatttatttttagcggcgtttttttttttttgggttgtttcgcgtcgttttttttttcgttgcgagggtaggcgagtagacgtatggttggagcgtaggcggtttttatttggcgtatttgttttcggtttaggcgttcgcgttaggcgtgtatcgtttttcgggcgtcgcgcgttgataggtggaagggtcggtcggcgtcgtaggtcgcgtcgcgagttatgttgagcgcgaaggtatcgagcgttgcgagcgcgcgtagttcggagaagcgtagtaggcggcgtagttgggcgcgtggttgtcgtattaggtttttatagcgtagttttaggtagcggcgtcgtagttaggcgggcgcgtcgcgcgcgaaaagtagatcgcgtagttaggtttcgtagattatttcgagcgtatcggttaggaagaaatcggcgcgcggcgcggcgggtagcgcgcgagattggttttcggggcgagtatttacgtcgtgcgttagtagtatacggtggaagcggtcgtttttttggcgggtgcgtagtatttggatgttttcgcgtagtagtttttgtttagatttgaggcgcgagttgtgtatcgttttcgggtcgcggaaaagttgtattatttttaggttgaggtttggattacgtaataggggtattagtacgtttagatcgagtaggcgtacgtttttgatgattattatcgggtattttcggtattcggtttttagggcgcgtatcgttacgggtgggtagttgcgttcgtaggcggtgttttcgacgaggtttatttcggttcgggtacggggtgcgttaggatatagtggcggcgagtagatgattttgttagttcgttagcggaagagggcggtcgtggtaagattggtcgtgttcggggcgcgcgtagcggggtttttcggcggcgcgtatagtcgtagtacggagaagtcgtagcggaagagcgaacgtagtatgtcgcgtagcgcgttttgtaagttttcggcgtcgttcggatatagcgtttgttatagatgttatatgggtttatataagtagaaaacgttcgggtgttggttaaagagttcgtttaggaaggacgagtcggtgcgttaggtggtatgtacgtagatgtgttgtttttcgcgagatattgttttttcgatagcgtcgttgaggttgtttgggaatcgaggagattggttcgcgttttttttttcggcggttcgcgttttcgttttttgttcgcgttcgtcggtcgtcgtcgtttttaggttttatatttttaggttgcgttgtaggtcggggtagtgttcggcgtttttgttttcgtcgcggtcgtcgtttaatacggaggggacgagtaatagtattagcgtgtatagtattaatagtagcgcgaatttgtagtattttcggcgtcgtcgtcgtcggttttttatcgtttatcgattttttagagcgggtcgggcgttagttttttttcgttttttagaaatttcgtgttaggttcgtttttgtggtttttttcggtttttttgcgtcgggaggagtagagtcgcggggtcgcgtatttataaggggaaatttggaaggcggtggtgttattgacggcgtttttgttttttcggtttagtagtcggagagtcgtttattggtcggtttggtagtcgttcgtttcgttt

SEQ ID NO: 18016 - DNA, 1791 bp, Artificial Sequence
  chemically treated genomic DNA (Homo sapiens) CpG-island No: 18016
aaacgaaacgaacgactaccaaaccgaccaataaacgactctccgactactaaaccgaaaaaacaaaaacgccgtcaataacaccaccgccttccaaatttccccttataaatacgcgaccccgcgactctactcctcccgacgcaaaaaaaccgaaaaaaaccacaaaaacgaacctaacacgaaatttctaaaaaacgaaaaaaaactaacgcccgacccgctctaaaaaatcgataaacgataaaaaaccgacgacgacgacgccgaaaatactacaaattcgcgctactattaatactatacacgctaatactattactcgtcccctccgtattaaacgacgaccgcgacgaaaacaaaaacgccgaacactaccccgacctacaacgcaacctaaaaatataaaacctaaaaacgacgacgaccgacgaacgcgaacaaaaaacgaaaacgcgaaccgccgaaaaaaaaaacgcgaaccaatctcctcgattcccaaacaacctcaacgacgctatcgaaaaaacaatatctcgcgaaaaacaacacatctacgtacataccacctaacgcaccgactcgtccttcctaaacgaactctttaaccaacacccgaacgttttctacttatataaacccatataacatctataacaaacgctatatccgaacgacgccgaaaacttacaaaacgcgctacgcgacatactacgttcgctcttccgctacgacttctccgtactacgactatacgcgccgccgaaaaaccccgctacgcgcgccccgaacacgaccaatcttaccacgaccgccctcttccgctaacgaactaacaaaatcatctactcgccgccactatatcctaacgcaccccgtacccgaaccgaaataaacctcgtcgaaaacaccgcctacgaacgcaactacccacccgtaacgatacgcgccctaaaaaccgaataccgaaaatacccgataataatcatcaaaaacgtacgcctactcgatctaaacgtactaatacccctattacgtaatccaaacctcaacctaaaaataatacaacttttccgcgacccgaaaacgatacacaactcgcgcctcaaatctaaacaaaaactactacgcgaaaacatccaaatactacgcacccgccaaaaaaacgaccgcttccaccgtatactactaacgcacgacgtaaatactcgccccgaaaaccaatctcgcgcgctacccgccgcgccgcgcgccgatttcttcctaaccgatacgctcgaaataatctacgaaacctaactacgcgatctacttttcgcgcgcgacgcgcccgcctaactacgacgccgctacctaaaactacgctataaaaacctaatacgacaaccacgcgcccaactacgccgcctactacgcttctccgaactacgcgcgctcgcaacgctcgataccttcgcgctcaacataactcgcgacgcgacctacgacgccgaccgacccttccacctatcaacgcgcgacgcccgaaaaacgatacacgcctaacgcgaacgcctaaaccgaaaacaaatacgccaaataaaaaccgcctacgctccaaccatacgtctactcgcctaccctcgcaacgaaaaaaaaaacgacgcgaaacaacccaaaaaaaaaaaaacgccgctaaaaataaataccgacgacgccacgtaacctcccatccctatccccgacacgaatccgaataaaataacccgaaacaaaacaaaaaccgaaactaatcttccgaaaacctaaaat

SEQ ID NO: 18017 - DNA, 882 bp, Artificial Sequence
  chemically treated genomic DNA (Homo sapiens) CpG-island No: 18017
gttgtatacgtttgattcggttatttgtttattcgattattaagcgaaatatcgtatcgagcgagtacgtattcggatggaagtcggttttgtcgattaggatgatttggacgaagagtattaggggttcgcgttagtcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatcgtcgttttcgaattttaatttaaagttaataaaagtttgtatgacgatagttttatattagaatattttcgttcgaaatgatcgattatgcgacgtttaatttgttattacgagatttcgattttatcgtcgttttttatgaaaggttgggtttcggaatcgtttttcgggacgtcggttggatgattttttagcgcggggattttatgttggagtttttcgtttaatttaggttcgattttttcgcgagttggtttatttgttgtttgaggttggacgatttcgcggagttttatcggtagtgtaaattcgtcggtatttaggaaattagtagcggttattcgcgtatttatgttttcgaattgtaggagtggggaggtacgatggtcgttttggtcggattaattcgcgcgatcgatcgattcgggtaacgttgttgttattgttgtaggggggggggggggggggggggggggggatttttattgtttattttacggataaaaata

SEQ ID NO: 18018 - DNA, 882 bp, Artificial Sequence
  chemically treated genomic DNA (Homo sapiens) CpG-island No: 18018
tatttttatccgtaaaataaacaataaaaatcccccccccccccccccccccccccccctacaacaataacaacaacgttacccgaatcgatcgatcgcgcgaattaatccgaccaaaacgaccatcgtacctccccactcctacaattcgaaaacataaatacgcgaataaccgctactaatttcctaaataccgacgaatttacactaccgataaaactccgcgaaatcgtccaacctcaaacaacaaataaaccaactcgcgaaaaaatcgaacctaaattaaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcataatcgatcatttcgaacgaaaatattctaatataaaactatcgtcatacaaacttttattaactttaaattaaaattcgaaaacgacgataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgactaacgcgaacccctaatactcttcgtccaaatcatcctaatcgacaaaaccgacttccatccgaatacgtactcgctcgatacgatatttcgcttaataatcgaataaacaaataaccgaatcaaacgtatacaac

SEQ ID NO: 18019 - DNA, 882 bp, Artificial Sequence
  chemically treated genomic DNA (Homo sapiens) CpG-island No: 18019
tgtttttgttcgtggaatgaataatggaagttttttttttttttttttttttttttttttgtagtaatggtaataacgttgttcggatcgatcggtcgcgcgaattgattcgattaaagcggttatcgtgtttttttatttttgtagttcgggggtatggatgcgcggatagtcgttgttggttttttggatgtcgacggatttgtattgtcggtagaatttcgcgaggtcgtttagttttaggtagtagatgaattaattcgcgaggggatcgagtttgggttgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtatggtcggttatttcgaacgggggtgttttggtgtggagttgtcgttatgtaggtttttgttggttttgggttggggttcgggagcggcgatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggttggcgcgagtttttgatgtttttcgtttagattattttgatcgataagatcggtttttattcgagtacgtgttcgttcgatgcgatgtttcgtttggtggtcgaatgggtaggtagtcggattaagcgtatgtagt

SEQ ID NO: 18020 - DNA, 882 bp, Artificial Sequence
  chemically treated genomic DNA (Homo sapiens) CpG-island No: 18020
actacatacgcttaatccgactacctacccattcgaccaccaaacgaaacatcgcatcgaacgaacacgtactcgaataaaaaccgatcttatcgatcaaaataatctaaacgaaaaacatcaaaaactcgcgccaaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatatcgccgctcccgaaccccaacccaaaaccaacaaaaacctacataacgacaactccacaccaaaacacccccgttcgaaataaccgaccatacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaacccaaactcgatcccctcgcgaattaattcatctactacctaaaactaaacgacctcgcgaaattctaccgacaatacaaatccgtcgacatccaaaaaaccaacaacgactatccgcgcatccatacccccgaactacaaaaataaaaaaacacgataaccgctttaatcgaatcaattcgcgcgaccgatcgatccgaacaacgttattaccattactacaaaaaaaaaaaaaaaaaaaaaaaaaaaaaacttccattattcattccacgaacaaaaaca

SEQ ID NO: 18021 - DNA, 1027 bp, Artificial Sequence
  chemically treated genomic DNA (Homo sapiens) CpG-island No: 18021
cgttcggggtgcgagaggtcgttttcggggaggggcgggattcgggcggggcgggaggggcggggcgttcgggtttattaggtttcgcgtcggtagtcgggtcgtagatacgaagtttttcgggtggtttatagacgttgttagtatcgtcgtcgttaggtgagtgttttcgattttgttgtcgttcgttgtttcgtttagttcgagttcggcggttagcgtttaggtcgcggttcgggtgtcgagcggttggaagtgtggggagtcgtgtttaggttttatcgttttagtaagtcgttggcggggcgacgtttcgggatttcggtttcgaaacgtattttttttgttcggggttttaggttttcgacgggcgatcgtgttaggcgcggtttttgcgggttttagttttcgcgtttgtgtaatggggtggtttttttgcgtttcgtcgcgacggttggacgttttatcgtcgtcgtatagttttttagtgcggttttcgggtattcggtttcgaattttggggtcgtgcggattcggttagatcgtagcgcggtaacgttagtttacggtcgcggtcgtatagtttcggtgtttttaaaagagggaagatggcgtcgtgttcggtgtcgtcgggatcggttttcggaggcgttgcgtatttgaggaagggtcgaggaaaggtttcgtaacgggacgtttagaaagttcggaataggaacgtgtatacggagcggcgcgtagtcgttcgttttcgtttgtttacgcgttttgtataggtgcgttttagattgggcggggattagagttcggttggggtatgcgattttgtttggtaaattggaggtgcgtttttgcgggtgattcgcgagggggtttttcgtttgcggggcgcggttacgataaggtttgtggggttcggagttggtcgtcgtttgggttttggttttttaaatgcgatcgtttttaagttttttattgttaattttgttagaatgagttattcgtggggtaggacgtggttgttgat

SEQ ID NO: 18022 - DNA, 1027 bp, Artificial Sequence
  chemically treated genomic DNA (Homo sapiens) CpG-island No: 18022
atcaacaaccacgtcctaccccacgaataactcattctaacaaaattaacaataaaaaacttaaaaacgatcgcatttaaaaaaccaaaacccaaacgacgaccaactccgaaccccacaaaccttatcgtaaccgcgccccgcaaacgaaaaaccccctcgcgaatcacccgcaaaaacgcacctccaatttaccaaacaaaatcgcataccccaaccgaactctaatccccgcccaatctaaaacgcacctatacaaaacgcgtaaacaaacgaaaacgaacgactacgcgccgctccgtatacacgttcctattccgaactttctaaacgtcccgttacgaaacctttcctcgacccttcctcaaatacgcaacgcctccgaaaaccgatcccgacgacaccgaacacgacgccatcttccctcttttaaaaacaccgaaactatacgaccgcgaccgtaaactaacgttaccgcgctacgatctaaccgaatccgcacgaccccaaaattcgaaaccgaatacccgaaaaccgcactaaaaaactatacgacgacgataaaacgtccaaccgtcgcgacgaaacgcaaaaaaaccaccccattacacaaacgcgaaaactaaaacccgcaaaaaccgcgcctaacacgatcgcccgtcgaaaacctaaaaccccgaacaaaaaaaatacgtttcgaaaccgaaatcccgaaacgtcgccccgccaacgacttactaaaacgataaaacctaaacacgactccccacacttccaaccgctcgacacccgaaccgcgacctaaacgctaaccgccgaactcgaactaaacgaaacaacgaacgacaacaaaatcgaaaacactcacctaacgacgacgatactaacaacgtctataaaccacccgaaaaacttcgtatctacgacccgactaccgacgcgaaacctaataaacccgaacgccccgcccctcccgccccgcccgaatcccgcccctccccgaaaacgacctctcgcaccccgaacg

SEQ ID NO: 18023 - DNA, 1027 bp, Artificial Sequence
  chemically treated genomic DNA (Homo sapiens) CpG-island No: 18023
attaataattacgttttattttacgagtggtttattttagtaaaattgataatgaagggtttgaaagcgatcgtatttaggaggttagagtttagacgacgattagtttcgaattttataagttttgtcgtgatcgcgtttcgtaggcggggggttttttcgcgggttattcgtaggggcgtatttttaatttattaaataaggtcgtatgttttagtcgggttttagttttcgtttagtttggggcgtatttgtgtagggcgcgtgggtaagcgagggcgggcggttgcgcgtcgtttcgtgtgtacgtttttgtttcggattttttgggcgtttcgttacgaagttttttttcggtttttttttaggtgcgtagcgttttcgggagtcggtttcggcggtatcgggtacgacgttatttttttttttttaagggtatcggggttgtgcggtcgcggtcgtgggttggcgttgtcgcgttacggtttggtcgggttcgtacgattttagagttcggagtcgggtgttcggaagtcgtattggaggattgtgcggcggcgatggggcgtttagtcgtcgcggcgagacgtagagggattattttattgtataggcgcggagattgaggttcgtaggggtcgcgtttggtacgatcgttcgtcggggatttggagtttcggatagagagggtacgtttcggagtcggagtttcgagacgtcgtttcgttagcgatttgttggagcggtaaaatttgggtacggttttttatatttttagtcgttcggtattcgggtcgcggtttgggcgttaatcgtcgggttcgagttgggcggagtagcgggcggtagtagggtcgggggtatttatttggcggcggcgatgttggtagcgtttgtaagttattcgggaggtttcgtgtttgcggttcggttgtcggcgcgggatttaataggttcgggcgtttcgtttttttcgtttcgttcgggtttcgttttttttcgggagcggtttttcgtatttcgagcg

SEQ ID NO: 18024 - DNA, 1027 bp, Artificial Sequence
  chemically treated genomic DNA (Homo sapiens) CpG-island No: 18024
cgctcgaaatacgaaaaaccgctcccgaaaaaaaacgaaacccgaacgaaacgaaaaaaacgaaacgcccgaacctattaaatcccgcgccgacaaccgaaccgcaaacacgaaacctcccgaataacttacaaacgctaccaacatcgccgccgccaaataaatacccccgaccctactaccgcccgctactccgcccaactcgaacccgacgattaacgcccaaaccgcgacccgaataccgaacgactaaaaatataaaaaaccgtacccaaattttaccgctccaacaaatcgctaacgaaacgacgtctcgaaactccgactccgaaacgtaccctctctatccgaaactccaaatccccgacgaacgatcgtaccaaacgcgacccctacgaacctcaatctccgcgcctatacaataaaataatccctctacgtctcgccgcgacgactaaacgccccatcgccgccgcacaatcctccaatacgacttccgaacacccgactccgaactctaaaatcgtacgaacccgaccaaaccgtaacgcgacaacgccaacccacgaccgcgaccgcacaaccccgatacccttaaaaaaaaaaaaataacgtcgtacccgataccgccgaaaccgactcccgaaaacgctacgcacctaaaaaaaaaccgaaaaaaaacttcgtaacgaaacgcccaaaaaatccgaaacaaaaacgtacacacgaaacgacgcgcaaccgcccgccctcgcttacccacgcgccctacacaaatacgccccaaactaaacgaaaactaaaacccgactaaaacatacgaccttatttaataaattaaaaatacgcccctacgaataacccgcgaaaaaaccccccgcctacgaaacgcgatcacgacaaaacttataaaattcgaaactaatcgtcgtctaaactctaacctcctaaatacgatcgctttcaaacccttcattatcaattttactaaaataaaccactcgtaaaataaaacgtaattattaat

SEQ ID NO: 18025 - DNA, 589 bp, Artificial Sequence
  chemically treated genomic DNA (Homo sapiens) CpG-island No: 18025
gttacgaagatcgcgggttgatagtgtacggtgcggtttagggttttttgcggttcgtgtaggtttagttttagtaggtcgtagtttagtacgcggcgggcggcggcgtagagttcgcggacgcgcgggtagttgagtagatcgcggtttatgtttattatttggttgttttggttcgggaagagtagtacggagtattggttcggtattcgtcgtttcgtcgtcgtttagggcgttttttttttcgtttcggtcgtatttcgtagtagtttcgttatattttgggcgttcggcggaggtatcgggaagttcgaggcgtcgcggcggtagttggcgtttaagtttttgatttacgttattcgtgcgattcggacgtttatggtcggatatttgttcgcgcgcgttatcgtggcgatcgaggttcgattgcggcggcgcggcgtagcgtggtttttgacgtattttttgtcggggttttcggggtatcgggagcgggaagaaaggtttcgtagacgttggtttcgtttcggttttgaggtttttcgggttgcgttttggggttttggagggatttatgcgtttatttaaa

SEQ ID NO: 18026 - DNA, 589 bp, Artificial Sequence
  chemically treated genomic DNA (Homo sapiens) CpG-island No: 18026
tttaaataaacgcataaatccctccaaaaccccaaaacgcaacccgaaaaacctcaaaaccgaaacgaaaccaacgtctacgaaacctttcttcccgctcccgataccccgaaaaccccgacaaaaaatacgtcaaaaaccacgctacgccgcgccgccgcaatcgaacctcgatcgccacgataacgcgcgcgaacaaatatccgaccataaacgtccgaatcgcacgaataacgtaaatcaaaaacttaaacgccaactaccgccgcgacgcctcgaacttcccgatacctccgccgaacgcccaaaatataacgaaactactacgaaatacgaccgaaacgaaaaaaaaaacgccctaaacgacgacgaaacgacgaataccgaaccaatactccgtactactcttcccgaaccaaaacaaccaaataataaacataaaccgcgatctactcaactacccgcgcgtccgcgaactctacgccgccgcccgccgcgtactaaactacgacctactaaaactaaacctacacgaaccgcaaaaaaccctaaaccgcaccgtacactatcaacccgcgatcttcgtaac

SEQ ID NO: 18027 - DNA, 589 bp, Artificial Sequence
  chemically treated genomic DNA (Homo sapiens) CpG-island No: 18027
tttaagtaaacgtatgagtttttttaggattttagaacgtagttcgaagggttttagagtcggggcggaattagcgtttgcggaattttttttttcgttttcggtgtttcggaagtttcggtaggaaatgcgttagggattacgttgcgtcgcgtcgtcgtagtcgggtttcggtcgttacggtaacgcgcgcgggtaggtgttcgattatgagcgttcgggtcgtacgggtagcgtgggttaggggtttgggcgttagttatcgtcgcggcgtttcgagtttttcggtgttttcgtcgggcgtttagggtgtagcggagttgttgcgagatgcgatcggggcggaggaggaggcgttttgggcggcgacggagcggcgaatgtcgggttagtgtttcgtgttgtttttttcgggttagggtagttaggtggtgggtatgggtcgcggtttgtttaattattcgcgcgttcgcgaattttacgtcgtcgttcgtcgcgtgttgggttacgatttgttggaattgagtttgtacgggtcgtaggagattttggatcgtatcgtgtattgttagttcgcgattttcgtggt

SEQ ID NO: 18028 - DNA, 589 bp, Artificial Sequence
  chemically treated genomic DNA (Homo sapiens) CpG-island No: 18028
accacgaaaatcgcgaactaacaatacacgatacgatccaaaatctcctacgacccgtacaaactcaattccaacaaatcgtaacccaacacgcgacgaacgacgacgtaaaattcgcgaacgcgcgaataattaaacaaaccgcgacccatacccaccacctaactaccctaacccgaaaaaaacaacacgaaacactaacccgacattcgccgctccgtcgccgcccaaaacgcctcctcctccgccccgatcgcatctcgcaacaactccgctacaccctaaacgcccgacgaaaacaccgaaaaactcgaaacgccgcgacgataactaacgcccaaacccctaacccacgctacccgtacgacccgaacgctcataatcgaacacctacccgcgcgcgttaccgtaacgaccgaaacccgactacgacgacgcgacgcaacgtaatccctaacgcatttcctaccgaaacttccgaaacaccgaaaacgaaaaaaaaaattccgcaaacgctaattccgccccgactctaaaacccttcgaactacgttctaaaatcctaaaaaaactcatacgtttacttaaa

SEQ ID NO: 18029 - DNA, 589 bp, Artificial Sequence
  chemically treated genomic DNA (Homo sapiens) CpG-island No: 18029
acgcgtttcgtttagtgggcgggaacgattatagtttttagtatgattcgcggtcgtttatgttacgtttcgttacgcgtgcgtttaggcgtcgttgagcgttgattgggtgcgagtggggaagttgttaattcgattcggattggcgttgaggtggttcgtggggtaggtgagtgcggggcgggagttagcggagatttatcggcgtttataagttttttttaggcgggggttgcggggcggttgtggtcggattgttcgatcgagggtcgtatgggtcgaaggcgtttacgagagaagtatcgtttcgggtcggagagtcgtcgggtcgattttgttcgcgtcgtcgttggaatgggggtcggggacgcggcggggcggggaggtcggttgcgtttttcggtgcggtcgtttttagacggtcgaggttattttaggtgttcggggcgttagtcggaatttatcgcgttggtagtcgggagcggttttacgaaaatcgcgtttgaggcggggggttttttaaaaagagtttggttggttttggtatcgggatagttgtagatttttttttaggtttaatttgcggttt

SEQ ID NO: 18030 - DNA, 589 bp, Artificial Sequence
  chemically treated genomic DNA (Homo sapiens) CpG-island No: 18030
aaaccgcaaattaaacctaaaaaaaaatctacaactatcccgataccaaaaccaaccaaactctttttaaaaaaccccccgcctcaaacgcgattttcgtaaaaccgctcccgactaccaacgcgataaattccgactaacgccccgaacacctaaaataacctcgaccgtctaaaaacgaccgcaccgaaaaacgcaaccgacctccccgccccgccgcgtccccgacccccattccaacgacgacgcgaacaaaatcgacccgacgactctccgacccgaaacgatacttctctcgtaaacgccttcgacccatacgaccctcgatcgaacaatccgaccacaaccgccccgcaacccccgcctaaaaaaaacttataaacgccgataaatctccgctaactcccgccccgcactcacctaccccacgaaccacctcaacgccaatccgaatcgaattaacaacttccccactcgcacccaatcaacgctcaacgacgcctaaacgcacgcgtaacgaaacgtaacataaacgaccgcgaatcatactaaaaactataatcgttcccgcccactaaacgaaacgcgt

SEQ ID NO: 18031 - DNA, 589 bp, Artificial Sequence
  chemically treated genomic DNA (Homo sapiens) CpG-island No: 18031
aaatcgtaagttaaatttgaggaggagtttgtagttgtttcggtgttagagttagttaggttttttttagaaagtttttcgttttaggcgcggttttcgtaaaatcgttttcggttgttagcgcggtggatttcggttggcgtttcgaatatttgaggtggtttcggtcgtttaggggcggtcgtatcggaggacgtagtcgattttttcgtttcgtcgcgttttcggtttttattttaacggcgacgcgagtaaggtcggttcggcggtttttcggttcgaggcggtgtttttttcgtgggcgttttcggtttatacgattttcggtcggatagttcgattatagtcgtttcgtagttttcgtttgaggggaatttgtaggcgtcggtgggttttcgttgattttcgtttcgtatttatttgttttacgggttattttagcgttaattcgggtcgggttagtagtttttttattcgtatttagttagcgtttagcggcgtttaagcgtacgcgtggcggggcgtggtatgggcggtcgcgggttatgttgggggttgtagtcgttttcgtttattaggcggggcgcgt

SEQ ID NO: 18032 - DNA, 589 bp, Artificial Sequence
  chemically treated genomic DNA (Homo sapiens) CpG-island No: 18032
acgcgccccgcctaataaacgaaaacgactacaacccccaacataacccgcgaccgcccataccacgccccgccacgcgtacgcttaaacgccgctaaacgctaactaaatacgaataaaaaaactactaacccgacccgaattaacgctaaaataacccgtaaaacaaataaatacgaaacgaaaatcaacgaaaacccaccgacgcctacaaattcccctcaaacgaaaactacgaaacgactataatcgaactatccgaccgaaaatcgtataaaccgaaaacgcccacgaaaaaaacaccgcctcgaaccgaaaaaccgccgaaccgaccttactcgcgtcgccgttaaaataaaaaccgaaaacgcgacgaaacgaaaaaatcgactacgtcctccgatacgaccgcccctaaacgaccgaaaccacctcaaatattcgaaacgccaaccgaaatccaccgcgctaacaaccgaaaacgattttacgaaaaccgcgcctaaaacgaaaaactttctaaaaaaaacctaactaactctaacaccgaaacaactacaaactcctcctcaaatttaacttacgattt

SEQ ID NO: 18033 - DNA, 651 bp, Artificial Sequence
  chemically treated genomic DNA (Homo sapiens) CpG-island No: 18033
cgtttcgcgtttgtagtttttttcgaagatatttggtgttagtataaggacggttttttttcgtacgtagcgcggttcggtttcgtcgtcgtcgtacgttttcgtatcgttaggcgttcgggttttttcgtagttttcgtcgcgcgtagatttcgcgtttcgagttttgagtcggaggcgcgagtagagtcgaggtaggcgagagatcggttttagtttcgcgtttttcgtcgcgttggtttttttcgggtatttgtttcgttgttcggttttcgtagtattcgcgttttcgtttcggttcggagcgtcgcgttttcgttcgtcgttcgtttagagtttcgtcgtttttttagttcgtcgttttttttttttttcgttatggttcgggttttcgggttcgtcgtttttcgttcgtcgtttttcgcgtttcgggggtttagttgattttgaattggcggggggtcggttggcggggttgggggtttttttcgatcgtcggtttcgggtggggacgcgttgttttcgcgtttttaatttggacgatttttcgcggtcgggttacgtttatgttaaggtaggtgggggttgggtgggtggggggaaggaagggagggtttcgtttcgatgttagttttttggcgcgttggtttt

SEQ ID NO: 18034 - DNA, 651 bp, Artificial Sequence
  chemically treated genomic DNA (Homo sapiens) CpG-island No: 18034
aaaaccaacgcgccaaaaaactaacatcgaaacgaaaccctcccttccttccccccacccacccaacccccacctaccttaacataaacgtaacccgaccgcgaaaaatcgtccaaattaaaaacgcgaaaacaacgcgtccccacccgaaaccgacgatcgaaaaaaacccccaaccccgccaaccgaccccccgccaattcaaaatcaactaaacccccgaaacgcgaaaaacgacgaacgaaaaacgacgaacccgaaaacccgaaccataacgaaaaaaaaaaaaaacgacgaactaaaaaaacgacgaaactctaaacgaacgacgaacgaaaacgcgacgctccgaaccgaaacgaaaacgcgaatactacgaaaaccgaacaacgaaacaaatacccgaaaaaaaccaacgcgacgaaaaacgcgaaactaaaaccgatctctcgcctacctcgactctactcgcgcctccgactcaaaactcgaaacgcgaaatctacgcgcgacgaaaactacgaaaaaacccgaacgcctaacgatacgaaaacgtacgacgacgacgaaaccgaaccgcgctacgtacgaaaaaaaaccgtccttatactaacaccaaatatcttcgaaaaaaactacaaacgcgaaacg

SEQ ID NO: 18035 - DNA, 651 bp, Artificial Sequence
  chemically treated genomic DNA (Homo sapiens) CpG-island No: 18035
gaagttaacgcgttaagaaattggtatcgaagcgaagtttttttttttttttttttatttatttagtttttatttattttggtatggacgtggttcggtcgcggggggtcgtttaggttagagacgcggggataacgcgtttttattcgaagtcggcgatcgagagggatttttagtttcgttagtcgatttttcgttaatttaggattagttgagttttcggggcgcggggggcggcgggcggggggcggcgggttcgggggttcgggttatggcgggaggaggaggaggcggcgggttggagggacggcgaggttttgggcgggcggcgggcgggagcgcggcgtttcgggtcggggcgggggcgcgggtgttgcggggatcgagtagcggggtaagtgttcgggagagattagcgcggcggggagcgcggggttgaggtcggtttttcgtttgtttcggttttgttcgcgttttcggtttagggttcgaagcgcggggtttgcgcgcggcgggggttgcggaggagttcgagcgtttggcggtgcggggacgtgcggcggcggcgagatcgagtcgcgttgcgtgcgaggaaaagtcgtttttatattgatattaaatgttttcggggaaagttgtaggcgcgggacg

SEQ ID NO: 18036 - DNA, 651 bp, Artificial Sequence
  chemically treated genomic DNA (Homo sapiens) CpG-island No: 18036
cgtcccgcgcctacaactttccccgaaaacatttaatatcaatataaaaacgacttttcctcgcacgcaacgcgactcgatctcgccgccgccgcacgtccccgcaccgccaaacgctcgaactcctccgcaacccccgccgcgcgcaaaccccgcgcttcgaaccctaaaccgaaaacgcgaacaaaaccgaaacaaacgaaaaaccgacctcaaccccgcgctccccgccgcgctaatctctcccgaacacttaccccgctactcgatccccgcaacacccgcgcccccgccccgacccgaaacgccgcgctcccgcccgccgcccgcccaaaacctcgccgtccctccaacccgccgcctcctcctcctcccgccataacccgaacccccgaacccgccgccccccgcccgccgccccccgcgccccgaaaactcaactaatcctaaattaacgaaaaatcgactaacgaaactaaaaatccctctcgatcgccgacttcgaataaaaacgcgttatccccgcgtctctaacctaaacgaccccccgcgaccgaaccacgtccataccaaaataaataaaaactaaataaataaaaaaaaaaaaaaaaaaacttcgcttcgataccaatttcttaacgcgttaacttc

SEQ ID NO: 18037 - DNA, 642 bp, Artificial Sequence
  chemically treated genomic DNA (Homo sapiens) CpG-island No: 18037
ggggcgggatcgggggcgggagtagcgcggggcgggattttattcgcggtttacgcggagttaggaggcgcggattatagttttcggtttgtttcgcgtgcggttttcgttcgtttttagcgttcgggaggaggatgtagacgtcgcggtcggcgatgaggatggaggtcggggaggtagcgtcgtcggcgggggcgggcggtcgcgtcgtaggcggttggggtaagtgggtgcggtttaacgtggggggtacggtgtttttgattattcggtagacgttgtgtcgcgagtagaagtttttttttagtcgtttgtgttagggggaagagttgtagtcggatcgggtgaggttttcggggtgggcggcgagcgggcggtgggtttttcgttcgttcgacgcggggttgtcgggtttggttcgttcgttaggttggggattcggtcgggtttattttcgaggaattggaggcgggaagaagcggtaggaggaggggagggggaggtgggtttggtagtgagggatgtatttattgtcgtggtaacgggacgacgtaggtcgcggttattagaagttttttagtcgtttcggatcggggttttttttttttttttggggttgtggatagggagagatttgggatt

SEQ ID NO: 18038 - DNA, 642 bp, Artificial Sequence
  chemically treated genomic DNA (Homo sapiens) CpG-island No: 18038
aatcccaaatctctccctatccacaaccccaaaaaaaaaaaaaaaaccccgatccgaaacgactaaaaaacttctaataaccgcgacctacgtcgtcccgttaccacgacaataaatacatccctcactaccaaacccacctccccctcccctcctcctaccgcttcttcccgcctccaattcctcgaaaataaacccgaccgaatccccaacctaacgaacgaaccaaacccgacaaccccgcgtcgaacgaacgaaaaacccaccgcccgctcgccgcccaccccgaaaacctcacccgatccgactacaactcttccccctaacacaaacgactaaaaaaaaacttctactcgcgacacaacgtctaccgaataatcaaaaacaccgtaccccccacgttaaaccgcacccacttaccccaaccgcctacgacgcgaccgcccgcccccgccgacgacgctacctccccgacctccatcctcatcgccgaccgcgacgtctacatcctcctcccgaacgctaaaaacgaacgaaaaccgcacgcgaaacaaaccgaaaactataatccgcgcctcctaactccgcgtaaaccgcgaataaaatcccgccccgcgctactcccgcccccgatcccgcccc

SEQ ID NO: 18039 - DNA, 642 bp, Artificial Sequence
  chemically treated genomic DNA (Homo sapiens) CpG-island No: 18039
ggttttaggtttttttttgtttatagttttaaaggagaaggagaggtttcgattcggggcggttggagagtttttaatggtcgcggtttgcgtcgtttcgttgttacggtaatgggtatattttttattattagatttattttttttttttttttttttgtcgttttttttcgtttttagtttttcggaaatgaattcggtcgggtttttagtttggcgggcgagttaggttcgatagtttcgcgtcgggcgagcggaggatttatcgttcgttcgtcgtttatttcgggggttttattcggttcgattgtagtttttttttttggtataggcggttgaggaaggatttttgttcgcggtatagcgtttgtcgggtggttaggaatatcgtgttttttacgttgagtcgtatttatttgttttagtcgtttgcggcgcggtcgttcgttttcgtcggcggcgttgttttttcggtttttatttttatcgtcggtcgcggcgtttgtatttttttttcgggcgttgggggcgggcggggatcgtacgcggggtaggtcgggagttgtagttcgcgttttttggtttcgcgtgggtcgcgggtagggtttcgtttcgcgttgttttcgttttcggtttcgtttt

SEQ ID NO: 18040 - DNA, 642 bp, Artificial Sequence
  chemically treated genomic DNA (Homo sapiens) CpG-island No: 18040
aaaacgaaaccgaaaacgaaaacaacgcgaaacgaaaccctacccgcgacccacgcgaaaccaaaaaacgcgaactacaactcccgacctaccccgcgtacgatccccgcccgcccccaacgcccgaaaaaaaaatacaaacgccgcgaccgacgataaaaataaaaaccgaaaaaacaacgccgccgacgaaaacgaacgaccgcgccgcaaacgactaaaacaaataaatacgactcaacgtaaaaaacacgatattcctaaccacccgacaaacgctataccgcgaacaaaaatccttcctcaaccgcctataccaaaaaaaaaaactacaatcgaaccgaataaaacccccgaaataaacgacgaacgaacgataaatcctccgctcgcccgacgcgaaactatcgaacctaactcgcccgccaaactaaaaacccgaccgaattcatttccgaaaaactaaaaacgaaaaaaaacgacaaaaaaaaaaaaaaaaaaaataaatctaataataaaaaatatacccattaccgtaacaacgaaacgacgcaaaccgcgaccattaaaaactctccaaccgccccgaatcgaaacctctccttctcctttaaaactataaacaaaaaaaaacctaaaacc

SEQ ID NO: 18041 - DNA, 913 bp, Artificial Sequence
  chemically treated genomic DNA (Homo sapiens) CpG-island No: 18041
tgcgagcgcgttttgagtttcgggtcgtagtacgcgcgttttcgcgttcgaggtcgcgcgttgtttagtttttcgttcgcgtttcgcgagttgcgttcgtcgcgtacgacgttttttcgcgggagttttgggtcgtcggtcgcgcgcgtaggggagggggcgggggcgtcgcgtacgcgtacgggtcggcggcgcgcgtcgagcggggggtatcgcgcgggtgtagttacgatggaagggggtgcgtacggagcgggtaaagtcgggggcgttttcgatttttatattttggttcggtagtcgtatattattttgcgcgtcgtgttttgggtaaggacggattggtcgacggttttgttaggtcggggtggtgggggtgtgagtaaaggcggcgcgttcggatcgatttcgatttcgattttaacgggttttcggcggcggcgcggcggcgggcgaggagttgttttgtttgcggggttcgttgtcgtcgtttttttttttcgggttcggggcgggcgggatttttggtgttcgcgggagacgtcgtttcggttttcggagttttggttttttggggttttcggttcgtgcgttttttttttcgtttcgattgttgtgatttttaggtcgcggttatgtcgcgaaaggttcggattgtgcgcggtcgttagggcggattggggatcgtggggacggagttagggtttaaggtggttttttttggggggtggattagggcgtggattatttcggtggggtgtatgtcgcgtttgcgatggacgttggaggaggagagggtcgggaatcgggttcgtattgtttagttcggttcgtgtggagcgatgagtcgggaattgagtattttttttttattcgggaattgtttttttttttttgcgtgattttgggttgg

SEQ ID NO: 18042 - DNA, 913 bp, Artificial Sequence
  chemically treated genomic DNA (Homo sapiens) CpG-island No: 18042
ccaacccaaaatcacgcaaaaaaaaaaaaacaattcccgaataaaaaaaaaatactcaattcccgactcatcgctccacacgaaccgaactaaacaatacgaacccgattcccgaccctctcctcctccaacgtccatcgcaaacgcgacatacaccccaccgaaataatccacgccctaatccaccccccaaaaaaaaccaccttaaaccctaactccgtccccacgatccccaatccgccctaacgaccgcgcacaatccgaacctttcgcgacataaccgcgacctaaaaatcacaacaatcgaaacgaaaaaaaaaacgcacgaaccgaaaaccccaaaaaaccaaaactccgaaaaccgaaacgacgtctcccgcgaacaccaaaaatcccgcccgccccgaacccgaaaaaaaaaaacgacgacaacgaaccccgcaaacaaaacaactcctcgcccgccgccgcgccgccgccgaaaacccgttaaaatcgaaatcgaaatcgatccgaacgcgccgcctttactcacacccccaccaccccgacctaacaaaaccgtcgaccaatccgtccttacccaaaacacgacgcgcaaaataatatacgactaccgaaccaaaatataaaaatcgaaaacgcccccgactttacccgctccgtacgcacccccttccatcgtaactacacccgcgcgataccccccgctcgacgcgcgccgccgacccgtacgcgtacgcgacgcccccgccccctcccctacgcgcgcgaccgacgacccaaaactcccgcgaaaaaacgtcgtacgcgacgaacgcaactcgcgaaacgcgaacgaaaaactaaacaacgcgcgacctcgaacgcgaaaacgcgcgtactacgacccgaaactcaaaacgcgctcgca

SEQ ID NO: 18043 - DNA, 913 bp, Artificial Sequence
  chemically treated genomic DNA (Homo sapiens) CpG-island No: 18043
ttagtttaaggttacgtagagaaggagaggtagttttcgggtggaagagaggtatttagttttcgatttatcgttttatacgggtcgggttaggtaatacgaattcggttttcggttttttttttttttaacgtttatcgtaggcgcggtatgtattttatcgagatggtttacgttttgatttattttttaaaaaaggttattttaaattttggtttcgtttttacggtttttagttcgttttggcggtcgcgtataattcgagtttttcgcggtatagtcgcggtttggaggttatagtaatcggggcgggaaggggggcgtacgaatcgggggttttaggaaattagggtttcgggagtcggagcggcgtttttcgcgagtattagggatttcgttcgtttcgggttcgggaaggaggagcggcggtagcgggtttcgtaggtaggatagtttttcgttcgtcgtcgcgtcgtcgtcgggggttcgttggggtcggggtcggggtcggttcgggcgcgtcgtttttgtttatatttttattatttcggtttggtagagtcgtcggttagttcgtttttatttaagatacgacgcgtaggatggtgtgcggttgtcggattagggtgtaggggtcgaaggcgttttcggttttgttcgtttcgtacgtatttttttttatcgtggttgtattcgcgcggtgtttttcgttcggcgcgcgtcgtcggttcgtgcgcgtgcgcggcgttttcgtttttttttttgcgcgcgcggtcggcggtttagggttttcgcgagggggcgtcgtgcgcggcgggcgtagttcgcggggcgcgggcggggggttgggtagcgcgcgatttcgggcgcgggggcgcgcgtgttgcggttcggggtttagggcgcgttcgta

SEQ ID NO: 18044 - DNA, 913 bp, Artificial Sequence
  chemically treated genomic DNA (Homo sapiens) CpG-island No: 18044
tacgaacgcgccctaaaccccgaaccgcaacacgcgcgcccccgcgcccgaaatcgcgcgctacccaaccccccgcccgcgccccgcgaactacgcccgccgcgcacgacgccccctcgcgaaaaccctaaaccgccgaccgcgcgcgcaaaaaaaaaaacgaaaacgccgcgcacgcgcacgaaccgacgacgcgcgccgaacgaaaaacaccgcgcgaatacaaccacgataaaaaaaaatacgtacgaaacgaacaaaaccgaaaacgccttcgacccctacaccctaatccgacaaccgcacaccatcctacgcgtcgtatcttaaataaaaacgaactaaccgacgactctaccaaaccgaaataataaaaatataaacaaaaacgacgcgcccgaaccgaccccgaccccgaccccaacgaacccccgacgacgacgcgacgacgaacgaaaaactatcctacctacgaaacccgctaccgccgctcctccttcccgaacccgaaacgaacgaaatccctaatactcgcgaaaaacgccgctccgactcccgaaaccctaatttcctaaaacccccgattcgtacgccccccttcccgccccgattactataacctccaaaccgcgactataccgcgaaaaactcgaattatacgcgaccgccaaaacgaactaaaaaccgtaaaaacgaaaccaaaatttaaaataaccttttttaaaaaataaatcaaaacgtaaaccatctcgataaaatacataccgcgcctacgataaacgttaaaaaaaaaaaaaaccgaaaaccgaattcgtattacctaacccgacccgtataaaacgataaatcgaaaactaaatacctctcttccacccgaaaactacctctccttctctacgtaaccttaaactaa

SEQ ID NO: 18045 - DNA, 811 bp, Artificial Sequence
  chemically treated genomic DNA (Homo sapiens) CpG-island No: 18045
ggcgatcgtagagatttggtcgggaggcgtcggtttagcgaggtcgttgggattgtgtattgaggggcgttgatcgttggacgcgcgtttttcgtagattttcgttgaaggagtagggggcggcgcgcgtgcgcggggcgtcgggcggcgcgcgagggggcggagcggggaggcgtgttgcgatttcggtcggttatagtttgcggcgcgcgtagagcgttagtggggcgcgcggcgcgcgcgcggggcgggggcgcgcggaggggggggttgtttcggggcggtttttttaggtcggggcgcggcgggcggcggcggcgggcgcgcgtttcgtttaggttcggagtaatcgtcgtcgtcgtcgttaaagttcgttaatatggcggatttggaggttgtgttggtcgatgttagttatttgatggttatggagaagagtaaggcgatttcggtcgttcgcgttagtaagaggatcgttttgtcggagtttaggtattagttgtttcggtcggcgtcggttttaagtcgtcgttttttgcggtcgttagttattttttgttttttggagggtcgggcgttgagttttcgttgtttcggggcgggtgatatagcggagcgggcgatgcggggtcggtttcgtcgttttagtttttgaaatggggtatcggagggtcggtggggggtatttcgggagagagcgttttaaagtgttcggcgcggcgttttgcgcgtagcgagcgttttagttagggtttggttatgatttggttggattagttttatttttgtcgttttttttttttagttttgt

SEQ ID NO: 18046 - DNA, 811 bp, Artificial Sequence
  chemically treated genomic DNA (Homo sapiens) CpG-island No: 18046
acaaaactaaaaaaaaaaaacgacaaaaataaaactaatccaaccaaatcataaccaaaccctaactaaaacgctcgctacgcgcaaaacgccgcgccgaacactttaaaacgctctctcccgaaataccccccaccgaccctccgataccccatttcaaaaactaaaacgacgaaaccgaccccgcatcgcccgctccgctatatcacccgccccgaaacaacgaaaactcaacgcccgaccctccaaaaaacaaaaaataactaacgaccgcaaaaaacgacgacttaaaaccgacgccgaccgaaacaactaatacctaaactccgacaaaacgatcctcttactaacgcgaacgaccgaaatcgccttactcttctccataaccatcaaataactaacatcgaccaacacaacctccaaatccgccatattaacgaactttaacgacgacgacgacgattactccgaacctaaacgaaacgcgcgcccgccgccgccgcccgccgcgccccgacctaaaaaaaccgccccgaaacaacccccccctccgcgcgcccccgccccgcgcgcgcgccgcgcgccccactaacgctctacgcgcgccgcaaactataaccgaccgaaatcgcaacacgcctccccgctccgccccctcgcgcgccgcccgacgccccgcgcacgcgcgccgccccctactccttcaacgaaaatctacgaaaaacgcgcgtccaacgatcaacgcccctcaatacacaatcccaacgacctcgctaaaccgacgcctcccgaccaaatctctacgatcgcc

SEQ ID NO: 18047 - DNA, 811 bp, Artificial Sequence
  chemically treated genomic DNA (Homo sapiens) CpG-island No: 18047
atagggttggggggagggggcgatagggatggagttggtttagttaagttataattagattttggttggggcgttcgttgcgcgtagggcgtcgcgtcgggtattttggagcgttttttttcggggtgttttttatcggtttttcgatgttttattttagagattggaacgacgaggtcggtttcgtatcgttcgtttcgttgtgttattcgtttcggggtagcggaggtttagcgttcgattttttaggaagtagggggtagttggcggtcgtagggggcggcggtttggggtcggcgtcggtcggggtagttggtatttgggtttcggtaggacgatttttttgttggcgcgggcggtcggggtcgttttgtttttttttatggttattaggtaattgatatcggttagtatagtttttaggttcgttatgttggcgagttttggcggcggcggcggcggttatttcggatttggacgggacgcgcgttcgtcgtcgtcgttcgtcgcgtttcgatttgggggggtcgtttcggggtagttttttttttcgcgcgttttcgtttcgcgcgcgcgtcgcgcgttttattagcgttttgcgcgcgtcgtaggttgtagtcggtcggggtcgtagtacgttttttcgtttcgttttttcgcgcgtcgttcggcgtttcgcgtacgcgcgtcgttttttgtttttttagcgagggtttgcggggagcgcgcgtttaacggttagcgttttttagtgtatagttttagcggtttcgttgggtcggcgtttttcgattaagtttttacggtcgtt

SEQ ID NO: 18048 - DNA, 811 bp, Artificial Sequence
  chemically treated genomic DNA (Homo sapiens) CpG-island No: 18048
aacgaccgtaaaaacttaatcgaaaaacgccgacccaacgaaaccgctaaaactatacactaaaaaacgctaaccgttaaacgcgcgctccccgcaaaccctcgctaaaaaaacaaaaaacgacgcgcgtacgcgaaacgccgaacgacgcgcgaaaaaacgaaacgaaaaaacgtactacgaccccgaccgactacaacctacgacgcgcgcaaaacgctaataaaacgcgcgacgcgcgcgcgaaacgaaaacgcgcgaaaaaaaaaactaccccgaaacgacccccccaaatcgaaacgcgacgaacgacgacgacgaacgcgcgtcccgtccaaatccgaaataaccgccgccgccgccgccaaaactcgccaacataacgaacctaaaaactatactaaccgatatcaattacctaataaccataaaaaaaaacaaaacgaccccgaccgcccgcgccaacaaaaaaatcgtcctaccgaaacccaaataccaactaccccgaccgacgccgaccccaaaccgccgccccctacgaccgccaactaccccctacttcctaaaaaatcgaacgctaaacctccgctaccccgaaacgaataacacaacgaaacgaacgatacgaaaccgacctcgtcgttccaatctctaaaataaaacatcgaaaaaccgataaaaaacaccccgaaaaaaaacgctccaaaatacccgacgcgacgccctacgcgcaacgaacgccccaaccaaaatctaattataacttaactaaaccaactccatccctatcgccccctccccccaaccctat

SEQ ID NO: 18049 - DNA, 982 bp, Artificial Sequence
  chemically treated genomic DNA (Homo sapiens) CpG-island No: 18049
  misc_feature (48)..(48): n is either a, c, g or t
  misc_feature (56)..(56): n is either a, c, g or t
  misc_feature (131)..(131): n is either a, c, g or t
  misc_feature (165)..(165): n is either a, c, g or t
  misc_feature (172)..(172): n is either a, c, g or t
  misc_feature (177)..(177): n is either a, c, g or t
  misc_feature (196)..(196): n is either a, c, g or t
  misc_feature (223)..(223): n is either a, c, g or t
  misc_feature (255)..(255): n is either a, c, g or t
  misc_feature (286)..(286): n is either a, c, g or t
  misc_feature (308)..(308): n is either a, c, g or t
  misc_feature (312)..(312): n is either a, c, g or t
  misc_feature (332)..(332): n is either a, c, g or t
  misc_feature (346)..(346): n is either a, c, g or t
  misc_feature (403)..(403): n is either a, c, g or t
  misc_feature (415)..(415): n is either a, c, g or t
  misc_feature (431)..(431): n is either a, c, g or t
  misc_feature (593)..(593): n is either a, c, g or t
  misc_feature (625)..(625): n is either a, c, g or t
  misc_feature (694)..(694): n is either a, c, g or t
  misc_feature (737)..(737): n is either a, c, g or t
  misc_feature (773)..(773): n is either a, c, g or t
  misc_feature (815)..(815): n is either a, c, g or t
  misc_feature (900)..(900): n is either a, c, g or t
  misc_feature (908)..(908): n is either a, c, g or t
  misc_feature (920)..(920): n is either a, c, g or t
  misc_feature (943)..(943): n is either a, c, g or t
  misc_feature (953)..(953): n is either a, c, g or t
  misc_feature (967)..(967): n is either a, c, g or t
tgagcggtggatttttcgttttttcgatcgcgatcgattttggtcgtngtagcgantgagcgttagagcgggtaggcggcgtacggacgtatacgcgttgagacgggatgttatggcgtggcgcgtgtggnagcgtagcgtacgtcgcgtgagcgtacgatagtnattggtnttagnagatacgttcgttcgcgtngttcgttgagtttcgagcgaagttgancgatagagaattgtaggggagggtatttgggntcgggcggttattgttcggtgatagtgcgtngagttttcgacgtgtattcgancgtngttgtaggcgcgaggagagnatatgtgcgttttngagatcgtggaggtacggtcgggagcgttcgggtaggtcgacggttggaggtttttntacggtagttgncgagtgcggagcgttnggtttcgtatatacgaggcgtaatcggtcgtttttgttagtattcgtagagagttataagcgaagggagagtacgcgaggcgcgagagcgagcgaagagggcgtagcgtcgttttacgttgggcgagcgtagttgcgtatgagcgcgcgtcgatttatcganttcgtcgtttttattagttttagcgtcggggntagtgcgtagttggagagcgataggtgagacgaggagagcgtggagttgacgatattcgtaggtagagntacgacggcgtcgttcgtgggagttatagtgttaatattaatncgacgtagtaaggagaggggaagcgacgtgagcggntagtcgcgtaggcgttagcgagcgagtgcgtgaagttagcgntttcgtgtattagcgttttgaggatcgttcgcgagggatgtttttgatgaggtcggtcgtagtgcgtaatttttgttagtgttgngttaggangagatcgttagncgaagttacgagatattgttcgntgcgatttantcgttcgtcggtgnagacgtgttcgggag

SEQ ID NO: 18050 - DNA, 982 bp, Artificial Sequence
  chemically treated genomic DNA (Homo sapiens) CpG-island No: 18050
  misc_feature (16)..(16): n is either a, c, g or t
  misc_feature (30)..(30): n is either a, c, g or t
  misc_feature (40)..(40): n is either a, c, g or t
  misc_feature (63)..(63): n is either a, c, g or t
  misc_feature (75)..(75): n is either a, c, g or t
  misc_feature (83)..(83): n is either a, c, g or t
  misc_feature (168)..(168): n is either a, c, g or t
  misc_feature (210)..(210): n is either a, c, g or t
  misc_feature (246)..(246): n is either a, c, g or t
  misc_feature (289)..(289): n is either a, c, g or t
  misc_feature (358)..(358): n is either a, c, g or t
  misc_feature (390)..(390): n is either a, c, g or t
  misc_feature (552)..(552): n is either a, c, g or t
  misc_feature (568)..(568): n is either a, c, g or t
  misc_feature (580)..(580): n is either a, c, g or t
  misc_feature (637)..(637): n is either a, c, g or t
  misc_feature (651)..(651): n is either a, c, g or t
  misc_feature (671)..(671): n is either a, c, g or t
  misc_feature (675)..(675): n is either a, c, g or t
  misc_feature (697)..(697): n is either a, c, g or t
  misc_feature (728)..(728): n is either a, c, g or t
  misc_feature (760)..(760): n is either a, c, g or t
  misc_feature (787)..(787): n is either a, c, g or t
  misc_feature (806)..(806): n is either a, c, g or t
  misc_feature (811)..(811): n is either a, c, g or t
  misc_feature (818)..(818): n is either a, c, g or t
  misc_feature (852)..(852): n is either a, c, g or t
  misc_feature (927)..(927): n is either a, c, g or t
  misc_feature (935)..(935): n is either a, c, g or t
ctcccgaacacgtctncaccgacgaacgantaaatcgcancgaacaatatctcgtaacttcgnctaacgatctcntcctaacncaacactaacaaaaattacgcactacgaccgacctcatcaaaaacatccctcgcgaacgatcctcaaaacgctaatacacgaaancgctaacttcacgcactcgctcgctaacgcctacgcgactanccgctcacgtcgcttcccctctccttactacgtcgnattaatattaacactataactcccacgaacgacgccgtcgtanctctacctacgaatatcgtcaactccacgctctcctcgtctcacctatcgctctccaactacgcactanccccgacgctaaaactaataaaaacgacgaantcgataaatcgacgcgcgctcatacgcaactacgctcgcccaacgtaaaacgacgctacgccctcttcgctcgctctcgcgcctcgcgtactctcccttcgcttataactctctacgaatactaacaaaaacgaccgattacgcctcgtatatacgaaaccnaacgctccgcactcgncaactaccgtanaaaaacctccaaccgtcgacctacccgaacgctcccgaccgtacctccacgatctcnaaaacgcacatatnctctcctcgcgcctacaacnacgntcgaatacacgtcgaaaactcnacgcactatcaccgaacaataaccgcccgancccaaataccctcccctacaattctctatcgntcaacttcgctcgaaactcaacgaacnacgcgaacgaacgtatctnctaanaccaatnactatcgtacgctcacgcgacgtacgctacgctnccacacgcgccacgccataacatcccgtctcaacgcgtatacgtccgtacgccgcctacccgctctaacgctcantcgctacnacgaccaaaatcgatcgcgatcgaaaaaacgaaaaatccaccgctca

SEQ ID NO: 18051 - DNA, 982 bp, Artificial Sequence
  chemically treated genomic DNA (Homo sapiens) CpG-island No: 18051
  misc_feature (16)..(16): n is either a, c, g or t
  misc_feature (30)..(30): n is either a, c, g or t
  misc_feature (40)..(40): n is either a, c, g or t
  misc_feature (63)..(63): n is either a, c, g or t
  misc_feature (75)..(75): n is either a, c, g or t
  misc_feature (83)..(83): n is either a, c, g or t
  misc_feature (168)..(168): n is either a, c, g or t
  misc_feature (210)..(210): n is either a, c, g or t
  misc_feature (246)..(246): n is either a, c, g or t
  misc_feature (289)..(289): n is either a, c, g or t
  misc_feature (358)..(358): n is either a, c, g or t
  misc_feature (390)..(390): n is either a, c, g or t
  misc_feature (552)..(552): n is either a, c, g or t
  misc_feature (568)..(568): n is either a, c, g or t
  misc_feature (580)..(580): n is either a, c, g or t
  misc_feature (637)..(637): n is either a, c, g or t
  misc_feature (651)..(651): n is either a, c, g or t
  misc_feature (671)..(671): n is either a, c, g or t
  misc_feature (675)..(675): n is either a, c, g or t
  misc_feature (697)..(697): n is either a, c, g or t
  misc_feature (728)..(728): n is either a, c, g or t
  misc_feature (760)..(760): n is either a, c, g or t
  misc_feature (787)..(787): n is either a, c, g or t
  misc_feature (806)..(806): n is either a, c, g or t
  misc_feature (811)..(811): n is either a, c, g or t
  misc_feature (818)..(818): n is either a, c, g or t
  misc_feature (852)..(852): n is either a, c, g or t
  misc_feature (927)..(927): n is either a, c, g or t
  misc_feature (935)..(935): n is either a, c, g or t
ttttcggatacgtttntatcgacgagcgantggatcgtancgagtagtgtttcgtggtttcgnttagcgattttnttttggtntagtattggtaggagttgcgtattacgatcgattttattagaggtatttttcgcgagcgatttttagagcgttaatgtacgaagncgttggttttacgtattcgttcgttagcgtttgcgcggttgntcgtttacgtcgttttttttttttttgttgcgtcgngttagtgttagtattgtagtttttacgagcgacgtcgtcgtgnttttgtttacgagtatcgttagttttacgtttttttcgttttatttatcgttttttagttgcgtattgntttcgacgttaggattggtaagagcgacgagntcgatgagtcggcgcgcgtttatacgtagttacgttcgtttagcgtagaacgacgttgcgtttttttcgttcgttttcgcgtttcgcgtgtttttttttcgtttgtggttttttgcgggtgttggtaggagcgatcggttgcgtttcgtgtgtgcgaggttnagcgtttcgtattcgntaattgtcgtgngagagtttttagtcgtcgatttgttcgagcgttttcgatcgtgtttttacggttttnagagcgtatatgtntttttttcgcgtttgtagtngcgntcgggtgtacgtcgagggtttngcgtattgttatcgagtagtggtcgttcgantttaagtgtttttttttatagttttttgtcgnttagtttcgttcgaggtttagcgagtnacgcgagcgagcgtgtttnttggngttagtngttgtcgtgcgtttacgcggcgtgcgttgcgttnttatacgcgttacgttatagtatttcgttttagcgcgtgtgcgttcgtgcgtcgtttgttcgttttgacgtttantcgttgtngcgattagggtcggtcgcggtcgaggagacgaggggtttatcgttta

SEQ ID NO: 18052 - DNA, 982 bp, Artificial Sequence
  chemically treated genomic DNA (Homo sapiens) CpG-island No: 18052
  misc_feature (48)..(48): n is either a, c, g or t
  misc_feature (56)..(56): n is either a, c, g or t
  misc_feature (131)..(131): n is either a, c, g or t
  misc_feature (165)..(165): n is either a, c, g or t
  misc_feature (172)..(172): n is either a, c, g or t
  misc_feature (177)..(177): n is either a, c, g or t
  misc_feature (196)..(196): n is either a, c, g or t
  misc_feature (223)..(223): n is either a, c, g or t
  misc_feature (255)..(255): n is either a, c, g or t
  misc_feature (286)..(286): n is either a, c, g or t
  misc_feature (308)..(308): n is either a, c, g or t
  misc_feature (312)..(312): n is either a, c, g or t
  misc_feature (332)..(332): n is either a, c, g or t
  misc_feature (346)..(346): n is either a, c, g or t
  misc_feature (403)..(403): n is either a, c, g or t
  misc_feature (415)..(415): n is either a, c, g or t
  misc_feature (431)..(431): n is either a, c, g or t
  misc_feature (593)..(593): n is either a, c, g or t
  misc_feature (625)..(625): n is either a, c, g or t
  misc_feature (694)..(694): n is either a, c, g or t
  misc_feature (737)..(737): n is either a, c, g or t
  misc_feature (773)..(773): n is either a, c, g or t
  misc_feature (815)..(815): n is either a, c, g or t
  misc_feature (900)..(900): n is either a, c, g or t
  misc_feature (908)..(908): n is either a, c, g or t
  misc_feature (920)..(920): n is either a, c, g or t
  misc_feature (943)..(943): n is either a, c, g or t
  misc_feature (953)..(953): n is either a, c, g or t
  misc_feature (967)..(967): n is either a, c, g or t
taaacgataaacccctcgtctcctcgaccgcgaccgaccctaatcgcnacaacgantaaacgtcaaaacgaacaaacgacgcacgaacgcacacgcgctaaaacgaaatactataacgtaacgcgtataanaacgcaacgcacgccgcgtaaacgcacgacaacnactaacnccaanaaacacgctcgctcgcgtnactcgctaaacctcgaacgaaactaancgacaaaaaactataaaaaaaaacacttaaantcgaacgaccactactcgataacaatacgcnaaaccctcgacgtacacccgancgcnactacaaacgcgaaaaaaanacatatacgctctnaaaaccgtaaaaacacgatcgaaaacgctcgaacaaatcgacgactaaaaactctcncacgacaattancgaatacgaaacgctnaacctcgcacacacgaaacgcaaccgatcgctcctaccaacacccgcaaaaaaccacaaacgaaaaaaaaacacgcgaaacgcgaaaacgaacgaaaaaaacgcaacgtcgttctacgctaaacgaacgtaactacgtataaacgcgcgccgactcatcganctcgtcgctcttaccaatcctaacgtcgaaancaatacgcaactaaaaaacgataaataaaacgaaaaaaacgtaaaactaacgatactcgtaaacaaaancacgacgacgtcgctcgtaaaaactacaatactaacactaacncgacgcaacaaaaaaaaaaaaaacgacgtaaacgancaaccgcgcaaacgctaacgaacgaatacgtaaaaccaacgncttcgtacattaacgctctaaaaatcgctcgcgaaaaatacctctaataaaatcgatcgtaatacgcaactcctaccaatactanaccaaaanaaaatcgctaancgaaaccacgaaacactactcgntacgatccantcgctcgtcgatanaaacgtatccgaaaa

SEQ ID NO: 18053 - DNA, 603 bp, Artificial Sequence
  chemically treated genomic DNA (Homo sapiens) CpG-island No: 18053
ggtcgacgggtcggcggttagaggaggcggttggtattttcggcgtcgtcgcggtttttttagtttattgttcgttcgttcgttttttttttttttgtattcgttcggtatagattcggttttagtttttttttttttttcgttcgttttacgttcgttcgttcgttcgtcggtttttttttattcgttcgttcgcgttcggcgtagttcggttagagcgatcgcggggttgagcgcgcgttcgtttagggggtttcggaagttgtttcggttcgcggttttttttttcgttttcgttttttttttttcgtttatcgtcgttttttttttttagttttttcgtcgttcgttcgttttatagttagcggtttcgcgttttttgtagttacgatgttcgcggttcggtcgttcgtcgcgggatttcgcgggatttcgttgtttttcgttttgtttttggggagttcggcggtagcgttggagcgaggtaagcgtttcgaggggcggggcgggtagggggtaaagttgtcgggagagcggggtagttaggggtcggggttgattagggcgatttaggtattattcgtcgggatgggaagcggtggt

SEQ ID NO: 18054 - DNA, 603 bp, Artificial Sequence
  chemically treated genomic DNA (Homo sapiens) CpG-island No: 18054
accaccgcttcccatcccgacgaataatacctaaatcgccctaatcaaccccgacccctaactaccccgctctcccgacaactttaccccctacccgccccgcccctcgaaacgcttacctcgctccaacgctaccgccgaactccccaaaaacaaaacgaaaaacaacgaaatcccgcgaaatcccgcgacgaacgaccgaaccgcgaacatcgtaactacaaaaaacgcgaaaccgctaactataaaacgaacgaacgacgaaaaaactaaaaaaaaaaaacgacgataaacgaaaaaaaaaaaacgaaaacgaaaaaaaaaaccgcgaaccgaaacaacttccgaaaccccctaaacgaacgcgcgctcaaccccgcgatcgctctaaccgaactacgccgaacgcgaacgaacgaataaaaaaaaaccgacgaacgaacgaacgaacgtaaaacgaacgaaaaaaaaaaaaaaactaaaaccgaatctataccgaacgaatacaaaaaaaaaaaaaacgaacgaacgaacaataaactaaaaaaaccgcgacgacgccgaaaataccaaccgcctcctctaaccgccgacccgtcgacc

SEQ ID NO: 18055 - DNA, 603 bp, Artificial Sequence
  chemically treated genomic DNA (Homo sapiens) CpG-island No: 18055
attatcgttttttatttcggcgggtggtgtttgagtcgttttggttagtttcgatttttggttgtttcgttttttcggtaattttgttttttgttcgtttcgtttttcggggcgtttatttcgttttagcgttgtcgtcgggttttttaggagtagagcgaggaatagcgagatttcgcggagtttcgcggcgggcggtcgggtcgcgggtatcgtggttgtagggggcgcggagtcgttggttgtggggcgggcggacggcgagggagttggggaaggagggcggcggtgagcgagaaaggggaagcgggagcgagggaggaggtcgcgggtcggggtagttttcggagttttttgggcggacgcgcgtttagtttcgcggtcgttttggtcgagttgcgtcgggcgcgggcgggcgagtgaggaggagtcggcgagcgagcgaacgagcgtggagcgagcgggaggagggagggggttggggtcgagtttgtgtcgagcgagtgtagggagggagggggcgggcgagcgggtagtgagttggaggggtcgcggcggcgtcgggggtgttagtcgttttttttggtcgtcggttcgtcggtt

SEQ ID NO: 18056 - DNA, 603 bp, Artificial Sequence
  chemically treated genomic DNA (Homo sapiens) CpG-island No: 18056
aaccgacgaaccgacgaccaaaaaaaacgactaacacccccgacgccgccgcgacccctccaactcactacccgctcgcccgccccctccctccctacactcgctcgacacaaactcgaccccaaccccctccctcctcccgctcgctccacgctcgttcgctcgctcgccgactcctcctcactcgcccgcccgcgcccgacgcaactcgaccaaaacgaccgcgaaactaaacgcgcgtccgcccaaaaaactccgaaaactaccccgacccgcgacctcctccctcgctcccgcttcccctttctcgctcaccgccgccctccttccccaactccctcgccgtccgcccgccccacaaccaacgactccgcgccccctacaaccacgatacccgcgacccgaccgcccgccgcgaaactccgcgaaatctcgctattcctcgctctactcctaaaaaacccgacgacaacgctaaaacgaaataaacgccccgaaaaacgaaacgaacaaaaaacaaaattaccgaaaaaacgaaacaaccaaaaatcgaaactaaccaaaacgactcaaacaccacccgccgaaataaaaaacgataat

SEQ ID NO: 18057 - DNA, 514 bp, Artificial Sequence
  chemically treated genomic DNA (Homo sapiens) CpG-island No: 18057
ttggcgtcgggtttagcgtaagggagttggcgattgtataggaggatttagttggcgggatcgcgagggtaagagtttcgcggtgttttttagtgtcggaggggaaggagcgggcgtgaaggacgcgagttggaggatagtttcgattcgggtttgagtcgtggaagtcgttggttttcgtgagtcgatgggggcgaggttttgtcggggcggggttggggagagggcggggttgggttggggttttttgttggttcgagtttagggcggggttgtcggaggggcggggttatatcggggcgggttcgagaggggaggcggggttggggggcgggatatgagtgtggattggcgggttggggcggggttagagcggggttgcggtaggggcggtaggggcggtaggggcggtaggggcggtagagggcggggcgggcggttttagtttgtagaattgggcggtttgcgggaggggtacgaataatgttttagggtttttttgtgatattggggt

SEQ ID NO: 18058 - DNA, 514 bp, Artificial Sequence
  chemically treated genomic DNA (Homo sapiens) CpG-island No: 18058
accccaatatcacaaaaaaaccctaaaacattattcgtacccctcccgcaaaccgcccaattctacaaactaaaaccgcccgccccgccctctaccgcccctaccgcccctaccgcccctaccgcccctaccgcaaccccgctctaaccccgccccaacccgccaatccacactcatatcccgccccccaaccccgcctcccctctcgaacccgccccgatataaccccgcccctccgacaaccccgccctaaactcgaaccaacaaaaaaccccaacccaaccccgccctctccccaaccccgccccgacaaaacctcgcccccatcgactcacgaaaaccaacgacttccacgactcaaacccgaatcgaaactatcctccaactcgcgtccttcacgcccgctccttcccctccgacactaaaaaacaccgcgaaactcttaccctcgcgatcccgccaactaaatcctcctatacaatcgccaactcccttacgctaaacccgacgccaa

SEQ ID NO: 18059 - DNA, 514 bp, Artificial Sequence
  chemically treated genomic DNA (Homo sapiens) CpG-island No: 18059
attttagtgttatagagaaattttggggtattattcgtgtttttttcgtagatcgtttagttttgtaggttgggatcgttcgtttcgttttttgtcgtttttgtcgtttttgtcgtttttgtcgtttttgtcgtaatttcgttttggtttcgttttaattcgttagtttatatttatgtttcgttttttagtttcgttttttttttcggattcgtttcgatatggtttcgttttttcggtaatttcgttttaaattcggattaatagggggttttagtttagtttcgttttttttttagtttcgtttcgatagggtttcgtttttatcggtttacgaaggttaacggtttttacggtttaggttcgaatcgagattgttttttagttcgcgttttttacgttcgttttttttttttcggtattggggggtatcgcgagatttttattttcgcggtttcgttagttgggtttttttatgtagtcgttagtttttttgcgttgagttcggcgttag

SEQ ID NO: 18060 - DNA, 514 bp, Artificial Sequence
  chemically treated genomic DNA (Homo sapiens) CpG-island No: 18060
ctaacgccgaactcaacgcaaaaaaactaacgactacataaaaaaacccaactaacgaaaccgcgaaaataaaaatctcgcgataccccccaataccgaaaaaaaaaaaacgaacgtaaaaaacgcgaactaaaaaacaatctcgattcgaacctaaaccgtaaaaaccgttaaccttcgtaaaccgataaaaacgaaaccctatcgaaacgaaactaaaaaaaaaacgaaactaaactaaaaccccctattaatccgaatttaaaacgaaattaccgaaaaaacgaaaccatatcgaaacgaatccgaaaaaaaaaacgaaactaaaaaacgaaacataaatataaactaacgaattaaaacgaaaccaaaacgaaattacgacaaaaacgacaaaaacgacaaaaacgacaaaaacgacaaaaaacgaaacgaacgatcccaacctacaaaactaaacgatctacgaaaaaaacacgaataataccccaaaatttctctataacactaaaat

SEQ ID NO: 18061 - DNA, 978 bp, Artificial Sequence
  chemically treated genomic DNA (Homo sapiens) CpG-island No: 18061
tttcgttcgttttggtttcgggttttcgggggttggggcggggttgttggcggtttcgttttcgtttgttagttttttaaagggcgtaagcgtcgttttcgtcgcgtgttcggggttagttcgagttcgtgcgggttttttaagggtcgggggcgtgtagcgggttcgtttttttttcgcggcgttcgtagttcgttaagtgcgagtttcggcgtaggggtcggatttggtcgggggtcggcggcggtgtgggagcggcgcgttatgtatattattattaaggggtttagtaagttggtcgcgtagcgtcgtataggtgcgtacgggtcggggaacgggaacggggacggggcggggcgcggcggcggttgatcgtttttcggtgttcgtaggttttacgtagtagtaggtggagggtcggttcggcgagtttttgaaatgtcggtagttcgcgtcgtcgatttcgtagttttcgcgggcgtagttttttgcgtagtcgtcgggattttggtttttgtcgaggtgagacgcgcgcggtttcggttcggttcggttcggttttttttttttcgtcggtcgttttagagcggagggtgattttggggaaatgttagtgaggttcggttacgtgttgtaggcggggcgggcgtttcgggcgcggggggtgcgcgggttttgtttattacgcgttcgcgggtttgcgtttcgtattttcgttttatttggtcgggttcgggtttttagcggggagaaagtcggttagtttttgggtcgtaggggtttttagcgttcgaggtcggtgtttcgggcgattttgggttgttgttggaattttgacgtgtagtaggtttaggttacggttcgcggagagcgtcgggcgttggtttttaagatttttcggttttgtttttgtagagtttagtgggggagacgtgcgtgcgtttttttcgggtagggtcgttgttttttttcgttttt

SEQ ID NO: 18062 - DNA, 978 bp, Artificial Sequence
  chemically treated genomic DNA (Homo sapiens) CpG-island No: 18062
aaaaacgaaaaaaaacaacgaccctacccgaaaaaaacgcacgcacgtctcccccactaaactctacaaaaacaaaaccgaaaaatcttaaaaaccaacgcccgacgctctccgcgaaccgtaacctaaacctactacacgtcaaaattccaacaacaacccaaaatcgcccgaaacaccgacctcgaacgctaaaaacccctacgacccaaaaactaaccgactttctccccgctaaaaacccgaacccgaccaaataaaacgaaaatacgaaacgcaaacccgcgaacgcgtaataaacaaaacccgcgcaccccccgcgcccgaaacgcccgccccgcctacaacacgtaaccgaacctcactaacatttccccaaaatcaccctccgctctaaaacgaccgacgaaaaaaaaaaaaccgaaccgaaccgaaccgaaaccgcgcgcgtctcacctcgacaaaaaccaaaatcccgacgactacgcaaaaaactacgcccgcgaaaactacgaaatcgacgacgcgaactaccgacatttcaaaaactcgccgaaccgaccctccacctactactacgtaaaacctacgaacaccgaaaaacgatcaaccgccgccgcgccccgccccgtccccgttcccgttccccgacccgtacgcacctatacgacgctacgcgaccaacttactaaaccccttaataataatatacataacgcgccgctcccacaccgccgccgacccccgaccaaatccgacccctacgccgaaactcgcacttaacgaactacgaacgccgcgaaaaaaaaacgaacccgctacacgcccccgacccttaaaaaacccgcacgaactcgaactaaccccgaacacgcgacgaaaacgacgcttacgccctttaaaaaactaacaaacgaaaacgaaaccgccaacaaccccgccccaacccccgaaaacccgaaaccaaaacgaacgaaa

SEQ ID NO: 18063 - DNA, 978 bp, Artificial Sequence
  chemically treated genomic DNA (Homo sapiens) CpG-island No: 18063
aagggcggaggagggtagcggttttgttcgagggaagcgtacgtacgttttttttattgagttttgtaagggtagagtcgggagattttgaggattagcgttcgacgtttttcgcgaatcgtggtttgggtttgttgtacgttagggttttagtagtaatttaaggtcgttcgaagtatcgatttcggacgttggaggtttttgcgatttaggaattggtcggtttttttttcgttgggggttcgggttcggttaggtgaggcggaagtgcgaggcgtaggttcgcgggcgcgtagtgggtaggattcgcgtatttttcgcgttcggagcgttcgtttcgtttgtagtacgtggtcggattttattaatatttttttaaggttatttttcgttttagggcggtcggcgggggaggggaagtcgggtcgggtcgggtcggggtcgcgcgcgttttatttcgataggggttagggtttcggcggttgcgtaaagggttgcgttcgcgggggttgcgaggtcggcggcgcgggttgtcggtattttaggagttcgtcgagtcggttttttatttgttgttgcgtgggatttgcgggtatcggggggcggttagtcgtcgtcgcgtttcgtttcgttttcgttttcgtttttcggttcgtgcgtatttgtgcggcgttgcgcgattagtttgttgggttttttggtgatggtgtatatgacgcgtcgtttttatatcgtcgtcggttttcggttagattcggtttttgcgtcggggttcgtatttaacggattgcgggcgtcgcggggagggggcgggttcgttatacgttttcggtttttaaagggttcgtacgggttcgggttgatttcggatacgcggcggaggcggcgtttgcgttttttgggaaattggtaggcgggggcggagtcgttagtaatttcgttttagttttcggaggttcgaggttaaggcggacgagg

SEQ ID NO: 18064 - DNA, 978 bp, Artificial Sequence
  chemically treated genomic DNA (Homo sapiens) CpG-island No: 18064
cctcgtccgccttaacctcgaacctccgaaaactaaaacgaaattactaacgactccgcccccgcctaccaatttcccaaaaaacgcaaacgccgcctccgccgcgtatccgaaatcaacccgaacccgtacgaaccctttaaaaaccgaaaacgtataacgaacccgccccctccccgcgacgcccgcaatccgttaaatacgaaccccgacgcaaaaaccgaatctaaccgaaaaccgacgacgatataaaaacgacgcgtcatatacaccatcaccaaaaaacccaacaaactaatcgcgcaacgccgcacaaatacgcacgaaccgaaaaacgaaaacgaaaacgaaacgaaacgcgacgacgactaaccgccccccgatacccgcaaatcccacgcaacaacaaataaaaaaccgactcgacgaactcctaaaataccgacaacccgcgccgccgacctcgcaacccccgcgaacgcaaccctttacgcaaccgccgaaaccctaacccctatcgaaataaaacgcgcgcgaccccgacccgacccgacccgacttcccctcccccgccgaccgccctaaaacgaaaaataaccttaaaaaaatattaataaaatccgaccacgtactacaaacgaaacgaacgctccgaacgcgaaaaatacgcgaatcctacccactacgcgcccgcgaacctacgcctcgcacttccgcctcacctaaccgaacccgaacccccaacgaaaaaaaaaccgaccaattcctaaatcgcaaaaacctccaacgtccgaaatcgatacttcgaacgaccttaaattactactaaaaccctaacgtacaacaaacccaaaccacgattcgcgaaaaacgtcgaacgctaatcctcaaaatctcccgactctacccttacaaaactcaataaaaaaaacgtacgtacgcttccctcgaacaaaaccgctaccctcctccgccctt

SEQ ID NO: 18065 - DNA, 531 bp, Artificial Sequence
  chemically treated genomic DNA (Homo sapiens) CpG-island No: 18065
gcgatttcgtttcgttgtttgtatgcggcgggagtttcggtcggtcgaggcgttgataggtgggcgcggcggaggattcgtaatcggcgcgggtttcgaagtcggtcgggttaatagggggttgttttgggaggttcgcggggtaaagggtagcgggattcgcggttggagtaattttggaggtcgttgacgtgagcggggtatttttatcggggaggttacgtggttagggcgtcgttatgacggcggaagtaatggcggaagtggtatcgttgttaggtagtcgttgtttggcgtcgcggggcgtattttgcgttgggcgcgcggaggtttaggcgggaagttcgagcggcggcgttatggttcgaggtagcgcgcggttggcgggggtttcgaggatttcgggtttcggggtttcggggtttagggtcggcggtcggagcgtttagggttttcgtttaggttttgaggttagagttttcgtttaggtagggtttcgtttgtcgggcgtttattttcgggttttcggag

SEQ ID NO: 18066 - DNA, 531 bp, Artificial Sequence
  chemically treated genomic DNA (Homo sapiens) CpG-island No: 18066
ctccgaaaacccgaaaataaacgcccgacaaacgaaaccctacctaaacgaaaactctaacctcaaaacctaaacgaaaaccctaaacgctccgaccgccgaccctaaaccccgaaaccccgaaacccgaaatcctcgaaacccccgccaaccgcgcgctacctcgaaccataacgccgccgctcgaacttcccgcctaaacctccgcgcgcccaacgcaaaatacgccccgcgacgccaaacaacgactacctaacaacgataccacttccgccattacttccgccgtcataacgacgccctaaccacgtaacctccccgataaaaataccccgctcacgtcaacgacctccaaaattactccaaccgcgaatcccgctaccctttaccccgcgaacctcccaaaacaaccccctattaacccgaccgacttcgaaacccgcgccgattacgaatcctccgccgcgcccacctatcaacgcctcgaccgaccgaaactcccgccgcatacaaacaacgaaacgaaatcgc

SEQ ID NO: 18067 - DNA, 531 bp, Artificial Sequence
  chemically treated genomic DNA (Homo sapiens) CpG-island No: 18067
tttcgggagttcgagggtgggcgttcggtagacgggattttgtttgagcggggattttggttttagggtttaggcgggggttttgagcgtttcggtcgtcgattttggatttcggaatttcggaattcgggattttcgggattttcgttagtcgcgcgttatttcgggttatggcgtcgtcgttcgagtttttcgtttaggttttcgcgcgtttagcgtagagtacgtttcgcgacgttaggtaacggttgtttggtaacggtgttattttcgttattattttcgtcgttatggcggcgttttggttacgtgattttttcggtgggagtatttcgtttacgttagcggtttttagggttgttttagtcgcgaatttcgttgttttttgtttcgcgggttttttaaggtagttttttgttagttcgatcggtttcgaagttcgcgtcggttgcggatttttcgtcgcgtttatttgttagcgtttcggtcggtcggggttttcgtcgtatgtaagtagcgaggcgaggtcgt

SEQ ID NO: 18068 - DNA, 531 bp, Artificial Sequence
  chemically treated genomic DNA (Homo sapiens) CpG-island No: 18068
acgacctcgcctcgctacttacatacgacgaaaaccccgaccgaccgaaacgctaacaaataaacgcgacgaaaaatccgcaaccgacgcgaacttcgaaaccgatcgaactaacaaaaaactaccttaaaaaacccgcgaaacaaaaaacaacgaaattcgcgactaaaacaaccctaaaaaccgctaacgtaaacgaaatactcccaccgaaaaaatcacgtaaccaaaacgccgccataacgacgaaaataataacgaaaataacaccgttaccaaacaaccgttacctaacgtcgcgaaacgtactctacgctaaacgcgcgaaaacctaaacgaaaaactcgaacgacgacgccataacccgaaataacgcgcgactaacgaaaatcccgaaaatcccgaattccgaaattccgaaatccaaaatcgacgaccgaaacgctcaaaacccccgcctaaaccctaaaaccaaaatccccgctcaaacaaaatcccgtctaccgaacgcccaccctcgaactcccgaaa

SEQ ID NO: 18069 - DNA, 661 bp, Artificial Sequence
  chemically treated genomic DNA (Homo sapiens) CpG-island No: 18069
cgggggaagattcgtttttttttcgtagttcgagttcggcgtagtttattgcggttgcgcgagtttggcgcgcgcggggcgggaacgcggaaggggttggggttgcggcgcggcggcgaggattagatcgggggcggggtcggtagtgggagtgcggggcgcgcggtgatagcgcggggttggcggcgtgggatttagggggcgatagaggtagtagtagttcgaggtttgaggagaggagatcggcggcggcggtaatgttggagatttttcgcgagcggttgttgagcgtgtagtaggattttattttcgggtgggtatacggtgggcgacgaaaagggatttgagggggtcgggtcgtcgtttgggatgtttttgtttcgttttttttttcgcgttacggtttagggttcgttttgtttcgtattttttcgtttcgtttcgtcgaggaaagtaacgaatttttcggcgttttcgcgtcgggcggcgtaaagtaatttaggtttttgcgggtcgtttgtgacgcgtattttttaggatcgggaggcgttcggcggcgtagcggagcgttcggggggggtgtgggattttgcggttttttttcggtagtattagttgggttttggagggaagttatgtgagaagttagcgcgttttatcg

SEQ ID NO: 18070 - DNA, 661 bp, Artificial Sequence
  chemically treated genomic DNA (Homo sapiens) CpG-island No: 18070
cgataaaacgcgctaacttctcacataacttccctccaaaacccaactaatactaccgaaaaaaaaccgcaaaatcccacaccccccccgaacgctccgctacgccgccgaacgcctcccgatcctaaaaaatacgcgtcacaaacgacccgcaaaaacctaaattactttacgccgcccgacgcgaaaacgccgaaaaattcgttactttcctcgacgaaacgaaacgaaaaaatacgaaacaaaacgaaccctaaaccgtaacgcgaaaaaaaaaacgaaacaaaaacatcccaaacgacgacccgaccccctcaaatcccttttcgtcgcccaccgtatacccacccgaaaataaaatcctactacacgctcaacaaccgctcgcgaaaaatctccaacattaccgccgccgccgatctcctctcctcaaacctcgaactactactacctctatcgccccctaaatcccacgccgccaaccccgcgctatcaccgcgcgccccgcactcccactaccgaccccgcccccgatctaatcctcgccgccgcgccgcaaccccaaccccttccgcgttcccgccccgcgcgcgccaaactcgcgcaaccgcaataaactacgccgaactcgaactacgaaaaaaaaacgaatcttcccccg

SEQ ID NO: 18071 - DNA, 661 bp, Artificial Sequence
  chemically treated genomic DNA (Homo sapiens) CpG-island No: 18071
cggtgaggcgcgttggttttttatatgatttttttttagggtttagttgatgttgtcgggaaaggatcgtagggttttatatttttttcgggcgtttcgttgcgtcgtcgagcgtttttcggttttggggggtgcgcgttataggcggttcgtagggatttaagttattttgcgtcgttcgacgcgaggacgtcgggaagttcgttatttttttcggcggggcggggcggggaggtgcgggataggacggattttggatcgtggcgcggggaagggagcgaggtaggggtattttaggcggcggttcggtttttttaggttttttttcgtcgtttatcgtatatttattcggaggtgaaattttgttgtacgtttagtagtcgttcgcgaagggtttttagtattgtcgtcgtcgtcggttttttttttttaggtttcgggttgttgttgtttttgtcgttttttgggttttacgtcgttaatttcgcgttgttatcgcgcgtttcgtatttttattatcggtttcgttttcggtttggttttcgtcgtcgcgtcgtaattttagtttttttcgcgttttcgtttcgcgcgcgttaggttcgcgtagtcgtagtggattgcgtcgggttcgggttgcggaaaaggggcgggttttttttcg

SEQ ID NO: 18072 - DNA, 661 bp, Artificial Sequence
  chemically treated genomic DNA (Homo sapiens) CpG-island No: 18072
cgaaaaaaaacccgccccttttccgcaacccgaacccgacgcaatccactacgactacgcgaacctaacgcgcgcgaaacgaaaacgcgaaaaaaactaaaattacgacgcgacgacgaaaaccaaaccgaaaacgaaaccgataataaaaatacgaaacgcgcgataacaacgcgaaattaacgacgtaaaacccaaaaaacgacaaaaacaacaacaacccgaaacctaaaaaaaaaaaaccgacgacgacgacaatactaaaaacccttcgcgaacgactactaaacgtacaacaaaatttcacctccgaataaatatacgataaacgacgaaaaaaaacctaaaaaaaccgaaccgccgcctaaaatacccctacctcgctcccttccccgcgccacgatccaaaatccgtcctatcccgcacctccccgccccgccccgccgaaaaaaataacgaacttcccgacgtcctcgcgtcgaacgacgcaaaataacttaaatccctacgaaccgcctataacgcgcaccccccaaaaccgaaaaacgctcgacgacgcaacgaaacgcccgaaaaaaatataaaaccctacgatcctttcccgacaacatcaactaaaccctaaaaaaaaatcatataaaaaaccaacgcgcctcaccg

SEQ ID NO: 18073 - DNA, 1197 bp, Artificial Sequence
  chemically treated genomic DNA (Homo sapiens) CpG-island No: 18073
tagtttcgcgttgtcgggggggcgggatatgtcggttgtttattagtgttcgcgattaattcgtaggtagtttcgttttcgtttttttcgggagagggcgcgcggaggattcgtcgtcgtcggtgtgaggcggttcgttttggtttttttgttcgggaagttcgtttaggtaattgagtttggtcgggtattttcggaggacgcgttatttttttacgtttcgtttcggtcgttgtatgggcggtgttcgggacgcgggggttgcgtttgtgcgggatcgcggggtagcggtcgttcgtgcgagtacgtttgattgacgcgtcggtcgtcgggtttgcggtttgtgggcggggttgtcgtgcgtgatagggtcgttcgtggtcgtcgggttgtgttcggggtcgcgtgagaaagttttgcgggattgagggttgggtgggtcgatcgggaacggcgcgcgttttcgtcgttatcgcgttttcgttttcgtttgcggtttgtttgggggtcgcggggcgtaggcgcggcgggtcgacgggcgggggttttttttacgggtgcgcgggcgtttttgttttcggcgtcgaagcggggtggggttttagggtagtttcgtttcgtcgcgttgaggtttcgtttcgtgttcgtttgtaggagtcgtcgtcgggtttcgttcgtttgtcgttttagttttagttttaattttagtcgtcgtcgttgcgtttgttttcgggcggttttggtttgtgtcgtcgtcgtttttagcgtcggagttatggcgggcgtcgcgtttttttgcgttaacggttgcgggttcggcgcgttttcggacgtcgaggtgttgtatttttgtcgtagtttcgaggtgggtatcgttatgattttgttttattttaagaagtcgtagcgattcgagcggaagattttttaggttaagttggagacgcgttagattacgtggagtcggggcgtcgataagatcgagggggttagtaagtgcgtttattttttgtttgggttcgtttcgcgcgggggtcgtgggagttcggttcgattgtttgtatttcggtcggtcgttttagcgatttgggtaaattttcgggtttttttagatttttttcgggtttcgttttcgtttcgtttcgggtggttattgggggcggggggtattcgggttttcggttatttgataggata

SEQ ID NO: 18074 - DNA, 1197 bp, Artificial Sequence
  chemically treated genomic DNA (Homo sapiens) CpG-island No: 18074
tatcctatcaaataaccgaaaacccgaataccccccgcccccaataaccacccgaaacgaaacgaaaacgaaacccgaaaaaaatctaaaaaaacccgaaaatttacccaaatcgctaaaacgaccgaccgaaatacaaacaatcgaaccgaactcccacgacccccgcgcgaaacgaacccaaacaaaaaataaacgcacttactaaccccctcgatcttatcgacgccccgactccacgtaatctaacgcgtctccaacttaacctaaaaaatcttccgctcgaatcgctacgacttcttaaaataaaacaaaatcataacgatacccacctcgaaactacgacaaaaatacaacacctcgacgtccgaaaacgcgccgaacccgcaaccgttaacgcaaaaaaacgcgacgcccgccataactccgacgctaaaaacgacgacgacacaaaccaaaaccgcccgaaaacaaacgcaacgacgacgactaaaattaaaactaaaactaaaacgacaaacgaacgaaacccgacgacgactcctacaaacgaacacgaaacgaaacctcaacgcgacgaaacgaaactaccctaaaaccccaccccgcttcgacgccgaaaacaaaaacgcccgcgcacccgtaaaaaaaacccccgcccgtcgacccgccgcgcctacgccccgcgacccccaaacaaaccgcaaacgaaaacgaaaacgcgataacgacgaaaacgcgcgccgttcccgatcgacccacccaaccctcaatcccgcaaaactttctcacgcgaccccgaacacaacccgacgaccacgaacgaccctatcacgcacgacaaccccgcccacaaaccgcaaacccgacgaccgacgcgtcaatcaaacgtactcgcacgaacgaccgctaccccgcgatcccgcacaaacgcaacccccgcgtcccgaacaccgcccatacaacgaccgaaacgaaacgtaaaaaaataacgcgtcctccgaaaatacccgaccaaactcaattacctaaacgaacttcccgaacaaaaaaaccaaaacgaaccgcctcacaccgacgacgacgaatcctccgcgcgccctctcccgaaaaaaacgaaaacgaaactacctacgaattaatcgcgaacactaataaacaaccgacatatcccgcccccccgacaacgcgaaacta

SEQ ID NO: 18075 - DNA, 1197 bp, Artificial Sequence
  chemically treated genomic DNA (Homo sapiens) CpG-island No: 18075
tgttttgttaggtgatcgaggattcggatgtttttcgtttttagtgattattcgagacgaagcgggggcggggttcggagggagtttgggagggttcgaaagtttgtttaagtcgttggggcggtcggtcggggtgtaagtagtcgggtcgggtttttacgattttcgcgcggggcgggtttaggtaggaagtgggcgtatttattggttttttcgattttgtcggcgtttcggttttacgtgatttggcgcgtttttagtttgatttggaaggtttttcgttcgggtcgttgcgattttttggagtagaataaagttatgacggtgtttatttcgaggttgcggtagaggtgtagtatttcggcgttcgagggcgcgtcgggttcgtagtcgttggcgtaaggggacgcggcgttcgttatggtttcgacgttgggggcggcggcggtataggttaggatcgttcgggagtaagcgtaacggcggcggttgaggttggggttgaggttgaggcggtagacgagcgggattcggcggcggtttttgtaggcggatacggggcggggttttagcgcggcggggcggggttgttttgaggttttatttcgtttcggcgtcgggaataaaggcgttcgcgtattcgtggggaggattttcgttcgtcggttcgtcgcgtttgcgtttcgcgatttttagataggtcgtaggcggggacggaggcgcgatggcggcgggagcgcgcgtcgttttcggtcgatttatttagtttttagtttcgtagagtttttttacgcggtttcggatatagttcggcggttacgagcggttttgttacgtacggtagtttcgtttataggtcgtaggttcggcggtcggcgcgttagttaggcgtattcgtacgggcggtcgttatttcgcggtttcgtatagacgtagttttcgcgtttcgaatatcgtttatgtagcgatcgggacgggacgtgaggggatggcgcgtttttcgggaatgttcggttaaatttagttatttgggcgggtttttcggataagggagttaggacgggtcgttttatatcggcggcggcgggtttttcgcgcgttttttttcgggaggggcgggggcggggttgtttgcggattggtcgcgggtattgatggatagtcgatatgtttcgttttttcggtagcgcggggttg

SEQ ID NO: 18076 - DNA, 1197 bp, Artificial Sequence
  chemically treated genomic DNA (Homo sapiens) CpG-island No: 18076
caaccccgcgctaccgaaaaaacgaaacatatcgactatccatcaatacccgcgaccaatccgcaaacaaccccgcccccgcccctcccgaaaaaaaacgcgcgaaaaacccgccgccgccgatataaaacgacccgtcctaactcccttatccgaaaaacccgcccaaataactaaatttaaccgaacattcccgaaaaacgcgccatcccctcacgtcccgtcccgatcgctacataaacgatattcgaaacgcgaaaactacgtctatacgaaaccgcgaaataacgaccgcccgtacgaatacgcctaactaacgcgccgaccgccgaacctacgacctataaacgaaactaccgtacgtaacaaaaccgctcgtaaccgccgaactatatccgaaaccgcgtaaaaaaactctacgaaactaaaaactaaataaatcgaccgaaaacgacgcgcgctcccgccgccatcgcgcctccgtccccgcctacgacctatctaaaaatcgcgaaacgcaaacgcgacgaaccgacgaacgaaaatcctccccacgaatacgcgaacgcctttattcccgacgccgaaacgaaataaaacctcaaaacaaccccgccccgccgcgctaaaaccccgccccgtatccgcctacaaaaaccgccgccgaatcccgctcgtctaccgcctcaacctcaaccccaacctcaaccgccgccgttacgcttactcccgaacgatcctaacctataccgccgccgcccccaacgtcgaaaccataacgaacgccgcgtccccttacgccaacgactacgaacccgacgcgccctcgaacgccgaaatactacacctctaccgcaacctcgaaataaacaccgtcataactttattctactccaaaaaatcgcaacgacccgaacgaaaaaccttccaaatcaaactaaaaacgcgccaaatcacgtaaaaccgaaacgccgacaaaatcgaaaaaaccaataaatacgcccacttcctacctaaacccgccccgcgcgaaaatcgtaaaaacccgacccgactacttacaccccgaccgaccgccccaacgacttaaacaaactttcgaaccctcccaaactccctccgaaccccgcccccgcttcgtctcgaataatcactaaaaacgaaaaacatccgaatcctcgatcacctaacaaaaca

SEQ ID NO: 18077 - DNA, 613 bp, Artificial Sequence
  chemically treated genomic DNA (Homo sapiens) CpG-island No: 18077
tgtttcgcggcgtaggtggcgtaagggttcgcggcgcggtttataggattcgaattttcggcggggtatttgaaggcgcggatgaacgcggatagggtttttaggattaatttattttatggttttttacgtcgcgttaatcggaaaagagattagtatgttttgcgtatgcgtttaaatagtggttttgatttcgcgataatgttttgtttttcggttttattcgtagagcggttgggtgggttaatttcgagaagcgcggttttttttggtcgttggggggcgtcgttgggtcgttaggtcggcgcggtaatttatagagttgtcgtagttttgagcgtttcgcggtttttcggtaatgtgtcgattcgcgttcgttgttgttggatttttagggaagcggttgggttcggggttcgagtttcggtagttatacgtattggtatagtttagtgatgtttattgatagcgtggatttcggtacgtttgttttttaaattttttttttttcgcgtttttcgtattagtttatgtttttaaaaggaagtttggttcgattttttttttttagtattttgttttaacgtggattcgtggtaagggaagtgttcgg

SEQ ID NO: 18078 - DNA, 613 bp, Artificial Sequence
  chemically treated genomic DNA (Homo sapiens) CpG-island No: 18078
ccgaacacttcccttaccacgaatccacgttaaaacaaaatactaaaaaaaaaaaatcgaaccaaacttccttttaaaaacataaactaatacgaaaaacgcgaaaaaaaaaaaatttaaaaaacaaacgtaccgaaatccacgctatcaataaacatcactaaactataccaatacgtataactaccgaaactcgaaccccgaacccaaccgcttccctaaaaatccaacaacaacgaacgcgaatcgacacattaccgaaaaaccgcgaaacgctcaaaactacgacaactctataaattaccgcgccgacctaacgacccaacgacgccccccaacgaccaaaaaaaaccgcgcttctcgaaattaacccacccaaccgctctacgaataaaaccgaaaaacaaaacattatcgcgaaatcaaaaccactatttaaacgcatacgcaaaacatactaatctcttttccgattaacgcgacgtaaaaaaccataaaataaattaatcctaaaaaccctatccgcgttcatccgcgccttcaaataccccgccgaaaattcgaatcctataaaccgcgccgcgaacccttacgccacctacgccgcgaaaca

SEQ ID NO: 18079 - DNA, 613 bp, Artificial Sequence
  chemically treated genomic DNA (Homo sapiens) CpG-island No: 18079
tcggatattttttttattacgagtttacgttagagtaaggtgttgagggagggaggtcgggttaggtttttttttgagaatataagttggtgcggagggcgcgaggggagaggggtttgagggataagcgtgtcggaatttacgttgttagtgaatattattgggttgtattagtacgtgtgattatcgaagttcgagtttcgaatttagtcgtttttttaggggtttagtagtagcgggcgcgaatcggtatattatcgggggatcgcggggcgtttaggattgcgataattttgtgggttatcgcgtcggtttagcggtttagcgacgttttttagcggttagagaaggtcgcgtttttcggggttggtttatttaatcgttttgcgggtaggatcgaggagtaaagtattatcgcgagattagggttattatttgagcgtatgcgtaagatatgttagtttttttttcggttagcgcggcgtgagaagttatgaggtgagttggttttgaaagttttattcgcgtttattcgcgtttttaggtgtttcgtcgagggttcggattttgtaggtcgcgtcgcggatttttgcgttatttgcgtcgcggggta

SEQ ID NO: 18080 - DNA, 613 bp, Artificial Sequence
  chemically treated genomic DNA (Homo sapiens) CpG-island No: 18080
taccccgcgacgcaaataacgcaaaaatccgcgacgcgacctacaaaatccgaaccctcgacgaaacacctaaaaacgcgaataaacgcgaataaaactttcaaaaccaactcacctcataacttctcacgccgcgctaaccgaaaaaaaaactaacatatcttacgcatacgctcaaataataaccctaatctcgcgataatactttactcctcgatcctacccgcaaaacgattaaataaaccaaccccgaaaaacgcgaccttctctaaccgctaaaaaacgtcgctaaaccgctaaaccgacgcgataacccacaaaattatcgcaatcctaaacgccccgcgatcccccgataatataccgattcgcgcccgctactactaaacccctaaaaaaacgactaaattcgaaactcgaacttcgataatcacacgtactaatacaacccaataatattcactaacaacgtaaattccgacacgcttatccctcaaacccctctcccctcgcgccctccgcaccaacttatattctcaaaaaaaaacctaacccgacctccctccctcaacaccttactctaacgtaaactcgtaataaaaaaaatatccga

SEQ ID NO: 18081 - DNA, 561 bp, Artificial Sequence
  chemically treated genomic DNA (Homo sapiens) CpG-island No: 18081
ggcgtttatatggtaacgtacgacggttgatcggagcgggtcggagtattaggaagtcgtcgtgacgttgttcgcggatttcggtagtttttcgtatttcgtttttcgtcgtcgggttttgcgttttagtttcgttggtcgtttcggtttaggttcggcgttttttttcgttatttgtttgatcgtttttttcgtttcggattgatttgtttcggttgtttacggcgttatcgtcgtcgtttcgtaggtttcgtagaattttttcgtttttgttaaaattttttttattaatttttaggttcgcggcggtcgtagcgttatacgtttcgcggttcggtttcgttttcgttagcgagacgttatcgcgttgttcggtttttttttttttacgttttttttcgttcggcggcggttaattattacgttttttggagatttttttaattttgttttttcgtttatcgtacgttgtttcgggttagtttgtggcgttttttggtgcgggatgcggacgtagtagttaagggaggagtaggggagcgttaggtttagtagaataag

SEQ ID NO: 18082 - DNA, 561 bp, Artificial Sequence
  chemically treated genomic DNA (Homo sapiens) CpG-island No: 18082
cttattctactaaacctaacgctcccctactcctcccttaactactacgtccgcatcccgcaccaaaaaacgccacaaactaacccgaaacaacgtacgataaacgaaaaaacaaaattaaaaaaatctccaaaaaacgtaataattaaccgccgccgaacgaaaaaaaacgtaaaaaaaaaaaaaccgaacaacgcgataacgtctcgctaacgaaaacgaaaccgaaccgcgaaacgtataacgctacgaccgccgcgaacctaaaaattaataaaaaaaattttaacaaaaacgaaaaaattctacgaaacctacgaaacgacgacgataacgccgtaaacaaccgaaacaaatcaatccgaaacgaaaaaaacgatcaaacaaataacgaaaaaaaacgccgaacctaaaccgaaacgaccaacgaaactaaaacgcaaaacccgacgacgaaaaacgaaatacgaaaaactaccgaaatccgcgaacaacgtcacgacgacttcctaatactccgacccgctccgatcaaccgtcgtacgttaccatataaacgcc

SEQ ID NO: 18083 - DNA, 561 bp, Artificial Sequence
  chemically treated genomic DNA (Homo sapiens) CpG-island No: 18083
tttgttttattggatttggcgtttttttgttttttttttagttgttacgttcgtatttcgtattagagggcgttataggttggttcggggtagcgtgcggtgggcggagaggtagaattaggggagtttttaggaggcgtggtgattggtcgtcgtcgggcggaagggggcgtggggagggaaaggtcgagtagcgcggtgacgtttcgttggcgggggcggggtcgggtcgcggagcgtgtgacgttgcggtcgtcgcggatttggggattaatgggaaaagttttggtaggagcgggagaattttgcggagtttgcgggacggcggcggtggcgtcgtaggtagtcgggataggttagttcgagacgagagaagcggttaggtaagtggcggagggaagcgtcgggtttgggtcgaggcggttagcgggattggggcgtaaggttcggcggcggggaacggggtgcggggagttgtcggggttcgcggatagcgttacggcggttttttgatgtttcggttcgtttcggttagtcgtcgtgcgttgttatgtaggcgtt

SEQ ID NO: 18084 - DNA, 561 bp, Artificial Sequence
  chemically treated genomic DNA (Homo sapiens) CpG-island No: 18084
aacgcctacataacaacgcacgacgactaaccgaaacgaaccgaaacatcaaaaaaccgccgtaacgctatccgcgaaccccgacaactccccgcaccccgttccccgccgccgaaccttacgccccaatcccgctaaccgcctcgacccaaacccgacgcttccctccgccacttacctaaccgcttctctcgtctcgaactaacctatcccgactacctacgacgccaccgccgccgtcccgcaaactccgcaaaattctcccgctcctaccaaaacttttcccattaatccccaaatccgcgacgaccgcaacgtcacacgctccgcgacccgaccccgcccccgccaacgaaacgtcaccgcgctactcgacctttccctccccacgcccccttccgcccgacgacgaccaatcaccacgcctcctaaaaactcccctaattctacctctccgcccaccgcacgctaccccgaaccaacctataacgccctctaatacgaaatacgaacgtaacaactaaaaaaaaaacaaaaaaacgccaaatccaataaaacaaa

SEQ ID NO: 18085 - DNA, 694 bp, Artificial Sequence
  chemically treated genomic DNA (Homo sapiens) CpG-island No: 18085
tcgttttttcggtttcgttttaatttcgcggtttcgtttttttttttcggtttcgtttcgttttttcgggttcgtcgtttttcgcggttttcgcgtttttttttcgggtcgcgttaggtcgggtttgcggcggttgtgtcgtatttagagagtcggggagtcgttttcgtatttaggttttttcgcgttgtttggtcgttggtgaagttcgcggcgcgcgtttttttcggattttgtagggtacggttttttttttatttttttttttcgtgggtttttgttttttttttttggcgtcggggcggggtcggggtcgagttagcgcgtagtttcgcgttttggggagtttggacgtttggtagaggttttcgttgttcgttttttttcgttcgcggtttcgcgttttcgcgttttcgttttacgtttgcggggtttgttggggtttttgagaattgttgacgtgtttcgggttttttttacgttatagtttgtttgtaggttgtgaggcgtcgttcggacgtgtgcgcggtttagggttgtttatatcgcgggggattgcgggtcgttttatattcgcgtttagtgttgcgtcggtagttacgcgtcggttatatgttcgtttgtgtttgtgatttttgtgtttgttgttttgatttttttttgatattcgatggtttttgtttaattaggtttg

SEQ ID NO: 18086 - DNA, 694 bp, Artificial Sequence
  chemically treated genomic DNA (Homo sapiens) CpG-island No: 18086
caaacctaattaaacaaaaaccatcgaatatcaaaaaaaaatcaaaacaacaaacacaaaaatcacaaacacaaacgaacatataaccgacgcgtaactaccgacgcaacactaaacgcgaatataaaacgacccgcaatcccccgcgatataaacaaccctaaaccgcgcacacgtccgaacgacgcctcacaacctacaaacaaactataacgtaaaaaaaacccgaaacacgtcaacaattctcaaaaaccccaacaaaccccgcaaacgtaaaacgaaaacgcgaaaacgcgaaaccgcgaacgaaaaaaaacgaacaacgaaaacctctaccaaacgtccaaactccccaaaacgcgaaactacgcgctaactcgaccccgaccccgccccgacgccaaaaaaaaaaaacaaaaacccacgaaaaaaaaaaataaaaaaaaaaccgtaccctacaaaatccgaaaaaaacgcgcgccgcgaacttcaccaacgaccaaacaacgcgaaaaaacctaaatacgaaaacgactccccgactctctaaatacgacacaaccgccgcaaacccgacctaacgcgacccgaaaaaaaaacgcgaaaaccgcgaaaaacgacgaacccgaaaaaacgaaacgaaaccgaaaaaaaaaaacgaaaccgcgaaattaaaacgaaaccgaaaaaacga

SEQ ID NO: 18087 - DNA, 694 bp, Artificial Sequence
  chemically treated genomic DNA (Homo sapiens) CpG-island No: 18087
taggtttggttaggtaaaaattatcggatgttagagggaaattaaggtagtaggtataggaattataagtataggcgggtatgtggtcgacgcgtggttgtcggcgtagtattgagcgcgggtgtggggcgattcgtagtttttcgcggtgtaaataattttgagtcgcgtatacgttcgaacgacgttttatagtttgtaggtagattgtagcgtagaaagagttcgaggtacgttagtagtttttaagggttttagtaagtttcgtaagcgtgaagcggaggcgcgggggcgcggggtcgcgggcggggaggggcgggtagcgggggtttttgttaggcgtttagattttttaaagcgcggagttgcgcgttggttcggtttcggtttcgtttcggcgttaaaggaagaagatagagatttacgggagggagaagtaaaggaagggtcgtattttgtagggttcgggagaggcgcgcgtcgcgggttttattagcgattaggtagcgcgagaaggtttgggtgcgggggcggtttttcgattttttagatgcggtataatcgtcgtaagttcggtttagcgcgattcggaaggaagacgcggaggtcgcgaggagcggcgggttcggggaggcggggcggagtcggggaggaggggcggggtcgcggggttggggcggggtcggggaggcgg

SEQ ID NO: 18088 - DNA, 694 bp, Artificial Sequence
  chemically treated genomic DNA (Homo sapiens) CpG-island No: 18088
ccgcctccccgaccccgccccaaccccgcgaccccgcccctcctccccgactccgccccgcctccccgaacccgccgctcctcgcgacctccgcgtcttccttccgaatcgcgctaaaccgaacttacgacgattataccgcatctaaaaaatcgaaaaaccgcccccgcacccaaaccttctcgcgctacctaatcgctaataaaacccgcgacgcgcgcctctcccgaaccctacaaaatacgacccttcctttacttctccctcccgtaaatctctatcttcttcctttaacgccgaaacgaaaccgaaaccgaaccaacgcgcaactccgcgctttaaaaaatctaaacgcctaacaaaaacccccgctacccgcccctccccgcccgcgaccccgcgcccccgcgcctccgcttcacgcttacgaaacttactaaaacccttaaaaactactaacgtacctcgaactctttctacgctacaatctacctacaaactataaaacgtcgttcgaacgtatacgcgactcaaaattatttacaccgcgaaaaactacgaatcgccccacacccgcgctcaatactacgccgacaaccacgcgtcgaccacatacccgcctatacttataattcctatacctactaccttaatttccctctaacatccgataatttttacctaaccaaaccta

SEQ ID NO: 18089 - DNA, 885 bp, Artificial Sequence
  chemically treated genomic DNA (Homo sapiens) CpG-island No: 18089
ttacggggagtcgtcgtcgtcgttttcgtcgtcgttttcgtttttttcgtcgtcgttatcgttttcgtcgtcgtcgtcgtgggatagcgcggtgatttattggtgagcgtggttgagcgggtgttcgttgttttgtagagcgtcgtagtcgttttgtattaggttttgcgtttcgcggtagtttttcgcgttttgttgtatgtcgtcgggcggttcggcgtgtacgatggaggcgttggaggtgagtaggttgtagtggttagacgttgcggtcgttatgattttcggagtcggattgagcgtttcggttaaaggagtcgcgtatttgatagttattttttcgtttcgggtttttttttttcgttcgttttttttgtttttttttttttttatagcgggtagtttcgacgttcgtttcgacgttttttgttgttgtttttgttattattgttgttgttgtcgtcgtcgtcgtttttcgttcgttttcgttttttttttttttttttttttttttttcgttttcgtttattttttgattagttcggcgtttttttttttttttgttttttttagttttttttcgtttttttggtagcgtcggttcgtagcggtacgcgtttgggtttcgtttttttcgtttttttttattggtttcgcgttttttgatttacgtggatatcgttagtaattttttaggtcggcgttattgattggcgtagagttattttttttttttttttcgggttcggagtttttttagttttttttttcgtttttttcgtttttcgatttagatttttttagtttttattttttcgttttttttttattcggggtttttttcgttttttttcggatgggtttcgttttttatttgttttttag

SEQ ID NO: 18090 - DNA, 885 bp, Artificial Sequence
  chemically treated genomic DNA (Homo sapiens) CpG-island No: 18090
ctaaaaaacaaataaaaaacgaaacccatccgaaaaaaaacgaaaaaaaccccgaataaaaaaaaaacgaaaaaataaaaactaaaaaaatctaaatcgaaaaacgaaaaaaacgaaaaaaaaaactaaaaaaactccgaacccgaaaaaaaaaaaaaaaataactctacgccaatcaataacgccgacctaaaaaattactaacgatatccacgtaaatcaaaaaacgcgaaaccaataaaaaaaaacgaaaaaaacgaaacccaaacgcgtaccgctacgaaccgacgctaccaaaaaaacgaaaaaaaactaaaaaaaacaaaaaaaaaaaaaaacgccgaactaatcaaaaaataaacgaaaacgaaaaaaaaaaaaaaaaaaaaaaaaaaaacgaaaacgaacgaaaaacgacgacgacgacaacaacaacaataataacaaaaacaacaacaaaaaacgtcgaaacgaacgtcgaaactacccgctataaaaaaaaaaaaaaacaaaaaaaacgaacgaaaaaaaaaaacccgaaacgaaaaaataactatcaaatacgcgactcctttaaccgaaacgctcaatccgactccgaaaatcataacgaccgcaacgtctaaccactacaacctactcacctccaacgcctccatcgtacacgccgaaccgcccgacgacatacaacaaaacgcgaaaaactaccgcgaaacgcaaaacctaatacaaaacgactacgacgctctacaaaacaacgaacacccgctcaaccacgctcaccaataaatcaccgcgctatcccacgacgacgacgacgaaaacgataacgacgacgaaaaaaacgaaaacgacgacgaaaacgacgacgacgactccccgtaa

SEQ ID NO: 18091 - DNA, 885 bp, Artificial Sequence
  chemically treated genomic DNA (Homo sapiens) CpG-island No: 18091
ttgggagatagatggggggcggggtttattcgagagagggcggaggaggtttcgggtgaggaagaagcgggggggtgagaattgagagaatttgaatcgggaggcgaaggggacggggaggagggttaggaggatttcgagttcgggggagggggagggagtagttttgcgttaattagtggcgtcggtttgggaggttgttagcggtatttacgtaaattaaagggcgcggagttaatgggagggggcggagggggcggggtttaggcgcgtgtcgttgcgagtcggcgttgttaagagagcgggagagagttggagagagtagggagaggggggagcgtcgagttagttagagagtgagcgagagcgagaaggagggagaggaggagaaagagagcgagggcgggcgggaggcggcggcggcggtagtagtagtagtaatagtaggagtagtaatagaaggcgtcggagcgggcgtcggagttgttcgttgtgggagagagaggagatagaaagagcgagcgaggagagggagttcgaggcgaaaaagtaattgttaaatgcgcggtttttttaatcggagcgtttagttcggtttcgagagttatggcgatcgtagcgtttaattattatagtttgtttatttttagcgtttttatcgtgtacgtcgagtcgttcggcggtatgtagtagggcgcggggggttatcgcgaagcgtagagtttggtgtagggcgattacggcgttttgtagagtaacggatattcgtttagttacgtttattagtggattatcgcgttgttttacggcggcggcggcgggggcggtggcggcggcggggggggcgggggcggcggcgggggcggcggcgacggtttttcgtgg

SEQ ID NO: 18092 - DNA, 885 bp, Artificial Sequence
  chemically treated genomic DNA (Homo sapiens) CpG-island No: 18092
ccacgaaaaaccgtcgccgccgcccccgccgccgcccccgccccccccgccgccgccaccgcccccgccgccgccgccgtaaaacaacgcgataatccactaataaacgtaactaaacgaatatccgttactctacaaaacgccgtaatcgccctacaccaaactctacgcttcgcgataaccccccgcgccctactacataccgccgaacgactcgacgtacacgataaaaacgctaaaaataaacaaactataataattaaacgctacgatcgccataactctcgaaaccgaactaaacgctccgattaaaaaaaccgcgcatttaacaattactttttcgcctcgaactccctctcctcgctcgctctttctatctcctctctctcccacaacgaacaactccgacgcccgctccgacgccttctattactactcctactattactactactactaccgccgccgccgcctcccgcccgccctcgctctctttctcctcctctccctccttctcgctctcgctcactctctaactaactcgacgctcccccctctccctactctctccaactctctcccgctctcttaacaacgccgactcgcaacgacacgcgcctaaaccccgccccctccgccccctcccattaactccgcgccctttaatttacgtaaataccgctaacaacctcccaaaccgacgccactaattaacgcaaaactactccctccccctcccccgaactcgaaatcctcctaaccctcctccccgtccccttcgcctcccgattcaaattctctcaattctcacccccccgcttcttcctcacccgaaacctcctccgccctctctcgaataaaccccgccccccatctatctcccaa

SEQ ID NO: 18093 - DNA, 568 bp, Artificial Sequence
  chemically treated genomic DNA (Homo sapiens) CpG-island No: 18093
cgtagagcgcgcgttcgtgggggtaatcggcggaaaattagggacgcgggtatagtcgtagattgggcgtggggggtatcggaatggtcgagtttgggacgttgggatttttggtcgtcgcggggcgattaggcgggcggagacgtttcgcgttttttcgggtcgcgcggttttaggcgtatttttgtatttagttttcgcgcgtcgcgttgcgttgtttttttcggatagttgatttattggttcggtcgtttagattgtttggcgtcggttgcgtgacgttatttatttacggagttcgtttttttcgtttcgttggcgtcggtcgggcggtcgttttgataacgtagacgttagttcgtataatgatttttagttggagtagtttagttagtttgcgcgtttattcgtttgtttgcgttgggttttagggcgttcgggtgagtttttttttttttttttcgttttttttttttttttaggttttcgcgggttttttttgttagggaatttattcgttgtagttttttagggttttggttttagttttttttgaagcgcgtttgta

SEQ ID NO: 18094 - DNA, 568 bp, Artificial Sequence
  chemically treated genomic DNA (Homo sapiens) CpG-island No: 18094
tacaaacgcgcttcaaaaaaaactaaaaccaaaaccctaaaaaactacaacgaataaattccctaacaaaaaaaacccgcgaaaacctaaaaaaaaaaaaaaaacgaaaaaaaaaaaaaaaaactcacccgaacgccctaaaacccaacgcaaacaaacgaataaacgcgcaaactaactaaactactccaactaaaaatcattatacgaactaacgtctacgttatcaaaacgaccgcccgaccgacgccaacgaaacgaaaaaaacgaactccgtaaataaataacgtcacgcaaccgacgccaaacaatctaaacgaccgaaccaataaatcaactatccgaaaaaaacaacgcaacgcgacgcgcgaaaactaaatacaaaaatacgcctaaaaccgcgcgacccgaaaaaacgcgaaacgtctccgcccgcctaatcgccccgcgacgaccaaaaatcccaacgtcccaaactcgaccattccgataccccccacgcccaatctacgactatacccgcgtccctaattttccgccgattacccccacgaacgcgcgctctacg

SEQ ID NO: 18095 - DNA, 568 bp, Artificial Sequence
  chemically treated genomic DNA (Homo sapiens) CpG-island No: 18095
tgtaagcgcgttttagaaaggattgggattagagttttagaaaattatagcgagtggattttttggtaggggaaattcgcgagagtttgggaaaaaaaaaaaaacgagagggagagaaaaaaatttattcgggcgttttgaagtttagcgtaagtaagcgagtgagcgcgtaggttggttgggttgttttagttggaagttattgtgcgggttggcgtttgcgttgttagggcgatcgttcggtcggcgttagcggagcgggggaggcgggtttcgtgaatgggtgacgttacgtagtcggcgttaggtagtttgggcggtcgagttaatgaattagttgttcgggggaggtagcgtagcgcggcgcgcgggagttgggtgtaggaatgcgtttggagtcgcgcggttcgggagggcgcgagacgttttcgttcgtttggtcgtttcgcggcggttagaggttttagcgttttaggttcggttatttcggtgttttttacgtttagtttgcggttgtgttcgcgtttttagtttttcgtcggttatttttacgggcgcgcgttttgcg

SEQ ID NO: 18096 - DNA, 568 bp, Artificial Sequence
  chemically treated genomic DNA (Homo sapiens) CpG-island No: 18096
cgcaaaacgcgcgcccgtaaaaataaccgacgaaaaactaaaaacgcgaacacaaccgcaaactaaacgtaaaaaacaccgaaataaccgaacctaaaacgctaaaacctctaaccgccgcgaaacgaccaaacgaacgaaaacgtctcgcgccctcccgaaccgcgcgactccaaacgcattcctacacccaactcccgcgcgccgcgctacgctacctcccccgaacaactaattcattaactcgaccgcccaaactacctaacgccgactacgtaacgtcacccattcacgaaacccgcctcccccgctccgctaacgccgaccgaacgatcgccctaacaacgcaaacgccaacccgcacaataacttccaactaaaacaacccaaccaacctacgcgctcactcgcttacttacgctaaacttcaaaacgcccgaataaatttttttctctccctctcgtttttttttttttcccaaactctcgcgaatttcccctaccaaaaaatccactcgctataattttctaaaactctaatcccaatcctttctaaaacgcgcttaca

SEQ ID NO: 18097 - DNA, 821 bp, Artificial Sequence
  chemically treated genomic DNA (Homo sapiens) CpG-island No: 18097
agggcgttcggcgttaggaagtttgggtttgggtttttatacgagttcggcgcgtttcgggcgggtttcgggcgcgggttcgtggtttttcgggtcgggtatttgtttcgaatcgaggcgcgaggcgcggtggggcggtggggtggggtggggtaggttggggtgggggcggggtggcgttacgtgttagcggcggtttcgggaaggttttatttttttcgcggttcgtattcgcggcgttcggggtttttttttcgtttcgttcgcggcgtttttcgcggtcgtatagtcgggcgatttcgggtcgggtttcgtttttttcgttggcggatttagcgcgtttttcgttagttttcgcgtttgttgttttcgttatttagttggtgcggtttatggcgagcgtattatggcgattgaaggtaagtggaggttgatagcggggagcgaggatcgggattatttagttggcggggggttcggaggtgcgtcggtaggtcgaggcgttgacggggtcgttttttgtggtttggagtcggttgaagacgcgcgggggttttggtcgcgtttcgggaggcgggtgggcggagcggcgtcgttgggacgtcgggttcgattggttcgttcgtttcggttttcgtggttttgtcggtttttcggcggtcgtacgcggggtaaagcgggttggcgggtaggtatagcgttcgggtcgtcgttttttgtcggtcgcgcggagtggaggtcggggtgaggttttgtagattttacgggacgggttgggaggagcgaggggttacggggggtttaggttgtttttttttttt

SEQ ID NO: 18098 - DNA, 821 bp, Artificial Sequence
  chemically treated genomic DNA (Homo sapiens) CpG-island No: 18098
aaaaaaaaaaaacaacctaaaccccccgtaacccctcgctcctcccaacccgtcccgtaaaatctacaaaacctcaccccgacctccactccgcgcgaccgacaaaaaacgacgacccgaacgctatacctacccgccaacccgctttaccccgcgtacgaccgccgaaaaaccgacaaaaccacgaaaaccgaaacgaacgaaccaatcgaacccgacgtcccaacgacgccgctccgcccacccgcctcccgaaacgcgaccaaaacccccgcgcgtcttcaaccgactccaaaccacaaaaaacgaccccgtcaacgcctcgacctaccgacgcacctccgaaccccccgccaactaaataatcccgatcctcgctccccgctatcaacctccacttaccttcaatcgccataatacgctcgccataaaccgcaccaactaaataacgaaaacaacaaacgcgaaaactaacgaaaaacgcgctaaatccgccaacgaaaaaaacgaaacccgacccgaaatcgcccgactatacgaccgcgaaaaacgccgcgaacgaaacgaaaaaaaaaccccgaacgccgcgaatacgaaccgcgaaaaaaataaaaccttcccgaaaccgccgctaacacgtaacgccaccccgcccccaccccaacctaccccaccccaccccaccgccccaccgcgcctcgcgcctcgattcgaaacaaatacccgacccgaaaaaccacgaacccgcgcccgaaacccgcccgaaacgcgccgaactcgtataaaaacccaaacccaaacttcctaacgccgaacgccct

SEQ ID NO: 18099 - DNA, 821 bp, Artificial Sequence
  chemically treated genomic DNA (Homo sapiens) CpG-island No: 18099
gaaaagaaagggtagtttgagtttttcgtggtttttcgttttttttagttcgtttcgtggggtttgtagggttttatttcgatttttatttcgcgcggtcggtaggaggcggcggttcggacgttgtatttgttcgttagttcgttttgtttcgcgtgcggtcgtcgggaggtcggtaaaattacgaaggtcggggcgagcgagttagtcgggttcggcgttttagcggcgtcgtttcgtttattcgtttttcgagacgcggttaggattttcgcgcgtttttagtcggttttagattataggaggcggtttcgttagcgtttcggtttgtcggcgtattttcgagtttttcgttagttgggtggtttcggttttcgtttttcgttgttagtttttatttatttttaatcgttatgatgcgttcgttatggatcgtattaattggatggcgggggtagtagacgcgagggttggcggaggacgcgttgagttcgttagcgagaggggcggggttcggttcggagtcgttcggttgtgcggtcgcgaggggcgtcgcgggcggggcgagggaggggtttcgagcgtcgcgagtgcgggtcgcggaagaaatggaattttttcggggtcgtcgttggtacgtgacgttatttcgtttttattttaatttattttattttattttatcgttttatcgcgtttcgcgtttcgattcgaaataggtgttcggttcggagagttacgggttcgcgttcgagattcgttcgaagcgcgtcgagttcgtgtgggggtttaagtttaagttttttggcgtcgggcgtttt

SEQ ID NO: 18100 - DNA, 821 bp, Artificial Sequence
  chemically treated genomic DNA (Homo sapiens) CpG-island No: 18100
aaaacgcccgacgccaaaaaacttaaacttaaacccccacacgaactcgacgcgcttcgaacgaatctcgaacgcgaacccgtaactctccgaaccgaacacctatttcgaatcgaaacgcgaaacgcgataaaacgataaaataaaataaaataaattaaaataaaaacgaaataacgtcacgtaccaacgacgaccccgaaaaaattccatttcttccgcgacccgcactcgcgacgctcgaaacccctccctcgccccgcccgcgacgcccctcgcgaccgcacaaccgaacgactccgaaccgaaccccgcccctctcgctaacgaactcaacgcgtcctccgccaaccctcgcgtctactacccccgccatccaattaatacgatccataacgaacgcatcataacgattaaaaataaataaaaactaacaacgaaaaacgaaaaccgaaaccacccaactaacgaaaaactcgaaaatacgccgacaaaccgaaacgctaacgaaaccgcctcctataatctaaaaccgactaaaaacgcgcgaaaatcctaaccgcgtctcgaaaaacgaataaacgaaacgacgccgctaaaacgccgaacccgactaactcgctcgccccgaccttcgtaattttaccgacctcccgacgaccgcacgcgaaacaaaacgaactaacgaacaaatacaacgtccgaaccgccgcctcctaccgaccgcgcgaaataaaaatcgaaataaaaccctacaaaccccacgaaacgaactaaaaaaaacgaaaaaccacgaaaaactcaaactaccctttcttttc

SEQ ID NO: 18101 - DNA, 656 bp, Artificial Sequence
  chemically treated genomic DNA (Homo sapiens) CpG-island No: 18101
taattcgcgttttcgtttcgtcgtcgtcgttatgtacgacgtagagcgcggttggagtttgtttttcgcgggttgcggttttttgggtttttattacgtcggggcgattcgttgtttgagcgagtacgtttcgtatttttttcgcgacgcgcgtatgttgttcggcgtttcggtcggggcgttgtattgcgtcggcgtttttttcggtatttcgttgggtgcgtttggggacgttgttcgggttttacgtgcggagtgggtgttttttaggtcggggagcgggggatttttaggggtcgcggggttttggaggagcgggtatcggacgcggatacggcggggtgtatttcgagggtttttttcgaggtagatgttttttgcgggggcgttgtttttgggttcgggaagggggcgttggaatttcgagcggttcgggtcgaagtttgggattttcgtgcgtttttatttttatttttattaggcgttcgtgtatgaagggagatttttattttcggattgagagtcggagcgtttcggagcgacggggagtagggagcgggattcggggcggagggtagtgttggtttttgcggatttcgggttttttgtgttttttcgggaggggttggacgggttgagttgtcgaggggtcgatt

SEQ ID NO: 18102 - DNA, 656 bp, Artificial Sequence
  chemically treated genomic DNA (Homo sapiens) CpG-island No: 18102
aatcgacccctcgacaactcaacccgtccaacccctcccgaaaaaacacaaaaaacccgaaatccgcaaaaaccaacactaccctccgccccgaatcccgctccctactccccgtcgctccgaaacgctccgactctcaatccgaaaataaaaatctcccttcatacacgaacgcctaataaaaataaaaataaaaacgcacgaaaatcccaaacttcgacccgaaccgctcgaaattccaacgcccccttcccgaacccaaaaacaacgcccccgcaaaaaacatctacctcgaaaaaaaccctcgaaatacaccccgccgtatccgcgtccgatacccgctcctccaaaaccccgcgacccctaaaaatcccccgctccccgacctaaaaaacacccactccgcacgtaaaacccgaacaacgtccccaaacgcacccaacgaaataccgaaaaaaacgccgacgcaatacaacgccccgaccgaaacgccgaacaacatacgcgcgtcgcgaaaaaaatacgaaacgtactcgctcaaacaacgaatcgccccgacgtaataaaaacccaaaaaaccgcaacccgcgaaaaacaaactccaaccgcgctctacgtcgtacataacgacgacgacgaaacgaaaacgcgaatta

SEQ ID NO: 18103 - DNA, 656 bp, Artificial Sequence
  chemically treated genomic DNA (Homo sapiens) CpG-island No: 18103
aatcggtttttcggtagtttagttcgtttagtttttttcgagaggatataggggattcggagttcgtaggggttagtattatttttcgtttcgggtttcgttttttatttttcgtcgtttcgagacgtttcgatttttagttcggaggtgagggtttttttttatgtacgggcgtttgatgggggtaggggtggggacgtacgagagttttaggtttcggttcggatcgttcggggttttaacgtttttttttcgggtttaggaatagcgttttcgtaggaagtatttgtttcggagggggttttcgggatgtatttcgtcgtgttcgcgttcgatgttcgtttttttagggtttcgcgatttttggggatttttcgtttttcggtttagggggtatttatttcgtacgtggagttcgggtagcgtttttagacgtatttagcgggatatcggagaggacgtcgacgtagtgtaacgtttcggtcgaagcgtcgaataatatgcgcgcgtcgcggaggaggtgcggggcgtgttcgtttaggtagcgggtcgtttcgacgtggtagaagtttaggaagtcgtagttcgcgaaggataagttttagtcgcgttttgcgtcgtatatggcggcggcggcggggcgggggcgcgggtta

SEQ ID NO: 18104 - DNA, 656 bp, Artificial Sequence
  chemically treated genomic DNA (Homo sapiens) CpG-island No: 18104
taacccgcgcccccgccccgccgccgccgccatatacgacgcaaaacgcgactaaaacttatccttcgcgaactacgacttcctaaacttctaccacgtcgaaacgacccgctacctaaacgaacacgccccgcacctcctccgcgacgcgcgcatattattcgacgcttcgaccgaaacgttacactacgtcgacgtcctctccgatatcccgctaaatacgtctaaaaacgctacccgaactccacgtacgaaataaataccccctaaaccgaaaaacgaaaaatccccaaaaatcgcgaaaccctaaaaaaacgaacatcgaacgcgaacacgacgaaatacatcccgaaaaccccctccgaaacaaatacttcctacgaaaacgctattcctaaacccgaaaaaaaaacgttaaaaccccgaacgatccgaaccgaaacctaaaactctcgtacgtccccacccctacccccatcaaacgcccgtacataaaaaaaaaccctcacctccgaactaaaaatcgaaacgtctcgaaacgacgaaaaataaaaaacgaaacccgaaacgaaaaataatactaacccctacgaactccgaatcccctatatcctctcgaaaaaaactaaacgaactaaactaccgaaaaaccgatt

SEQ ID NO: 18105 - DNA, 666 bp, Artificial Sequence
  chemically treated genomic DNA (Homo sapiens) CpG-island No: 18105
cgggggttgtttttatttcgatgcgtttagatcgggattgagttgttgtggacgtgttcggtgggtaggcggtgagttcgtatcgggtaagatacgggtttgattttttttcgtatttattttttttttgggcgttcgtaggattcgaagtagcgtaagggcgttttggttgtttaaacgcggggttttagcgtcgtttgtcggtcgtcgtgtgtaacgtcgattcggaagtttcgtcgtttttgtttgcgttggggacgcgcgggatattcggtttcgggaatttcggtgggggttcgattttgttttgggcgtagggaacgcggttttgtaggacgggttgtcgtcgagggtatcggtaagtttcggggtgtggatcgtgtttgcgttcgttgtattcgttttgggtaaggttgtggttttttgagttttagttattttttgcggaggacgaatagggtgggaattcgattttttttatcgtagcgtttttgtaatttcgttttcgacgacgttttagttttttttttagtttagttttatttttaatattttttttattttattcgttgggtatttttcgtaattttaaatttcggcgtgtggtttatttacgtgaaaattttttagagtttttggttgtcgtataaaacgttgtttttatat

SEQ ID NO: 18106 - DNA, 666 bp, Artificial Sequence
  chemically treated genomic DNA (Homo sapiens) CpG-island No: 18106
atataaaaacaacgttttatacgacaaccaaaaactctaaaaaattttcacgtaaataaaccacacgccgaaatttaaaattacgaaaaatacccaacgaataaaataaaaaaaatattaaaaataaaactaaactaaaaaaaaaactaaaacgtcgtcgaaaacgaaattacaaaaacgctacgataaaaaaaatcgaattcccaccctattcgtcctccgcaaaaaataactaaaactcaaaaaaccacaaccttacccaaaacgaatacaacgaacgcaaacacgatccacaccccgaaacttaccgataccctcgacgacaacccgtcctacaaaaccgcgttccctacgcccaaaacaaaatcgaacccccaccgaaattcccgaaaccgaatatcccgcgcgtccccaacgcaaacaaaaacgacgaaacttccgaatcgacgttacacacgacgaccgacaaacgacgctaaaaccccgcgtttaaacaaccaaaacgcccttacgctacttcgaatcctacgaacgcccaaaaaaaaaataaatacgaaaaaaaatcaaacccgtatcttacccgatacgaactcaccgcctacccaccgaacacgtccacaacaactcaatcccgatctaaacgcatcgaaataaaaacaacccccg

SEQ ID NO: 18107 - DNA, 666 bp, Artificial Sequence
  chemically treated genomic DNA (Homo sapiens) CpG-island No: 18107
atatgaaagtaacgttttatgcgataattaggagttttgaagggtttttacgtggatgagttatacgtcgggatttggaattgcgggaagtgtttagcgagtagggtaggaggaatgttgggggtgggattggattagaagggaggttgggacgtcgtcgagaacgagattgtagggacgttgcggtgggagaagtcgaatttttattttgttcgtttttcgtaaagagtgattgaggtttaaaaagttatagttttgtttaaaacggatgtagcgggcgtaggtacggtttatatttcgaagtttgtcgatgttttcggcggtagttcgttttgtagagtcgcgttttttgcgtttaaagtaaggtcggatttttatcgggattttcggaatcgggtgtttcgcgcgtttttagcgtaggtagagacggcgagattttcgggtcggcgttgtatacggcggtcggtaggcggcgttggagtttcgcgtttgggtagttaggacgtttttgcgttgtttcgggttttgcgagcgtttagggagggggtgagtgcggggaggggttagattcgtgttttgttcggtgcgagtttatcgtttgtttatcgggtacgtttatagtagtttagtttcggtttgagcgtatcggagtgaaaatagttttcg

SEQ ID NO: 18108 - DNA, 666 bp, Artificial Sequence
  chemically treated genomic DNA (Homo sapiens) CpG-island No: 18108
cgaaaactattttcactccgatacgctcaaaccgaaactaaactactataaacgtacccgataaacaaacgataaactcgcaccgaacaaaacacgaatctaacccctccccgcactcaccccctccctaaacgctcgcaaaacccgaaacaacgcaaaaacgtcctaactacccaaacgcgaaactccaacgccgcctaccgaccgccgtatacaacgccgacccgaaaatctcgccgtctctacctacgctaaaaacgcgcgaaacacccgattccgaaaatcccgataaaaatccgaccttactttaaacgcaaaaaacgcgactctacaaaacgaactaccgccgaaaacatcgacaaacttcgaaatataaaccgtacctacgcccgctacatccgttttaaacaaaactataactttttaaacctcaatcactctttacgaaaaacgaacaaaataaaaattcgacttctcccaccgcaacgtccctacaatctcgttctcgacgacgtcccaacctcccttctaatccaatcccacccccaacattcctcctaccctactcgctaaacacttcccgcaattccaaatcccgacgtataactcatccacgtaaaaacccttcaaaactcctaattatcgcataaaacgttactttcatat

SEQ ID NO: 18109 - DNA, 541 bp, Artificial Sequence
  chemically treated genomic DNA (Homo sapiens) CpG-island No: 18109
ggtcgcggcgttaagatcgaagttaggtcgtcgtatttgtttagcgttttattaagggttttatcgggtcgttagaattttatcggttttacgggcgtagttatgttggggtaaaaggttacgaggttagttttattttatcgtcgcgcgttaggtttttagggttcggagggcgtggttttcgaagagtcgttgtttagacggatcgcgtcgtgtgacggttacgtttttatagttatcgttttcgtttgagttacgtgatttatttttaggtttcggcgagcgtatcggtttcgttttcgagtttacgtgattttgtttagttattttggagaaaagggcgcgttttttcgtttattttttgagcgtggagggtagatgttttaggtgattttttacgagcgtggcgtgttttggatggcggtcgtatatttaggaagaacgggttttgggagaggatcgttggttcgagagtggaattttgtacgtattgggcgttgaagtagtgttttttggattaaatacgaaatattgatgttat

SEQ ID NO: 18110 - DNA, 541 bp, Artificial Sequence
  chemically treated genomic DNA (Homo sapiens) CpG-island No: 18110
ataacatcaatatttcgtatttaatccaaaaaacactacttcaacgcccaatacgtacaaaattccactctcgaaccaacgatcctctcccaaaacccgttcttcctaaatatacgaccgccatccaaaacacgccacgctcgtaaaaaatcacctaaaacatctaccctccacgctcaaaaaataaacgaaaaaacgcgcccttttctccaaaataactaaacaaaatcacgtaaactcgaaaacgaaaccgatacgctcgccgaaacctaaaaataaatcacgtaactcaaacgaaaacgataactataaaaacgtaaccgtcacacgacgcgatccgtctaaacaacgactcttcgaaaaccacgccctccgaaccctaaaaacctaacgcgcgacgataaaataaaactaacctcgtaaccttttaccccaacataactacgcccgtaaaaccgataaaattctaacgacccgataaaacccttaataaaacgctaaacaaatacgacgacctaacttcgatcttaacgccgcgacc

SEQ ID NO: 18111 - DNA, 541 bp, Artificial Sequence
  chemically treated genomic DNA (Homo sapiens) CpG-island No: 18111
gtgatattagtatttcgtatttaatttagaaagtattgttttaacgtttagtgcgtgtaaggttttattttcgggttagcggtttttttttaaagttcgttttttttaagtgtgcggtcgttatttaggatacgttacgttcgtaaaaggttatttgaagtatttattttttacgtttaagaggtaggcggaggagcgcgtttttttttttaaaatggttgagtagggttacgtgggttcgggggcggggtcggtgcgttcgtcggagtttggaagtgggttacgtggtttagacgggggcggtagttgtgggggcgtggtcgttatacggcgcgattcgtttgggtagcggtttttcgggggttacgtttttcgggttttgggggtttagcgcgcgacggtggggtggagttagtttcgtgattttttattttaatatggttgcgttcgtgggatcggtgaagttttggcgattcggtaaggtttttggtggaacgttgggtagatgcggcggtttgatttcggttttggcgtcgcggtt

SEQ ID NO: 18112 - DNA, 541 bp, Artificial Sequence
  chemically treated genomic DNA (Homo sapiens) CpG-island No: 18112
aaccgcgacgccaaaaccgaaatcaaaccgccgcatctacccaacgttccaccaaaaaccttaccgaatcgccaaaacttcaccgatcccacgaacgcaaccatattaaaataaaaaatcacgaaactaactccaccccaccgtcgcgcgctaaacccccaaaacccgaaaaacgtaacccccgaaaaaccgctacccaaacgaatcgcgccgtataacgaccacgcccccacaactaccgcccccgtctaaaccacgtaacccacttccaaactccgacgaacgcaccgaccccgcccccgaacccacgtaaccctactcaaccattttaaaaaaaaaaacgcgctcctccgcctacctcttaaacgtaaaaaataaatacttcaaataaccttttacgaacgtaacgtatcctaaataacgaccgcacacttaaaaaaaacgaactttaaaaaaaaaccgctaacccgaaaataaaaccttacacgcactaaacgttaaaacaatactttctaaattaaatacgaaatactaatatcac

SEQ ID NO: 18113 - DNA, 897 bp, Artificial Sequence
  chemically treated genomic DNA (Homo sapiens) CpG-island No: 18113
cgcgtcgagcggagttgttggcgtagagcgtttttgtagtcgtaggggttattttcgttagcgtcgcggggttggaagtgcgtttcgatacgcgtggcgtcgcggtaggcgttttggtagaaggcgggttagttaagttttaatagcggtggttttaggttcgattgttcggggaagtaggtgttcgaagagtagtcgtgcgaggagtcgaacgagttttcggtcgtcgtcgtcgtcgtcgcgtttttttttttcggttttttcgtcgcgcgtagaatggcgtgtattttatcggggtttaggaaacgagttaggcgttcgcgtcgtaggaaggtcgcgaaggtttcggggtcgttcgttattagtttttttagagttaggcgtcgtgattcgttgaatagttcggtcgggttgggcggttcgtacggcgataggtaggcggcgggtatttcgtttaggttttcggatagtagagttatggcggcgttcggattcgatagttttcggataaaaatcggcgtgtagtttcgttttataggtaatttttgaattaaataggttcgcgttattggtcgtattttttcgtttcggtttttttattggttgttttttttttaatagcggagcgaggcggggcgtaagtttttacggtttcgttttttgatgcgttattggttgcgatgttgggtttgttaagaggaatttaaatttgtaggggcgaggcgggtcgtagagtagggatagagcggggagagtcgagtttttggttattttagcgcgttttttgtcggtcgtttcgttgcgcggtcgtgtaaggttagggatagttaggtttagataacgaggagaggtaggtgtcgattttcggagattttggttacgttgtttttaggtttt

SEQ ID NO: 18114 - DNA, 897 bp, Artificial Sequence
  chemically treated genomic DNA (Homo sapiens) CpG-island No: 18114
aaaacctaaaaacaacgtaaccaaaatctccgaaaatcgacacctacctctcctcgttatctaaacctaactatccctaaccttacacgaccgcgcaacgaaacgaccgacaaaaaacgcgctaaaataaccaaaaactcgactctccccgctctatccctactctacgacccgcctcgcccctacaaatttaaattcctcttaacaaacccaacatcgcaaccaataacgcatcaaaaaacgaaaccgtaaaaacttacgccccgcctcgctccgctattaaaaaaaaaacaaccaataaaaaaaccgaaacgaaaaaatacgaccaataacgcgaacctatttaattcaaaaattacctataaaacgaaactacacgccgatttttatccgaaaactatcgaatccgaacgccgccataactctactatccgaaaacctaaacgaaatacccgccgcctacctatcgccgtacgaaccgcccaacccgaccgaactattcaacgaatcacgacgcctaactctaaaaaaactaataacgaacgaccccgaaaccttcgcgaccttcctacgacgcgaacgcctaactcgtttcctaaaccccgataaaatacacgccattctacgcgcgacgaaaaaaccgaaaaaaaaaaacgcgacgacgacgacgacgaccgaaaactcgttcgactcctcgcacgactactcttcgaacacctacttccccgaacaatcgaacctaaaaccaccgctattaaaacttaactaacccgccttctaccaaaacgcctaccgcgacgccacgcgtatcgaaacgcacttccaaccccgcgacgctaacgaaaataacccctacgactacaaaaacgctctacgccaacaactccgctcgacgcg

SEQ ID NO: 18115 - DNA, 897 bp, Artificial Sequence
  chemically treated genomic DNA (Homo sapiens) CpG-island No: 18115
agagtttaggagtagcgtggttagagttttcgggagtcggtatttgttttttttcgttgtttaggtttgattgtttttggttttgtacggtcgcgtagcggggcgatcggtagggggcgcgttgggatggttaggagttcggtttttttcgttttgtttttgttttgcggttcgtttcgtttttgtaagtttaaattttttttagtaagtttagtatcgtagttaataacgtattagggggcggagtcgtagaggtttgcgtttcgtttcgtttcgttattggaaggaaagtagttaatgggagagtcgaggcggggaggtgcggttaatggcgcgggtttgtttgatttaaaggttgtttataaagcgggattgtacgtcggtttttgttcgagggttgtcgagttcgagcgtcgttatggttttgttgttcgagggtttggacgaggtgttcgtcgtttgtttgtcgtcgtgcgggtcgtttaattcgatcgagttgtttagcgagttacggcgtttggttttggaggagttggtggcgggcggtttcgaagttttcgcggtttttttgcgacgcgagcgtttggttcgttttttgaatttcgatgaggtgtacgttattttgcgcgcggcggagaggtcgggagaggagggcgcggcggcggcggcggcggtcgaggattcgttcggtttttcgtacgattgtttttcgggtatttattttttcgagtagtcggatttggagttatcgttgttggagtttggttggttcgttttttattagggcgtttatcgcggcgttacgcgtgtcgagacgtatttttagtttcgcggcgttggcgaaggtggtttttacggttgtaaggacgttttgcgttagtagtttcgttcggcgcg

SEQ ID NO: 18116 - DNA, 897 bp, Artificial Sequence
  chemically treated genomic DNA (Homo sapiens) CpG-island No: 18116
cgcgccgaacgaaactactaacgcaaaacgtccttacaaccgtaaaaaccaccttcgccaacgccgcgaaactaaaaatacgtctcgacacgcgtaacgccgcgataaacgccctaataaaaaacgaaccaaccaaactccaacaacgataactccaaatccgactactcgaaaaaataaatacccgaaaaacaatcgtacgaaaaaccgaacgaatcctcgaccgccgccgccgccgccgcgccctcctctcccgacctctccgccgcgcgcaaaataacgtacacctcatcgaaattcaaaaaacgaaccaaacgctcgcgtcgcaaaaaaaccgcgaaaacttcgaaaccgcccgccaccaactcctccaaaaccaaacgccgtaactcgctaaacaactcgatcgaattaaacgacccgcacgacgacaaacaaacgacgaacacctcgtccaaaccctcgaacaacaaaaccataacgacgctcgaactcgacaaccctcgaacaaaaaccgacgtacaatcccgctttataaacaacctttaaatcaaacaaacccgcgccattaaccgcacctccccgcctcgactctcccattaactactttccttccaataacgaaacgaaacgaaacgcaaacctctacgactccgccccctaatacgttattaactacgatactaaacttactaaaaaaaatttaaacttacaaaaacgaaacgaaccgcaaaacaaaaacaaaacgaaaaaaaccgaactcctaaccatcccaacgcgccccctaccgatcgccccgctacgcgaccgtacaaaaccaaaaacaatcaaacctaaacaacgaaaaaaaacaaataccgactcccgaaaactctaaccacgctactcctaaactct

SEQ ID NO: 18117 - DNA, 1109 bp, Artificial Sequence
  chemically treated genomic DNA (Homo sapiens) CpG-island No: 18117
ggtcgcgtgtttttagcgtttataggtggaaattaatcgttcgcggggttgcggggtataaagaggtagttagcggtttcgttgattttttttcgtcggtttggacgaagtttgggttcgggagtcgcgtgatgtattttaaagaaggcgtagaatagtacgtgtttttttcggtgttcggggtttttatattatcgtttaatcgttgcggtcgtttagtgttcgggtcgcgtttgtcggtcgcggggatttcgggttcgggtattcgcgtcgtcgtcgttcgttatgcgttttcgttttggggtggtggtgttattcgtcgtggtcggcgttcggtcggagttgttggtggtggggtcgcggttcgagttggggcgttgggagtcgcgcggtgtcgttcgtttgaggtcggtcggtatcgcggcgggcgacggggttttggttttgtaggagtcgggtttgtggttcggggaggtggagttggcggtcgaggaggcggcgtaggacggggcggagtcgggtcgcgtggatacgttttggtataagtttttgaagcgggagtcgggaggagagtttttttgggaaggtattgttagtagacgtttgttttcggcgtagagcgggagtttcggttcgtatttttaatcggggtttcggtttcgggtaggtttcgtaggtttcggcggcgcgcgtttcgggttttttgttcgcgtttttgcgtatttttcgggcgatttgggttgattttgttttgtcggttacgttgtcgtcgttagtcgcgttttcggttttttattgattttttagattcgtatagcgttttcggtcgttttttcgtttattttgttgtttgtttttttgatttggttttcgtatatttagtttttagtttttttttaatcgcgtttgcgttacgggttagtgtttttcgtttttcgttcggggtttttttcgtttttcgagtgtttttcgattttcgagttttttttttcgcgggttttttggttgttcggtcgcgcgtcgttgatggttttaatagtttaatttcgttttggttgggttttgtgtttttatttttttgttttaatttattaaaaaaaatttaaaat

SEQ ID NO: 18118 - DNA, 1109 bp, Artificial Sequence
  chemically treated genomic DNA (Homo sapiens) CpG-island No: 18118
attttaaattttttttaataaattaaaacaaaaaaataaaaacacaaaacccaaccaaaacgaaattaaactattaaaaccatcaacgacgcgcgaccgaacaaccaaaaaacccgcgaaaaaaaaaactcgaaaatcgaaaaacactcgaaaaacgaaaaaaaccccgaacgaaaaacgaaaaacactaacccgtaacgcaaacgcgattaaaaaaaaactaaaaactaaatatacgaaaaccaaatcaaaaaaacaaacaacaaaataaacgaaaaaacgaccgaaaacgctatacgaatctaaaaaatcaataaaaaaccgaaaacgcgactaacgacgacaacgtaaccgacaaaacaaaatcaacccaaatcgcccgaaaaatacgcaaaaacgcgaacaaaaaacccgaaacgcgcgccgccgaaacctacgaaacctacccgaaaccgaaaccccgattaaaaatacgaaccgaaactcccgctctacgccgaaaacaaacgtctactaacaataccttcccaaaaaaactctcctcccgactcccgcttcaaaaacttataccaaaacgtatccacgcgacccgactccgccccgtcctacgccgcctcctcgaccgccaactccacctccccgaaccacaaacccgactcctacaaaaccaaaaccccgtcgcccgccgcgataccgaccgacctcaaacgaacgacaccgcgcgactcccaacgccccaactcgaaccgcgaccccaccaccaacaactccgaccgaacgccgaccacgacgaataacaccaccaccccaaaacgaaaacgcataacgaacgacgacgacgcgaatacccgaacccgaaatccccgcgaccgacaaacgcgacccgaacactaaacgaccgcaacgattaaacgataatataaaaaccccgaacaccgaaaaaaacacgtactattctacgccttctttaaaatacatcacgcgactcccgaacccaaacttcgtccaaaccgacgaaaaaaaatcaacgaaaccgctaactacctctttataccccgcaaccccgcgaacgattaatttccacctataaacgctaaaaacacgcgacc

SEQ ID NO: 18119 - DNA, 1109 bp, Artificial Sequence
  chemically treated genomic DNA (Homo sapiens) CpG-island No: 18119
gttttgggttttttttagtgaattagagtaggaaaatgaggatataaaatttaattaaggcggagttgggttgttgaagttattagcggcgcgcggtcgggtagttaagggattcgcgaagggggggattcggaggtcgaggggtattcggagggcgaagggagtttcgggcgggagacgaagggtattggttcgtgacgtaggcgcggttggaaagaagttgaggattggatgtgcggaaattaggttagaggggtaggtaatagagtgggcgggaaggcggtcgggagcgttatacgggtttagggaattagtaggaagtcggaggcgcggttggcggcgatagcgtggtcggtagagtagggttagtttaggtcgttcggggagtgcgtagggacgcgggtaaaaagttcgggacgcgcgtcgtcggggtttgcggggtttgttcgaggtcgaggtttcggttgggggtgcgggtcggagttttcgttttgcgtcgggggtaggcgtttgttggtaatatttttttaggagagtttttttttcggttttcgttttaggaatttgtattagaacgtgtttacgcggttcggtttcgtttcgttttgcgtcgttttttcggtcgttagttttattttttcgagttataggttcggtttttgtagggttagggtttcgtcgttcgtcgcggtgtcggtcggttttaggcggacggtatcgcgcggtttttaacgttttagttcgggtcgcgattttattattagtagtttcggtcgggcgtcggttacggcgggtggtattattattttaaagcggaagcgtatggcgggcggcggcggcgcgaatattcgggttcggagttttcgcggtcggtaggcgcggttcgagtattaggcggtcgtagcgattgggcggtggtgtgggagtttcgggtatcggggagaatacgtgttgttttgcgttttttttgggatgtattacgcggttttcgagtttagatttcgtttaggtcggcgggaaggggttagcggagtcgttagttgtttttttgtgtttcgtaatttcgcgggcggttgatttttatttgtgggcgttggggatacgcgatt

SEQ ID NO: 18120 - DNA, 1109 bp, Artificial Sequence
  chemically treated genomic DNA (Homo sapiens) CpG-island No: 18120
aatcgcgtatccccaacgcccacaaataaaaatcaaccgcccgcgaaattacgaaacacaaaaaaacaactaacgactccgctaaccccttcccgccgacctaaacgaaatctaaactcgaaaaccgcgtaatacatcccaaaaaaaacgcaaaacaacacgtattctccccgatacccgaaactcccacaccaccgcccaatcgctacgaccgcctaatactcgaaccgcgcctaccgaccgcgaaaactccgaacccgaatattcgcgccgccgccgcccgccatacgcttccgctttaaaataataataccacccgccgtaaccgacgcccgaccgaaactactaataataaaatcgcgacccgaactaaaacgttaaaaaccgcgcgataccgtccgcctaaaaccgaccgacaccgcgacgaacgacgaaaccctaaccctacaaaaaccgaacctataactcgaaaaaataaaactaacgaccgaaaaaacgacgcaaaacgaaacgaaaccgaaccgcgtaaacacgttctaatacaaattcctaaaacgaaaaccgaaaaaaaaactctcctaaaaaaatattaccaacaaacgcctacccccgacgcaaaacgaaaactccgacccgcacccccaaccgaaacctcgacctcgaacaaaccccgcaaaccccgacgacgcgcgtcccgaactttttacccgcgtccctacgcactccccgaacgacctaaactaaccctactctaccgaccacgctatcgccgccaaccgcgcctccgacttcctactaattccctaaacccgtataacgctcccgaccgccttcccgcccactctattacctacccctctaacctaatttccgcacatccaatcctcaacttctttccaaccgcgcctacgtcacgaaccaatacccttcgtctcccgcccgaaactcccttcgccctccgaatacccctcgacctccgaatcccccccttcgcgaatcccttaactacccgaccgcgcgccgctaataacttcaacaacccaactccgccttaattaaattttatatcctcattttcctactctaattcactaaaaaaaacccaaaac

SEQ ID NO: 18121 - DNA, 1057 bp, Artificial Sequence
  chemically treated genomic DNA (Homo sapiens) CpG-island No: 18121
ggggcggcgtgtcgggattcggaggggaaggtttgcgtatttagcgcggcgagtcgtggtttttgttgtcgtttcggggtttcgggtggtagcggttttagaaggcggttcgagtttacggcggtgttcgggggggggtttcgcgggcgtcggtgtaggtttggtttgggaggttttttggggaaataatgcgtttcgtttcggattttagttttttttaagcgtcgcgttgttcgtcgttttttttattgtcgtttcgtcgttttagggggcgtcgcgcgtggtcgtgttcggtttttttcgagtttcggcgggtgacgggcgcggaatatggcggcgcggggtttcgggtagtcgcgaggggtcgcggcgttgcggtttcggttggggcggcgcggttagagttgcgtttgggttcgtcggcgaggtttttttttcgttcgtcgtcgtcgtcgtcgtcgtcgcgtttcgtttcgcgcgttcgttttttttcgggtcgcggtcgtgtttcgcgtcgcgttttttcgggatggttcgcgcgtttcggcgttgtttttcggagtttacggcggagcggcggcggtcgcgttcgaggggcgcgcggttgtagcggcggcggcgtcgcgcgtgaggggtcgtttaaggtcgagcgggcgcggcgagcggtcgggcgagcgtagttaatatgtcggatattaaggtaaaagttgtcgttcgggttcggtttatgaatcgacgaggtgaggagtttttcgtttttttttatttttgttcgggttgagggcgggggtaattttagaaattgcggggtcgggacggcgagagcgcggtcggggtcggggggtcggggcggaggcggcgttcgcgttggtcgtggtgttcggggcgtcgtttttaggttcggtcgtttttagggacggagtttcgttcggcgcggttggcgggcgggcgggttggaggcgcggatgttggattttgtaacgtttttttttttttgtttttagaattggaattgaatattaagtgcgtggtggagatggaagggaattaaacggtt

SEQ ID NO: 18122 - DNA, 1057 bp, Artificial Sequence
  chemically treated genomic DNA (Homo sapiens) CpG-island No: 18122
aaccgtttaattcccttccatctccaccacgcacttaatattcaattccaattctaaaaacaaaaaaaaaaaaacgttacaaaatccaacatccgcgcctccaacccgcccgcccgccaaccgcgccgaacgaaactccgtccctaaaaacgaccgaacctaaaaacgacgccccgaacaccacgaccaacgcgaacgccgcctccgccccgaccccccgaccccgaccgcgctctcgccgtcccgaccccgcaatttctaaaattacccccgccctcaacccgaacaaaaataaaaaaaaacgaaaaactcctcacctcgtcgattcataaaccgaacccgaacgacaacttttaccttaatatccgacatattaactacgctcgcccgaccgctcgccgcgcccgctcgaccttaaacgacccctcacgcgcgacgccgccgccgctacaaccgcgcgcccctcgaacgcgaccgccgccgctccgccgtaaactccgaaaaacaacgccgaaacgcgcgaaccatcccgaaaaaacgcgacgcgaaacacgaccgcgacccgaaaaaaaacgaacgcgcgaaacgaaacgcgacgacgacgacgacgacgacgaacgaaaaaaaaacctcgccgacgaacccaaacgcaactctaaccgcgccgccccaaccgaaaccgcaacgccgcgacccctcgcgactacccgaaaccccgcgccgccatattccgcgcccgtcacccgccgaaactcgaaaaaaaccgaacacgaccacgcgcgacgccccctaaaacgacgaaacgacaataaaaaaaacgacgaacaacgcgacgcttaaaaaaaactaaaatccgaaacgaaacgcattatttccccaaaaaacctcccaaaccaaacctacaccgacgcccgcgaaacccccccccgaacaccgccgtaaactcgaaccgccttctaaaaccgctaccacccgaaaccccgaaacgacaacaaaaaccacgactcgccgcgctaaatacgcaaaccttcccctccgaatcccgacacgccgcccc

SEQ ID NO: 18123 - DNA, 1057 bp, Artificial Sequence
  chemically treated genomic DNA (Homo sapiens) CpG-island No: 18123
gatcgtttgatttttttttatttttattacgtatttggtgtttagttttagttttgaaagtagagagaaagggacgttgtaaagtttagtattcgcgtttttagttcgttcgttcgttagtcgcgtcgagcggggtttcgtttttggaggcggtcgagtttggagacggcgtttcgggtattacggttagcgcggacgtcgttttcgtttcggtttttcggtttcggtcgcgttttcgtcgtttcggtttcgtagtttttaaagttgttttcgtttttagttcgagtagaaataaaaaagagcggaaagttttttatttcgtcggtttatgggtcggattcggacggtaatttttattttggtattcgatatgttggttgcgttcgttcggtcgttcgtcgcgttcgttcggttttaggcggttttttacgcgcggcgtcgtcgtcgttgtagtcgcgcgtttttcgagcgcggtcgtcgtcgtttcgtcgtgagtttcgagaggtagcgtcgaggcgcgcgggttatttcgggggagcgcgacgcggggtacggtcgcggttcggggaggggcgggcgcgcggggcggggcgcggcggcggcggcggcggcggcgggcggggaggaggtttcgtcggcgggtttaggcgtagttttagtcgcgtcgttttagtcgagatcgtagcgtcgcggtttttcgcggttgttcggggtttcgcgtcgttatgtttcgcgttcgttattcgtcggggttcgggagaggtcggatacggttacgcgcggcgttttttggagcggcgggacggtagtgagaggagcggcgagtagcgcggcgtttaggggaggttggagttcggggcgggacgtattgtttttttaggggattttttaggttaagtttgtatcggcgttcgcggggttttttttcggatatcgtcgtgagttcgagtcgttttttggggtcgttgttattcggagtttcgggacggtagtaaggattacggttcgtcgcgttgggtgcgtaggttttttttttcgagtttcggtacgtcgtttt

SEQ ID NO: 18124 - DNA, 1057 bp, Artificial Sequence
  chemically treated genomic DNA (Homo sapiens) CpG-island No: 18124
aaaacgacgtaccgaaactcgaaaaaaaaaacctacgcacccaacgcgacgaaccgtaatccttactaccgtcccgaaactccgaataacaacgaccccaaaaaacgactcgaactcacgacgatatccgaaaaaaaaccccgcgaacgccgatacaaacttaacctaaaaaatcccctaaaaaaacaatacgtcccgccccgaactccaacctcccctaaacgccgcgctactcgccgctcctctcactaccgtcccgccgctccaaaaaacgccgcgcgtaaccgtatccgacctctcccgaaccccgacgaataacgaacgcgaaacataacgacgcgaaaccccgaacaaccgcgaaaaaccgcgacgctacgatctcgactaaaacgacgcgactaaaactacgcctaaacccgccgacgaaacctcctccccgcccgccgccgccgccgccgccgccgcgccccgccccgcgcgcccgcccctccccgaaccgcgaccgtaccccgcgtcgcgctcccccgaaataacccgcgcgcctcgacgctacctctcgaaactcacgacgaaacgacgacgaccgcgctcgaaaaacgcgcgactacaacgacgacgacgccgcgcgtaaaaaaccgcctaaaaccgaacgaacgcgacgaacgaccgaacgaacgcaaccaacatatcgaataccaaaataaaaattaccgtccgaatccgacccataaaccgacgaaataaaaaactttccgctcttttttatttctactcgaactaaaaacgaaaacaactttaaaaactacgaaaccgaaacgacgaaaacgcgaccgaaaccgaaaaaccgaaacgaaaacgacgtccgcgctaaccgtaatacccgaaacgccgtctccaaactcgaccgcctccaaaaacgaaaccccgctcgacgcgactaacgaacgaacgaactaaaaacgcgaatactaaactttacaacgtccctttctctctactttcaaaactaaaactaaacaccaaatacgtaataaaaataaaaaaaaatcaaacgatc

SEQ ID NO: 18125 - DNA, 1326 bp, Artificial Sequence
  chemically treated genomic DNA (Homo sapiens) CpG-island No: 18125
atttttatcgtgttgtattgggtttcggttttttcgagttcggttttttcggacgacggtcgtcgttattgcgggtattagattggggggcgggtcgtttatttcgcggttttgttttatatcgatttcgttgaggagttttcggtattcggggcgattagggaaggcgggaggaggtgtttagaaattgttcgttttgttagtcgtatttggtcgacgattttttggttattggtttggtttgggggatacgattttttatttaattgaattagattcgaggtcgcggcggggagggtagcggtcggggttttttcgttttttttttcggttcgtttttatttgttgcgggaaagtcgcggtggagcgttcgagggcggtcgtaatttcggtcggggtcgagtcgggttggtcgagtcgcggcggcgaagggcgggggaaggcgttttcggagtagggtgcgcggcgcgtagggtcggttgtttcgggtcgcggtcgcgcgggcggggagggggttgtcggcgtcgggtgatttcggtgttagttcgtcggtttcgttcgtcgttttttgttcgacgggatttttattattttcgttgtgcggttatttgtttcgtttcgtattgcgtcgtcgtcgtttttgtggtcgtcgtcgttagtttttagtttcgttatggtgtttcgatgacgcgttcggagagtcgtttcgtttttttttcggtttggttttcgtcggttttcgttttttaggttagcggtttagataggtgagcgtagttcggggatggcggagggcggggatagagagcgcggtagtcggttgcggtttgggtttggcgcgttttttcgcgggtaggtgcggcgtggtagtcgtttcgatcgtcgttgtcgagtttcggttggaagagcggcgggcggaattagtattttagttcggagttttcggtcgtcgcggtcgattagttgagggttttcggagatatggagcggggttagcgaggtttggtggcgttttttggagtttgggacgagcggcggttcgaggagtagtttaggtggggcgagggtacggagacgttattttttttcgaattttgaagtagttaggttagtgtcggtttcgcgagggttggagtttacggtgatagtcggtagagtatttgatgttacgtggagaggcgaagtatatgggtcggattttacgttgggagtcggtttggatttgcgttttaggaagttattgcgggcgattttattttgtcgttaggatttcgtatttgatgagttttagggtatataagttagagaggtttgtgtcggttgatg

SEQ ID NO: 18126 - DNA, 1326 bp, Artificial Sequence
  chemically treated genomic DNA (Homo sapiens) CpG-island No: 18126
catcaaccgacacaaacctctctaacttatataccctaaaactcatcaaatacgaaatcctaacgacaaaataaaatcgcccgcaataacttcctaaaacgcaaatccaaaccgactcccaacgtaaaatccgacccatatacttcgcctctccacgtaacatcaaatactctaccgactatcaccgtaaactccaaccctcgcgaaaccgacactaacctaactacttcaaaattcgaaaaaaaataacgtctccgtaccctcgccccacctaaactactcctcgaaccgccgctcgtcccaaactccaaaaaacgccaccaaacctcgctaaccccgctccatatctccgaaaaccctcaactaatcgaccgcgacgaccgaaaactccgaactaaaatactaattccgcccgccgctcttccaaccgaaactcgacaacgacgatcgaaacgactaccacgccgcacctacccgcgaaaaaacgcgccaaacccaaaccgcaaccgactaccgcgctctctatccccgccctccgccatccccgaactacgctcacctatctaaaccgctaacctaaaaaacgaaaaccgacgaaaaccaaaccgaaaaaaaaacgaaacgactctccgaacgcgtcatcgaaacaccataacgaaactaaaaactaacgacgacgaccacaaaaacgacgacgacgcaatacgaaacgaaacaaataaccgcacaacgaaaataataaaaatcccgtcgaacaaaaaacgacgaacgaaaccgacgaactaacaccgaaatcacccgacgccgacaaccccctccccgcccgcgcgaccgcgacccgaaacaaccgaccctacgcgccgcgcaccctactccgaaaacgccttcccccgcccttcgccgccgcgactcgaccaacccgactcgaccccgaccgaaattacgaccgccctcgaacgctccaccgcgactttcccgcaacaaataaaaacgaaccgaaaaaaaaaacgaaaaaaccccgaccgctaccctccccgccgcgacctcgaatctaattcaattaaataaaaaatcgtatcccccaaaccaaaccaataaccaaaaaatcgtcgaccaaatacgactaacaaaacgaacaatttctaaacacctcctcccgccttccctaatcgccccgaataccgaaaactcctcaacgaaatcgatataaaacaaaaccgcgaaataaacgacccgccccccaatctaatacccgcaataacgacgaccgtcgtccgaaaaaaccgaactcgaaaaaaccgaaacccaatacaacacgataaaaat

SEQ ID NO: 18127 - DNA, 1326 bp, Artificial Sequence
  chemically treated genomic DNA (Homo sapiens) CpG-island No: 18127
tattagtcggtataagtttttttaatttgtgtgttttgaggtttattagatgcgaagttttggcgataagatagggtcgttcgtagtggttttttaaagcgtagatttaggtcggtttttagcgtggaattcgatttatgtatttcgtttttttacgtggtattagatgttttgtcggttgttatcgtgaattttagttttcgcggagtcgatattgatttggttattttagagttcggagggaaatagcgttttcgtattttcgttttatttgggttgtttttcggatcgtcgttcgttttagattttaggaggcgttattaggtttcgttgatttcgttttatattttcgggagtttttagttggtcggtcgcggcgatcggaagtttcggattgaggtattggtttcgttcgtcgtttttttagtcgagattcggtagcggcggtcggagcggttgttacgtcgtatttgttcgcgagggggcgcgttaggtttaggtcgtagtcgattgtcgcgttttttgttttcgtttttcgttattttcggattgcgtttatttgtttgggtcgttggtttgggaggcgggggtcggcgggagttaagtcgaggaaagggcggagcggtttttcgggcgcgttatcggagtattatggcggagttaggagttggcggcgacggttataggggcggcgacggcgtagtgcgaagcgaaataggtgatcgtatagcggggatagtgggggtttcgtcgggtaggggacggcgagcggggtcggcgggttggtatcgaaattattcggcgtcggtagtttttttttcgttcgcgcggtcgcggttcggaataatcggttttgcgcgtcgcgtattttgtttcgagagcgttttttttcgtttttcgtcgtcgcggttcggttagttcggttcggtttcggtcggggttgcggtcgttttcgggcgttttatcgcgattttttcgtaataggtggaggcgagtcgggggaggaaacggagagatttcggtcgttgtttttttcgtcgcggtttcgggtttaatttagttgaatgggaaatcgtattttttagattaaattagtggttagagagtcgtcggttaggtgcgattggtaggacgagtagtttttgggtattttttttcgttttttttggtcgtttcgggtgtcgggggttttttagcggggtcggtgtggggtaggatcgcggggtgagcggttcgttttttaatttggtgttcgtagtggcgacgatcgtcgttcgaggggatcgagttcgggagggtcggggtttagtgtagtacggtgggggt

SEQ ID NO: 18128 - DNA, 1326 bp, Artificial Sequence
  chemically treated genomic DNA (Homo sapiens) CpG-island No: 18128
acccccaccgtactacactaaaccccgaccctcccgaactcgatcccctcgaacgacgatcgtcgccactacgaacaccaaattaaaaaacgaaccgctcaccccgcgatcctaccccacaccgaccccgctaaaaaacccccgacacccgaaacgaccaaaaaaaacgaaaaaaaatacccaaaaactactcgtcctaccaatcgcacctaaccgacgactctctaaccactaatttaatctaaaaaatacgatttcccattcaactaaattaaacccgaaaccgcgacgaaaaaaacaacgaccgaaatctctccgtttcctcccccgactcgcctccacctattacgaaaaaatcgcgataaaacgcccgaaaacgaccgcaaccccgaccgaaaccgaaccgaactaaccgaaccgcgacgacgaaaaacgaaaaaaaacgctctcgaaacaaaatacgcgacgcgcaaaaccgattattccgaaccgcgaccgcgcgaacgaaaaaaaaactaccgacgccgaataatttcgataccaacccgccgaccccgctcgccgtcccctacccgacgaaacccccactatccccgctatacgatcacctatttcgcttcgcactacgccgtcgccgcccctataaccgtcgccgccaactcctaactccgccataatactccgataacgcgcccgaaaaaccgctccgccctttcctcgacttaactcccgccgacccccgcctcccaaaccaacgacccaaacaaataaacgcaatccgaaaataacgaaaaacgaaaacaaaaaacgcgacaatcgactacgacctaaacctaacgcgccccctcgcgaacaaatacgacgtaacaaccgctccgaccgccgctaccgaatctcgactaaaaaaacgacgaacgaaaccaatacctcaatccgaaacttccgatcgccgcgaccgaccaactaaaaactcccgaaaatataaaacgaaatcaacgaaacctaataacgcctcctaaaatctaaaacgaacgacgatccgaaaaacaacccaaataaaacgaaaatacgaaaacgctatttccctccgaactctaaaataaccaaatcaatatcgactccgcgaaaactaaaattcacgataacaaccgacaaaacatctaataccacgtaaaaaaacgaaatacataaatcgaattccacgctaaaaaccgacctaaatctacgctttaaaaaaccactacgaacgaccctatcttatcgccaaaacttcgcatctaataaacctcaaaacacacaaattaaaaaaacttataccgactaata

SEQ ID NO: 18129 - DNA, 621 bp, Artificial Sequence
  chemically treated genomic DNA (Homo sapiens) CpG-island No: 18129
  misc_feature (515)..(515): n is either a, c, g or t
gatcgtattttacgacgcgatattacgattattacgcgatatttcgttttcgttatacgttaatatattttcgttcgttagatatttacgcgttacgatatattacgattataatacgcgcgcgttatcgcgatttcgcgatttcgtagtttagtatatcgcgattattacgtttagcgttacgttattagtattacgtatataatttatattatattaggtattagatagcgcgatagcgcgtatatcgtatatcgtcgcgcgcgttagtatcgtatacgatacgtcgataattagcgtttacgacgatagcgatattcgttcgcgtacgtacgtcgcgcgttacgatatatataggcgcggtatcgtatagtcgcgacgcgacggttcgatttaaggtcgcgtcgcgcgtttatatacgatatcgatcgttcggcgttatattattttttacgatatttacgcgattagcgttacgtaggcgtattacgacgacggattcgtttttcgattantcgtaatatttattagtagagacgattatttacgttatgatagtgttgttattttttacgattttagtagttttcgttttcgatatgtatttattattttaagtat

SEQ ID NO: 18130 - DNA, 621 bp, Artificial Sequence
  chemically treated genomic DNA (Homo sapiens) CpG-island No: 18130
  misc_feature (107)..(107): n is either a, c, g or t
atacttaaaataataaatacatatcgaaaacgaaaactactaaaatcgtaaaaaataacaacactatcataacgtaaataatcgtctctactaataaatattacgantaatcgaaaaacgaatccgtcgtcgtaatacgcctacgtaacgctaatcgcgtaaatatcgtaaaaaataatataacgccgaacgatcgatatcgtatataaacgcgcgacgcgaccttaaatcgaaccgtcgcgtcgcgactatacgataccgcgcctatatatatcgtaacgcgcgacgtacgtacgcgaacgaatatcgctatcgtcgtaaacgctaattatcgacgtatcgtatacgatactaacgcgcgcgacgatatacgatatacgcgctatcgcgctatctaatacctaatataatataaattatatacgtaatactaataacgtaacgctaaacgtaataatcgcgatatactaaactacgaaatcgcgaaatcgcgataacgcgcgcgtattataatcgtaatatatcgtaacgcgtaaatatctaacgaacgaaaatatattaacgtataacgaaaacgaaatatcgcgtaataatcgtaatatcgcgtcgtaaaatacgatc

SEQ ID NO: 18131 - DNA, 621 bp, Artificial Sequence
  chemically treated genomic DNA (Homo sapiens) CpG-island No: 18131
  misc_feature (107)..(107): n is either a, c, g or t
atgtttgaggtggtggatgtatgtcggggacggagattgttgagatcgtagggagtagtagtattattatggcgtgggtggtcgtttttgttggtgggtgttgcggntggtcggggggcgggttcgtcgtcgtggtgcgtttgcgtggcgttggtcgcgtgggtgtcgtggggggtggtgtggcgtcgggcggtcggtgtcgtgtgtgggcgcgcggcgcggttttgggtcgggtcgtcgcgtcgcggttgtgcggtgtcgcgtttgtgtgtgtcgtggcgcgcggcgtgcgtgcgcgggcgggtgtcgttgtcgtcgtgggcgttggttgtcggcgtgtcgtgtgcggtgttggcgcgcgcggcggtgtgcggtgtgcgcgttgtcgcgttgtttggtgtttggtgtggtgtgggttgtgtgcgtggtgttggtggcgtggcgttgggcgtggtggtcgcggtgtgttgggttgcggggtcgcggggtcgcggtggcgcgcgcgtgttgtggtcgtggtgtgtcgtggcgcgtgggtgtttggcgggcgggggtgtgttggcgtgtggcgggggcggggtgtcgcgtggtggtcgtggtgtcgcgtcgtggggtgcggtt

SEQ ID NO: 18132 - DNA, 621 bp, Artificial Sequence
  chemically treated genomic DNA (Homo sapiens) CpG-island No: 18132
  misc_feature (515)..(515): n is either a, c, g or t
aaccgcaccccacgacgcgacaccacgaccaccacgcgacaccccgcccccgccacacgccaacacacccccgcccgccaaacacccacgcgccacgacacaccacgaccacaacacgcgcgcgccaccgcgaccccgcgaccccgcaacccaacacaccgcgaccaccacgcccaacgccacgccaccaacaccacgcacacaacccacaccacaccaaacaccaaacaacgcgacaacgcgcacaccgcacaccgccgcgcgcgccaacaccgcacacgacacgccgacaaccaacgcccacgacgacaacgacacccgcccgcgcacgcacgccgcgcgccacgacacacacaaacgcgacaccgcacaaccgcgacgcgacgacccgacccaaaaccgcgccgcgcgcccacacacgacaccgaccgcccgacgccacaccaccccccacgacacccacgcgaccaacgccacgcaaacgcaccacgacgacgaacccgccccccgaccanccgcaacacccaccaacaaaaacgaccacccacgccataataatactactactccctacgatctcaacaatctccgtccccgacatacatccaccacctcaaacat

SEQ ID NO: 18133 - DNA, 506 bp, Artificial Sequence
  chemically treated genomic DNA (Homo sapiens) CpG-island No: 18133
ttggtcgatcgcgaacgtaggttatgttagtagtaggagtttattatgttattgtacgttatcgcgtacgcggttcgatatagatatcgtatgtacgatcgttagtcgcgttaatatacgcgatcgcgatttatgtatcgatatagtaatgttcgagcgtgattatagttttaacgtgttattcgattacgaattcgagcgatggcgtcgtttaggtatcgttaacgtttgcgcgtacgtatgttttagttatggtttagtcgaagtcgacgttatgtcgaatcgacgtgaagtgtacgtcgcgattagttaatgattagggttatgtgcggtttgtttatcgtattagttgtttatttcgtttaagtcgtagttagcgtacgttagtcgatcgcgatttttagcgtagcgaatcgtagttcgtattagtttatgttcgtgtagtttggtatggtagacgtagcgttgttatgtgatatgtcgtcgtatttgatttaagtcgcggt

SEQ ID NO: 18134 - DNA, 506 bp, Artificial Sequence
  chemically treated genomic DNA (Homo sapiens) CpG-island No: 18134
accgcgacttaaatcaaatacgacgacatatcacataacaacgctacgtctaccataccaaactacacgaacataaactaatacgaactacgattcgctacgctaaaaatcgcgatcgactaacgtacgctaactacgacttaaacgaaataaacaactaatacgataaacaaaccgcacataaccctaatcattaactaatcgcgacgtacacttcacgtcgattcgacataacgtcgacttcgactaaaccataactaaaacatacgtacgcgcaaacgttaacgatacctaaacgacgccatcgctcgaattcgtaatcgaataacacgttaaaactataatcacgctcgaacattactatatcgatacataaatcgcgatcgcgtatattaacgcgactaacgatcgtacatacgatatctatatcgaaccgcgtacgcgataacgtacaataacataataaactcctactactaacataacctacgttcgcgatcgaccaa

SEQ ID NO: 18135 - DNA, 506 bp, Artificial Sequence
  chemically treated genomic DNA (Homo sapiens) CpG-island No: 18135
atcgcgatttagattagatgcgacgatatgttatatgatagcgttgcgtttattatattagattatacgagtatagattagtacgagttacgattcgttacgttagaggtcgcgatcgattgacgtgcgttgattgcgatttgaacgagataggtagttgatgcgatgaataggtcgtatatagttttgattattagttagtcgcgacgtgtattttacgtcggttcgatatggcgtcggtttcggttaagttatgattgagatatgcgtacgcgtagacgttagcgatgtttgagcgacgttatcgttcggattcgtgatcggatgatacgttgagattatggttacgttcgagtattgttatgtcgatatatggatcgcgatcgcgtgtattgacgcggttgacgatcgtgtatgcggtgtttatatcggatcgcgtacgcgatggcgtatagtgatatagtagatttttattgttgatatagtttgcgttcgcgatcggttag

SEQ ID NO: 18136 - DNA, 506 bp, Artificial Sequence
  chemically treated genomic DNA (Homo sapiens) CpG-island No: 18136
ctaaccgatcgcgaacgcaaactatatcaacaataaaaatctactatatcactatacgccatcgcgtacgcgatccgatataaacaccgcatacacgatcgtcaaccgcgtcaatacacgcgatcgcgatccatatatcgacataacaatactcgaacgtaaccataatctcaacgtatcatccgatcacgaatccgaacgataacgtcgctcaaacatcgctaacgtctacgcgtacgcatatctcaatcataacttaaccgaaaccgacgccatatcgaaccgacgtaaaatacacgtcgcgactaactaataatcaaaactatatacgacctattcatcgcatcaactacctatctcgttcaaatcgcaatcaacgcacgtcaatcgatcgcgacctctaacgtaacgaatcgtaactcgtactaatctatactcgtataatctaatataataaacgcaacgctatcatataacatatcgtcgcatctaatctaaatcgcgat

SEQ ID NO: 18137 - DNA, 671 bp, Artificial Sequence
  chemically treated genomic DNA (Homo sapiens) CpG-island No: 18137
tcggtttcggggttggagggaggttcgcgagatttcgggtcgttcgtttcgtcgtcgcgtttcggttcgcgggggtagtttgcgagtttcgacgtttcgggtttagggtcgcgtttcgaagcgtcgtttttagaattcgattcgttgtttttttggattgaggagttcgaggagtgtggtttcgcgagttgttcggagagcgcgttttttcgtttgtaggggtttagtagtagttatcgagcgcggggcgaggtttacgttttttttttttttttcgcgtttacggcgggcgagttggcgttggagtaaggtttcgggttttcgtcgtagttttcggattttagttagatttattttttttcgagcgagttcgtggggagttaggaggacggttttcgttttcgagtcgtgttcgatgttttggacggggatggggacggtttcgttcgtatcgaggattttatttagtttgttacggtttacggggtagagtaggtacggagcggttcgggtcggggcgtgggaattgggtaggtgcgcgttggtcggcggggttgatgtgggatcggtcgacgttgtttttggagtcgggaaaggtattgttaagatttgacggttttgttttttttgtttatttattatttcggttttggatttttggttgaattgcg

SEQ ID NO: 18138 - DNA, 671 bp, Artificial Sequence
  chemically treated genomic DNA (Homo sapiens) CpG-island No: 18138
cgcaattcaaccaaaaatccaaaaccgaaataataaataaacaaaaaaaacaaaaccgtcaaatcttaacaatacctttcccgactccaaaaacaacgtcgaccgatcccacatcaaccccgccgaccaacgcgcacctacccaattcccacgccccgacccgaaccgctccgtacctactctaccccgtaaaccgtaacaaactaaataaaatcctcgatacgaacgaaaccgtccccatccccgtccaaaacatcgaacacgactcgaaaacgaaaaccgtcctcctaactccccacgaactcgctcgaaaaaaaataaatctaactaaaatccgaaaactacgacgaaaacccgaaaccttactccaacgccaactcgcccgccgtaaacgcgaaaaaaaaaaaaaaaacgtaaacctcgccccgcgctcgataactactactaaacccctacaaacgaaaaaacgcgctctccgaacaactcgcgaaaccacactcctcgaactcctcaatccaaaaaaacaacgaatcgaattctaaaaacgacgcttcgaaacgcgaccctaaacccgaaacgtcgaaactcgcaaactacccccgcgaaccgaaacgcgacgacgaaacgaacgacccgaaatctcgcgaacctccctccaaccccgaaaccga

SEQ ID NO: 18139 - DNA, 671 bp, Artificial Sequence
  chemically treated genomic DNA (Homo sapiens) CpG-island No: 18139
cgtaatttaattagaaatttagggtcgaagtggtgaataagtagaaaaagtaggatcgttaggttttgatagtgtttttttcgattttaggggtagcgtcgatcggttttatattaatttcgtcggttagcgcgtatttgtttagtttttacgtttcggttcgggtcgtttcgtatttgttttgtttcgtagatcgtagtaaattggatgaagttttcgatgcggacgaaatcgtttttattttcgtttagggtatcgaatacggttcggaggcgggggtcgtttttttgattttttacgggttcgttcggaagggggtgggtttggttgaggttcgagggttgcggcggggattcgggattttgttttagcgttagttcgttcgtcgtgggcgcggggaagggagagaagacgtagatttcgtttcgcgttcggtggttgttgttggatttttgtaagcggaaaggcgcgtttttcgggtagttcgcggggttatatttttcgggttttttagtttaggagaataacgggtcgagttttggaagcggcgtttcggagcgcggttttgggttcggggcgtcggggttcgtaagttgttttcgcgggtcggagcgcggcggcggggcggacggttcggggtttcgcgggtttttttttagtttcggggtcgg

SEQ ID NO: 18140 - DNA, 671 bp, Artificial Sequence
  chemically treated genomic DNA (Homo sapiens) CpG-island No: 18140
ccgaccccgaaactaaaaaaaaacccgcgaaaccccgaaccgtccgccccgccgccgcgctccgacccgcgaaaacaacttacgaaccccgacgccccgaacccaaaaccgcgctccgaaacgccgcttccaaaactcgacccgttattctcctaaactaaaaaacccgaaaaatataaccccgcgaactacccgaaaaacgcgcctttccgcttacaaaaatccaacaacaaccaccgaacgcgaaacgaaatctacgtcttctctcccttccccgcgcccacgacgaacgaactaacgctaaaacaaaatcccgaatccccgccgcaaccctcgaacctcaaccaaacccacccccttccgaacgaacccgtaaaaaatcaaaaaaacgacccccgcctccgaaccgtattcgataccctaaacgaaaataaaaacgatttcgtccgcatcgaaaacttcatccaatttactacgatctacgaaacaaaacaaatacgaaacgacccgaaccgaaacgtaaaaactaaacaaatacgcgctaaccgacgaaattaatataaaaccgatcgacgctacccctaaaatcgaaaaaaacactatcaaaacctaacgatcctactttttctacttattcaccacttcgaccctaaatttctaattaaattacg

SEQ ID NO: 18141 - DNA, 566 bp, Artificial Sequence
  chemically treated genomic DNA (Homo sapiens) CpG-island No: 18141
  misc_feature (272)..(272): n is either a, c, g or t
gcggggggtttcggggcggcggggggttttcgggtaggcgggggcgggtttcgggttggtatcgtttttcgcgttcgtttttcgcgtttatagcggttcgcgggtcgggcgttatgggcggttttttttggcgtttcgcgttgcgggggttgcgttgcggttcgcgggtttcgggttcgagtttgttagtgcgttacggttcgggtgagtggggtcgcgcgtttcggcggggacgcggagggaggaaggggcgcgcgtcgttcggtttttgngcgcgtacgtgcgggttggggttcgatttttttagaggtttcggggcgcgggttgcggggttcgttcgagttggggaaggcgtcggttcgtattcgtacgtttttttagtgttcgttcggttttgcggttttttttcgtttttttaggttttaggttgtaggcgttcggcgagttggtagtttgggcgggttcggggcgatcgagggttcgggagcgtaaggaaggtagaggtcggttgtagtattgggcggggagggggtttttcggtcggggtgggggtgggggtgtggggg

SEQ ID NO: 18142 - DNA, 566 bp, Artificial Sequence
  chemically treated genomic DNA (Homo sapiens) CpG-island No: 18142
  misc_feature (295)..(295): n is either a, c, g or t
cccccacacccccacccccaccccgaccgaaaaaccccctccccgcccaatactacaaccgacctctaccttccttacgctcccgaaccctcgatcgccccgaacccgcccaaactaccaactcgccgaacgcctacaacctaaaacctaaaaaaacgaaaaaaaaccgcaaaaccgaacgaacactaaaaaaacgtacgaatacgaaccgacgccttccccaactcgaacgaaccccgcaacccgcgccccgaaacctctaaaaaaatcgaaccccaacccgcacgtacgcgcncaaaaaccgaacgacgcgcgccccttcctccctccgcgtccccgccgaaacgcgcgaccccactcacccgaaccgtaacgcactaacaaactcgaacccgaaacccgcgaaccgcaacgcaacccccgcaacgcgaaacgccaaaaaaaaccgcccataacgcccgacccgcgaaccgctataaacgcgaaaaacgaacgcgaaaaacgataccaacccgaaacccgcccccgcctacccgaaaaccccccgccgccccgaaaccccccgc

SEQ ID NO: 18143 - DNA, 566 bp, Artificial Sequence
  chemically treated genomic DNA (Homo sapiens) CpG-island No: 18143
  misc_feature (295)..(295): n is either a, c, g or t
tttttatatttttatttttatttcggtcgggagatttttttttcgtttagtgttgtagtcggtttttgttttttttgcgttttcgggttttcggtcgtttcggattcgtttaggttgttaattcgtcgggcgtttgtagtttggggtttggggaggcgagaaggagtcgtagagtcggacgggtattggaggggcgtgcgggtgcgagtcggcgttttttttaattcggacggatttcgtagttcgcgtttcgaggtttttgggggagtcggattttagttcgtacgtgcgcgtntaaaggtcgagcggcgcgcgttttttttttttttcgcgttttcgtcggagcgcgcggttttatttattcgagtcgtggcgtattagtaggttcgggttcggggttcgcgggtcgtagcgtagttttcgtagcgcggagcgttagaagaggtcgtttatgacgttcggttcgcgggtcgttgtgagcgcgaggagcgggcgcggagggcggtgttagttcgagattcgttttcgtttgttcgggagtttttcgtcgtttcggagtttttcgt

SEQ ID NO: 18144 - DNA, 566 bp, Artificial Sequence
  chemically treated genomic DNA (Homo sapiens) CpG-island No: 18144
  misc_feature (272)..(272): n is either a, c, g or t
acgaaaaactccgaaacgacgaaaaactcccgaacaaacgaaaacgaatctcgaactaacaccgccctccgcgcccgctcctcgcgctcacaacgacccgcgaaccgaacgtcataaacgacctcttctaacgctccgcgctacgaaaactacgctacgacccgcgaaccccgaacccgaacctactaatacgccacgactcgaataaataaaaccgcgcgctccgacgaaaacgcgaaaaaaaaaaaaaacgcgcgccgctcgacctttanacgcgcacgtacgaactaaaatccgactcccccaaaaacctcgaaacgcgaactacgaaatccgtccgaattaaaaaaaacgccgactcgcacccgcacgcccctccaatacccgtccgactctacgactccttctcgcctccccaaaccccaaactacaaacgcccgacgaattaacaacctaaacgaatccgaaacgaccgaaaacccgaaaacgcaaaaaaaacaaaaaccgactacaacactaaacgaaaaaaaaatctcccgaccgaaataaaaataaaaatataaaaa

SEQ ID NO: 18145 - DNA, 531 bp, Artificial Sequence
  chemically treated genomic DNA (Homo sapiens) CpG-island No: 18145
aaagattcggggaggagattcgtagatcgtcgagtttttgtcgcgggaatcgcgttttcggtttcgtaatgcgtttgcgtttcgcgcgtcgatttttagttttagtaggtcgcgggcgggggcggggttttcggggagaattcgggggaggggcggggttttcgggaagtaattagggtaggggcggggcgttcggggagtggggcggggttttcggttttaggcgagttcgtagttgcgcgtcgggttttggaggtcgaggtcgttttcgttcgttgttttcgtagttttcgacgggagcgttatggtttagtcgtcgttcgacgtggagggggacgattgttttttcgcgtatcgttattttttttgttcggatttgttgcggtgagcggggtttgggaagcgagcgtagttttggtgcggggttcggttcgcgggcgtcggcgtttttacgtggttttcgagggttcgcgtgttaggaaatttgttttgtttggtttttttttttttttttttttttttttttttttt

SEQ ID NO: 18146 - DNA, 531 bp, Artificial Sequence
  chemically treated genomic DNA (Homo sapiens) CpG-island No: 18146
aaaaaaaaaaaaaaaaaaaaaaaaaaaaaaaaaaccaaacaaaacaaatttcctaacacgcgaaccctcgaaaaccacgtaaaaacgccgacgcccgcgaaccgaaccccgcaccaaaactacgctcgcttcccaaaccccgctcaccgcaacaaatccgaacaaaaaaaataacgatacgcgaaaaaacaatcgtccccctccacgtcgaacgacgactaaaccataacgctcccgtcgaaaactacgaaaacaacgaacgaaaacgacctcgacctccaaaacccgacgcgcaactacgaactcgcctaaaaccgaaaaccccgccccactccccgaacgccccgcccctaccctaattacttcccgaaaaccccgcccctcccccgaattctccccgaaaaccccgcccccgcccgcgacctactaaaactaaaaatcgacgcgcgaaacgcaaacgcattacgaaaccgaaaacgcgattcccgcgacaaaaactcgacgatctacgaatctcctccccgaatcttt

SEQ ID NO: 18147 - DNA, 531 bp, Artificial Sequence
  chemically treated genomic DNA (Homo sapiens) CpG-island No: 18147
aaaaaaaaaaagaaagaaaaaagaaagaaaggagttaggtaagataggttttttaatacgcgagttttcggggattacgtgggggcgtcggcgttcgcggatcggatttcgtattaaggttgcgttcgttttttaggtttcgtttatcgtagtaggttcgggtagaagaggtggcggtacgcggggagatagtcgtttttttttacgtcgggcggcggttgggttatggcgttttcgtcggggattgcggggataacgggcgggagcggtttcggtttttaggattcggcgcgtagttgcgaattcgtttggaatcgggagtttcgttttatttttcggacgtttcgtttttgttttgattgtttttcggaggtttcgtttttttttcgaatttttttcggaggtttcgttttcgttcgcggtttgttgggattggaagtcggcgcgcgaggcgtaggcgtattgcggggtcgggggcgcggttttcgcggtagaagttcggcggtttgcgggtttttttttcgagttttt

SEQ ID NO: 18148 - DNA, 531 bp, Artificial Sequence
  chemically treated genomic DNA (Homo sapiens) CpG-island No: 18148
aaaaactcgaaaaaaaaacccgcaaaccgccgaacttctaccgcgaaaaccgcgcccccgaccccgcaatacgcctacgcctcgcgcgccgacttccaatcccaacaaaccgcgaacgaaaacgaaacctccgaaaaaaattcgaaaaaaaaacgaaacctccgaaaaacaatcaaaacaaaaacgaaacgtccgaaaaataaaacgaaactcccgattccaaacgaattcgcaactacgcgccgaatcctaaaaaccgaaaccgctcccgcccgttatccccgcaatccccgacgaaaacgccataacccaaccgccgcccgacgtaaaaaaaaacgactatctccccgcgtaccgccacctcttctacccgaacctactacgataaacgaaacctaaaaaacgaacgcaaccttaatacgaaatccgatccgcgaacgccgacgcccccacgtaatccccgaaaactcgcgtattaaaaaacctatcttacctaactcctttctttcttttttctttcttttttttttt

SEQ ID NO: 18149 - DNA, 706 bp, Artificial Sequence
  chemically treated genomic DNA (Homo sapiens) CpG-island No: 18149
tgtaatgcgtttcggttttttgtaattcgtgtgtgtttcgtgtttgtaatgggttttggttttttgtaaattcgtgtgtgtttcgtgtttgtaatgggtttcggttttttgtaattcgtgtatgtttcgtgtttgtaatgggtttcggttttttgtaattcgtgtgtgtttcgtgtatgtaatgtgattcggttttttgtaaattcgtgtgtgtttcgtgtttgtaatgtgtcgcggttttttgtaattcgtgtgtgtttcgtgtttgtaatgcgtttcggttttttgtaattcgtgtgtgtttcgtgtttgtaatgcgtttcggttttttgtaattcgtgtgtgtttcgtgtttgtaatgggtttcggttttttgtaattcgtgtgtgtttcgtgtttgtaatgtgtttcggttttttgtaattcgtgtgtgtttcgtgtttgtaatgggtttcggttttttgtaattcgtgtgtgtttcgtgtttgtaatgtgtttcggttttttgtaattcgtgtgtgtttcgtgtttgtaatgggttttggttttttgtaaagttgtgtgtgtttcgtgtttgtaatgtgtttcggttttttgtaaattcgtgtgtgtttcgtgtttgtaatgtgtcgcggttttttgtaaatttttgtgtgttttatattatttggattaggtatttttttttagcggttcggggtgttga

SEQ ID NO: 18150 - DNA, 706 bp, Artificial Sequence
  chemically treated genomic DNA (Homo sapiens) CpG-island No: 18150
tcaacaccccgaaccgctaaaaaaaaatacctaatccaaataatataaaacacacaaaaatttacaaaaaaccgcgacacattacaaacacgaaacacacacgaatttacaaaaaaccgaaacacattacaaacacgaaacacacacaactttacaaaaaaccaaaacccattacaaacacgaaacacacacgaattacaaaaaaccgaaacacattacaaacacgaaacacacacgaattacaaaaaaccgaaacccattacaaacacgaaacacacacgaattacaaaaaaccgaaacacattacaaacacgaaacacacacgaattacaaaaaaccgaaacccattacaaacacgaaacacacacgaattacaaaaaaccgaaacgcattacaaacacgaaacacacacgaattacaaaaaaccgaaacgcattacaaacacgaaacacacacgaattacaaaaaaccgcgacacattacaaacacgaaacacacacgaatttacaaaaaaccgaatcacattacatacacgaaacacacacgaattacaaaaaaccgaaacccattacaaacacgaaacatacacgaattacaaaaaaccgaaacccattacaaacacgaaacacacacgaatttacaaaaaaccaaaacccattacaaacacgaaacacacacgaattacaaaaaaccgaaacgcattaca

SEQ ID NO: 18151 - DNA, 706 bp, Artificial Sequence
  chemically treated genomic DNA (Homo sapiens) CpG-island No: 18151
ttagtatttcgggtcgttgggagaaggtatttagtttagatgatatgggatatataggggtttataggaaatcgcgatatattatagatacgggatatatacgggtttataggaaatcgggatatattatagatacgggatatatatagttttataggaaattaggatttattatagatacgggatatatacgggttataggaaatcgggatatattatagatacgggatatatacgggttataggaaatcgggatttattatagatacgggatatatacgggttataggaaatcgggatatattatagatacgggatatatacgggttataggaaatcgggatttattatagatacgggatatatacgggttataggaaatcgggacgtattatagatacgggatatatacgggttataggaaatcgggacgtattatagatacgggatatatacgggttataggaaatcgcgatatattatagatacgggatatatacgggtttataggaaatcgggttatattatatatacgggatatatacgggttataggaaatcgggatttattatagatacgggatatatacgggttataggaaatcgggatttattatagatacgggatatatacgggtttataggaaattaggatttattatagatacgggatatatacgggttataggaaatcgggacgtattata

SEQ ID NO: 18152 - DNA, 706 bp, Artificial Sequence
  chemically treated genomic DNA (Homo sapiens) CpG-island No: 18152
tataatacgtcccgatttcctataacccgtatatatcccgtatctataataaatcctaatttcctataaacccgtatatatcccgtatctataataaatcccgatttcctataacccgtatatatcccgtatctataataaatcccgatttcctataacccgtatatatcccgtatatataatataacccgatttcctataaacccgtatatatcccgtatctataatatatcgcgatttcctataacccgtatatatcccgtatctataatacgtcccgatttcctataacccgtatatatcccgtatctataatacgtcccgatttcctataacccgtatatatcccgtatctataataaatcccgatttcctataacccgtatatatcccgtatctataatatatcccgatttcctataacccgtatatatcccgtatctataataaatcccgatttcctataacccgtatatatcccgtatctataatatatcccgatttcctataacccgtatatatcccgtatctataataaatcctaatttcctataaaactatatatatcccgtatctataatatatcccgatttcctataaacccgtatatatcccgtatctataatatatcgcgatttcctataaacccctatatatcccatatcatctaaactaaataccttctcccaacgacccgaaatactaa

SEQ ID NO: 18153 - DNA, 2474 bp, Artificial Sequence
  chemically treated genomic DNA (Homo sapiens) CpG-island No: 18153
ggacgggtgtgagtggtgttacgggacgggtgtgagtggtgttacgggacgggtgtgagtggtgtttcgggacgggtgtgagtggtgttacgggacgggtgtgagtgatgttacgggacgggtgtgagtggtgttacgggacgggtgtgagtggtgttacgggacgggtgtgagtggtgtttcgggacgggtgtgcgtggtgtttcgggacgggtgtgcgtggtgtttcgggacgggtgtgtagtggtgtttcgggacgggtgtgcgtggtgtttcgggatgggtgtgcgtggtgtttcgggatgggtgtgagtggtgtttcgggatgggtgtgagtggtgtttcgggatgggtgtgcgtggtgttacgggatgggtgtgtagtggtgtttcgggatgggtgtgcgtggtgtttcgggatgggtgtgcgtggtgtttcgggatgggtgtgcgtggtgtttcgggatgggtgtgcgtggtgtttcgggatgggtgtgagtggtgtttcgggatgggtgtgagtggtgtttcgggatgggtgtgtagtggtgtttcgggatgggtgtgagtggtgtttcgggatgggtgtgagtggtgtttcgggatgggtgtgagtggtgttacgggatgggtgtgagtggtgtttcgggatgggtgtgcgtggtgttacgggatgggtgtgagtggtgtttcgggatgggtgtgcgtggtgttacgggatgggtgtgagtggtgttacgggatgggtgtgtagtggtgtttcgggatgggtgtgtagtggtgtttcgggatgggtgtgtagtggtgtttcgggatgggtgtgagtggtgtttcgggacgggtgtgtagtggtgtttcgggacgggtgtgagtggtgtttcgggacgggtgtgagtggtgttacgggacgggtgtgagtggtgttacgggacgggtgtgagtggtgattcgggacgggtgtgtagtggtgattcgggacgggtgtgcgtggtgtttcgggacgggtgtgtagtggtgtttcgggacgggtgtgtagtggtgtttcgggacgggtgtgagtggtgtttcgggacgggtgtgagtggtgtttcgggacgggtgtgtagtggtgtttcgggacgggtgtgtagtggtgtttcgggacgggtgtgagtggtgttacgggacgggtgtgagtggtgttacgggacgggtgtgagtggtgtttcgggacgggtgtgagtggtgtttcgggacgggtgtgattggtgttacgggacgggtgtgtagtggtgttacgggacgggtgtgagtggtgtttcgggacgggtgtgagtggtgttacgggacgggtgtgagtggtgttacgggacgggtgtgagtggtgtttcgggacgggtgtgtagtggtgtttcgggacgggtgtgtagtggtgttacgggacgggtgtgtagtggtgttacgggacgggtgtgtagtggtgttacgggacgggtgtgtagtggtgttacgggacgcgtgtgtagtggtgttacgggacgggtgtgagtgatgttacgggacgggtgtgagtggtgttacgggacgggtgtgagtggtgtttcgggacgggtgtgtagtgatgtttcgggacgggtgtgtattgatgttacgggacgggtgtgtagtggtgtttcgggacgggtgtgagtggtgtttcgggacgggtgtgagtggtgtttcgggacgggtgtgtagtggtgttacgggacgggtgtgtagtggtgttacgggacgggtgtgagtggtgtttcgggacgggtgtgagtggtgtttcgggacgggtgtgtagtgttgttacgggacgggtgtgtagtggtgtttcgggacgggtgtgtagtggtgtttcgggatgggtgtgtagtggtgtttcgggaggggtgtgtagtggtgtttcgggacgggtgtgagtggtgttacgggacgggtgtgagtggtgtttcgggacgggtgtgagtggtgtttcgggacgggtgtgtagtgttgttacgggacgggtgtgagtggtgtttcgggacgggtgtgtagtgatgttacgggacgggtgtgtagtggtgtttcgggacgggtgtgtagtggtgtttcgggacgggtgtgtagtggtgtttcgggacgggtgtgcgtggtgtttcgggacgggtgtgtagtggtgtttcgggacgggtgtgtagtggtgtttcgggacgggtgtgtagtggtgtttcgggacgggtgtgtagtggtgtttcgggatgggtgtgagtggtgtttcgggatgggtgtgtagtgatgttacgagatgggtgtgagtggtgtttcgggatgggtgtgagtggtgttacgggatgggtgtgtagtggtgtttcgggatgggtgtgagtggtgtttcgggatgggtgtgtagtggtgttacgggatcggtgtgagtggtgttacgggatgggtgtgtagtgatggtatcggatgggtgtgtagtgg

SEQ ID NO: 18154 - DNA, 2474 bp, Artificial Sequence
  chemically treated genomic DNA (Homo sapiens) CpG-island No: 18154
ccactacacacccatccgataccatcactacacacccatcccgtaacaccactcacaccgatcccgtaacaccactacacacccatcccgaaacaccactcacacccatcccgaaacaccactacacacccatcccgtaacaccactcacacccatcccgaaacaccactcacacccatctcgtaacatcactacacacccatcccgaaacaccactcacacccatcccgaaacaccactacacacccgtcccgaaacaccactacacacccgtcccgaaacaccactacacacccgtcccgaaacaccactacacacccgtcccgaaacaccacgcacacccgtcccgaaacaccactacacacccgtcccgaaacaccactacacacccgtcccgaaacaccactacacacccgtcccgtaacatcactacacacccgtcccgaaacaccactcacacccgtcccgtaacaacactacacacccgtcccgaaacaccactcacacccgtcccgaaacaccactcacacccgtcccgtaacaccactcacacccgtcccgaaacaccactacacacccctcccgaaacaccactacacacccatcccgaaacaccactacacacccgtcccgaaacaccactacacacccgtcccgtaacaacactacacacccgtcccgaaacaccactcacacccgtcccgaaacaccactcacacccgtcccgtaacaccactacacacccgtcccgtaacaccactacacacccgtcccgaaacaccactcacacccgtcccgaaacaccactcacacccgtcccgaaacaccactacacacccgtcccgtaacatcaatacacacccgtcccgaaacatcactacacacccgtcccgaaacaccactcacacccgtcccgtaacaccactcacacccgtcccgtaacatcactcacacccgtcccgtaacaccactacacacgcgtcccgtaacaccactacacacccgtcccgtaacaccactacacacccgtcccgtaacaccactacacacccgtcccgtaacaccactacacacccgtcccgaaacaccactacacacccgtcccgaaacaccactcacacccgtcccgtaacaccactcacacccgtcccgtaacaccactcacacccgtcccgaaacaccactcacacccgtcccgtaacaccactacacacccgtcccgtaacaccaatcacacccgtcccgaaacaccactcacacccgtcccgaaacaccactcacacccgtcccgtaacaccactcacacccgtcccgtaacaccactcacacccgtcccgaaacaccactacacacccgtcccgaaacaccactacacacccgtcccgaaacaccactcacacccgtcccgaaacaccactcacacccgtcccgaaacaccactacacacccgtcccgaaacaccactacacacccgtcccgaaacaccacgcacacccgtcccgaatcaccactacacacccgtcccgaatcaccactcacacccgtcccgtaacaccactcacacccgtcccgtaacaccactcacacccgtcccgaaacaccactcacacccgtcccgaaacaccactacacacccgtcccgaaacaccactcacacccatcccgaaacaccactacacacccatcccgaaacaccactacacacccatcccgaaacaccactacacacccatcccgtaacaccactcacacccatcccgtaacaccacgcacacccatcccgaaacaccactcacacccatcccgtaacaccacgcacacccatcccgaaacaccactcacacccatcccgtaacaccactcacacccatcccgaaacaccactcacacccatcccgaaacaccactcacacccatcccgaaacaccactacacacccatcccgaaacaccactcacacccatcccgaaacaccactcacacccatcccgaaacaccacgcacacccatcccgaaacaccacgcacacccatcccgaaacaccacgcacacccatcccgaaacaccacgcacacccatcccgaaacaccactacacacccatcccgtaacaccacgcacacccatcccgaaacaccactcacacccatcccgaaacaccactcacacccatcccgaaacaccacgcacacccatcccgaaacaccacgcacacccgtcccgaaacaccactacacacccgtcccgaaacaccacgcacacccgtcccgaaacaccacgcacacccgtcccgaaacaccactcacacccgtcccgtaacaccactcacacccgtcccgtaacaccactcacacccgtcccgtaacatcactcacacccgtcccgtaacaccactcacacccgtcccgaaacaccactcacacccgtcccgtaacaccactcacacccgtcccgtaacaccactcacacccgtcc

SEQ ID NO: 18155 - DNA, 2474 bp, Artificial Sequence
  chemically treated genomic DNA (Homo sapiens) CpG-island No: 18155
ttattgtatatttattcggtattattattgtatatttatttcgtgatattatttatatcgatttcgtgatattattgtatatttatttcgagatattatttatatttatttcgagatattattgtatatttatttcgtgatattatttatatttatttcgagatattatttatatttatttcgtgatattattgtatatttatttcgagatattatttatatttatttcgagatattattgtatattcgtttcgagatattattgtatattcgtttcgagatattattgtatattcgtttcgagatattattgtatattcgtttcgagatattacgtatattcgtttcgagatattattgtatattcgtttcgagatattattgtatattcgtttcgagatattattgtatattcgtttcgtgatattattgtatattcgtttcgagatattatttatattcgtttcgtgataatattgtatattcgtttcgagatattatttatattcgtttcgagatattatttatattcgtttcgtgatattatttatattcgtttcgagatattattgtatatttttttcgagatattattgtatatttatttcgagatattattgtatattcgtttcgagatattattgtatattcgtttcgtgataatattgtatattcgtttcgagatattatttatattcgtttcgagatattatttatattcgtttcgtgatattattgtatattcgtttcgtgatattattgtatattcgtttcgagatattatttatattcgtttcgagatattatttatattcgtttcgagatattattgtatattcgtttcgtgatattagtgtatattcgtttcgagatattattgtatattcgtttcgagatattatttatattcgtttcgtgatattatttatattcgtttcgtgatattatttatattcgtttcgtgatattattgtatacgcgtttcgtgatattattgtatattcgtttcgtgatattattgtatattcgtttcgtgatattattgtatattcgtttcgtgatattattgtatattcgtttcgagatattattgtatattcgtttcgagatattatttatattcgtttcgtgatattatttatattcgtttcgtgatattatttatattcgtttcgagatattatttatattcgtttcgtgatattattgtatattcgtttcgtgatattagttatattcgtttcgagatattatttatattcgtttcgagatattatttatattcgtttcgtgatattatttatattcgtttcgtgatattatttatattcgtttcgagatattattgtatattcgtttcgagatattattgtatattcgtttcgagatattatttatattcgtttcgagatattatttatattcgtttcgagatattattgtatattcgtttcgagatattattgtatattcgtttcgagatattacgtatattcgtttcgagttattattgtatattcgtttcgagttattatttatattcgtttcgtgatattatttatattcgtttcgtgatattatttatattcgtttcgagatattatttatattcgtttcgagatattattgtatattcgtttcgagatattatttatatttatttcgagatattattgtatatttatttcgagatattattgtatatttatttcgagatattattgtatatttatttcgtgatattatttatatttatttcgtgatattacgtatatttatttcgagatattatttatatttatttcgtgatattacgtatatttatttcgagatattatttatatttatttcgtgatattatttatatttatttcgagatattatttatatttatttcgagatattatttatatttatttcgagatattattgtatatttatttcgagatattatttatatttatttcgagatattatttatatttatttcgagatattacgtatatttatttcgagatattacgtatatttatttcgagatattacgtatatttatttcgagatattacgtatatttatttcgagatattattgtatatttatttcgtgatattacgtatatttatttcgagatattatttatatttatttcgagatattatttatatttatttcgagatattacgtatatttatttcgagatattacgtatattcgtttcgagatattattgtatattcgtttcgagatattacgtatattcgtttcgagatattacgtatattcgtttcgagatattatttatattcgtttcgtgatattatttatattcgtttcgtgatattatttatattcgtttcgtgatattatttatattcgtttcgtgatattatttatattcgtttcgagatattatttatattcgtttcgtgatattatttatattcgtttcgtgatattatttatattcgttt

SEQ ID NO: 18156 - DNA, 2474 bp, Artificial Sequence
  chemically treated genomic DNA (Homo sapiens) CpG-island No: 18156
aaacgaatataaataatatcacgaaacgaatataaataatatcacgaaacgaatataaataatatctcgaaacgaatataaataatatcacgaaacgaatataaataatatcacgaaacgaatataaataatatcacgaaacgaatataaataatatcacgaaacgaatataaataatatctcgaaacgaatatacgtaatatctcgaaacgaatatacgtaatatctcgaaacgaatatacaataatatctcgaaacgaatatacgtaatatctcgaaataaatatacgtaatatctcgaaataaatataaataatatctcgaaataaatataaataatatctcgaaataaatatacgtaatatcacgaaataaatatacaataatatctcgaaataaatatacgtaatatctcgaaataaatatacgtaatatctcgaaataaatatacgtaatatctcgaaataaatatacgtaatatctcgaaataaatataaataatatctcgaaataaatataaataatatctcgaaataaatatacaataatatctcgaaataaatataaataatatctcgaaataaatataaataatatctcgaaataaatataaataatatcacgaaataaatataaataatatctcgaaataaatatacgtaatatcacgaaataaatataaataatatctcgaaataaatatacgtaatatcacgaaataaatataaataatatcacgaaataaatatacaataatatctcgaaataaatatacaataatatctcgaaataaatatacaataatatctcgaaataaatataaataatatctcgaaacgaatatacaataatatctcgaaacgaatataaataatatctcgaaacgaatataaataatatcacgaaacgaatataaataatatcacgaaacgaatataaataataactcgaaacgaatatacaataataactcgaaacgaatatacgtaatatctcgaaacgaatatacaataatatctcgaaacgaatatacaataatatctcgaaacgaatataaataatatctcgaaacgaatataaataatatctcgaaacgaatatacaataatatctcgaaacgaatatacaataatatctcgaaacgaatataaataatatcacgaaacgaatataaataatatcacgaaacgaatataaataatatctcgaaacgaatataaataatatctcgaaacgaatataactaatatcacgaaacgaatatacaataatatcacgaaacgaatataaataatatctcgaaacgaatataaataatatcacgaaacgaatataaataatatcacgaaacgaatataaataatatctcgaaacgaatatacaataatatctcgaaacgaatatacaataatatcacgaaacgaatatacaataatatcacgaaacgaatatacaataatatcacgaaacgaatatacaataatatcacgaaacgcgtatacaataatatcacgaaacgaatataaataatatcacgaaacgaatataaataatatcacgaaacgaatataaataatatctcgaaacgaatatacaataatatctcgaaacgaatatacactaatatcacgaaacgaatatacaataatatctcgaaacgaatataaataatatctcgaaacgaatataaataatatctcgaaacgaatatacaataatatcacgaaacgaatatacaataatatcacgaaacgaatataaataatatctcgaaacgaatataaataatatctcgaaacgaatatacaatattatcacgaaacgaatatacaataatatctcgaaacgaatatacaataatatctcgaaataaatatacaataatatctcgaaaaaaatatacaataatatctcgaaacgaatataaataatatcacgaaacgaatataaataatatctcgaaacgaatataaataatatctcgaaacgaatatacaatattatcacgaaacgaatataaataatatctcgaaacgaatatacaataatatcacgaaacgaatatacaataatatctcgaaacgaatatacaataatatctcgaaacgaatatacaataatatctcgaaacgaatatacgtaatatctcgaaacgaatatacaataatatctcgaaacgaatatacaataatatctcgaaacgaatatacaataatatctcgaaacgaatatacaataatatctcgaaataaatataaataatatctcgaaataaatatacaataatatcacgaaataaatataaataatatctcgaaataaatataaataatatcacgaaataaatatacaataatatctcgaaataaatataaataatatctcgaaataaatatacaataatatcacgaaatcgatataaataatatcacgaaataaatatacaataataataccgaataaatatacaataa

SEQ ID NO: 18157 - DNA, 526 bp, Artificial Sequence
  chemically treated genomic DNA (Homo sapiens) CpG-island No: 18157
cgggtaggtgcggtttaggtgcggtttcgcggtcggttcgcgggttttcgtagatcgggttttttttcgagggcgcggtcgttttagggttcgttcggttcgtcgtttaatgcgagtttttattttcgcgagcggcgtcgttttttttaatcggttgcgggcgcggcgtcgatcgtttaaagtttaagtcgtcgggggtgggcgtgaggggcggtggtcgcgttgagataggttgcggagggatgattggcgttttggcgtttaatgggcgttggcgggcggttttgagtatttgcgttgggcgggcgggaacggcgcgcggcgagttgagggtggcggcggtcgatatgttttaggtttcggatagcgagggcggtcgcgtcggttttaggtgcggcgcggggtatacgggaggcgggcggatagcgcgattacgtggcgggagcgggttagtttagggcgtttattagtcgtgtggggttggggtggggttggggggtagggcgattttatagaggttttcggg

SEQ ID NO: 18158 - DNA, 526 bp, Artificial Sequence
  chemically treated genomic DNA (Homo sapiens) CpG-island No: 18158
cccgaaaacctctataaaatcgccctaccccccaaccccaccccaaccccacacgactaataaacgccctaaactaacccgctcccgccacgtaatcgcgctatccgcccgcctcccgtataccccgcgccgcacctaaaaccgacgcgaccgccctcgctatccgaaacctaaaacatatcgaccgccgccaccctcaactcgccgcgcgccgttcccgcccgcccaacgcaaatactcaaaaccgcccgccaacgcccattaaacgccaaaacgccaatcatccctccgcaacctatctcaacgcgaccaccgcccctcacgcccacccccgacgacttaaactttaaacgatcgacgccgcgcccgcaaccgattaaaaaaaacgacgccgctcgcgaaaataaaaactcgcattaaacgacgaaccgaacgaaccctaaaacgaccgcgccctcgaaaaaaaacccgatctacgaaaacccgcgaaccgaccgcgaaaccgcacctaaaccgcacctacccg

SEQ ID NO: 18159 - DNA, 526 bp, Artificial Sequence
  chemically treated genomic DNA (Homo sapiens) CpG-island No: 18159
ttcgagggtttttgtgaggtcgttttgttttttaattttattttaattttatacggttggtggacgttttgggttggttcgttttcgttacgtggtcgcgttattcgttcgtttttcgtgtgtttcgcgtcgtatttggagtcggcgcggtcgttttcgttattcgggatttggaatatgtcgatcgtcgttatttttagttcgtcgcgcgtcgttttcgttcgtttagcgtaggtatttaaggtcgttcgttagcgtttattgggcgttaagacgttaattattttttcgtagtttattttagcgcggttatcgttttttacgtttattttcgacgatttaggttttgaacggtcggcgtcgcgttcgtagtcgattggggaaggcgacgtcgttcgcggaggtgggagttcgtattgggcggcgggtcgggcgggttttgggacggtcgcgttttcgggaggaagttcggtttgcgggagttcgcgagtcgatcgcggggtcgtatttgggtcgtatttgttcg

SEQ ID NO: 18160 - DNA, 526 bp, Artificial Sequence
  chemically treated genomic DNA (Homo sapiens) CpG-island No: 18160
cgaacaaatacgacccaaatacgaccccgcgatcgactcgcgaactcccgcaaaccgaacttcctcccgaaaacgcgaccgtcccaaaacccgcccgacccgccgcccaatacgaactcccacctccgcgaacgacgtcgccttccccaatcgactacgaacgcgacgccgaccgttcaaaacctaaatcgtcgaaaataaacgtaaaaaacgataaccgcgctaaaataaactacgaaaaaataattaacgtcttaacgcccaataaacgctaacgaacgaccttaaatacctacgctaaacgaacgaaaacgacgcgcgacgaactaaaaataacgacgatcgacatattccaaatcccgaataacgaaaacgaccgcgccgactccaaatacgacgcgaaacacacgaaaaacgaacgaataacgcgaccacgtaacgaaaacgaaccaacccaaaacgtccaccaaccgtataaaattaaaataaaattaaaaaacaaaacgacctcacaaaaaccctcgaa

SEQ ID NO: 18161 - DNA, 520 bp, Artificial Sequence
  chemically treated genomic DNA (Homo sapiens) CpG-island No: 18161
cgggatttcggtttattttattagcgcggcgatagcggaggagcgttcgggttttttgtatcgttcgtcgtttgttaagtcgcgtttttagcgtcgggtgtcggtagtttttggggaagcggtgtttgattatcgtcgcgcggttttggaagcggttacggaatacgcgcgtttcggtattttgttttattagttttaggtcgtttaagaagcggttgtttcgttttcgggttgcggttagagttttagttttcggggcgggtttttcgttatcggtcggcgtagtagttttggtcgtcgttatgattgttcggcgtaatagttttaatcgattagttgtttttgaaaattgtcgcgatgtttcggttcgtttcggaaattttgggattttttcggtaattttgggattttttcggttattcgaatgcgtttatttcggatattttcggtttgtaagtggttacgttttttaatttttcggttttttgaagtttgaggttttttgtaggaagggtttttg

SEQ ID NO: 18162 - DNA, 520 bp, Artificial Sequence
  chemically treated genomic DNA (Homo sapiens) CpG-island No: 18162
caaaaacccttcctacaaaaaacctcaaacttcaaaaaaccgaaaaattaaaaaacgtaaccacttacaaaccgaaaatatccgaaataaacgcattcgaataaccgaaaaaatcccaaaattaccgaaaaaatcccaaaatttccgaaacgaaccgaaacatcgcgacaattttcaaaaacaactaatcgattaaaactattacgccgaacaatcataacgacgaccaaaactactacgccgaccgataacgaaaaacccgccccgaaaactaaaactctaaccgcaacccgaaaacgaaacaaccgcttcttaaacgacctaaaactaataaaacaaaataccgaaacgcgcgtattccgtaaccgcttccaaaaccgcgcgacgataatcaaacaccgcttccccaaaaactaccgacacccgacgctaaaaacgcgacttaacaaacgacgaacgatacaaaaaacccgaacgctcctccgctatcgccgcgctaataaaataaaccgaaatcccg

SEQ ID NO: 18163 - DNA, 520 bp, Artificial Sequence
  chemically treated genomic DNA (Homo sapiens) CpG-island No: 18163
taagagttttttttgtagggaattttaggttttagagagtcgaaaagttgggaggcgtaattatttataggtcggaagtgttcggggtggacgtattcgggtagtcgaagaagttttaggattgtcgaagaagttttaggattttcgaagcgagtcgaagtatcgcgatagtttttagagatagttgatcggttggagttgttgcgtcgagtagttatggcggcggttagagttattacgtcggtcgatggcgaggagttcgtttcggaggttgaggttttggtcgtagttcgggagcggagtagtcgttttttgagcggtttggagttggtgaagtagggtgtcgaggcgcgcgtgtttcgtggtcgtttttagggtcgcgcggcggtgattaagtatcgtttttttaagggttatcggtattcggcgttggaggcgcggtttggtagacggcggacggtgtaggaggttcgggcgttttttcgttgtcgtcgcgttggtaaggtgggtcgggatttcg

SEQ ID NO: 18164 - DNA, 520 bp, Artificial Sequence
  chemically treated genomic DNA (Homo sapiens) CpG-island No: 18164
cgaaatcccgacccaccttaccaacgcgacgacaacgaaaaaacgcccgaacctcctacaccgtccgccgtctaccaaaccgcgcctccaacgccgaataccgataacccttaaaaaaacgatacttaatcaccgccgcgcgaccctaaaaacgaccacgaaacacgcgcgcctcgacaccctacttcaccaactccaaaccgctcaaaaaacgactactccgctcccgaactacgaccaaaacctcaacctccgaaacgaactcctcgccatcgaccgacgtaataactctaaccgccgccataactactcgacgcaacaactccaaccgatcaactatctctaaaaactatcgcgatacttcgactcgcttcgaaaatcctaaaacttcttcgacaatcctaaaacttcttcgactacccgaatacgtccaccccgaacacttccgacctataaataattacgcctcccaacttttcgactctctaaaacctaaaattccctacaaaaaaaactctta

SEQ ID NO: 18165 - DNA, 659 bp, Artificial Sequence
  chemically treated genomic DNA (Homo sapiens) CpG-island No: 18165
tcgggagaaggtcgcgttaggagagaagtcgcgcggcgtttagggtaaggtgtagagggcggcgcggcggtgtagcgagaaagacgcggagagagggcgttgttttgtggttttgtaatttttcgttagtttttacgtttttttcgcgcgttttcggcgttttttcgttttttttgttttttcgcgatttttgcgttttcgtgcgcgcgcgttcgtttgtttgttttttgtcgtcgtcgttgttcgggttatggcgatttgtatttggttgcggagttgtggggttcggcgtttcgggtcgacgtttttaggttgtcgttttcgttttcgcgtcggcggtttggtttttgttttcgggtttgcgttcggttcggtttagtttcgttgttacgttgggcgtttggcgggtttttttgcggcgttgttgcgtatcgatagtttcgtgggcggtcgttggttttcggtcgtcgttatttttttcgtgtaagattcggttagcggcgtcgttttgggtatggtagtcgattgcggggtgcgagaggttcgcgtcgtcgtgcgcgttgtttacgaggttttttgtcgttggagggaggttttcgttaaggtgagagagttcggatgtagggggttagagttggtcggggatacggcggggagta

SEQ ID NO: 18166 - DNA, 659 bp, Artificial Sequence
  chemically treated genomic DNA (Homo sapiens) CpG-island No: 18166
tactccccgccgtatccccgaccaactctaaccccctacatccgaactctctcaccttaacgaaaacctccctccaacgacaaaaaacctcgtaaacaacgcgcacgacgacgcgaacctctcgcaccccgcaatcgactaccatacccaaaacgacgccgctaaccgaatcttacacgaaaaaaataacgacgaccgaaaaccaacgaccgcccacgaaactatcgatacgcaacaacgccgcaaaaaaacccgccaaacgcccaacgtaacaacgaaactaaaccgaaccgaacgcaaacccgaaaacaaaaaccaaaccgccgacgcgaaaacgaaaacgacaacctaaaaacgtcgacccgaaacgccgaaccccacaactccgcaaccaaatacaaatcgccataacccgaacaacgacgacgacaaaaaacaaacaaacgaacgcgcgcgcacgaaaacgcaaaaatcgcgaaaaaacaaaaaaaacgaaaaaacgccgaaaacgcgcgaaaaaaacgtaaaaactaacgaaaaattacaaaaccacaaaacaacgccctctctccgcgtctttctcgctacaccgccgcgccgccctctacaccttaccctaaacgccgcgcgacttctctcctaacgcgaccttctcccga

SEQ ID NO: 18167 - DNA, 659 bp, Artificial Sequence
  chemically treated genomic DNA (Homo sapiens) CpG-island No: 18167
tgtttttcgtcgtgttttcggttagttttggttttttgtattcgggtttttttattttggcggagatttttttttagcggtagaaagtttcgtaggtagcgcgtacggcggcgcgggtttttcgtatttcgtagtcggttattatgtttagagcggcgtcgttggtcgggttttgtacggggaaggtggcggcggtcgggagttagcggtcgtttacgaagttgtcggtgcgtagtagcgtcgtagagaggttcgttaggcgtttagcgtagtagcggagttgggtcgggtcgggcgtaggttcggaggtagggattaggtcgtcggcgcgggggcggaggcggtagtttggaaacgtcgattcgaggcgtcgggttttatagtttcgtagttaaatgtaggtcgttatggttcgggtaacgacggcgataggaaataggtaagcgggcgcgcgcgtacgggaacgtaggggtcgcggggaagtaagaggagcgaggaggcgtcggggacgcgcggggaaagcgtgggagttggcggaaggttgtagagttatagagtagcgtttttttttcgcgtttttttcgttgtatcgtcgcgtcgttttttgtattttgttttaagcgtcgcgcggttttttttttggcgcgattttttttcgg

SEQ ID NO: 18168 - DNA, 659 bp, Artificial Sequence
  chemically treated genomic DNA (Homo sapiens) CpG-island No: 18168
ccgaaaaaaaatcgcgccaaaaaaaaaaccgcgcgacgcttaaaacaaaatacaaaaaacgacgcgacgatacaacgaaaaaaacgcgaaaaaaaaacgctactctataactctacaaccttccgccaactcccacgctttccccgcgcgtccccgacgcctcctcgctcctcttacttccccgcgacccctacgttcccgtacgcgcgcgcccgcttacctatttcctatcgccgtcgttacccgaaccataacgacctacatttaactacgaaactataaaacccgacgcctcgaatcgacgtttccaaactaccgcctccgcccccgcgccgacgacctaatccctacctccgaacctacgcccgacccgacccaactccgctactacgctaaacgcctaacgaacctctctacgacgctactacgcaccgacaacttcgtaaacgaccgctaactcccgaccgccgccaccttccccgtacaaaacccgaccaacgacgccgctctaaacataataaccgactacgaaatacgaaaaacccgcgccgccgtacgcgctacctacgaaactttctaccgctaaaaaaaaatctccgccaaaataaaaaaacccgaatacaaaaaaccaaaactaaccgaaaacacgacgaaaaaca

SEQ ID NO: 18169 - DNA, 1138 bp, Artificial Sequence
  chemically treated genomic DNA (Homo sapiens) CpG-island No: 18169
cgggttacgtatttttagttcgagaggttttagcgtagagcgtagtagttttcgcgagcgtaggtttttttcgcggtggtttcgtttagggcgtttgggtttcggggatttcgttttcgtttcgttcggtgttatttaggtttcggtggcgtagggcggagtcgcgggcggcgggcgtaggtggggaggggcggtcggagcgcgtcggtgatattcgcgggggggcggggaaggcgcggcggtcgtattttattttgggaagaaatcggttaggtgtggtttaggcgtttagtgttagcggggaggagattcgtttcgtcgtcgattaatattaatatttagtttcgacgtagtttttttgcgtttttgtcgtttttcgagttatagtttttttttcgtttttgttttcggttcgtcgtcgttttcgcgttcgtagcggtttcgggagggtttaggtagcgagtagcgatttcgcgagtttttcgtattttcgttcggtttttcggtcgttcgtttatttttggtttttttcgtttttttcgcgtcggttcgtttcgtttatgtttcggcgttgagtcgttttttcgattgttcgtcgatatgagttgtaacggaggtttttattcgcggattaatattttgggtcgtatgattcgcgtcgagtttggttcggatttgcgttacgaggtgattagcggcggcgggggtattagtaggatgtattattttcggcgcggcgtgattatcgattagaattcggacggttattggtgggtatttgttcggagagcgcgggttgcggggttcgcgggatagggagggatcgtttttttttggacgattgggagattcgggtttcgaaggtggaaaggtttttttgttttaggtttcgaaagaatttttcggtcgcgttgggagtaggatcgggtgttttgacgcgtgcggggataggttggtttttgttttgcgaatagggattcggtcgtattttttttttttttcgcgagttcgggcgggtggttagagggggcgtcgggttcgcgcggggttgttttttgtttgttggatacggttgtagtcgtttttgttttagttcgcgaatgggaggttaggcgaggtggggttgcgattataaaat

SEQ ID NO: 18170 - DNA, 1138 bp, Artificial Sequence
  chemically treated genomic DNA (Homo sapiens) CpG-island No: 18170
attttataatcgcaaccccacctcgcctaacctcccattcgcgaactaaaacaaaaacgactacaaccgtatccaacaaacaaaaaacaaccccgcgcgaacccgacgccccctctaaccacccgcccgaactcgcgaaaaaaaaaaaaaatacgaccgaatccctattcgcaaaacaaaaaccaacctatccccgcacgcgtcaaaacacccgatcctactcccaacgcgaccgaaaaattctttcgaaacctaaaacaaaaaaacctttccaccttcgaaacccgaatctcccaatcgtccaaaaaaaaacgatccctccctatcccgcgaaccccgcaacccgcgctctccgaacaaatacccaccaataaccgtccgaattctaatcgataatcacgccgcgccgaaaataatacatcctactaatacccccgccgccgctaatcacctcgtaacgcaaatccgaaccaaactcgacgcgaatcatacgacccaaaatattaatccgcgaataaaaacctccgttacaactcatatcgacgaacaatcgaaaaaacgactcaacgccgaaacataaacgaaacgaaccgacgcgaaaaaaacgaaaaaaaccaaaaataaacgaacgaccgaaaaaccgaacgaaaatacgaaaaactcgcgaaatcgctactcgctacctaaaccctcccgaaaccgctacgaacgcgaaaacgacgacgaaccgaaaacaaaaacgaaaaaaaaactataactcgaaaaacgacaaaaacgcaaaaaaactacgtcgaaactaaatattaatattaatcgacgacgaaacgaatctcctccccgctaacactaaacgcctaaaccacacctaaccgatttcttcccaaaataaaatacgaccgccgcgccttccccgcccccccgcgaatatcaccgacgcgctccgaccgcccctccccacctacgcccgccgcccgcgactccgccctacgccaccgaaacctaaataacaccgaacgaaacgaaaacgaaatccccgaaacccaaacgccctaaacgaaaccaccgcgaaaaaaacctacgctcgcgaaaactactacgctctacgctaaaacctctcgaactaaaaatacgtaacccg

SEQ ID NO: 18171 - DNA, 1138 bp, Artificial Sequence
  chemically treated genomic DNA (Homo sapiens) CpG-island No: 18171
gttttgtggtcgtagttttatttcgtttgattttttattcgcgggttgggataaaggcggttgtagtcgtgtttagtaggtaggggatagtttcgcgcgggttcgacgttttttttgattattcgttcgggttcgcgggaggggagaaaggtacgatcgagtttttgttcgtaggataggggttaatttgttttcgtacgcgttaggatattcggttttgtttttagcgcggtcgggaagttttttcgggatttggggtaaaaaaatttttttattttcgggattcgagttttttagtcgtttagaggaggacggtttttttttgtttcgcgagtttcgtagttcgcgtttttcgggtaggtatttattagtagtcgttcgagttttggtcggtgattacgtcgcgtcgagaatagtatattttgttggtgttttcgtcgtcgttggttatttcgtagcgtaggttcgggttagattcggcgcggattatgcggtttagagtgttgattcgcgggtgggagttttcgttgtagtttatgtcggcgggtaatcgggagagcggtttagcgtcgaggtataagcgaggcgggtcggcgcggagaaagcggagggggttaaggataggcggacggtcggggaatcgggcgggagtgcggaaggttcgcgaggtcgttgttcgttatttgggttttttcgaggtcgttgcgagcgcggagacggcgacgggtcgggggtaggagcgggaggaaagttgtggttcggagggcggtaagggcgtagaggagttgcgtcggagttgggtgttggtgttggtcggcggcggagcgagtttttttttcgttggtattgggcgtttaggttatatttggtcggtttttttttagggtggggtgcggtcgtcgcgtttttttcgttttttcgcgggtgttatcgacgcgtttcggtcgtttttttttatttgcgttcgtcgttcgcgatttcgttttgcgttatcgaggtttgagtaatatcgggcggggcgggggcggggttttcgagatttaagcgttttgggcgaagttatcgcggggaggatttgcgttcgcgggggttgttgcgttttgcgttggggtttttcgggttgggaatgcgtggttcg

SEQ ID NO: 18172 - DNA, 1138 bp, Artificial Sequence
  chemically treated genomic DNA (Homo sapiens) CpG-island No: 18172
cgaaccacgcattcccaacccgaaaaaccccaacgcaaaacgcaacaacccccgcgaacgcaaatcctccccgcgataacttcgcccaaaacgcttaaatctcgaaaaccccgcccccgccccgcccgatattactcaaacctcgataacgcaaaacgaaatcgcgaacgacgaacgcaaataaaaaaaaacgaccgaaacgcgtcgataacacccgcgaaaaaacgaaaaaaacgcgacgaccgcaccccaccctaaaaaaaaaccgaccaaatataacctaaacgcccaataccaacgaaaaaaaaactcgctccgccgccgaccaacaccaacacccaactccgacgcaactcctctacgcccttaccgccctccgaaccacaactttcctcccgctcctacccccgacccgtcgccgtctccgcgctcgcaacgacctcgaaaaaacccaaataacgaacaacgacctcgcgaaccttccgcactcccgcccgattccccgaccgtccgcctatccttaaccccctccgctttctccgcgccgacccgcctcgcttatacctcgacgctaaaccgctctcccgattacccgccgacataaactacaacgaaaactcccacccgcgaatcaacactctaaaccgcataatccgcgccgaatctaacccgaacctacgctacgaaataaccaacgacgacgaaaacaccaacaaaatatactattctcgacgcgacgtaatcaccgaccaaaactcgaacgactactaataaatacctacccgaaaaacgcgaactacgaaactcgcgaaacaaaaaaaaaccgtcctcctctaaacgactaaaaaactcgaatcccgaaaataaaaaaatttttttaccccaaatcccgaaaaaacttcccgaccgcgctaaaaacaaaaccgaatatcctaacgcgtacgaaaacaaattaacccctatcctacgaacaaaaactcgatcgtacctttctcccctcccgcgaacccgaacgaataatcaaaaaaaacgtcgaacccgcgcgaaactatcccctacctactaaacacgactacaaccgcctttatcccaacccgcgaataaaaaatcaaacgaaataaaactacgaccacaaaac

SEQ ID NO: 18173 - DNA, 563 bp, Artificial Sequence
  chemically treated genomic DNA (Homo sapiens) CpG-island No: 18173
ttataggttgtttaagttacgtggcgattgtggtttcgtttatagtttttagaggtttgcgcgtgcggtttgtagttcggtcgtttttttttggcgggtgggttgtagttatggagggcgagtttttatttgtggaggagcggcggcggttgtaggaggagttgaacgagttcgtggagagcggttgtcggacgttggaggaggtgatcgcgtttttgggttgggatttagatagtttggatttcggggaagaggaggcggcggaggtgaggagcgcggtcgcggggttttttcggggattatcggttcggggttttttttggaagaagggagattcgtattggtagtcgcggagggaagggcgaggagttttcgttcgtgtgtagagtcgcgatgggcgtttgggattcgaggggcgtcgggggttttggagtaattttgacgtttttgggtttcgggttggggcgcgcgaggaattttcgaaggttttatatcgatttttagtgcggcgtttttttcgcgtaatttcgagtttaaagaaaatcgggggtcgggcgcggtgg

SEQ ID NO: 18174 - DNA, 563 bp, Artificial Sequence
  chemically treated genomic DNA (Homo sapiens) CpG-island No: 18174
ccaccgcgcccgacccccgattttctttaaactcgaaattacgcgaaaaaaacgccgcactaaaaatcgatataaaaccttcgaaaattcctcgcgcgccccaacccgaaacccaaaaacgtcaaaattactccaaaacccccgacgcccctcgaatcccaaacgcccatcgcgactctacacacgaacgaaaactcctcgcccttccctccgcgactaccaatacgaatctcccttcttccaaaaaaaaccccgaaccgataatccccgaaaaaaccccgcgaccgcgctcctcacctccgccgcctcctcttccccgaaatccaaactatctaaatcccaacccaaaaacgcgatcacctcctccaacgtccgacaaccgctctccacgaactcgttcaactcctcctacaaccgccgccgctcctccacaaataaaaactcgccctccataactacaacccacccgccaaaaaaaaacgaccgaactacaaaccgcacgcgcaaacctctaaaaactataaacgaaaccacaatcgccacgtaacttaaacaacctataa

SEQ ID NO: 18175 - DNA, 563 bp, Artificial Sequence
  chemically treated genomic DNA (Homo sapiens) CpG-island No: 18175
ttatcgcgttcggttttcggttttttttaaattcgaagttgcgcgggaggagcgtcgtattggaggtcgatgtggagttttcgggagtttttcgcgcgttttagttcggaatttagggacgttagggttgttttagggttttcggcgtttttcgggttttaggcgtttatcgcggttttgtatacggacgaggatttttcgttttttttttcgcggttgttagtgcggatttttttttttttagagaagatttcgggtcgatagttttcgaaagggtttcgcggtcgcgttttttattttcgtcgttttttttttttcgggatttagattatttaggttttagtttagggacgcggttattttttttaacgttcggtagtcgttttttacgaattcgtttagttttttttgtagtcgtcgtcgtttttttataggtggaggttcgttttttatagttgtagtttattcgttaagaggaagcggtcgaattgtagatcgtacgcgtaggtttttgggagttgtgggcggggttatagtcgttacgtgatttgaatagtttatag

SEQ ID NO: 18176 - DNA, 563 bp, Artificial Sequence
  chemically treated genomic DNA (Homo sapiens) CpG-island No: 18176
ctataaactattcaaatcacgtaacgactataaccccgcccacaactcccaaaaacctacgcgtacgatctacaattcgaccgcttcctcttaacgaataaactacaactataaaaaacgaacctccacctataaaaaaacgacgacgactacaaaaaaaactaaacgaattcgtaaaaaacgactaccgaacgttaaaaaaaataaccgcgtccctaaactaaaacctaaataatctaaatcccgaaaaaaaaaaaacgacgaaaataaaaaacgcgaccgcgaaaccctttcgaaaactatcgacccgaaatcttctctaaaaaaaaaaaaatccgcactaacaaccgcgaaaaaaaaaacgaaaaatcctcgtccgtatacaaaaccgcgataaacgcctaaaacccgaaaaacgccgaaaaccctaaaacaaccctaacgtccctaaattccgaactaaaacgcgcgaaaaactcccgaaaactccacatcgacctccaatacgacgctcctcccgcgcaacttcgaatttaaaaaaaaccgaaaaccgaacgcgataa

SEQ ID NO: 18177 - DNA, 584 bp, Artificial Sequence
  chemically treated genomic DNA (Homo sapiens) CpG-island No: 18177
ggtcgcgggttaggcgtggcgggaaggagttcgcgtagatatagggtttgataggtagagagagatatagatatcggggattgatagtcgcgggggtacgcggggtcggttggtcgtggcgggcgtttatttggtagcggcggcggtggcggcgttcgcgatcgggtcgtttttttcgcgttgcgggttttttttttcgcggtcgggcgggcggtcggcgtaggtttcgtagaggcggcggcggcggcgacgtcggagtcgcggattgttgagcggcggggacgtagttgtattaatcgatttcgggtcgttcggttgggttcggtcgttttcggaggcgttcggttttgttcggttttgtacggtttttttcggttttgttcgattcggttgggggcgtggtttaggttttttagttcgtttaggtcgtttttggcggtcgcggggcggggttttcgagcgggtgcgagttttttgacgtcgcggggagcggattttgttttcggcgtatgcgttagtatttttttttttttttttttttcgttttatcgtgtggaggttgaagaagacggggaaggaggcgt

SEQ ID NO: 18178 - DNA, 584 bp, Artificial Sequence
  chemically treated genomic DNA (Homo sapiens) CpG-island No: 18178
acgcctccttccccgtcttcttcaacctccacacgataaaacgaaaaaaaaaaaaaaaaaaaaatactaacgcatacgccgaaaacaaaatccgctccccgcgacgtcaaaaaactcgcacccgctcgaaaaccccgccccgcgaccgccaaaaacgacctaaacgaactaaaaaacctaaaccacgcccccaaccgaatcgaacaaaaccgaaaaaaaccgtacaaaaccgaacaaaaccgaacgcctccgaaaacgaccgaacccaaccgaacgacccgaaatcgattaatacaactacgtccccgccgctcaacaatccgcgactccgacgtcgccgccgccgccgcctctacgaaacctacgccgaccgcccgcccgaccgcgaaaaaaaaaacccgcaacgcgaaaaaaacgacccgatcgcgaacgccgccaccgccgccgctaccaaataaacgcccgccacgaccaaccgaccccgcgtacccccgcgactatcaatccccgatatctatatctctctctacctatcaaaccctatatctacgcgaactccttcccgccacgcctaacccgcgacc

SEQ ID NO: 18179 - DNA, 584 bp, Artificial Sequence
  chemically treated genomic DNA (Homo sapiens) CpG-island No: 18179
gcgttttttttttcgttttttttagtttttatacggtggggcggggaggaggggggaggaggagtgttggcgtatgcgtcgggggtaaggttcgtttttcgcgacgttagggggttcgtattcgttcgaaagtttcgtttcgcggtcgttagaggcgatttgggcggattggggggtttgggttacgtttttagtcgagtcgagtaaggtcgaggggagtcgtgtaaggtcgagtagagtcgagcgttttcgagagcggtcgagtttagtcgagcggttcggagtcggttggtgtagttgcgttttcgtcgtttagtagttcgcggtttcggcgtcgtcgtcgtcgtcgtttttgcggggtttgcgtcggtcgttcgttcggtcgcggggagggaggttcgtagcgcgggaagagcggttcggtcgcgggcgtcgttatcgtcgtcgttgttaggtgagcgttcgttacggttagtcggtttcgcgtgttttcgcggttgttagttttcggtgtttgtatttttttttgtttgttagattttgtgtttgcgcgagttttttttcgttacgtttggttcgcggtt

SEQ ID NO: 18180 - DNA, 584 bp, Artificial Sequence
  chemically treated genomic DNA (Homo sapiens) CpG-island No: 18180
aaccgcgaaccaaacgtaacgaaaaaaaactcgcgcaaacacaaaatctaacaaacaaaaaaaaatacaaacaccgaaaactaacaaccgcgaaaacacgcgaaaccgactaaccgtaacgaacgctcacctaacaacgacgacgataacgacgcccgcgaccgaaccgctcttcccgcgctacgaacctccctccccgcgaccgaacgaacgaccgacgcaaaccccgcaaaaacgacgacgacgacgacgccgaaaccgcgaactactaaacgacgaaaacgcaactacaccaaccgactccgaaccgctcgactaaactcgaccgctctcgaaaacgctcgactctactcgaccttacacgactcccctcgaccttactcgactcgactaaaaacgtaacccaaaccccccaatccgcccaaatcgcctctaacgaccgcgaaacgaaactttcgaacgaatacgaaccccctaacgtcgcgaaaaacgaaccttacccccgacgcatacgccaacactcctcctcccccctcctccccgccccaccgtataaaaactaaaaaaaacgaaaaaaaaaacgc

SEQ ID NO: 18181 - DNA, 586 bp, Artificial Sequence
  chemically treated genomic DNA (Homo sapiens) CpG-island No: 18181
ttttatatttcgatttcgcgatcgacgcggttcgcgttttgcgcggcgggttcgagtttgcggagtcggggttgttaagttagtcgcgagaaagttcgggcgttcgtcgtgcgcgcggttgcggagcgcggtttggggtgttagcgggggaacgttcggtttcggaacgtcgttcgcgtattttttgtcgtttaggagttaagttataagttaagaaatagttcgagcgcgcggcggtcgtgatttagtagcggggtcgggtcggtagggcgggagggtagcgatcgtagggttcgagcgggatcgtagggcgggagcggggtcggggtagggtcgagttcggaaaaggttatcgagatgtcgcgggcgtcgtcgttcgagttcgcgattcgtttcgcggtcgggttagtagtagcgagggcggtagggcggcgttttgggcgggcgtggcgtcggggtcgggcgggcgggtcggggggtttttattttttcggtttttgggggagtttcgtttgtttcgggcgttggttcgtttttttttaatcgtagttgttattttagggttgttttttttattgtattagat

SEQ ID NO: 18182 - DNA, 586 bp, Artificial Sequence
  chemically treated genomic DNA (Homo sapiens) CpG-island No: 18182
atctaatacaataaaaaaaacaaccctaaaataacaactacgattaaaaaaaaacgaaccaacgcccgaaacaaacgaaactcccccaaaaaccgaaaaaataaaaaccccccgacccgcccgcccgaccccgacgccacgcccgcccaaaacgccgccctaccgccctcgctactactaacccgaccgcgaaacgaatcgcgaactcgaacgacgacgcccgcgacatctcgataaccttttccgaactcgaccctaccccgaccccgctcccgccctacgatcccgctcgaaccctacgatcgctaccctcccgccctaccgacccgaccccgctactaaatcacgaccgccgcgcgctcgaactatttcttaacttataacttaactcctaaacgacaaaaaatacgcgaacgacgttccgaaaccgaacgttcccccgctaacaccccaaaccgcgctccgcaaccgcgcgcacgacgaacgcccgaactttctcgcgactaacttaacaaccccgactccgcaaactcgaacccgccgcgcaaaacgcgaaccgcgtcgatcgcgaaatcgaaatataaaa

SEQ ID NO: 18183 - DNA, 586 bp, Artificial Sequence
  chemically treated genomic DNA (Homo sapiens) CpG-island No: 18183
gtttggtataatggggaagataattttgagatagtagttgcgattgaggaagagcgagttagcgttcggagtaagcggagtttttttaagagtcggaaaggtaggagtttttcggttcgttcgttcggtttcggcgttacgttcgtttaggacgtcgttttgtcgttttcgttgttgttggttcgatcgcgaggcgggtcgcgggttcgggcggcggcgttcgcggtatttcggtgatttttttcggattcggttttgtttcggtttcgttttcgttttgcggtttcgttcgggttttgcgatcgttgttttttcgttttgtcgattcggtttcgttgttgaattacggtcgtcgcgcgttcgggttgttttttaatttgtgatttagtttttgggcggtagaaagtgcgcggacggcgtttcggggtcggacgttttttcgttggtattttaagtcgcgtttcgtagtcgcgcgtacggcgggcgttcgagttttttcgcggttagtttgatagtttcggtttcgtagattcgggttcgtcgcgtaggacgcgggtcgcgtcggtcgcggagtcggggtgtggga

SEQ ID NO: 18184 - DNA, 586 bp, Artificial Sequence
  chemically treated genomic DNA (Homo sapiens) CpG-island No: 18184
tcccacaccccgactccgcgaccgacgcgacccgcgtcctacgcgacgaacccgaatctacgaaaccgaaactatcaaactaaccgcgaaaaaactcgaacgcccgccgtacgcgcgactacgaaacgcgacttaaaataccaacgaaaaaacgtccgaccccgaaacgccgtccgcgcactttctaccgcccaaaaactaaatcacaaattaaaaaacaacccgaacgcgcgacgaccgtaattcaacaacgaaaccgaatcgacaaaacgaaaaaacaacgatcgcaaaacccgaacgaaaccgcaaaacgaaaacgaaaccgaaacaaaaccgaatccgaaaaaaatcaccgaaataccgcgaacgccgccgcccgaacccgcgacccgcctcgcgatcgaaccaacaacaacgaaaacgacaaaacgacgtcctaaacgaacgtaacgccgaaaccgaacgaacgaaccgaaaaactcctacctttccgactcttaaaaaaactccgcttactccgaacgctaactcgctcttcctcaatcgcaactactatctcaaaattatcttccccattataccaaac

SEQ ID NO: 18185 - DNA, 1090 bp, Artificial Sequence
  chemically treated genomic DNA (Homo sapiens) CpG-island No: 18185
gtcgtggattttcggacgtgaaaacgtttaaagttagttgggaaaattttattagcgtttttcgcgtatagcgttagttataggaaaggatttttaggagcgaattcgggtagggaaatttcggacgttcgtatatttagtattagtatcggtatttagtatttagtatcgagtatcgagtacgtagtatttagtatcgattatcgagtagagtatttcgtacgtagaatttatcgagagtttgatgtagttttcgtcgtaggtatagcgttaggtttcggcgtttttataataaagggacgttggcgggcggggtttgagaggcgcgcggtggaggggtcgggcgcgaggtcgcggagatagttcggagttcggtattggggagtggtatagcgttggcggatttaggtgggttttacggggcgttcgcgggatcggaaatgacgcgtagaattttgtatcgggtttttcgttgtttcgcgggcgtcgttttttagtgttttagagttacggagtcggggaaacgcgtcgcggtttataacgttttcgcggttgttcgttggtttcgttcgggtcgttttattttaggtagacgggaggagaaatacggcgcgtttagcgttttttttttcgttggttttgttcgggtttttttattgtaggtcgacgggggtggaaatacgtagttttttttttttttttaaggtttagggtaatacggggtttttaagtgttttttcgttgtcgtttggtggtttagttcgggtcgttgtagtgtagttatacggggagggatacggcgcgtcgagtgtttcgggcggtcgtacgttggtttcgttcgggtcgttttattgtaggtagagggagaggacgacggtgcgcgtagtgtattttcgtggttcgttggtttcgtcggggtcgttttattgaaggtagaaggggggggatcgtggttttatttttcgcggtagttcgttggtttcgttcgggcggtttcgttcgggttgttttattagcggtattttagggcgggatcggttagtttgtggaggtagcggtttttaagtttcggagggtttattgtttaggt

SEQ ID NO: 18186 - DNA, 1090 bp, Artificial Sequence
  chemically treated genomic DNA (Homo sapiens) CpG-island No: 18186
acctaaacaataaaccctccgaaacttaaaaaccgctacctccacaaactaaccgatcccgccctaaaataccgctaataaaacaacccgaacgaaaccgcccgaacgaaaccaacgaactaccgcgaaaaataaaaccacgatccccccccttctaccttcaataaaacgaccccgacgaaaccaacgaaccacgaaaatacactacgcgcaccgtcgtcctctccctctacctacaataaaacgacccgaacgaaaccaacgtacgaccgcccgaaacactcgacgcgccgtatccctccccgtataactacactacaacgacccgaactaaaccaccaaacgacaacgaaaaaacacttaaaaaccccgtattaccctaaaccttaaaaaaaaaaaaaaaactacgtatttccacccccgtcgacctacaataaaaaaacccgaacaaaaccaacgaaaaaaaaaacgctaaacgcgccgtatttctcctcccgtctacctaaaataaaacgacccgaacgaaaccaacgaacaaccgcgaaaacgttataaaccgcgacgcgtttccccgactccgtaactctaaaacactaaaaaacgacgcccgcgaaacaacgaaaaacccgatacaaaattctacgcgtcatttccgatcccgcgaacgccccgtaaaacccacctaaatccgccaacgctataccactccccaataccgaactccgaactatctccgcgacctcgcgcccgacccctccaccgcgcgcctctcaaaccccgcccgccaacgtccctttattataaaaacgccgaaacctaacgctatacctacgacgaaaactacatcaaactctcgataaattctacgtacgaaatactctactcgataatcgatactaaatactacgtactcgatactcgatactaaatactaaataccgatactaatactaaatatacgaacgtccgaaatttccctacccgaattcgctcctaaaaatcctttcctataactaacgctatacgcgaaaaacgctaataaaattttcccaactaactttaaacgttttcacgtccgaaaatccacgac

SEQ ID NO: 18187 - DNA, 1090 bp, Artificial Sequence
  chemically treated genomic DNA (Homo sapiens) CpG-island No: 18187
atttgggtagtaaatttttcggggtttagaggtcgttgtttttatagattggtcgatttcgttttgaagtgtcgttggtggaatagttcgggcggaatcgttcgggcggaattaacgggttgtcgcggggggtggggttacggtttttttttttttgtttttagtggaacggtttcggcggaattaacgggttacggggatgtattacgcgtatcgtcgttttttttttttgtttgtagtggaacggttcgggcggaattaacgtgcggtcgttcggagtattcggcgcgtcgtgttttttttcgtgtggttgtattgtaacggttcgggttggattattaggcggtagcggagaggtatttaaaagtttcgtgttattttagattttaaaaaaaaaaaaaaaattgcgtgtttttattttcgtcggtttgtagtggaagggttcgagtagaattaacgggggaggggacgttgagcgcgtcgtgttttttttttcgtttgtttggagtagaacggttcgggcggaattaacgggtagtcgcgggggcgttgtgggtcgcggcgcgttttttcggtttcgtggttttggggtattgaggagcggcgttcgcggggtagcgaggagttcgatgtagggttttgcgcgttattttcggtttcgcgggcgtttcgtgaagtttatttggattcgttagcgttgtgttattttttagtgtcgagtttcgagttgttttcgcggtttcgcgttcggtttttttatcgcgcgttttttaggtttcgttcgttagcgtttttttgttgtgaaggcgtcggggtttagcgttatgtttgcggcggagattgtattaggttttcggtgggttttgcgtgcggggtgttttgttcggtgatcggtgttgggtgttgcgtgttcggtgttcggtgttgggtgttgggtgtcggtattgatgttgagtgtgcgggcgttcggggtttttttgttcggattcgtttttgggggtttttttttatggttggcgttgtgcgcggaaaacgttggtggggtttttttagttggttttaagcgtttttacgttcgggagtttacggt

SEQ ID NO: 18188 - DNA, 1090 bp, Artificial Sequence
  chemically treated genomic DNA (Homo sapiens) CpG-island No: 18188
accgtaaactcccgaacgtaaaaacgcttaaaaccaactaaaaaaaccccaccaacgttttccgcgcacaacgccaaccataaaaaaaaacccccaaaaacgaatccgaacaaaaaaaccccgaacgcccgcacactcaacatcaataccgacacccaacacccaacaccgaacaccgaacacgcaacacccaacaccgatcaccgaacaaaacaccccgcacgcaaaacccaccgaaaacctaatacaatctccgccgcaaacataacgctaaaccccgacgccttcacaacaaaaaaacgctaacgaacgaaacctaaaaaacgcgcgataaaaaaaccgaacgcgaaaccgcgaaaacaactcgaaactcgacactaaaaaataacacaacgctaacgaatccaaataaacttcacgaaacgcccgcgaaaccgaaaataacgcgcaaaaccctacatcgaactcctcgctaccccgcgaacgccgctcctcaataccccaaaaccacgaaaccgaaaaaacgcgccgcgacccacaacgcccccgcgactacccgttaattccgcccgaaccgttctactccaaacaaacgaaaaaaaaaacacgacgcgctcaacgtcccctcccccgttaattctactcgaacccttccactacaaaccgacgaaaataaaaacacgcaattttttttttttttttaaaatctaaaataacacgaaacttttaaatacctctccgctaccgcctaataatccaacccgaaccgttacaatacaaccacacgaaaaaaaacacgacgcgccgaatactccgaacgaccgcacgttaattccgcccgaaccgttccactacaaacaaaaaaaaaaaacgacgatacgcgtaatacatccccgtaacccgttaattccgccgaaaccgttccactaaaaacaaaaaaaaaaaaaccgtaaccccaccccccgcgacaacccgttaattccgcccgaacgattccgcccgaactattccaccaacgacacttcaaaacgaaatcgaccaatctataaaaacaacgacctctaaaccccgaaaaatttactacccaaat

SEQ ID NO: 18189 - DNA, 512 bp, Artificial Sequence
  chemically treated genomic DNA (Homo sapiens) CpG-island No: 18189
gtcgagggcggtttcgcggttgcgttttagtagatatatcgggtttcggggagttggtttacgggcggcggggttgggttcggggtttttaggcgttgattttcggggttcgtaggcgtgtggtttacggatttggtgtacgtggcggtttacgagatcggttacgcgttgggtttgatgtatttataatacggtcgggcgtttatgtatttgaacgttacgttgcgcggttggaaggcgttgttttaggacgagttgtgggggttgtatcggttttacggtgagtttttttgtcgggcgggagggcggggatcgggcggttttgagttaggtcgtgttttttacgttttcgataggatgtttcgataggttgttcgtgtgcgcgttttgggcgcggaggggtttttgcgacgttcgtcggcggtttatgaagaggttttgttttagtagttgcgatttttgttacggtgatgtttacggggtcgggatagggttgcgtgggagttgggttt

SEQ ID NO: 18190 - DNA, 512 bp, Artificial Sequence
  chemically treated genomic DNA (Homo sapiens) CpG-island No: 18190
aaacccaactcccacgcaaccctatcccgaccccgtaaacatcaccgtaacaaaaatcgcaactactaaaacaaaacctcttcataaaccgccgacgaacgtcgcaaaaacccctccgcgcccaaaacgcgcacacgaacaacctatcgaaacatcctatcgaaaacgtaaaaaacacgacctaactcaaaaccgcccgatccccgccctcccgcccgacaaaaaaactcaccgtaaaaccgatacaacccccacaactcgtcctaaaacaacgccttccaaccgcgcaacgtaacgttcaaatacataaacgcccgaccgtattataaatacatcaaacccaacgcgtaaccgatctcgtaaaccgccacgtacaccaaatccgtaaaccacacgcctacgaaccccgaaaatcaacgcctaaaaaccccgaacccaaccccgccgcccgtaaaccaactccccgaaacccgatatatctactaaaacgcaaccgcgaaaccgccctcgac

SEQ ID NO: 18191 - DNA, 512 bp, Artificial Sequence
  chemically treated genomic DNA (Homo sapiens) CpG-island No: 18191
aggtttagtttttacgtagttttgtttcggtttcgtgggtattatcgtagtagaagtcgtagttgttggggtagagtttttttatgagtcgtcggcgagcgtcgtagaagttttttcgcgtttaggacgcgtatacgaatagtttgtcgaggtattttgtcgggagcgtggggagtacggtttggtttaggatcgttcggttttcgttttttcgttcgataaagggatttatcgtagagtcggtgtagtttttatagttcgttttgggataacgttttttagtcgcgtagcgtggcgtttaggtgtatgagcgttcggtcgtgttgtgagtgtattaggtttagcgcgtggtcgatttcgtgggtcgttacgtgtattaggttcgtgagttatacgtttgcgggtttcgggggttagcgtttgggagtttcgggtttagtttcgtcgttcgtgggttagtttttcgaggttcggtgtatttgttggagcgtagtcgcggagtcgttttcggt

SEQ ID NO: 18192 - DNA, 512 bp, Artificial Sequence
  chemically treated genomic DNA (Homo sapiens) CpG-island No: 18192
accgaaaacgactccgcgactacgctccaacaaatacaccgaacctcgaaaaactaacccacgaacgacgaaactaaacccgaaactcccaaacgctaacccccgaaacccgcaaacgtataactcacgaacctaatacacgtaacgacccacgaaatcgaccacgcgctaaacctaatacactcacaacacgaccgaacgctcatacacctaaacgccacgctacgcgactaaaaaacgttatcccaaaacgaactataaaaactacaccgactctacgataaatccctttatcgaacgaaaaaacgaaaaccgaacgatcctaaaccaaaccgtactccccacgctcccgacaaaatacctcgacaaactattcgtatacgcgtcctaaacgcgaaaaaacttctacgacgctcgccgacgactcataaaaaaactctaccccaacaactacgacttctactacgataatacccacgaaaccgaaacaaaactacgtaaaaactaaacct

SEQ ID NO: 18193 - DNA, 688 bp, Artificial Sequence
  chemically treated genomic DNA (Homo sapiens) CpG-island No: 18193
gattcgtcgtttttattatttaaagtttcgtgcgggatgagattgttcgcggaagcgagggtgtcgttcgttttcgggttcgggttcgtttcgtttcgaggtttgttcggaagaaagatttcggtgcgtagttttcgtcgcgtttttatatttggttcgtttagtcggaatttatttttacggggtcgcggtcggtttttgagtttgagaagaaatagtaatcggcgttcgttagaagtatttttattttttgtgttgacgtttaatgatgatataatagtcgatttttggtttagaatttaagacgataggggttcgttttgtgcggtattttttgtgtttgcgcgggatgatgacgtataaaatagcgtttgtttaggtttaggattttaaaagaaattgcgtcgtgagttgtattttcgatttcggcgcgggtcggggcgtcgagtagagcgacgtcgatttttggagtagtttgcgtttgcgcggaacgcgtggtcggttttcggaattttatcgggattttttcggtagcgaagttcgcgtttgtgttaaggtttgcgagtagaatgttttcgcgatggacgttcgtattttatttttttgatcgttgggatttttagtggcgggtgggtggagcgcgttttatttatttgttggttatttcgtgaggcgttttaggtttgtg

SEQ ID NO: 18194 - DNA, 688 bp, Artificial Sequence
  chemically treated genomic DNA (Homo sapiens) CpG-island No: 18194
cacaaacctaaaacgcctcacgaaataaccaacaaataaataaaacgcgctccacccacccgccactaaaaatcccaacgatcaaaaaaataaaatacgaacgtccatcgcgaaaacattctactcgcaaaccttaacacaaacgcgaacttcgctaccgaaaaaatcccgataaaattccgaaaaccgaccacgcgttccgcgcaaacgcaaactactccaaaaatcgacgtcgctctactcgacgccccgacccgcgccgaaatcgaaaatacaactcacgacgcaatttcttttaaaatcctaaacctaaacaaacgctattttatacgtcatcatcccgcgcaaacacaaaaaataccgcacaaaacgaacccctatcgtcttaaattctaaaccaaaaatcgactattatatcatcattaaacgtcaacacaaaaaataaaaatacttctaacgaacgccgattactatttcttctcaaactcaaaaaccgaccgcgaccccgtaaaaataaattccgactaaacgaaccaaatataaaaacgcgacgaaaactacgcaccgaaatctttcttccgaacaaacctcgaaacgaaacgaacccgaacccgaaaacgaacgacaccctcgcttccgcgaacaatctcatcccgcacgaaactttaaataataaaaacgacgaatc

SEQ ID NO: 18195 - DNA, 688 bp, Artificial Sequence
  chemically treated genomic DNA (Homo sapiens) CpG-island No: 18195
tatagatttgaggcgttttacgaggtaattagtaggtaaatggagcgcgttttatttattcgttattaggggttttagcggttaagggggtggaatgcgggcgtttatcgcgaaggtattttgttcgtaagttttggtataggcgcgggtttcgttatcggaaaagtttcggtaggatttcggaagtcggttacgcgtttcgcgtaggcgtaaattgttttaaaagtcggcgtcgttttgttcggcgtttcggttcgcgtcgaagtcggaagtgtagtttacggcgtagttttttttggagttttggatttgagtaagcgttgttttatgcgttattatttcgcgtagatataggaagtgtcgtatagagcgagtttttgtcgttttgagttttgggttagaggtcggttattatattattattaggcgttaatataggaagtgaggatatttttggcgagcgtcggttgttgtttttttttaggtttagggatcggtcgcggtttcgtaggggtgagtttcgattgggcggattaggtgtgggagcgcgacgagaattgcgtatcgaggtttttttttcgagtaggtttcggagcggggcggattcgggttcgggggcgagcgatattttcgttttcgcggatagttttatttcgtacggaattttgggtggtggaggcggcgggtt

SEQ ID NO: 18196 - DNA, 688 bp, Artificial Sequence
  chemically treated genomic DNA (Homo sapiens) CpG-island No: 18196
aacccgccgcctccaccacccaaaattccgtacgaaataaaactatccgcgaaaacgaaaatatcgctcgcccccgaacccgaatccgccccgctccgaaacctactcgaaaaaaaaacctcgatacgcaattctcgtcgcgctcccacacctaatccgcccaatcgaaactcacccctacgaaaccgcgaccgatccctaaacctaaaaaaaaacaacaaccgacgctcgccaaaaatatcctcacttcctatattaacgcctaataataatataataaccgacctctaacccaaaactcaaaacgacaaaaactcgctctatacgacacttcctatatctacgcgaaataataacgcataaaacaacgcttactcaaatccaaaactccaaaaaaaactacgccgtaaactacacttccgacttcgacgcgaaccgaaacgccgaacaaaacgacgccgacttttaaaacaatttacgcctacgcgaaacgcgtaaccgacttccgaaatcctaccgaaacttttccgataacgaaacccgcgcctataccaaaacttacgaacaaaataccttcgcgataaacgcccgcattccacccccttaaccgctaaaacccctaataacgaataaataaaacgcgctccatttacctactaattacctcgtaaaacgcctcaaatctata

SEQ ID NO: 18197 - DNA, 979 bp, Artificial Sequence
  chemically treated genomic DNA (Homo sapiens) CpG-island No: 18197
ggtcgcgcgttcgcgggtagcgatgattttaggtagcgggcgattttaggcggacggtaggtcgggtttgtttatttatcgttcgttgtcgcgggcgtttgcgggggcgtttatatgtcggatcgagttcgtaggtttcgtcgtcgcgtcgtcgttagtcgtcgttatttggtttttggcgttttggtcgtttgttgttttatggtcgttcggatttcggcgtcggcgtcgtcgagtagtaatgcgtcgcgttcgtttattgcgtaggcgtattcgttacgtatgcgcgttgtcgcgtacgtggggcgtttcgcgcgtttgtcgggttttatcggcgtcgggatatttcgcgcgggcgggaggcggcgggcgtggcgggaaagaggcgggcggtggggaagaggggcgaatcgcggtggagagtagtgattagggagtggaggcgggtagcggggataggggcgggcgttcgcgattcgggtaggcgggggtcggcgtttcgaggagggcggttttcggttttcgtttttatttatttgtcgcgttcggagggcgttttcgggttcgttcgttacgtttacgtttaggcgttttcgatattgtgattttagttcggcgtttcgtttttaatttatcgttatcgcgggcgggatttttcggattacgtgggtcggtttaggggagtgtaggtgtttcgcgagagttggtttcgttcgtcgtcgtttttttaattatcgggttgtgatacggtgtgggtcgagtcggatttgggaatcgaaatttagagtagttgcggtagcgttgcgttttttcggggttgttcgtcggggttgggagggcggttttgcgtttgggggaatcgcgatcggttttacgtttatttttagcggttaggtgcgttttgtacgtttacgaacgtttttagaggtttacgtttgggattttaaggttggtagtggagggaggattcggtggtttg

SEQ ID NO: 18198 - DNA, 979 bp, Artificial Sequence
  chemically treated genomic DNA (Homo sapiens) CpG-island No: 18198
caaaccaccgaatcctccctccactaccaaccttaaaatcccaaacgtaaacctctaaaaacgttcgtaaacgtacaaaacgcacctaaccgctaaaaataaacgtaaaaccgatcgcgattcccccaaacgcaaaaccgccctcccaaccccgacgaacaaccccgaaaaaacgcaacgctaccgcaactactctaaatttcgattcccaaatccgactcgacccacaccgtatcacaacccgataattaaaaaaacgacgacgaacgaaaccaactctcgcgaaacacctacactcccctaaaccgacccacgtaatccgaaaaatcccgcccgcgataacgataaattaaaaacgaaacgccgaactaaaatcacaatatcgaaaacgcctaaacgtaaacgtaacgaacgaacccgaaaacgccctccgaacgcgacaaataaataaaaacgaaaaccgaaaaccgccctcctcgaaacgccgacccccgcctacccgaatcgcgaacgcccgcccctatccccgctacccgcctccactccctaatcactactctccaccgcgattcgcccctcttccccaccgcccgcctctttcccgccacgcccgccgcctcccgcccgcgcgaaatatcccgacgccgataaaacccgacaaacgcgcgaaacgccccacgtacgcgacaacgcgcatacgtaacgaatacgcctacgcaataaacgaacgcgacgcattactactcgacgacgccgacgccgaaatccgaacgaccataaaacaacaaacgaccaaaacgccaaaaaccaaataacgacgactaacgacgacgcgacgacgaaacctacgaactcgatccgacatataaacgcccccgcaaacgcccgcgacaacgaacgataaataaacaaacccgacctaccgtccgcctaaaatcgcccgctacctaaaatcatcgctacccgcgaacgcgcgacc

SEQ ID NO: 18199 - DNA, 979 bp, Artificial Sequence
  chemically treated genomic DNA (Homo sapiens) CpG-island No: 18199
taggttatcgggttttttttttattgttagttttgggattttaagcgtagatttttgaggacgttcgtgggcgtgtaaggcgtatttggtcgttagaggtgggcgtgaggtcgatcgcggtttttttaggcgtagggtcgtttttttagtttcgacggatagtttcgagggagcgtagcgttgtcgtagttgttttaagtttcggtttttaaattcggttcggtttatatcgtgttatagttcggtaattagggaagcggcggcgggcggggttagttttcgcggggtatttgtatttttttgagtcggtttacgtggttcgggaggtttcgttcgcggtggcggtgagttgggggcgggacgtcgggttgggattataatgtcgggggcgtttaggcgtagacgtggcgggcggattcgggggcgtttttcggacgcggtaggtgagtggggacgggagtcgggggtcgtttttttcggggcgtcgattttcgtttattcgagtcgcggacgttcgtttttgttttcgttgttcgtttttattttttggttattgttttttatcgcgattcgttttttttttttatcgttcgtttttttttcgttacgttcgtcgtttttcgttcgcgcggggtgtttcggcgtcggtgggattcggtagacgcgcgggacgttttacgtgcgcggtagcgcgtatgcgtggcgggtgcgtttgcgtagtgggcgggcgcggcgtattgttgttcggcggcgtcggcgtcggggttcgggcggttatggggtaataggcggttagggcgttaagggttaggtagcgacggttggcggcggcgcggcggcggggtttgcgggttcggttcggtatgtagacgttttcgtaggcgttcgcggtagcgaacggtgagtgagtagattcggtttgtcgttcgtttggggtcgttcgttgtttggggttatcgttgttcgcgagcgcgcggtt

SEQ ID NO: 18200 - DNA, 979 bp, Artificial Sequence
  chemically treated genomic DNA (Homo sapiens) CpG-island No: 18200
aaccgcgcgctcgcgaacaacgataaccccaaacaacgaacgaccccaaacgaacgacaaaccgaatctactcactcaccgttcgctaccgcgaacgcctacgaaaacgtctacataccgaaccgaacccgcaaaccccgccgccgcgccgccgccaaccgtcgctacctaacccttaacgccctaaccgcctattaccccataaccgcccgaaccccgacgccgacgccgccgaacaacaatacgccgcgcccgcccactacgcaaacgcacccgccacgcatacgcgctaccgcgcacgtaaaacgtcccgcgcgtctaccgaatcccaccgacgccgaaacaccccgcgcgaacgaaaaacgacgaacgtaacgaaaaaaaaacgaacgataaaaaaaaaaaacgaatcgcgataaaaaacaataaccaaaaaataaaaacgaacaacgaaaacaaaaacgaacgtccgcgactcgaataaacgaaaatcgacgccccgaaaaaaacgacccccgactcccgtccccactcacctaccgcgtccgaaaaacgcccccgaatccgcccgccacgtctacgcctaaacgcccccgacattataatcccaacccgacgtcccgcccccaactcaccgccaccgcgaacgaaacctcccgaaccacgtaaaccgactcaaaaaaatacaaataccccgcgaaaactaaccccgcccgccgccgcttccctaattaccgaactataacacgatataaaccgaaccgaatttaaaaaccgaaacttaaaacaactacgacaacgctacgctccctcgaaactatccgtcgaaactaaaaaaacgaccctacgcctaaaaaaaccgcgatcgacctcacgcccacctctaacgaccaaatacgccttacacgcccacgaacgtcctcaaaaatctacgcttaaaatcccaaaactaacaataaaaaaaaaacccgataaccta

SEQ ID NO: 18201 - DNA, 828 bp, Artificial Sequence
  chemically treated genomic DNA (Homo sapiens) CpG-island No: 18201
ggttcgcgggcgcggttttatttttaggttttttcgtcgcggaggttttttagcgtcgttcgtattttcgtttttcgcgcgtttttgttttaatagttttggttttgttaggattttattttttcgttttcggcgtaatcgcggttacgtagcgacgtgtacgcgcgtgtgcgtcgtcgtcgttcggtagagtgggcgttttcgatattaggagcgcgtacgtcgcgtagaggggtttggacgagcgcgttttcgattcgtcgttatcgtttttttttttttttttcggttcgttttttttttcgtttttttttgttaggcggttttttttttttttttttttagtttttttcgtttttttcgggttttagcggtggcggagcgaacgggatcggttcggttttagagcgcgaggtggagggtggaacgcgggcgtttgaaggagttgttgtttcggtagcgttcgcggagacgtgaagaggtgaggcgaggacggttttttagggatacgagggcggttcggcggttcggattcgcgggtcgaggttgtttgggtgtgttggcgtcgggttgagtttggggagggtcgagatggggttttagtcgaggattgggatgcgggaggatcgcggtaaggagggtagggggcgggtttaggattgtcggtcgtttttcggatatcgtagtttttttaggtggtcgtttttcgcggatagggcgggcggggtcggcgtttttatttgggggtggggtagtggttttggcggtcgttttttttagttgtgtttttttgatattgttgtttcggcggttgtcgttcgttgttat

SEQ ID NO: 18202 - DNA, 828 bp, Artificial Sequence
  chemically treated genomic DNA (Homo sapiens) CpG-island No: 18202
ataacaacgaacgacaaccgccgaaacaacaatatcaaaaaaacacaactaaaaaaaacgaccgccaaaaccactaccccacccccaaataaaaacgccgaccccgcccgccctatccgcgaaaaacgaccacctaaaaaaactacgatatccgaaaaacgaccgacaatcctaaacccgccccctaccctccttaccgcgatcctcccgcatcccaatcctcgactaaaaccccatctcgaccctccccaaactcaacccgacgccaacacacccaaacaacctcgacccgcgaatccgaaccgccgaaccgccctcgtatccctaaaaaaccgtcctcgcctcacctcttcacgtctccgcgaacgctaccgaaacaacaactccttcaaacgcccgcgttccaccctccacctcgcgctctaaaaccgaaccgatcccgttcgctccgccaccgctaaaacccgaaaaaaacgaaaaaaactaaaaaaaaaaaaaaaaaaaaccgcctaacaaaaaaaaacgaaaaaaaaaacgaaccgaaaaaaaaaaaaaaaaacgataacgacgaatcgaaaacgcgctcgtccaaacccctctacgcgacgtacgcgctcctaatatcgaaaacgcccactctaccgaacgacgacgacgcacacgcgcgtacacgtcgctacgtaaccgcgattacgccgaaaacgaaaaaataaaatcctaacaaaaccaaaactattaaaacaaaaacgcgcgaaaaacgaaaatacgaacgacgctaaaaaacctccgcgacgaaaaaacctaaaaataaaaccgcgcccgcgaacc

SEQ ID NO: 18203 - DNA, 828 bp, Artificial Sequence
  chemically treated genomic DNA (Homo sapiens) CpG-island No: 18203
gtagtagcgggcggtagtcgtcgaggtagtaatgttaggagggtatagttggaggaggcggtcgttaaagttattattttatttttaggtaagggcgtcgatttcgttcgttttattcgcgaggagcggttatttgggagaattgcggtgttcgggaggcggtcgatagttttgaattcgttttttattttttttatcgcggttttttcgtattttagttttcggttggggttttatttcgattttttttaggtttagttcgacgttaatatatttaggtagtttcggttcgcggattcgggtcgtcgggtcgttttcgtgtttttaggaggtcgttttcgttttatttttttacgttttcgcgggcgttgtcgagataataatttttttaggcgttcgcgttttattttttatttcgcgttttgaagtcgggtcggtttcgttcgtttcgttatcgttggagttcgaggagggcggagggaattgagaggggaggggagaagggtcgtttggtaggaagaggcgagggagggggcgggtcgagaaggaggggaggaggcggtggcggcgggtcggaagcgcgttcgtttaggtttttttgcgcggcgtgcgcgtttttgatgtcggaggcgtttattttgtcgggcggcggcggcgtatacgcgcgtgtacgtcgttgcgtggtcgcggttgcgtcgggagcggaggagtgaggttttgatagaattagagttgttagagtagggacgcgcgaaaggcgggagtacgggcggcgttggagaattttcgcggcggaggggtttgggggtgggatcgcgttcgcgagtt

SEQ ID NO: 18204 - DNA, 828 bp, Artificial Sequence
  chemically treated genomic DNA (Homo sapiens) CpG-island No: 18204
aactcgcgaacgcgatcccacccccaaacccctccgccgcgaaaattctccaacgccgcccgtactcccgcctttcgcgcgtccctactctaacaactctaattctatcaaaacctcactcctccgctcccgacgcaaccgcgaccacgcaacgacgtacacgcgcgtatacgccgccgccgcccgacaaaataaacgcctccgacatcaaaaacgcgcacgccgcgcaaaaaaacctaaacgaacgcgcttccgacccgccgccaccgcctcctcccctccttctcgacccgccccctccctcgcctcttcctaccaaacgacccttctcccctcccctctcaattccctccgccctcctcgaactccaacgataacgaaacgaacgaaaccgacccgacttcaaaacgcgaaataaaaaataaaacgcgaacgcctaaaaaaattattatctcgacaacgcccgcgaaaacgtaaaaaaataaaacgaaaacgacctcctaaaaacacgaaaacgacccgacgacccgaatccgcgaaccgaaactacctaaatatattaacgtcgaactaaacctaaaaaaaatcgaaataaaaccccaaccgaaaactaaaatacgaaaaaaccgcgataaaaaaaataaaaaacgaattcaaaactatcgaccgcctcccgaacaccgcaattctcccaaataaccgctcctcgcgaataaaacgaacgaaatcgacgcccttacctaaaaataaaataataactttaacgaccgcctcctccaactataccctcctaacattactacctcgacgactaccgcccgctactac

SEQ ID NO: 18205 - DNA, 528 bp, Artificial Sequence
  chemically treated genomic DNA (Homo sapiens) CpG-island No: 18205
tttcgtcgcggtttcgtcggttttttagggtcgttagagggattgcgtttcggttagtgggcgggcggtcggggttacggcggggacggcggtagtcggttaatgaggagcgcggttgtggtcgggggcgggcgtattcggtttttcgcgtcgttttcggatcgttatttttttcgtttcgagttttattaggtcgaggattttaaatttcgaagaaaggaaaggttttttatcgttttttcgtcgtcgtttcgcgttttttgatgagttcgtttagggagatgttcgttattttgattcgtcgagtaagtcgaaagtagtcgagatttcgcgagttcgttttttcggtcgttagggagcgacgaattattttcggcgttcgcggattaattttcgcgatagttagtttaaagtaggtaagaatcggaaggggcggggacgtttttcgtgagttttcgcggtgttggttgtttatttgtatacggaagttcggtatattatgaattatttatttttttcgagggaaaa

SEQ ID NO: 18206 - DNA, 528 bp, Artificial Sequence
  chemically treated genomic DNA (Homo sapiens) CpG-island No: 18206
ttttccctcgaaaaaaataaataattcataatataccgaacttccgtatacaaataaacaaccaacaccgcgaaaactcacgaaaaacgtccccgccccttccgattcttacctactttaaactaactatcgcgaaaattaatccgcgaacgccgaaaataattcgtcgctccctaacgaccgaaaaaacgaactcgcgaaatctcgactactttcgacttactcgacgaatcaaaataacgaacatctccctaaacgaactcatcaaaaaacgcgaaacgacgacgaaaaaacgataaaaaacctttcctttcttcgaaatttaaaatcctcgacctaataaaactcgaaacgaaaaaaataacgatccgaaaacgacgcgaaaaaccgaatacgcccgcccccgaccacaaccgcgctcctcattaaccgactaccgccgtccccgccgtaaccccgaccgcccgcccactaaccgaaacgcaatccctctaacgaccctaaaaaaccgacgaaaccgcgacgaaa

SEQ ID NO: 18207 - DNA, 528 bp, Artificial Sequence
  chemically treated genomic DNA (Homo sapiens) CpG-island No: 18207
ttttttttcgaggaaaataaataatttataatgtgtcgaattttcgtatgtagatgagtagttagtatcgcgaaggtttacggggaacgttttcgtttttttcggtttttgtttgttttgagttggttgtcgcgagagttggttcgcggacgtcggaagtagttcgtcgttttttagcggtcgaaggggcgggttcgcggggtttcgattgttttcggtttgttcggcggattaagatggcggatatttttttggacgaatttattaggaagcgcggggcggcggcgaaaggacggtgagaggtttttttttttttcggggtttagggttttcggtttagtggagttcgaggcgggggaggtagcgattcgggagcgacgcggaggatcgggtgcgttcgttttcgattatagtcgcgttttttattggtcggttgtcgtcgttttcgtcgtggtttcgatcgttcgtttattggtcgaggcgtagtttttttggcggttttgggaggtcgacggggtcgcggcgggg

SEQ ID NO: 18208 - DNA, 528 bp, Artificial Sequence
  chemically treated genomic DNA (Homo sapiens) CpG-island No: 18208
ccccgccgcgaccccgtcgacctcccaaaaccgccaaaaaaactacgcctcgaccaataaacgaacgatcgaaaccacgacgaaaacgacgacaaccgaccaataaaaaacgcgactataatcgaaaacgaacgcacccgatcctccgcgtcgctcccgaatcgctacctcccccgcctcgaactccactaaaccgaaaaccctaaaccccgaaaaaaaaaaaaacctctcaccgtcctttcgccgccgccccgcgcttcctaataaattcgtccaaaaaaatatccgccatcttaatccgccgaacaaaccgaaaacaatcgaaaccccgcgaacccgccccttcgaccgctaaaaaacgacgaactacttccgacgtccgcgaaccaactctcgcgacaaccaactcaaaacaaacaaaaaccgaaaaaaacgaaaacgttccccgtaaaccttcgcgatactaactactcatctacatacgaaaattcgacacattataaattatttattttcctcgaaaaaaaa

SEQ ID NO: 18209 - DNA, 578 bp, Artificial Sequence
  chemically treated genomic DNA (Homo sapiens) CpG-island No: 18209
acgtagttcgtttaggttattgtggggtggggtggggcgcggcgggttgggcgggagaagtgggtgcggtcgggtgcggttcgggtttcgcgttatttttcgtaggttagttcgttttttcgtcgtcgggttttagtttttcgagacgtttcgcggtttcggcgtttttttttcgtttatcgtgttgagttgggtttttatggtggtttcgcgtcgcgttcgttttgtcgtcgtcgtcgtcgtcgtcgagatcgtcgcgttcgggttcgcgttatttcggagtaggggcggggtcgaggggttaggcgggcgcgcggggcggggcgggcgcgggggcggggatcgggtcgtttcgtttgtttttgtcggggatggagattggaaattggggatgcggttttttgcgtttcgagttttttcgtcgttgtgttgtttcgcgcgggaaggtggtttatttgggtttcgttcgtcgttataaaggaagtaagatggcgtttttcggatgggagcgagaataagaggcggaattttttttcggttttcgagattgtaggggtcggttttgtttggtttggtat

SEQ ID NO: 18210 - DNA, 578 bp, Artificial Sequence
  chemically treated genomic DNA (Homo sapiens) CpG-island No: 18210
ataccaaaccaaacaaaaccgacccctacaatctcgaaaaccgaaaaaaaattccgcctcttattctcgctcccatccgaaaaacgccatcttacttcctttataacgacgaacgaaacccaaataaaccaccttcccgcgcgaaacaacacaacgacgaaaaaactcgaaacgcaaaaaaccgcatccccaatttccaatctccatccccgacaaaaacaaacgaaacgacccgatccccgcccccgcgcccgccccgccccgcgcgcccgcctaacccctcgaccccgcccctactccgaaataacgcgaacccgaacgcgacgatctcgacgacgacgacgacgacgacaaaacgaacgcgacgcgaaaccaccataaaaacccaactcaacacgataaacgaaaaaaaaacgccgaaaccgcgaaacgtctcgaaaaactaaaacccgacgacgaaaaaacgaactaacctacgaaaaataacgcgaaacccgaaccgcacccgaccgcacccacttctcccgcccaacccgccgcgccccaccccaccccacaataacctaaacgaactacgt

SEQ ID NO: 18211 - DNA, 578 bp, Artificial Sequence
  chemically treated genomic DNA (Homo sapiens) CpG-island No: 18211
atgttaggttaggtaggatcggtttttgtagtttcggaggtcgggggaagatttcgttttttattttcgtttttattcggggggcgttattttgttttttttatggcggcgaacgaggtttagataggttattttttcgcgcggggtagtatagcggcgggagagttcggagcgtagagggtcgtatttttagtttttagtttttattttcggtagaagtaggcggagcgattcggttttcgttttcgcgttcgtttcgtttcgcgcgttcgtttggtttttcggtttcgtttttgtttcggagtgacgcgggttcgggcgcgacggtttcggcggcggcggcggcggcgatagagcgagcgcggcgcggggttattatgggggtttagtttagtacggtaggcggggagggggcgtcggggtcgcggggcgtttcgagggattgggattcggcggcgagggggcgggttggtttgcgggaggtgacgcgggattcgggtcgtattcggtcgtatttatttttttcgtttagttcgtcgcgttttattttattttataatggtttgggcgagttacgt

SEQ ID NO: 18212 - DNA, 578 bp, Artificial Sequence
  chemically treated genomic DNA (Homo sapiens) CpG-island No: 18212
acgtaactcgcccaaaccattataaaataaaataaaacgcgacgaactaaacgaaaaaaataaatacgaccgaatacgacccgaatcccgcgtcacctcccgcaaaccaacccgccccctcgccgccgaatcccaatccctcgaaacgccccgcgaccccgacgccccctccccgcctaccgtactaaactaaacccccataataaccccgcgccgcgctcgctctatcgccgccgccgccgccgccgaaaccgtcgcgcccgaacccgcgtcactccgaaacaaaaacgaaaccgaaaaaccaaacgaacgcgcgaaacgaaacgaacgcgaaaacgaaaaccgaatcgctccgcctacttctaccgaaaataaaaactaaaaactaaaaatacgaccctctacgctccgaactctcccgccgctatactaccccgcgcgaaaaaataacctatctaaacctcgttcgccgccataaaaaaaacaaaataacgccccccgaataaaaacgaaaataaaaaacgaaatcttcccccgacctccgaaactacaaaaaccgatcctacctaacctaacat

SEQ ID NO: 18213 - DNA, 511 bp, Artificial Sequence
  chemically treated genomic DNA (Homo sapiens) CpG-island No: 18213
gggtcgcggaggaaaaggtcggtttttcgattgtagtttcgtggtggggaggttgcggggtttacgggttaagttttttacgtagggtcggtttttggttttttttggttttcggaggcgtcgtcgttttgtttcggggtcgagttcgtttttcgttgtttatttcgattattttttcgttcgttttttacgtgtggattttttgtttttattttgttcgttgtggttatatttgggatatttagaattattttttcgtttttaggttttcgacgtagttatattcgttaagttttttttttttgtgggcgaatttgtggtcgttcgttcgtagatgttcggatcgtggtgtggatatcggggggcgttatttttggttcggcgcggacgtttttttttcggcgcgggtttgttcggatttcgtttttagttattattttcgcgttttatttttatttttttaggttgtttttggtgttttcgtagtatttattcggtagaaaattatttg

SEQ ID NO: 18214 - DNA, 511 bp, Artificial Sequence
  chemically treated genomic DNA (Homo sapiens) CpG-island No: 18214
caaataattttctaccgaataaatactacgaaaacaccaaaaacaacctaaaaaaataaaaataaaacgcgaaaataataactaaaaacgaaatccgaacaaacccgcgccgaaaaaaaaacgtccgcgccgaaccaaaaataacgccccccgatatccacaccacgatccgaacatctacgaacgaacgaccacaaattcgcccacaaaaaaaaaaaacttaacgaatataactacgtcgaaaacctaaaaacgaaaaaataattctaaatatcccaaatataaccacaacgaacaaaataaaaacaaaaaatccacacgtaaaaaacgaacgaaaaaataatcgaaataaacaacgaaaaacgaactcgaccccgaaacaaaacgacgacgcctccgaaaaccaaaaaaaaccaaaaaccgaccctacgtaaaaaacttaacccgtaaaccccgcaacctccccaccacgaaactacaatcgaaaaaccgaccttttcctccgcgaccc

SEQ ID NO: 18215 - DNA, 511 bp, Artificial Sequence
  chemically treated genomic DNA (Homo sapiens) CpG-island No: 18215
taggtgattttttgtcgggtgggtgttgcgagggtattaggggtaatttgggaaagtgggaatgggacgcggaggtggtggttgagggcggggttcgggtaggttcgcgtcgaggagggggcgttcgcgtcgagttaggaatggcgtttttcgatgtttatattacggttcgggtatttgcgaacgggcggttatagattcgtttatagggaaaggggatttggcgggtatggttgcgtcgggggtttggagacggggagatggttttggatgttttaggtgtaattatagcgggtaggataaggataaagggtttatacgtggaggacgggcggggagatggtcggagtgagtaacgggagacgaattcggtttcgaagtaggacgacggcgttttcggaagttagaaaaggttaagaatcggttttgcgtggggagtttagttcgtgagtttcgtagtttttttattacggaattgtagtcgggaaatcggttttttttttcgcggttt

SEQ ID NO: 18216 - DNA, 511 bp, Artificial Sequence
  chemically treated genomic DNA (Homo sapiens) CpG-island No: 18216
aaaccgcgaaaaaaaaaaccgatttcccgactacaattccgtaataaaaaaactacgaaactcacgaactaaactccccacgcaaaaccgattcttaaccttttctaacttccgaaaacgccgtcgtcctacttcgaaaccgaattcgtctcccgttactcactccgaccatctccccgcccgtcctccacgtataaaccctttatccttatcctacccgctataattacacctaaaacatccaaaaccatctccccgtctccaaacccccgacgcaaccatacccgccaaatcccctttccctataaacgaatctataaccgcccgttcgcaaatacccgaaccgtaatataaacatcgaaaaacgccattcctaactcgacgcgaacgccccctcctcgacgcgaacctacccgaaccccgccctcaaccaccacctccgcgtcccattcccactttcccaaattacccctaataccctcgcaacacccacccgacaaaaaatcaccta

SEQ ID NO: 18217 - DNA, 543 bp, Artificial Sequence
  chemically treated genomic DNA (Homo sapiens) CpG-island No: 18217
acgtagtgggaggtgaaatcgacgagggtgtaggtagtattaggcggcgaattaggttcgttgggtggtggttggaggttgcgggtggggataaaagcgcggtagacgagataaaagggagcgtatttattagaattattcgttatcgaagttgggtacggaaaatattttttagtggatgaagatgtcgaatttggtttggttaaattacgcgggtagttggcgggcgtttagggatttttaggtggggtcgaagcgcgtggcgttgtgggtagggtacggcggcggcggtagtagtagtaatagtaatagtagtaacgggaacgcgagtttggggagtttttggggtcgtatgtttcggcgtaggtcggttgttttttttgtaggttttcgcggtttcgggagcgttgttttttcgtttttgtcgttgagtatgtcgcgtcgcggttatttgattaagtcggatttggaaatcggttatttttttttttttggggcgggagtggttattttttcgggcgtttcgaatgattttaggagggt

SEQ ID NO: 18218 - DNA, 543 bp, Artificial Sequence
  chemically treated genomic DNA (Homo sapiens) CpG-island No: 18218
accctcctaaaatcattcgaaacgcccgaaaaaataaccactcccgccccaaaaaaaaaaaaataaccgatttccaaatccgacttaatcaaataaccgcgacgcgacatactcaacgacaaaaacgaaaaaacaacgctcccgaaaccgcgaaaacctacaaaaaaaacaaccgacctacgccgaaacatacgaccccaaaaactccccaaactcgcgttcccgttactactattactattactactactaccgccgccgccgtaccctacccacaacgccacgcgcttcgaccccacctaaaaatccctaaacgcccgccaactacccgcgtaatttaaccaaaccaaattcgacatcttcatccactaaaaaatattttccgtacccaacttcgataacgaataattctaataaatacgctcccttttatctcgtctaccgcgcttttatccccacccgcaacctccaaccaccacccaacgaacctaattcgccgcctaatactacctacaccctcgtcgatttcacctcccactacgt

SEQ ID NO: 18219 - DNA, 543 bp, Artificial Sequence
  chemically treated genomic DNA (Homo sapiens) CpG-island No: 18219
gtttttttgaggttattcggaacgttcgggagagtggttattttcgttttagagggggaagggtggtcggtttttaagttcgatttggttaggtgatcgcggcgcggtatatttagcggtagagacggaagaatagcgttttcgaggtcgcgggagtttgtagagaggatagtcggtttgcgtcgggatatgcggttttaggagttttttaggttcgcgttttcgttgttgttgttgttgttgttgttgttgtcgtcgtcgtcgtgttttgtttatagcgttacgcgtttcgattttatttgggagtttttggacgttcgttagttgttcgcgtggtttgattaggttaagttcggtatttttatttattggggagtgtttttcgtgtttagtttcggtagcgagtggttttggtgagtgcgtttttttttgtttcgtttgtcgcgtttttgtttttattcgtagtttttagttattatttagcgggtttggttcgtcgtttggtgttgtttgtattttcgtcggttttattttttattgcgt

SEQ ID NO: 18220 - DNA, 543 bp, Artificial Sequence
  chemically treated genomic DNA (Homo sapiens) CpG-island No: 18220
acgcaataaaaaataaaaccgacgaaaatacaaacaacaccaaacgacgaaccaaacccgctaaataataactaaaaactacgaataaaaacaaaaacgcgacaaacgaaacaaaaaaaaacgcactcaccaaaaccactcgctaccgaaactaaacacgaaaaacactccccaataaataaaaataccgaacttaacctaatcaaaccacgcgaacaactaacgaacgtccaaaaactcccaaataaaatcgaaacgcgtaacgctataaacaaaacacgacgacgacgacaacaacaacaacaacaacaacaacaacgaaaacgcgaacctaaaaaactcctaaaaccgcatatcccgacgcaaaccgactatcctctctacaaactcccgcgacctcgaaaacgctattcttccgtctctaccgctaaatataccgcgccgcgatcacctaaccaaatcgaacttaaaaaccgaccacccttccccctctaaaacgaaaataaccactctcccgaacgttccgaataacctcaaaaaaac

SEQ ID NO: 18221 - DNA, 718 bp, Artificial Sequence
  chemically treated genomic DNA (Homo sapiens) CpG-island No: 18221
ttaaggcggttatcgcgggtcggttggggtcggagggggatcgtttcgtcgaggttttcgttttttttttttttttttttttttcgcgtcgtcgagtcggagttgcgtcgtacgtttagcggtcgttcggattcgtcggtcggagttgatttagtgggttacgggtttcggattttagaattttttaagcgggggaaatttggcggcgggtaggtaggaaaggtaggtgaggtaggggcgagcgagagaattggttggtagcggggcggggagtcgggggcgcggcgttaaggtgggcgcgtggggcgggggttttaattcgtgtcgtaggtgtttacgtgtcgcgcggagttcgcgggttaggcgaggtagtttggtcgaggtttttgtttgcgttttgtcggggatggcggtcggtgtttgggatatcggcggttatttttgtgcggtttggggcgcgtttttttttttttcgtcgtttgtagtttttcgtttttgcgttgggcggagggcgggtcgggtgacgtgggagttgaatagtcgttatttagcgttcgtttcgtcggttattgttttcgcgcggaggtaggtcgtcgtttttcgggttttgtgtttttcgaggttgggggcggggttgtttgcgtagacggcggggtgattattgttgaattattttaacgggagaattttaagtgttagtttagttcgttttttagag

SEQ ID NO: 18222 - DNA, 718 bp, Artificial Sequence
  chemically treated genomic DNA (Homo sapiens) CpG-island No: 18222
ctctaaaaaacgaactaaactaacacttaaaattctcccgttaaaataattcaacaataatcaccccgccgtctacgcaaacaaccccgcccccaacctcgaaaaacacaaaacccgaaaaacgacgacctacctccgcgcgaaaacaataaccgacgaaacgaacgctaaataacgactattcaactcccacgtcacccgacccgccctccgcccaacgcaaaaacgaaaaactacaaacgacgaaaaaaaaaaaaacgcgccccaaaccgcacaaaaataaccgccgatatcccaaacaccgaccgccatccccgacaaaacgcaaacaaaaacctcgaccaaactacctcgcctaacccgcgaactccgcgcgacacgtaaacacctacgacacgaattaaaacccccgccccacgcgcccaccttaacgccgcgcccccgactccccgccccgctaccaaccaattctctcgctcgcccctacctcacctacctttcctacctacccgccgccaaatttcccccgcttaaaaaattctaaaatccgaaacccgtaacccactaaatcaactccgaccgacgaatccgaacgaccgctaaacgtacgacgcaactccgactcgacgacgcgaaaaaaaaaaaaaaaaaaaaaaaacgaaaacctcgacgaaacgatccccctccgaccccaaccgacccgcgataaccgccttaa

SEQ ID NO: 18223 - DNA, 718 bp, Artificial Sequence
  chemically treated genomic DNA (Homo sapiens) CpG-island No: 18223
ttttgggagacgggttaagttggtatttgagattttttcgttggggtggtttagtaatgattatttcgtcgtttgcgtagatagtttcgtttttagtttcggagagtataggattcgggaggcggcgatttgttttcgcgcggggatagtggtcggcggggcgggcgttaggtggcggttgtttagtttttacgttattcggttcgtttttcgtttagcgtagaagcgaagagttgtagacgacggagaaaagggaagcgcgttttaagtcgtataaaggtggtcgtcggtgttttaagtatcgatcgttattttcggtaggacgtaggtaggagtttcggttaggttatttcgtttggttcgcggatttcgcgcggtacgtgggtatttgcggtacgggttggagttttcgttttacgcgtttattttaacgtcgcgttttcggtttttcgtttcgttgttagttagttttttcgttcgtttttgttttatttgttttttttatttattcgtcgttaagtttttttcgtttggaaagttttggagttcggagttcgtggtttattgggttagtttcggtcggcgggttcgggcggtcgttgggcgtgcggcgtagtttcgattcggcggcgcggaaaaggggaaggggaggaaggggcgggagtttcggcggggcgattttttttcgattttagtcggttcgcggtagtcgttttgg

SEQ ID NO: 18224 - DNA, 718 bp, Artificial Sequence
  chemically treated genomic DNA (Homo sapiens) CpG-island No: 18224
ccaaaacgactaccgcgaaccgactaaaatcgaaaaaaaatcgccccgccgaaactcccgccccttcctccccttccccttttccgcgccgccgaatcgaaactacgccgcacgcccaacgaccgcccgaacccgccgaccgaaactaacccaataaaccacgaactccgaactccaaaactttccaaacgaaaaaaacttaacgacgaataaataaaaaaaacaaataaaacaaaaacgaacgaaaaaactaactaacaacgaaacgaaaaaccgaaaacgcgacgttaaaataaacgcgtaaaacgaaaactccaacccgtaccgcaaatacccacgtaccgcgcgaaatccgcgaaccaaacgaaataacctaaccgaaactcctacctacgtcctaccgaaaataacgatcgatacttaaaacaccgacgaccacctttatacgacttaaaacgcgcttcccttttctccgtcgtctacaactcttcgcttctacgctaaacgaaaaacgaaccgaataacgtaaaaactaaacaaccgccacctaacgcccgccccgccgaccactatccccgcgcgaaaacaaatcgccgcctcccgaatcctatactctccgaaactaaaaacgaaactatctacgcaaacgacgaaataatcattactaaaccaccccaacgaaaaaatctcaaataccaacttaacccgtctcccaaaa

SEQ ID NO: 18225 - DNA, 632 bp, Artificial Sequence
  chemically treated genomic DNA (Homo sapiens) CpG-island No: 18225
ttacgtttcgggttattggacggtgtattggtttacgtttagtatcggtagtagggcgaaggcgagtacggttagttatacgtcgagtagtatagcgcgggtggtacgcgtttttatgtggttcgtatattagtgcggcgttttgatggttagcgttcgttcgacggttatggcgttggcgatgaataacgaggagagttcgaaaatagttatggttagttcgaaaaaggtgtagagtcgtttcgacgggtcgatgtgtttttaacgttgtttggataggtatacgacgatgacgatcggggtggtgagaagttgttcgattaggtcggtgagcgttagttagtcgatgtatagtaggaaggattttttgcgtttgttttttcggcgtcggtagttgcgcgatacgagtagtatggttagtgcgttgtttacgaaattagtgagtagtatggtgatcgggaaggttacggatatcgattcgtaattttcgttagattttggagggcgcgtgaggttgtttcgcgtttcggcggaacgttcgggcgtttatatgtttgtgtaggagtggttgaggcgggtgtagaagggggtatttttttcgtagtttcgggttttttttatgttggtttcga

SEQ ID NO: 18226 - DNA, 632 bp, Artificial Sequence
  chemically treated genomic DNA (Homo sapiens) CpG-island No: 18226
tcgaaaccaacataaaaaaaacccgaaactacgaaaaaaatacccccttctacacccgcctcaaccactcctacacaaacatataaacgcccgaacgttccgccgaaacgcgaaacaacctcacgcgccctccaaaatctaacgaaaattacgaatcgatatccgtaaccttcccgatcaccatactactcactaatttcgtaaacaacgcactaaccatactactcgtatcgcgcaactaccgacgccgaaaaaacaaacgcaaaaaatccttcctactatacatcgactaactaacgctcaccgacctaatcgaacaacttctcaccaccccgatcgtcatcgtcgtatacctatccaaacaacgttaaaaacacatcgacccgtcgaaacgactctacacctttttcgaactaaccataactattttcgaactctcctcgttattcatcgccaacgccataaccgtcgaacgaacgctaaccatcaaaacgccgcactaatatacgaaccacataaaaacgcgtaccacccgcgctatactactcgacgtataactaaccgtactcgccttcgccctactaccgatactaaacgtaaaccaatacaccgtccaataacccgaaacgtaa

SEQ ID NO: 18227 - DNA, 632 bp, Artificial Sequence
  chemically treated genomic DNA (Homo sapiens) CpG-island No: 18227
tcgaagttaatatgaaggagattcggggttacggaggggatgtttttttttgtattcgttttaattatttttatataggtatgtgggcgttcgagcgtttcgtcgaggcgcggggtaattttacgcgttttttagggtttggcgaggattgcggatcggtgttcgtggttttttcgattattatgttgtttattggtttcgtgggtaacgtattggttatgttgttcgtgtcgcgtagttatcggcgtcgggagagtaagcgtaagaagttttttttgttgtgtatcggttggttggcgtttatcgatttggtcgggtagttttttattatttcggtcgttatcgtcgtgtatttgtttaagtagcgttgggagtatatcgattcgtcggggcggttttgtatttttttcgggttgattatgattgttttcgggtttttttcgttgtttatcgttagcgttatggtcgtcgagcgggcgttggttattagggcgtcgtattggtatgcgagttatatgaagacgcgtgttattcgcgttgtgttgttcggcgtgtggttggtcgtgttcgttttcgttttgttgtcggtgttgggcgtgggttagtatatcgtttagtggttcgggacgtgg

SEQ ID NO: 18228 - DNA, 632 bp, Artificial Sequence
  chemically treated genomic DNA (Homo sapiens) CpG-island No: 18228
ccacgtcccgaaccactaaacgatatactaacccacgcccaacaccgacaacaaaacgaaaacgaacacgaccaaccacacgccgaacaacacaacgcgaataacacgcgtcttcatataactcgcataccaatacgacgccctaataaccaacgcccgctcgacgaccataacgctaacgataaacaacgaaaaaaacccgaaaacaatcataatcaacccgaaaaaaatacaaaaccgccccgacgaatcgatatactcccaacgctacttaaacaaatacacgacgataacgaccgaaataataaaaaactacccgaccaaatcgataaacgccaaccaaccgatacacaacaaaaaaaacttcttacgcttactctcccgacgccgataactacgcgacacgaacaacataaccaatacgttacccacgaaaccaataaacaacataataatcgaaaaaaccacgaacaccgatccgcaatcctcgccaaaccctaaaaaacgcgtaaaattaccccgcgcctcgacgaaacgctcgaacgcccacatacctatataaaaataattaaaacgaatacaaaaaaaaacatcccctccgtaaccccgaatctccttcatattaacttcga

SEQ ID NO: 18229 - DNA, 532 bp, Artificial Sequence
  chemically treated genomic DNA (Homo sapiens) CpG-island No: 18229
ttttttcgggtatattgtgcgattaaagtcgtagtagcgttgttttcgcgcgatcgcgtacgttttttcgtagtacgatttttttcgagagcgcgatttgttacgggatcgggatcggtatcgcgaaggagatcggtagtattttttggtgaattcgtagcgtttttttcggtaacggcggttgcgggatcgcgatcggtttcgcgagtatgatcgcgagtagcgtttgtattttcgttggtggcgttttcgggaacgggatttggatttgttttttcgatttttggacgaaaatcggttcgagacgcgggaatgggatcgagagtttttggaaaaagagcggtttttagatcgcgacgatagtcggttggattcgttcgatcgcgaggtcgagggcgaattttttttttgcggcgagttcggttatatgtcgtttacgtagttggatatttttatttgcggttttagtttgcgtttttttcggaaaggatttcgtaagttttaatttaggattttttaaaaaattaagaga

SEQ ID NO: 18230 - DNA, 532 bp, Artificial Sequence
  chemically treated genomic DNA (Homo sapiens) CpG-island No: 18230
tctcttaattttttaaaaaatcctaaattaaaacttacgaaatcctttccgaaaaaaacgcaaactaaaaccgcaaataaaaatatccaactacgtaaacgacatataaccgaactcgccgcaaaaaaaaaattcgccctcgacctcgcgatcgaacgaatccaaccgactatcgtcgcgatctaaaaaccgctctttttccaaaaactctcgatcccattcccgcgtctcgaaccgattttcgtccaaaaatcgaaaaaacaaatccaaatcccgttcccgaaaacgccaccaacgaaaatacaaacgctactcgcgatcatactcgcgaaaccgatcgcgatcccgcaaccgccgttaccgaaaaaaacgctacgaattcaccaaaaaatactaccgatctccttcgcgataccgatcccgatcccgtaacaaatcgcgctctcgaaaaaaatcgtactacgaaaaaacgtacgcgatcgcgcgaaaacaacgctactacgactttaatcgcacaatatacccgaaaaaa

SEQ ID NO: 18231 - DNA, 532 bp, Artificial Sequence
  chemically treated genomic DNA (Homo sapiens) CpG-island No: 18231
ttttttggttttttaggaagttttgagttgaggtttgcgggatttttttcggagaaagcgtaggttaaagtcgtaggtgaagatgtttaattacgtgaacgatatgtggtcgggttcgtcgtaggagaaggattcgttttcgatttcgcggtcgggcgggtttagtcggttgtcgtcgcggtttaggagtcgttttttttttagaagttttcggttttattttcgcgtttcgagtcggttttcgtttaggagtcggaggagtaagtttaggtttcgttttcgaaggcgttattagcggaagtataggcgttattcgcggttatattcgcggagtcggtcgcgatttcgtagtcgtcgttatcgagagaggcgttacgggtttattaggagatattatcggtttttttcgcggtatcggtttcggtttcgtagtaggtcgcgttttcggggaaggtcgtattgcggaagggcgtacgcgatcgcgcggggatagcgttattacggttttggtcgtatagtgtattcggaggag

SEQ ID NO: 18232 - DNA, 532 bp, Artificial Sequence
  chemically treated genomic DNA (Homo sapiens) CpG-island No: 18232
ctcctccgaatacactatacgaccaaaaccgtaataacgctatccccgcgcgatcgcgtacgcccttccgcaatacgaccttccccgaaaacgcgacctactacgaaaccgaaaccgataccgcgaaaaaaaccgataatatctcctaataaacccgtaacgcctctctcgataacgacgactacgaaatcgcgaccgactccgcgaatataaccgcgaataacgcctatacttccgctaataacgccttcgaaaacgaaacctaaacttactcctccgactcctaaacgaaaaccgactcgaaacgcgaaaataaaaccgaaaacttctaaaaaaaaaacgactcctaaaccgcgacgacaaccgactaaacccgcccgaccgcgaaatcgaaaacgaatccttctcctacgacgaacccgaccacatatcgttcacgtaattaaacatcttcacctacgactttaacctacgctttctccgaaaaaaatcccgcaaacctcaactcaaaacttcctaaaaaaccaaaaaa

SEQ ID NO: 18233 - DNA, 623 bp, Artificial Sequence
  chemically treated genomic DNA (Homo sapiens) CpG-island No: 18233
agtcgcggaagtcggcgtttggttattcggaagttatagtcggggaattttcgggaggcggagttacggcgcgggcggcgatcgtcgcgataggaatcgagttttagaaatttcgttcggcgttttgaggtcgcggttttgaagcgaaacgttgcgttttttaaacgcggggttcggtacgtttttcgttttttatttttgagagattattgcggtggttttgagagatttcgttagtagaaaatttatcgtacgtcgtcgacgttttttttacgattgagagaaaggtttaatagacgtttttttttcggaacgtaagacgaagtggggtttttagtttttgttttcgaacggcgaattttataatttttattttttacgttcggatgcgtattgagggattacgttagtagacgcgttaaaagtattagaagttggttttcggcgtatgcgtagagatgtttcgtggtgggcgcggttttttttttgtttaattatcgttttgttttttttttttttaagtcgcgttttgtgtttcgagcgtttgtttttagggtgcgtatgcgcgatggggttttagggggaggtgtttgatatattagggtgtttcgttgtttttggtt

SEQ ID NO: 18234 - DNA, 623 bp, Artificial Sequence
  chemically treated genomic DNA (Homo sapiens) CpG-island No: 18234
aaccaaaaacaacgaaacaccctaatatatcaaacacctccccctaaaaccccatcgcgcatacgcaccctaaaaacaaacgctcgaaacacaaaacgcgacttaaaaaaaaaaaaaacaaaacgataattaaacaaaaaaaaaaccgcgcccaccacgaaacatctctacgcatacgccgaaaaccaacttctaatacttttaacgcgtctactaacgtaatccctcaatacgcatccgaacgtaaaaaataaaaattataaaattcgccgttcgaaaacaaaaactaaaaaccccacttcgtcttacgttccgaaaaaaaaacgtctattaaacctttctctcaatcgtaaaaaaaacgtcgacgacgtacgataaattttctactaacgaaatctctcaaaaccaccgcaataatctctcaaaaataaaaaacgaaaaacgtaccgaaccccgcgtttaaaaaacgcaacgtttcgcttcaaaaccgcgacctcaaaacgccgaacgaaatttctaaaactcgattcctatcgcgacgatcgccgcccgcgccgtaactccgcctcccgaaaattccccgactataacttccgaataaccaaacgccgacttccgcgact

SEQ ID NO: 18235 - DNA, 623 bp, Artificial Sequence
  chemically treated genomic DNA (Homo sapiens) CpG-island No: 18235
agttaagggtaacgggatattttgatgtattaaatatttttttttggagttttatcgcgtatgcgtattttggaggtaagcgttcgaggtatagggcgcggtttggggagggaggaggtagggcggtggttgggtaagagaagagtcgcgtttattacggaatatttttgcgtatgcgtcgggggttagtttttggtatttttgacgcgtttgttaacgtagttttttagtgcgtattcggacgtaggaggtggaggttgtggaattcgtcgttcgaaagtagggattaaaagttttatttcgttttacgtttcgaaaggaaggcgtttgttgagttttttttttagtcgtgagggaggcgtcgacggcgtgcggtaagttttttgttgacggggttttttaggattatcgtagtggttttttaggagtgagggacgggaaacgtgtcgggtttcgcgtttggggaacgtagcgtttcgttttaaggtcgcggttttagggcgtcgagcggggtttttagggttcggtttttgtcgcggcggtcgtcgttcgcgtcgtggtttcgtttttcggaggtttttcgattgtggttttcgggtggttaggcgtcggttttcgcgatt

SEQ ID NO: 18236 - DNA, 623 bp, Artificial Sequence
  chemically treated genomic DNA (Homo sapiens) CpG-island No: 18236
aatcgcgaaaaccgacgcctaaccacccgaaaaccacaatcgaaaaacctccgaaaaacgaaaccacgacgcgaacgacgaccgccgcgacaaaaaccgaaccctaaaaaccccgctcgacgccctaaaaccgcgaccttaaaacgaaacgctacgttccccaaacgcgaaacccgacacgtttcccgtccctcactcctaaaaaaccactacgataatcctaaaaaaccccgtcaacaaaaaacttaccgcacgccgtcgacgcctccctcacgactaaaaaaaaaactcaacaaacgccttcctttcgaaacgtaaaacgaaataaaacttttaatccctactttcgaacgacgaattccacaacctccacctcctacgtccgaatacgcactaaaaaactacgttaacaaacgcgtcaaaaataccaaaaactaacccccgacgcatacgcaaaaatattccgtaataaacgcgactcttctcttacccaaccaccgccctacctcctccctccccaaaccgcgccctatacctcgaacgcttacctccaaaatacgcatacgcgataaaactccaaaaaaaaatatttaatacatcaaaatatcccgttacccttaact

SEQ ID NO: 18237 - DNA, 616 bp, Artificial Sequence
  chemically treated genomic DNA (Homo sapiens) CpG-island No: 18237
gtcgtcgtttatagggagagaagcgcgggcgagtcgggtcggggaagtcgtcgttgtttggttttgggcgtttaggcggtcgtcgcgcgcgtttttatgtcgtttcggcgcggatgttgatgaattacgttcgttttatgtcgcgggttacgttagtttcgcgtttcgttcgtcgtttcgtttcgttcgtttgggttaggtgcgtttcgttcggcggcggttgcgggttggggtcggagagtgaggttggaggtcgttgatttgatcgtcgaggtaggtttcgcgggcgtcgcgtttagcggaaaggtggggacggatgttcggagttggttcgttagtcgtcgggagggagcgtttggttcgcggcgggcggcgggaggtaggcggggaggggtttcgtcgcggttttcgtattttttgagtcgacggtggtcgcgggcggagtcggagcggtttagttcggatatcgggatttttagcgtggtgtaggcgtcgcgttcgttgtatttcgtcgtttgttaatcggaaaatttttgcgtttagttattaatagtttttttgggttattttttgtgttaggttcgggcgatgtagcgttgtatatattgtgtttttg

SEQ ID NO: 18238 - DNA, 616 bp, Artificial Sequence
  chemically treated genomic DNA (Homo sapiens) CpG-island No: 18238
caaaaacacaatatatacaacgctacatcgcccgaacctaacacaaaaaataacccaaaaaaactattaataactaaacgcaaaaattttccgattaacaaacgacgaaatacaacgaacgcgacgcctacaccacgctaaaaatcccgatatccgaactaaaccgctccgactccgcccgcgaccaccgtcgactcaaaaaatacgaaaaccgcgacgaaacccctccccgcctacctcccgccgcccgccgcgaaccaaacgctccctcccgacgactaacgaaccaactccgaacatccgtccccacctttccgctaaacgcgacgcccgcgaaacctacctcgacgatcaaatcaacgacctccaacctcactctccgaccccaacccgcaaccgccgccgaacgaaacgcacctaacccaaacgaacgaaacgaaacgacgaacgaaacgcgaaactaacgtaacccgcgacataaaacgaacgtaattcatcaacatccgcgccgaaacgacataaaaacgcgcgcgacgaccgcctaaacgcccaaaaccaaacaacgacgacttccccgacccgactcgcccgcgcttctctccctataaacgacgac

SEQ ID NO: 18239 - DNA, 616 bp, Artificial Sequence
  chemically treated genomic DNA (Homo sapiens) CpG-island No: 18239
taggggtatagtgtgtgtaacgttgtatcgttcgagtttggtatagggagtggtttaaaaaagttgttagtgattgaacgtaagaatttttcggttagtagacgacgggatgtagcgggcgcggcgtttgtattacgttgggggtttcggtgttcgggttgggtcgtttcgatttcgttcgcggttatcgtcggtttagggggtgcgaagatcgcggcgaggttttttttcgtttgtttttcgtcgttcgtcgcggattaggcgttttttttcggcggttggcgagttagtttcggatattcgtttttattttttcgttaagcgcggcgttcgcggggtttgtttcggcggttaggttagcggtttttagttttatttttcggttttagttcgtagtcgtcgtcgagcggagcgtatttgatttaggcgggcggggcggggcggcgggcggggcgcggggttgacgtggttcgcggtatggagcgggcgtgatttattagtattcgcgtcggggcggtatgggggcgcgcgcggcggtcgtttaggcgtttagggttaggtagcggcggttttttcggttcggttcgttcgcgtttttttttttgtgggcggcggt

SEQ ID NO: 18240 - DNA, 616 bp, Artificial Sequence
  chemically treated genomic DNA (Homo sapiens) CpG-island No: 18240
accgccgcccacaaaaaaaaaaacgcgaacgaaccgaaccgaaaaaaccgccgctacctaaccctaaacgcctaaacgaccgccgcgcgcgcccccataccgccccgacgcgaatactaataaatcacgcccgctccataccgcgaaccacgtcaaccccgcgccccgcccgccgccccgccccgcccgcctaaatcaaatacgctccgctcgacgacgactacgaactaaaaccgaaaaataaaactaaaaaccgctaacctaaccgccgaaacaaaccccgcgaacgccgcgcttaacgaaaaaataaaaacgaatatccgaaactaactcgccaaccgccgaaaaaaaacgcctaatccgcgacgaacgacgaaaaacaaacgaaaaaaaacctcgccgcgatcttcgcaccccctaaaccgacgataaccgcgaacgaaatcgaaacgacccaacccgaacaccgaaacccccaacgtaatacaaacgccgcgcccgctacatcccgtcgtctactaaccgaaaaattcttacgttcaatcactaacaacttttttaaaccactccctataccaaactcgaacgatacaacgttacacacactataccccta

SEQ ID NO: 18241 - DNA, 2273 bp, Artificial Sequence
  chemically treated genomic DNA (Homo sapiens) CpG-island No: 18241
ggcggtagcgagatcggcgggtttcggcgtcgtttttttttttttattcgttcgcggtcgtcggattcgtattttcgattttaacgagtttcggttggggggaggggatcgcgcgggggggaggtcgggagtttcgagggtcgattttcggaaggagggggagtgagtcggggcggagttagtaaagttcgcgggcggggggcgggggttcgaagagagaggttagcgcgtcggggggcggtgggtgggggtaggattcgggtttttagagcgggtggggttttcggaggacgcggttttcgagagtcgtagggggcgggggtcgattgggtttcgcgcggagttagggggcggggcgcgggttatcgggttcgggggatcgggggagtagtcgggggtttcgggagtcgatttcggttcgaggggggtttaaaatttttcgagagtaatcggagttaggggcgggcggcggttcggatcgcgttttcgggggcggggaaagagtaagtaggtcggcggggaggggttgggggcgtcgataggttttaggtcgacgcgaggtcggagaggggcggttcgggggagagaaataggcgtaacggttttggggaaagggcgcggggaggacgcggaggttcgcggaggggacgcggaggcgaggttcggcggagaggatcgagcgcgggttcgagtagggggcgggggttgggttttcgggggggtcgacgaggggaaagcgggggaaggggagggcggcgtttcgggcgatcgggggtttggttgtttgaggacggtaggatcgcggagggggtggtcgggggcgattcggacgtatagttttatttattttcgggtggaaggcggcggcgtaagagttagagtttatgtttcgggcggggggcggcggcggttgcgagagtgtaggagttgggatgttggagcggggtcgttcggggttgggggttcgggcggttgcgtagggcgagggcggattcgggaggggtcgttcgggttggaggtgatggggggtttagcgcgtcgttttttaagttttgtgatttcggattggcggttttatcgtcgatcggagtggacgatgtagttttcgcggcggtagaggcgggagagtggttgtagggggcggcggcggcggcggtgagcgggaattcgatcggtttttcgatttgacgtttagttcggttcgtgtttcgggagggagggcgggagagtcgggaggtttgtcgggaaatgtagtttgggtggcgattggaagttagcggcgagggggcgtggcgcgggaggcgggcgcggtgttttgtgggagtggtagtttaaggtttcgttaatattgcgtataaaggaaattttggggattttaatttttatgaggtttcgcggcggcggtttcggtgtgtggaggcgggttttttggattcgaggtcgcgcgagcgggggaggtgcgggggttcgcgtcggttcggtcgcggggggaggggtagtgtgagcggtagcgttttggtttcggcgggcgcgggggcgggagtcgttgcggcggtgggggcggggttgacggttcgggttgcgaagggcggcggcggttggtatttattttttttcgttttttatttggggttcgcgtttttttgtggggcgggggttttcgaggtttggtcgggagtaggggcggtaggggcggggacgttgacgtcgcggtcgtttcgggtatcgtttttcgtttttcgtttttcgttgagggcggagtcgtcgttcggttttcgttttaggtcgggtttagcgaagttgttttcgcggttgcgggtttcgtgcggttttttgtttcgggttcgcggggtcgggattggatcgggtttttttttaggtatttgcgggatttattcgaggtggtcgggttcgtgtattaaaaatatcgggttagcgttgttagtgttttaaagaggtgtgcgtttagtttgttttttgttgtcgtttaagtttaattttgggatcggtcgtttttttatttttttgaatatttttcggttcgtagggcgaggcggagacgcggtgtttggcgttggtatcgattggtatttgtttagtggtgtttaattgggatgggtagtgtgtaaacgttggatcgtagagtattcgatagttgtacgtgtggaaggttggtcggatacggtggggattgtttttatgcggtgattaaaaggcggtttgacgggaatatttttaatattcgaaagtgggggaaaaaggtaagtataaaa

SEQ ID NO: 18242 - DNA, 2273 bp, Artificial Sequence
  chemically treated genomic DNA (Homo sapiens) CpG-island No: 18242
ttttatacttacctttttcccccactttcgaatattaaaaatattcccgtcaaaccgccttttaatcaccgcataaaaacaatccccaccgtatccgaccaaccttccacacgtacaactatcgaatactctacgatccaacgtttacacactacccatcccaattaaacaccactaaacaaataccaatcgataccaacgccaaacaccgcgtctccgcctcgccctacgaaccgaaaaatattcaaaaaaataaaaaaacgaccgatcccaaaattaaacttaaacgacaacaaaaaacaaactaaacgcacacctctttaaaacactaacaacgctaacccgatatttttaatacacgaacccgaccacctcgaataaatcccgcaaatacctaaaaaaaaacccgatccaatcccgaccccgcgaacccgaaacaaaaaaccgcacgaaacccgcaaccgcgaaaacaacttcgctaaacccgacctaaaacgaaaaccgaacgacgactccgccctcaacgaaaaacgaaaaacgaaaaacgatacccgaaacgaccgcgacgtcaacgtccccgcccctaccgcccctactcccgaccaaacctcgaaaacccccgccccacaaaaaaacgcgaaccccaaataaaaaacgaaaaaaaataaataccaaccgccgccgcccttcgcaacccgaaccgtcaaccccgcccccaccgccgcaacgactcccgcccccgcgcccgccgaaaccaaaacgctaccgctcacactacccctccccccgcgaccgaaccgacgcgaacccccgcacctcccccgctcgcgcgacctcgaatccaaaaaacccgcctccacacaccgaaaccgccgccgcgaaacctcataaaaattaaaatccccaaaatttcctttatacgcaatattaacgaaaccttaaactaccactcccacaaaacaccgcgcccgcctcccgcgccacgccccctcgccgctaacttccaatcgccacccaaactacatttcccgacaaacctcccgactctcccgccctccctcccgaaacacgaaccgaactaaacgtcaaatcgaaaaaccgatcgaattcccgctcaccgccgccgccgccgccccctacaaccactctcccgcctctaccgccgcgaaaactacatcgtccactccgatcgacgataaaaccgccaatccgaaatcacaaaacttaaaaaacgacgcgctaaaccccccatcacctccaacccgaacgacccctcccgaatccgccctcgccctacgcaaccgcccgaacccccaaccccgaacgaccccgctccaacatcccaactcctacactctcgcaaccgccgccgccccccgcccgaaacataaactctaactcttacgccgccgccttccacccgaaaataaataaaactatacgtccgaatcgcccccgaccaccccctccgcgatcctaccgtcctcaaacaaccaaacccccgatcgcccgaaacgccgccctccccttcccccgctttcccctcgtcgacccccccgaaaacccaacccccgccccctactcgaacccgcgctcgatcctctccgccgaacctcgcctccgcgtcccctccgcgaacctccgcgtcctccccgcgccctttccccaaaaccgttacgcctatttctctcccccgaaccgcccctctccgacctcgcgtcgacctaaaacctatcgacgcccccaacccctccccgccgacctacttactctttccccgcccccgaaaacgcgatccgaaccgccgcccgcccctaactccgattactctcgaaaaattttaaacccccctcgaaccgaaatcgactcccgaaacccccgactactcccccgatcccccgaacccgataacccgcgccccgccccctaactccgcgcgaaacccaatcgacccccgccccctacgactctcgaaaaccgcgtcctccgaaaaccccacccgctctaaaaacccgaatcctacccccacccaccgccccccgacgcgctaacctctctcttcgaacccccgccccccgcccgcgaactttactaactccgccccgactcactccccctccttccgaaaatcgaccctcgaaactcccgacctcccccccgcgcgatcccctccccccaaccgaaactcgttaaaatcgaaaatacgaatccgacgaccgcgaacgaataaaaaaaaaaaaacgacgccgaaacccgccgatctcgctaccgcc

SEQ ID NO: 18243 - DNA, 2273 bp, Artificial Sequence
  chemically treated genomic DNA (Homo sapiens) CpG-island No: 18243
ttttgtatttattttttttttttattttcgaatattaaaaatgttttcgttagatcgttttttggttatcgtataggggtagtttttatcgtgttcggttagttttttatacgtatagttgtcggatattttgcggtttagcgtttatatattgtttattttagttaaatattattaaataagtattagtcgatgttagcgttaaatatcgcgttttcgtttcgttttgcgggtcggaggatatttaggagagtgggaaaacggtcggttttaaggttaggtttaggcggtaatagaaagtaaattgaacgtatatttttttagaatattgataacgttggttcggtgtttttaatgtacgaattcggttatttcgagtgaatttcgtagatgtttagagaagagttcggtttagtttcggtttcgcgggttcggagtagggagtcgtacgaagttcgtagtcgcgaaaataatttcgttgagttcggtttggagcgggggtcgggcggcgatttcgtttttagcggggagcggggagcggggagcgatgttcggggcggtcgcgacgttagcgttttcgtttttgtcgtttttattttcggttaggtttcggggattttcgttttataaaggggcgcgaattttaagtaggagacgaggaagggtaggtgttagtcgtcgtcgtttttcgtaattcgggtcgttagtttcgtttttatcgtcgtagcgattttcgttttcgcgttcgtcgagattaaggcgttatcgtttatattgttttttttttcgcggtcgagtcggcgcgggttttcgtatttttttcgttcgcgcggtttcgagtttagaagattcgtttttatatatcggggtcgtcgtcgcggagttttatgggggttggagtttttaaggttttttttgtgcgtagtattggcggggttttggattattatttttataaggtatcgcgttcgtttttcgcgttacgttttttcgtcgttggtttttagtcgttatttagattatatttttcgataggtttttcggttttttcgttttttttttcgagatacgagtcgaattgggcgttaggtcggggagtcggtcgggttttcgtttatcgtcgtcgtcgtcgttttttgtagttattttttcgtttttatcgtcgcgggagttgtatcgtttatttcggtcggcggtggaatcgttagttcggggttatagagtttgagaagcgacgcgttgagttttttattatttttagttcgggcgatttttttcgggttcgttttcgttttgcgtagtcgttcgagtttttagtttcgggcggtttcgttttagtattttagtttttgtattttcgtagtcgtcgtcgtttttcgttcggaatatggattttgatttttgcgtcgtcgttttttattcggaggtgagtgaagttgtgcgttcgaatcgttttcgattatttttttcgcgattttgtcgtttttaggtagttagattttcggtcgttcggagcgtcgttttttttttttttcgtttttttttcgtcggttttttcgggagtttaattttcgttttttgttcgggttcgcgttcggtttttttcgtcgggtttcgttttcgcgtttttttcgcggattttcgcgtttttttcgcgttttttttttagggtcgttgcgtttatttttttttttcgggtcgttttttttcggtttcgcgtcgatttgggatttgtcggcgtttttagttttttttcgtcggtttgtttatttttttttcgttttcggggacgcggttcgagtcgtcgttcgtttttggtttcggttgttttcgaggagttttaggtttttttcggatcggggtcggttttcgaggttttcggttgttttttcgatttttcgggttcggtggttcgcgtttcgttttttgatttcgcgcggggtttagtcggttttcgttttttacggttttcgggggtcgcgtttttcgggggttttattcgttttggggattcgagttttgtttttatttatcgtttttcggcgcgttggttttttttttcgggttttcgtttttcgttcgcgggttttgttggtttcgtttcggtttatttttttttttttcggggatcggttttcggggttttcggtttttttttcgcgcggttttttttttttagtcgaggttcgttggggtcgggggtgcgggttcggcgatcgcgggcgggtgggggaggggaggcggcgtcggagttcgtcggtttcgttgtcgtt

SEQ ID NO: 18244 - DNA, 2273 bp, Artificial Sequence
  chemically treated genomic DNA (Homo sapiens) CpG-island No: 18244
aacgacaacgaaaccgacgaactccgacgccgcctcccctcccccacccgcccgcgatcgccgaacccgcacccccgaccccaacgaacctcgactaaaaaaaaaaaaccgcgcgaaaaaaaaaccgaaaaccccgaaaaccgatccccgaaaaaaaaaaaaataaaccgaaacgaaaccaacaaaacccgcgaacgaaaaacgaaaacccgaaaaaaaaaaccaacgcgccgaaaaacgataaataaaaacaaaactcgaatccccaaaacgaataaaacccccgaaaaacgcgacccccgaaaaccgtaaaaaacgaaaaccgactaaaccccgcgcgaaatcaaaaaacgaaacgcgaaccaccgaacccgaaaaatcgaaaaaacaaccgaaaacctcgaaaaccgaccccgatccgaaaaaaacctaaaactcctcgaaaacaaccgaaaccaaaaacgaacgacgactcgaaccgcgtccccgaaaacgaaaaaaaaataaacaaaccgacgaaaaaaaactaaaaacgccgacaaatcccaaatcgacgcgaaaccgaaaaaaaacgacccgaaaaaaaaaaataaacgcaacgaccctaaaaaaaaaacgcgaaaaaaacgcgaaaatccgcgaaaaaaacgcgaaaacgaaacccgacgaaaaaaaccgaacgcgaacccgaacaaaaaacgaaaattaaactcccgaaaaaaccgacgaaaaaaaaacgaaaaaaaaaaaaaacgacgctccgaacgaccgaaaatctaactacctaaaaacgacaaaatcgcgaaaaaaataatcgaaaacgattcgaacgcacaacttcactcacctccgaataaaaaacgacgacgcaaaaatcaaaatccatattccgaacgaaaaacgacgacgactacgaaaatacaaaaactaaaatactaaaacgaaaccgcccgaaactaaaaactcgaacgactacgcaaaacgaaaacgaacccgaaaaaaatcgcccgaactaaaaataataaaaaactcaacgcgtcgcttctcaaactctataaccccgaactaacgattccaccgccgaccgaaataaacgatacaactcccgcgacgataaaaacgaaaaaataactacaaaaaacgacgacgacgacgataaacgaaaacccgaccgactccccgacctaacgcccaattcgactcgtatctcgaaaaaaaaaacgaaaaaaccgaaaaacctatcgaaaaatataatctaaataacgactaaaaaccaacgacgaaaaaacgtaacgcgaaaaacgaacgcgataccttataaaaataataatccaaaaccccgccaatactacgcacaaaaaaaaccttaaaaactccaacccccataaaactccgcgacgacgaccccgatatataaaaacgaatcttctaaactcgaaaccgcgcgaacgaaaaaaatacgaaaacccgcgccgactcgaccgcgaaaaaaaaaacaatataaacgataacgccttaatctcgacgaacgcgaaaacgaaaatcgctacgacgataaaaacgaaactaacgacccgaattacgaaaaacgacgacgactaacacctacccttcctcgtctcctacttaaaattcgcgcccctttataaaacgaaaatccccgaaacctaaccgaaaataaaaacgacaaaaacgaaaacgctaacgtcgcgaccgccccgaacatcgctccccgctccccgctccccgctaaaaacgaaatcgccgcccgacccccgctccaaaccgaactcaacgaaattattttcgcgactacgaacttcgtacgactccctactccgaacccgcgaaaccgaaactaaaccgaactcttctctaaacatctacgaaattcactcgaaataaccgaattcgtacattaaaaacaccgaaccaacgttatcaatattctaaaaaaatatacgttcaatttactttctattaccgcctaaacctaaccttaaaaccgaccgttttcccactctcctaaatatcctccgacccgcaaaacgaaacgaaaacgcgatatttaacgctaacatcgactaatacttatttaataatatttaactaaaataaacaatatataaacgctaaaccgcaaaatatccgacaactatacgtataaaaaactaaccgaacacgataaaaactacccctatacgataaccaaaaaacgatctaacgaaaacatttttaatattcgaaaataaaaaaaaaaaataaatacaaaa

SEQ ID NO: 18245 - DNA, 862 bp, Artificial Sequence
  chemically treated genomic DNA (Homo sapiens) CpG-island No: 18245
gtcgagttcgtttttttcgggttgggtttagtagtcgggtcgggtgggtcgtgggtaatttcgggaggttttcggtttcggcgcgcggcgaggtcgttttcggatttggtatttgttattcgttgttttcggttcgggcgttagcggggagacgtagaagggcggagggagggagtcggtcgcggatagcggtgatttagtttgcggagtcgggggcgggcgtcgcgcgggggataggcgagttcgcgttcgcggggggcggtggcgttcggtatagaggggttaagggggcggtgtagacgttttttcgtttatttcgtttttcgagagtcgcggcgtttcgttttatttatagtagcggtgtttagcgcgtcgcgttttttcgtaggtttcggtcgcggcgttttcgataatttatcgaaggcgttatggagcgatcggcgtttttggtcgtgttttttttttcggatttcgcgtacgttttgagtttgttgcgcggtttgagttagttgcgcgtcgagcgtaagtttttggacgtgattttggaggcggcgggcgggcgcgatttttcggcgtatcgtgcggtgttggtcgtcgttagtttttattttcgcgttatgttcgcggggtagttgcgcgagagtcgcgtcgagcgggtgcgtttgtacggagtgtttttcgatatgttgtagttgttgttggattttagttatacgggtcgcgtggcggtaagcggcgataacgttgagtcgttgttgcgcgtcgtcgatttgttgtagttttcggtcgtgaaggaggcgtgcggggtttttttgtagtagtagttcgatttggttaattgtttggatatgtaggatttcgt

SEQ ID NO: 18246 - DNA, 862 bp, Artificial Sequence
  chemically treated genomic DNA (Homo sapiens) CpG-island No: 18246
acgaaatcctacatatccaaacaattaaccaaatcgaactactactacaaaaaaaccccgcacgcctccttcacgaccgaaaactacaacaaatcgacgacgcgcaacaacgactcaacgttatcgccgcttaccgccacgcgacccgtataactaaaatccaacaacaactacaacatatcgaaaaacactccgtacaaacgcacccgctcgacgcgactctcgcgcaactaccccgcgaacataacgcgaaaataaaaactaacgacgaccaacaccgcacgatacgccgaaaaatcgcgcccgcccgccgcctccaaaatcacgtccaaaaacttacgctcgacgcgcaactaactcaaaccgcgcaacaaactcaaaacgtacgcgaaatccgaaaaaaaaaacacgaccaaaaacgccgatcgctccataacgccttcgataaattatcgaaaacgccgcgaccgaaacctacgaaaaaacgcgacgcgctaaacaccgctactataaataaaacgaaacgccgcgactctcgaaaaacgaaataaacgaaaaaacgtctacaccgcccccttaacccctctataccgaacgccaccgccccccgcgaacgcgaactcgcctatcccccgcgcgacgcccgcccccgactccgcaaactaaatcaccgctatccgcgaccgactccctccctccgcccttctacgtctccccgctaacgcccgaaccgaaaacaacgaataacaaataccaaatccgaaaacgacctcgccgcgcgccgaaaccgaaaacctcccgaaattacccacgacccacccgacccgactactaaacccaacccgaaaaaaacgaactcgac

SEQ ID NO: 18247 - DNA, 862 bp, Artificial Sequence
  chemically treated genomic DNA (Homo sapiens) CpG-island No: 18247
gcgaagttttgtatgtttaggtagttggttaggtcgagttgttgttgtaggaaggtttcgtacgttttttttacggtcgggaattgtagtaggtcggcggcgcgtagtagcggtttagcgttgtcgtcgtttatcgttacgcggttcgtgtagttgaagtttagtagtagttgtagtatgtcgggaggtatttcgtgtaggcgtattcgttcggcgcggttttcgcgtagttgtttcgcgaatatggcgcggaagtaggggttggcggcggttagtatcgtacggtgcgtcgggaagtcgcgttcgttcgtcgtttttagggttacgtttaggaatttgcgttcggcgcgtagttggtttaggtcgcgtagtaggtttagggcgtgcgcggggttcgagaagggaagtacggttaggggcgtcggtcgttttatggcgttttcgataggttgtcgaggacgtcgcggtcggggtttgcggagagacgcggcgcgttaggtatcgttgttataaatagggcggggcgtcgcggttttcgaggggcgggatgggcggggagacgtttgtatcgtttttttaatttttttgtgtcgggcgttatcgtttttcgcgagcgcgggttcgtttgtttttcgcgcggcgttcgttttcggtttcgtaggttgagttatcgttgttcgcggtcggtttttttttttcgtttttttgcgttttttcgttgacgttcgggtcggggatagcgagtgataagtgttaggttcgagggcggtttcgtcgcgcgtcgggatcgggggtttttcggggttgtttacgatttattcggttcggttgttgaatttaattcgggagaggcgagttcggt

SEQ ID NO: 18248 - DNA, 862 bp, Artificial Sequence
  chemically treated genomic DNA (Homo sapiens) CpG-island No: 18248
accgaactcgcctctcccgaattaaattcaacaaccgaaccgaataaatcgtaaacaaccccgaaaaacccccgatcccgacgcgcgacgaaaccgccctcgaacctaacacttatcactcgctatccccgacccgaacgtcaacgaaaaaacgcaaaaaaacgaaaaaaaaaaaccgaccgcgaacaacgataactcaacctacgaaaccgaaaacgaacgccgcgcgaaaaacaaacgaacccgcgctcgcgaaaaacgataacgcccgacacaaaaaaattaaaaaaacgatacaaacgtctccccgcccatcccgcccctcgaaaaccgcgacgccccgccctatttataacaacgatacctaacgcgccgcgtctctccgcaaaccccgaccgcgacgtcctcgacaacctatcgaaaacgccataaaacgaccgacgcccctaaccgtacttcccttctcgaaccccgcgcacgccctaaacctactacgcgacctaaaccaactacgcgccgaacgcaaattcctaaacgtaaccctaaaaacgacgaacgaacgcgacttcccgacgcaccgtacgatactaaccgccgccaacccctacttccgcgccatattcgcgaaacaactacgcgaaaaccgcgccgaacgaatacgcctacacgaaatacctcccgacatactacaactactactaaacttcaactacacgaaccgcgtaacgataaacgacgacaacgctaaaccgctactacgcgccgccgacctactacaattcccgaccgtaaaaaaaacgtacgaaaccttcctacaacaacaactcgacctaaccaactacctaaacatacaaaacttcgc

SEQ ID NO: 18249 - DNA, 577 bp, Artificial Sequence
  chemically treated genomic DNA (Homo sapiens) CpG-island No: 18249
gagcgcggcgtagcggtttattttgcgttacgtgggcgagttgggcgtcgagtagttggagcggttgttattggcgcgtttgttgcgttatttgcgggacgacgggttgtgtgtgtttaaggaggaggtcgtttattagttggcgttgcgttgggttcgcgttgattcgtcgcgtcgcgtcgcgtattggtcgtagttgttggaggtcgtgcgtttgtttttcgtgcgtcgtttttatttgttggcgtacgtcgaggtcgagtcgttggtggcgcgttgtttattttgtttgcgtttgttgcgcgaggcgcgcgatttttaggcggcgcgttacgatcgttacgatcgcgggttttgttttcgaatgcgttttcgttcgtttatcggtttcgtcgagattttcgtgttcgtgggcggttgcgattaggattgtgacgagttggttattgtcgattgttataattcgtagacgggttagtggcgttatttggtcgagtttttagattatttgggcggaggttatagtatcgtggcgttgggtaatgatatttacgtgacgggtgagtgggttaggggt

SEQ ID NO: 18250 - DNA, 577 bp, Artificial Sequence
  chemically treated genomic DNA (Homo sapiens) CpG-island No: 18250
acccctaacccactcacccgtcacgtaaatatcattacccaacgccacgatactataacctccgcccaaataatctaaaaactcgaccaaataacgccactaacccgtctacgaattataacaatcgacaataaccaactcgtcacaatcctaatcgcaaccgcccacgaacacgaaaatctcgacgaaaccgataaacgaacgaaaacgcattcgaaaacaaaacccgcgatcgtaacgatcgtaacgcgccgcctaaaaatcgcgcgcctcgcgcaacaaacgcaaacaaaataaacaacgcgccaccaacgactcgacctcgacgtacgccaacaaataaaaacgacgcacgaaaaacaaacgcacgacctccaacaactacgaccaatacgcgacgcgacgcgacgaatcaacgcgaacccaacgcaacgccaactaataaacgacctcctccttaaacacacacaacccgtcgtcccgcaaataacgcaacaaacgcgccaataacaaccgctccaactactcgacgcccaactcgcccacgtaacgcaaaataaaccgctacgccgcgctc

SEQ ID NO: 18251 - DNA, 577 bp, Artificial Sequence
  chemically treated genomic DNA (Homo sapiens) CpG-island No: 18251
gtttttggtttatttattcgttacgtagatgttattgtttagcgttacgatgttgtagttttcgtttaggtggtttgggaattcggttaggtagcgttattgattcgtttgcgggttgtagtagtcgatagtgattagttcgttatagttttggtcgtagtcgtttacgagtacgaggatttcggcgagatcggtggacgggcgaggacgtattcggggatagggttcgcggtcgtggcggtcgtagcgcgtcgtttggaagtcgcgcgtttcgcgtagtaggcgtaggtagggtgggtagcgcgttattagcggttcggtttcgacgtgcgttaataggtagaagcggcgtacgaagggtaggcgtacggtttttagtagttgcggttagtgcgcggcgcggcgcggcgggttagcgcggatttagcgtagcgttagttggtaggcggttttttttttgggtatatatagttcgtcgtttcgtaggtagcgtagtaggcgcgttagtggtagtcgttttagttgttcggcgtttagttcgtttacgtggcgtagaatgaatcgttgcgtcgcgttt

SEQ ID NO: 18252 - DNA, 577 bp, Artificial Sequence
  chemically treated genomic DNA (Homo sapiens) CpG-island No: 18252
aaacgcgacgcaacgattcattctacgccacgtaaacgaactaaacgccgaacaactaaaacgactaccactaacgcgcctactacgctacctacgaaacgacgaactatatatacccaaaaaaaaaaccgcctaccaactaacgctacgctaaatccgcgctaacccgccgcgccgcgccgcgcactaaccgcaactactaaaaaccgtacgcctacccttcgtacgccgcttctacctattaacgcacgtcgaaaccgaaccgctaataacgcgctacccaccctacctacgcctactacgcgaaacgcgcgacttccaaacgacgcgctacgaccgccacgaccgcgaaccctatccccgaatacgtcctcgcccgtccaccgatctcgccgaaatcctcgtactcgtaaacgactacgaccaaaactataacgaactaatcactatcgactactacaacccgcaaacgaatcaataacgctacctaaccgaattcccaaaccacctaaacgaaaactacaacatcgtaacgctaaacaataacatctacgtaacgaataaataaaccaaaaac

SEQ ID NO: 18253 - DNA, 853 bp, Artificial Sequence
  chemically treated genomic DNA (Homo sapiens) CpG-island No: 18253
tcgcggtttttacgagtaatattaggtttagcgtattggggaagcggggcgcgtttatagtcgttatgagtatttcgaattgtagcgcgtttattatgtcgtaggagaggtcgaaggcgacgtagaaggcgacgagggcgtcgtaggagcgcgcgcgtgcgttgtttaggtttgtgagtttattggttagtagggttaggttgaatagatacgggacgtgcggtcgtagacgcgttaggttcgttagggcgtcgtacgtcgggcgcgttacgatgtttacgaagtttacgatggatagtaggaaggcggcgtcggtgtcgggtacgttcgcgtttttggcgtagtttattagtaggatggcggggacgaagagttcgagcgttattaggaatttggtgacggcgtatacggcgaaggcgcggtcggtgtatattgttaagtttagtaggcgtcggcggggtcggattttgggggatgtttcgcgtagttgtagtttcgtatcgttagttttcgtttcgttcggagcgttttcggcgcggtcgtcggcgttgtttttgcgcggtcgcgggttcggttcgggcggcggttttatgatagtttcgtaggcgtagtagtgtagtaggagttcgtcgagtagtaggaagtcgtcgcgttagtcgaagcgttttagtagttgttggtcgagcggcgatagcgcggataggaatacggggttgttcgtcgtcgttagttcgttggttagaggtcgtcgtcgttcgaagtatagttttagtatgatgagcgacggttggaagttgagggttaggtttaggtttgcgggcgaggcggtgttgtgtcggggttttcggagagt

SEQ ID NO: 18254 - DNA, 853 bp, Artificial Sequence
  chemically treated genomic DNA (Homo sapiens) CpG-island No: 18254
actctccgaaaaccccgacacaacaccgcctcgcccgcaaacctaaacctaaccctcaacttccaaccgtcgctcatcatactaaaactatacttcgaacgacgacgacctctaaccaacgaactaacgacgacgaacaaccccgtattcctatccgcgctatcgccgctcgaccaacaactactaaaacgcttcgactaacgcgacgacttcctactactcgacgaactcctactacactactacgcctacgaaactatcataaaaccgccgcccgaaccgaacccgcgaccgcgcaaaaacaacgccgacgaccgcgccgaaaacgctccgaacgaaacgaaaactaacgatacgaaactacaactacgcgaaacatcccccaaaatccgaccccgccgacgcctactaaacttaacaatatacaccgaccgcgccttcgccgtatacgccgtcaccaaattcctaataacgctcgaactcttcgtccccgccatcctactaataaactacgccaaaaacgcgaacgtacccgacaccgacgccgccttcctactatccatcgtaaacttcgtaaacatcgtaacgcgcccgacgtacgacgccctaacgaacctaacgcgtctacgaccgcacgtcccgtatctattcaacctaaccctactaaccaataaactcacaaacctaaacaacgcacgcgcgcgctcctacgacgccctcgtcgccttctacgtcgccttcgacctctcctacgacataataaacgcgctacaattcgaaatactcataacgactataaacgcgccccgcttccccaatacgctaaacctaatattactcgtaaaaaccgcga

SEQ ID NO: 18255 - DNA, 853 bp, Artificial Sequence
  chemically treated genomic DNA (Homo sapiens) CpG-island No: 18255
gtttttcggggatttcggtatagtatcgtttcgttcgtaggtttgggtttggtttttaatttttagtcgtcgtttattatgttggggttgtatttcgagcggcggcggtttttggttaacgggttggcggcggcgggtagtttcgtgtttttgttcgcgttgtcgtcgttcggttagtagttgttggagcgtttcggttggcgcggcggttttttgttgttcggcgggtttttgttgtattgttgcgtttgcggggttgttatgaggtcgtcgttcgggtcgggttcgcgatcgcgtagggatagcgtcggcgatcgcgtcggggacgtttcgggcgaggcggaggttgacggtgcggggttgtagttgcgcgaggtattttttagggttcggtttcgtcggcgtttgttggatttggtagtgtgtatcgatcgcgttttcgtcgtgtacgtcgttattaagtttttgatggcgttcgggtttttcgttttcgttattttgttggtgaattacgttaaggacgcgggcgtgttcgatatcgacgtcgtttttttgttgtttatcgtgggtttcgtggatatcgtggcgcgttcggcgtgcggcgttttggcgggtttggcgcgtttgcggtcgtacgtttcgtatttgtttagtttggttttgttggttaatgggtttatagatttgagtagcgtacgcgcgcgtttttacggcgttttcgtcgttttttgcgtcgttttcggttttttttacggtatggtgggcgcgttgtagttcgaggtgtttatggcggttgtgggcgcgtttcgtttttttagtgcgttgggtttggtgttgttcgtggaggtcgcgg

SEQ ID NO: 18256 - DNA, 853 bp, Artificial Sequence
  chemically treated genomic DNA (Homo sapiens) CpG-island No: 18256
ccgcgacctccacgaacaacaccaaacccaacgcactaaaaaaacgaaacgcgcccacaaccgccataaacacctcgaactacaacgcgcccaccataccgtaaaaaaaaccgaaaacgacgcaaaaaacgacgaaaacgccgtaaaaacgcgcgcgtacgctactcaaatctataaacccattaaccaacaaaaccaaactaaacaaatacgaaacgtacgaccgcaaacgcgccaaacccgccaaaacgccgcacgccgaacgcgccacgatatccacgaaacccacgataaacaacaaaaaaacgacgtcgatatcgaacacgcccgcgtccttaacgtaattcaccaacaaaataacgaaaacgaaaaacccgaacgccatcaaaaacttaataacgacgtacacgacgaaaacgcgatcgatacacactaccaaatccaacaaacgccgacgaaaccgaaccctaaaaaatacctcgcgcaactacaaccccgcaccgtcaacctccgcctcgcccgaaacgtccccgacgcgatcgccgacgctatccctacgcgatcgcgaacccgacccgaacgacgacctcataacaaccccgcaaacgcaacaatacaacaaaaacccgccgaacaacaaaaaaccgccgcgccaaccgaaacgctccaacaactactaaccgaacgacgacaacgcgaacaaaaacacgaaactacccgccgccgccaacccgttaaccaaaaaccgccgccgctcgaaatacaaccccaacataataaacgacgactaaaaattaaaaaccaaacccaaacctacgaacgaaacgatactataccgaaatccccgaaaaac

SEQ ID NO: 18257 - DNA, 737 bp, Artificial Sequence
  chemically treated genomic DNA (Homo sapiens) CpG-island No: 18257
atgtggacgtcgtagattcgtgagaaatttttttttttttattttatttcggttcgtcggttttttattgtgggtgggcgcgcgtgggtggagaggggcgcggaattgtttttaggtagtcggagttgtagtcgcgtatattttcgattatataggtggagggcgaggagttttcgaattaaagttagaggacggggtatttttttgtcgattcgcgcgtaattagcggtttagggagggaggagacgtgtataacgttacgacggacggggataggttttcggggatatattcgttcggcggggggcgggagtttcggacgttttattttttcgttttagtagtagcgcggttacggcgttgtttacgtcgtcggatagggcgtatacgacgtgtcgtaaggtttgtattcgttagtcgtttaatttcgttagttgtagttatcgtcgttttcgcgttttgtcggaagtttcgtttcggtcgtagggttcgcgttagtggttcggtcggaagttgcggtagtttattcgcgtttcgttcggtttttttttgtttcgcggcgggtttttttgttttcggtttgcgtttatttttgaggttttatcgattcgcggggcgtcgagattttgtcgggtcgcgaggggttggttttttttttgagtcgtcgttttgttttttttattcgcgtttcggttttattgttttttttttgcgttgtaaattaaaaataaaatttt

SEQ ID NO: 18258 - DNA, 737 bp, Artificial Sequence
  chemically treated genomic DNA (Homo sapiens) CpG-island No: 18258
aaaattttatttttaatttacaacgcaaaaaaaaaacaataaaaccgaaacgcgaataaaaaaaacaaaacgacgactcaaaaaaaaaaccaacccctcgcgacccgacaaaatctcgacgccccgcgaatcgataaaacctcaaaaataaacgcaaaccgaaaacaaaaaaacccgccgcgaaacaaaaaaaaaccgaacgaaacgcgaataaactaccgcaacttccgaccgaaccactaacgcgaaccctacgaccgaaacgaaacttccgacaaaacgcgaaaacgacgataactacaactaacgaaattaaacgactaacgaatacaaaccttacgacacgtcgtatacgccctatccgacgacgtaaacaacgccgtaaccgcgctactactaaaacgaaaaaataaaacgtccgaaactcccgccccccgccgaacgaatatatccccgaaaacctatccccgtccgtcgtaacgttatacacgtctcctccctccctaaaccgctaattacgcgcgaatcgacaaaaaaataccccgtcctctaactttaattcgaaaactcctcgccctccacctatataatcgaaaatatacgcgactacaactccgactacctaaaaacaattccgcgcccctctccacccacgcgcgcccacccacaataaaaaaccgacgaaccgaaataaaataaaaaaaaaaaaatttctcacgaatctacgacgtccacat

SEQ ID NO: 18259 - DNA, 737 bp, Artificial Sequence
  chemically treated genomic DNA (Homo sapiens) CpG-island No: 18259
agaattttatttttggtttatagcgtagaagaagagtagtgaggtcggggcgcgggtggggagggtaaggcggcggtttaaaaaaaaagttagtttttcgcggttcgatagagtttcggcgtttcgcgggtcggtggagttttaggggtgagcgtaggtcggagataggggaattcgtcgcgggataggggaaggtcggacggaacgcgggtaagttgtcgtagttttcggtcgggttattagcgcggattttacggtcggggcgggattttcggtaaggcgcggaagcggcggtagttgtagttggcgaagttgggcgattggcggatgtaggttttgcggtacgtcgtgtgcgttttgttcggcggcgtggatagcgtcgtggtcgcgttgttgttgaggcggagaggtgaggcgttcgaggttttcgtttttcgtcgagcgaatgtgttttcggaaatttgttttcgttcgtcgtggcgttgtgtacgttttttttttttttgggtcgttggttgcgcgcgggtcggtaggaggatatttcgttttttgattttggttcggaggtttttcgttttttatttgtgtagtcggaggtgtgcgcgattgtagtttcgattatttgggagtagtttcgcgtttttttttatttacgcgcgtttatttatagtgagaagtcggcgggtcggggtggggtggggagggaagggttttttacggatttgcggcgtttatat

SEQ ID NO: 18260 - DNA, 737 bp, Artificial Sequence
  chemically treated genomic DNA (Homo sapiens) CpG-island No: 18260
atataaacgccgcaaatccgtaaaaaacccttccctccccaccccaccccgacccgccgacttctcactataaataaacgcgcgtaaataaaaaaaaacgcgaaactactcccaaataatcgaaactacaatcgcgcacacctccgactacacaaataaaaaacgaaaaacctccgaaccaaaatcaaaaaacgaaatatcctcctaccgacccgcgcgcaaccaacgacccaaaaaaaaaaaaaacgtacacaacgccacgacgaacgaaaacaaatttccgaaaacacattcgctcgacgaaaaacgaaaacctcgaacgcctcacctctccgcctcaacaacaacgcgaccacgacgctatccacgccgccgaacaaaacgcacacgacgtaccgcaaaacctacatccgccaatcgcccaacttcgccaactacaactaccgccgcttccgcgccttaccgaaaatcccgccccgaccgtaaaatccgcgctaataacccgaccgaaaactacgacaacttacccgcgttccgtccgaccttcccctatcccgcgacgaattcccctatctccgacctacgctcacccctaaaactccaccgacccgcgaaacgccgaaactctatcgaaccgcgaaaaactaactttttttttaaaccgccgccttaccctccccacccgcgccccgacctcactactcttcttctacgctataaaccaaaaataaaattct

SEQ ID NO: 18261 - DNA, 516 bp, Artificial Sequence
  chemically treated genomic DNA (Homo sapiens) CpG-island No: 18261
gacgttttcgtttttaacgtttagaacgatatcgacgttagttttaatattttgaacgtgattttttcggcgttgttgtttggcggcgttcgcggttagtttttttcgtcggaggatttgtaggagtagatttatttgaatcggacgttgttgattattatttttacgtagcgcgtgttgtttttcgacgataatatttgtttgcgcgagttttgcgagaattatatgaagtgcgtgttcgttttgcgattcgatagtttcgcgtttttttttagttttattatcgtgttttttcggtttatttattttattaacggtttgcgttgtcgttgttcgttcggttttatcggcgattattgcgagacggagatcgatttttgttatttcgattcgtgcggcgttaacggtcgttgtcgtagtcgcgagggcggttatatttgcgagtgtttcgaggattttattggtaggtgttcgggtttattttggttttgtgtatatgtttttaggttatatggt

SEQ ID NO: 18262 - DNA, 516 bp, Artificial Sequence
  chemically treated genomic DNA (Homo sapiens) CpG-island No: 18262
accatataacctaaaaacatatacacaaaaccaaaataaacccgaacacctaccaataaaatcctcgaaacactcgcaaatataaccgccctcgcgactacgacaacgaccgttaacgccgcacgaatcgaaataacaaaaatcgatctccgtctcgcaataatcgccgataaaaccgaacgaacaacgacaacgcaaaccgttaataaaataaataaaccgaaaaaacacgataataaaactaaaaaaaaacgcgaaactatcgaatcgcaaaacgaacacgcacttcatataattctcgcaaaactcgcgcaaacaaatattatcgtcgaaaaacaacacgcgctacgtaaaaataataatcaacaacgtccgattcaaataaatctactcctacaaatcctccgacgaaaaaaactaaccgcgaacgccgccaaacaacaacgccgaaaaaatcacgttcaaaatattaaaactaacgtcgatatcgttctaaacgttaaaaacgaaaacgtc

SEQ ID NO: 18263 - DNA, 516 bp, Artificial Sequence
  chemically treated genomic DNA (Homo sapiens) CpG-island No: 18263
gttatgtgatttggggatatgtatataaagttagggtgagttcgggtatttattagtgaagttttcgaagtattcgtaggtgtagtcgttttcgcggttgcggtagcggtcgttggcgtcgtacgggtcggagtagtagaggtcgattttcgtttcgtagtagtcgtcggtgaagtcgggcgggtagcggtagcgtaggtcgttgatggggtggatgggtcggaagagtacggtggtggagttgaggaagggcgcggagttgtcgaatcgtagaacggatacgtattttatgtagttttcgtagggttcgcgtaggtagatgttgtcgtcgaagggtagtacgcgttgcgtggagatggtggttagtagcgttcgatttaggtagatttgtttttgtaggtttttcgacgggaagaattggtcgcggacgtcgttaggtagtagcgtcgagaaggttacgtttaggatgttggagttgacgtcggtgtcgttttggacgttgaagacgaagacgtt

SEQ ID NO: 18264 - DNA, 516 bp, Artificial Sequence
  chemically treated genomic DNA (Homo sapiens) CpG-island No: 18264
aacgtcttcgtcttcaacgtccaaaacgacaccgacgtcaactccaacatcctaaacgtaaccttctcgacgctactacctaacgacgtccgcgaccaattcttcccgtcgaaaaacctacaaaaacaaatctacctaaatcgaacgctactaaccaccatctccacgcaacgcgtactacccttcgacgacaacatctacctacgcgaaccctacgaaaactacataaaatacgtatccgttctacgattcgacaactccgcgcccttcctcaactccaccaccgtactcttccgacccatccaccccatcaacgacctacgctaccgctacccgcccgacttcaccgacgactactacgaaacgaaaatcgacctctactactccgacccgtacgacgccaacgaccgctaccgcaaccgcgaaaacgactacacctacgaatacttcgaaaacttcactaataaatacccgaactcaccctaactttatatacatatccccaaatcacataac

SEQ ID NO: 18265 - DNA, 535 bp, Artificial Sequence
  chemically treated genomic DNA (Homo sapiens) CpG-island No: 18265
tttggtcggttttcgagcggcgattagtaatttttcgcgggcgatagttttttttttaaagttacgcgtaattttttattcggcggcgttattttttcgagtaggtttcgtcggagttcgagtcgcgggttgattttcgttcgggaaagtggttttaagagttcgttataggggacgttagggattcgcggtaggttttgcgggttaggatgagttttaagtataggttagtgttcgcggtttcgttgagtttcgacgtttttagtagtcgcggtcgggattttagttttttcgtttatagggttttgtagttttcgaggatagattcgtttttttttcgcgtttaggtttatttggaatcgatcgtttcgtaacgtttttatttcgggagttatcgggacgcggttgggttaggtttcggggtgggttcgagacggggtcgtttttgattggtttgtttgttgttatttattcgtttttttgttgttcggtttattttaaaggaataggaagggtttcgtcgggaggggatagt

SEQ ID NO: 18266 - DNA, 535 bp, Artificial Sequence
  chemically treated genomic DNA (Homo sapiens) CpG-island No: 18266
actatcccctcccgacgaaacccttcctattcctttaaaataaaccgaacaacaaaaaaacgaataaataacaacaaacaaaccaatcaaaaacgaccccgtctcgaacccaccccgaaacctaacccaaccgcgtcccgataactcccgaaataaaaacgttacgaaacgatcgattccaaataaacctaaacgcgaaaaaaaaacgaatctatcctcgaaaactacaaaaccctataaacgaaaaaactaaaatcccgaccgcgactactaaaaacgtcgaaactcaacgaaaccgcgaacactaacctatacttaaaactcatcctaacccgcaaaacctaccgcgaatccctaacgtcccctataacgaactcttaaaaccactttcccgaacgaaaatcaacccgcgactcgaactccgacgaaacctactcgaaaaaataacgccgccgaataaaaaattacgcgtaactttaaaaaaaaaactatcgcccgcgaaaaattactaatcgccgctcgaaaaccgaccaaa

SEQ ID NO: 18267 - DNA, 535 bp, Artificial Sequence
  chemically treated genomic DNA (Homo sapiens) CpG-island No: 18267
gttattttttttcgacgagattttttttgtttttttaaaatgggtcgggtagtagaaagacgagtgagtgatagtagataggttaattagaagcggtttcgtttcgggtttatttcgaggtttggtttaatcgcgtttcggtagttttcggaataggagcgttgcgagacggtcggttttaagtgggtttgggcgcgggggagaggcgggtttgttttcgggaattgtaaggttttgtgagcgggaggattgggatttcggtcgcggttgttggaagcgtcgaagtttagcggggtcgcggatattgatttgtgtttagaatttattttggttcgtagagtttgtcgcgagtttttggcgttttttgtggcgggtttttggagttattttttcgagcggaagttagttcgcggttcggatttcggcgggatttgttcggaggaatggcgtcgtcgggtgaggagttgcgcgtggttttggggagagggttgtcgttcgcgggaggttattagtcgtcgttcgagagtcggttagg

SEQ ID NO: 18268 - DNA, 535 bp, Artificial Sequence
  chemically treated genomic DNA (Homo sapiens) CpG-island No: 18268
cctaaccgactctcgaacgacgactaataacctcccgcgaacgacaaccctctccccaaaaccacgcgcaactcctcacccgacgacgccattcctccgaacaaatcccgccgaaatccgaaccgcgaactaacttccgctcgaaaaaataactccaaaaacccgccacaaaaaacgccaaaaactcgcgacaaactctacgaaccaaaataaattctaaacacaaatcaatatccgcgaccccgctaaacttcgacgcttccaacaaccgcgaccgaaatcccaatcctcccgctcacaaaaccttacaattcccgaaaacaaacccgcctctcccccgcgcccaaacccacttaaaaccgaccgtctcgcaacgctcctattccgaaaactaccgaaacgcgattaaaccaaacctcgaaataaacccgaaacgaaaccgcttctaattaacctatctactatcactcactcgtctttctactacccgacccattttaaaaaaacaaaaaaaatctcgtcgaaaaaaaataac

SEQ ID NO: 18269 - DNA, 691 bp, Artificial Sequence
  chemically treated genomic DNA (Homo sapiens) CpG-island No: 18269
acggagatttcggtcgggttttttaaggcgtcgtggacgcggggggcggggcgagcgcggttaggtttcgtttcggttaggttcggtttcgtttttagttagatttcgttttcgtagcggcgttcgtttagtagttgtttagtcgtcggcgcgcgcggttgggagcggtagttgtgtttcggcgttttcgagttggtgtcgagcgtagcgttttaggagtttttttattttcgcgtcggtttacggtaagtgtcgcgggttgcggttagtgttgttgggtcgtcgtttgggttcggtttcgcgttttaattcggacggatcgacggtcgtcgtttttttggttcgggttttttaggaggtacgggggtggttttcgaggcggggggcggtgggaaggtttcgacgttttttcggttttggggaaattgaggtcgcgtatgtttggaggggcggggtttcgggggtatttttttttcgaacgcgtaggagagggtgcggcggtggggttcgtattgcggagcggacggggagggtattcgggcgttggcgacggtttttttcgtatttgagtcgttaagcgaggtttcgattttcgcgttttttttttcgggggagtagacgggttcggggttttttagtatttttttcgggcgggttgtattttttagcgttttcgttttttttttttttt

SEQ ID NO: 18270 - DNA, 691 bp, Artificial Sequence
  chemically treated genomic DNA (Homo sapiens) CpG-island No: 18270
aaaaaaaaaaaaaaacgaaaacgctaaaaaatacaacccgcccgaaaaaaatactaaaaaaccccgaacccgtctactcccccgaaaaaaaaaacgcgaaaatcgaaacctcgcttaacgactcaaatacgaaaaaaaccgtcgccaacgcccgaataccctccccgtccgctccgcaatacgaaccccaccgccgcaccctctcctacgcgttcgaaaaaaaaatacccccgaaaccccgcccctccaaacatacgcgacctcaatttccccaaaaccgaaaaaacgtcgaaaccttcccaccgccccccgcctcgaaaaccacccccgtacctcctaaaaaacccgaaccaaaaaaacgacgaccgtcgatccgtccgaattaaaacgcgaaaccgaacccaaacgacgacccaacaacactaaccgcaacccgcgacacttaccgtaaaccgacgcgaaaataaaaaaactcctaaaacgctacgctcgacaccaactcgaaaacgccgaaacacaactaccgctcccaaccgcgcgcgccgacgactaaacaactactaaacgaacgccgctacgaaaacgaaatctaactaaaaacgaaaccgaacctaaccgaaacgaaacctaaccgcgctcgccccgccccccgcgtccacgacgccttaaaaaacccgaccgaaatctccgt

SEQ ID NO: 18271 - DNA, 691 bp, Artificial Sequence
  chemically treated genomic DNA (Homo sapiens) CpG-island No: 18271
ggaggagggaagggacgaggacgttggggggtgtagttcgttcgggaggggtgttgggaggtttcgggttcgtttgttttttcggggagggaggcgcgggggtcgaagtttcgtttggcggtttaagtgcgggggaggtcgtcgttagcgttcggatatttttttcgttcgtttcgtagtgcggattttatcgtcgtatttttttttgcgcgttcggaggggaaatgttttcgagatttcgtttttttaagtatgcgcggttttagtttttttagggtcgaggggacgtcgagatttttttatcgtttttcgtttcggaggttattttcgtgttttttgggggattcggattaagggggcggcggtcgtcggttcgttcgggttggggcgcggggtcgagtttagacggcggtttaatagtattggtcgtagttcgcggtatttatcgtgggtcggcgcggggatgggggggtttttggggcgttgcgttcggtattagttcggggacgtcgaggtatagttatcgtttttagtcgcgcgcgtcgacgattgagtaattgttgggcggacgtcgttgcgggggcggggtttgattgggggcggggtcgggtttgatcggggcggggtttgatcgcgttcgtttcgtttttcgcgtttacggcgttttaggggattcggtcggggttttcgt

SEQ ID NO: 18272 - DNA, 691 bp, Artificial Sequence
  chemically treated genomic DNA (Homo sapiens) CpG-island No: 18272
acgaaaaccccgaccgaatcccctaaaacgccgtaaacgcgaaaaacgaaacgaacgcgatcaaaccccgccccgatcaaacccgaccccgcccccaatcaaaccccgcccccgcaacgacgtccgcccaacaattactcaatcgtcgacgcgcgcgactaaaaacgataactatacctcgacgtccccgaactaataccgaacgcaacgccccaaaaacccccccatccccgcgccgacccacgataaataccgcgaactacgaccaatactattaaaccgccgtctaaactcgaccccgcgccccaacccgaacgaaccgacgaccgccgcccccttaatccgaatcccccaaaaaacacgaaaataacctccgaaacgaaaaacgataaaaaaatctcgacgtcccctcgaccctaaaaaaactaaaaccgcgcatacttaaaaaaacgaaatctcgaaaacatttcccctccgaacgcgcaaaaaaaaatacgacgataaaatccgcactacgaaacgaacgaaaaaaatatccgaacgctaacgacgacctcccccgcacttaaaccgccaaacgaaacttcgacccccgcgcctccctccccgaaaaaacaaacgaacccgaaacctcccaacacccctcccgaacgaactacaccccccaacgtcctcgtcccttccctcctcc

SEQ ID NO: 18273 - DNA, 630 bp, Artificial Sequence
  chemically treated genomic DNA (Homo sapiens) CpG-island No: 18273
tacgtttcgtttattttgtagcgcggcgtcgattttttcggcgaaggtttttagggagcgcgtcgggaggtgtcgagggcggtcgtttttcgttttcggttcgcgcgttgtttttttgcggtttatggcgcggatttggggtgtcggggattttttattttacggtcgcgtttttcggttttttaatgggttgtgcggttgttagcgtttgcgtcggacgttattttcggttttcgtggttacgtgatcgttattttacgtgatcgcgcggcggtcgttgcggcgcgatggcggcggggttggcgcggtttttgttgtttttcgggttttcggtcggcggtgagtggttcggtcgttcgcgtttttaggtttcgcgcgcgttttgtatttcggttttttcgtttacggtttcgtttttcgtagggttcgcgtcggtaggtgtagcgaagatgaaggtggtggaggagtttaacgcgtttgggtgagtagtttcgcgggttggcggttcgagcgggggacggttcgggttcgtttttcgttgattttgtcgtttttcgtagggtgaataattcgtttttgttttaggttagtcgtttttaggttaagagggattttttattcgtgtttggt

SEQ ID NO: 18274 - DNA, 630 bp, Artificial Sequence
  chemically treated genomic DNA (Homo sapiens) CpG-island No: 18274
accaaacacgaataaaaaatccctcttaacctaaaaacgactaacctaaaacaaaaacgaattattcaccctacgaaaaacgacaaaatcaacgaaaaacgaacccgaaccgtcccccgctcgaaccgccaacccgcgaaactactcacccaaacgcgttaaactcctccaccaccttcatcttcgctacacctaccgacgcgaaccctacgaaaaacgaaaccgtaaacgaaaaaaccgaaatacaaaacgcgcgcgaaacctaaaaacgcgaacgaccgaaccactcaccgccgaccgaaaacccgaaaaacaacaaaaaccgcgccaaccccgccgccatcgcgccgcaacgaccgccgcgcgatcacgtaaaataacgatcacgtaaccacgaaaaccgaaaataacgtccgacgcaaacgctaacaaccgcacaacccattaaaaaaccgaaaaacgcgaccgtaaaataaaaaatccccgacaccccaaatccgcgccataaaccgcaaaaaaacaacgcgcgaaccgaaaacgaaaaacgaccgccctcgacacctcccgacgcgctccctaaaaaccttcgccgaaaaaatcgacgccgcgctacaaaataaacgaaacgta

SEQ ID NO: 18275 - DNA, 630 bp, Artificial Sequence
  chemically treated genomic DNA (Homo sapiens) CpG-island No: 18275
attagatacgggtgaaggattttttttggtttggaggcgattggtttgaggtaagaacgggttgtttattttacgggaagcggtaaggttagcggggaacgggttcgggtcgtttttcgttcgagtcgttagttcgcgaggttgtttatttaaacgcgttgggtttttttattatttttattttcgttgtatttgtcggcgcgggttttacggggagcgagatcgtgagcggggaggtcggggtgtagagcgcgcgcggggtttggggacgcggacggtcgggttatttatcgtcggtcgagagttcgaggagtaataggagtcgcgttagtttcgtcgttatcgcgtcgtagcggtcgtcgcgcggttacgtgaagtgacggttacgtgattacggggatcggaagtggcgttcggcgtaagcgttggtagtcgtatagtttattgggaggtcgaggggcgcggtcgtggggtggggagttttcggtattttaggttcgcgttatgggtcgtaggagggtagcgcgcgggtcgggggcggaaggcggtcgttttcggtatttttcgacgcgttttttggaggttttcgtcgaggaggtcggcgtcgcgttgtagggtgagcgaggcgtg

SEQ ID NO: 18276 - DNA, 630 bp, Artificial Sequence
  chemically treated genomic DNA (Homo sapiens) CpG-island No: 18276
cacgcctcgctcaccctacaacgcgacgccgacctcctcgacgaaaacctccaaaaaacgcgtcgaaaaataccgaaaacgaccgccttccgcccccgacccgcgcgctaccctcctacgacccataacgcgaacctaaaataccgaaaactccccaccccacgaccgcgcccctcgacctcccaataaactatacgactaccaacgcttacgccgaacgccacttccgatccccgtaatcacgtaaccgtcacttcacgtaaccgcgcgacgaccgctacgacgcgataacgacgaaactaacgcgactcctattactcctcgaactctcgaccgacgataaataacccgaccgtccgcgtccccaaaccccgcgcgcgctctacaccccgacctccccgctcacgatctcgctccccgtaaaacccgcgccgacaaatacaacgaaaataaaaataataaaaaaacccaacgcgtttaaataaacaacctcgcgaactaacgactcgaacgaaaaacgacccgaacccgttccccgctaaccttaccgcttcccgtaaaataaacaacccgttcttacctcaaaccaatcgcctccaaaccaaaaaaaatccttcacccgtatctaat

SEQ ID NO: 18277 - DNA, 1114 bp, Artificial Sequence
  chemically treated genomic DNA (Homo sapiens) CpG-island No: 18277
gggcgcggtgttgtagggaacggaggtttattagggcggtcgggattgaggcgtaggcgttgagtttttatttaagttcgtcgaagtgtgtagagtttggagacgggatcgaggttatcggaagtttacggttgcggggatatgattaagttatagcgcgttgggggaagcgattattgtcgtttcgcggattttatcggtttggtcgggagttttttttgttcggtttattcgcgttttcggttcgaagttcggttttttttgacgttacggtttttgcgttttttggcggcgcggttgcggcgggacgcgcgggtatcgtttttttcggttggagggcgggattttcggtgagtgagtgacgggcgtagtttcggtagcggcggcggcggagttttgaggcgatagtagttgcgggaggcgacgggttgcggtttgcggaatttgaggtagttggggagggtcgggcgcgtcggtcggatagcgagtcgcgttggcggcggcggtggtcgcgatgatggagatttagatggacgagggcggcggcgtggtggtgtattaggacgattattgtttcggttcggtgatgtcggagcgggtgtcgggtttggcgggttttatttatcgcgagttcgagcgttttatttattgttacgacgaggaggtggttaaggagtttatgtcgttggtggtgaacgtgttggagaatttagattcggtgtttagcgagaattaggagtacgaggtggagttggagttgttgcgcgaggataacgagtagttgtttatttagtacgagcgtgagaaggcgttgcgtaggtaggcggaggaggtgcgtgggtcgcgggattcgttcgtattttcgtttcggatttttagttagtttcgggtttcggatttaatattcgtttcgattttagatttcgtttcggtatttcggatcgcgggatttttggatttttagatttcgtttcgagattcgtttggattttatatttttcgtttcgggatttttttattttttttgttcgtcgtgagatatttttttagagtattttttcgtttgtttcgggattttatttcgattttcggggattttttttttcgtttaggt

SEQ ID NO: 18278 - DNA, 1114 bp, Artificial Sequence
  chemically treated genomic DNA (Homo sapiens) CpG-island No: 18278
acctaaacgaaaaaaaaaatccccgaaaatcgaaataaaatcccgaaacaaacgaaaaaatactctaaaaaaatatctcacgacgaacaaaaaaaataaaaaaatcccgaaacgaaaaatataaaatccaaacgaatctcgaaacgaaatctaaaaatccaaaaatcccgcgatccgaaataccgaaacgaaatctaaaatcgaaacgaatattaaatccgaaacccgaaactaactaaaaatccgaaacgaaaatacgaacgaatcccgcgacccacgcacctcctccgcctacctacgcaacgccttctcacgctcgtactaaataaacaactactcgttatcctcgcgcaacaactccaactccacctcgtactcctaattctcgctaaacaccgaatctaaattctccaacacgttcaccaccaacgacataaactccttaaccacctcctcgtcgtaacaataaataaaacgctcgaactcgcgataaataaaacccgccaaacccgacacccgctccgacatcaccgaaccgaaacaataatcgtcctaatacaccaccacgccgccgccctcgtccatctaaatctccatcatcgcgaccaccgccgccgccaacgcgactcgctatccgaccgacgcgcccgaccctccccaactacctcaaattccgcaaaccgcaacccgtcgcctcccgcaactactatcgcctcaaaactccgccgccgccgctaccgaaactacgcccgtcactcactcaccgaaaatcccgccctccaaccgaaaaaaacgatacccgcgcgtcccgccgcaaccgcgccgccaaaaaacgcaaaaaccgtaacgtcaaaaaaaaccgaacttcgaaccgaaaacgcgaataaaccgaacaaaaaaaactcccgaccaaaccgataaaatccgcgaaacgacaataatcgcttcccccaacgcgctataacttaatcatatccccgcaaccgtaaacttccgataacctcgatcccgtctccaaactctacacacttcgacgaacttaaataaaaactcaacgcctacgcctcaatcccgaccgccctaataaacctccgttccctacaacaccgcgccc

SEQ ID NO: 18279 - DNA, 1114 bp, Artificial Sequence
  chemically treated genomic DNA (Homo sapiens) CpG-island No: 18279
gtttgggcggaaaagggggttttcgggagtcggggtggggtttcggggtaggcgggggagtgttttagggaggtgttttacggcgggtagagggggtggggaagtttcggggcgggggatatggggtttaggcgggtttcggggcggggtttgggggtttaggggtttcgcggttcggggtgtcggagcggggtttggggtcgggacgggtgttgggttcggggttcggggttggttgggggttcgggacggggatgcgggcgggtttcgcggtttacgtatttttttcgtttgtttgcgtagcgtttttttacgttcgtattgggtgagtagttgttcgttgttttcgcgtagtagttttagttttatttcgtgtttttggttttcgttgagtatcgagtttaggttttttagtacgtttattattagcggtatgagttttttgattattttttcgtcgtagtagtggatgaggcgttcgaattcgcggtagatggagttcgttaggttcgatattcgtttcgatattatcgagtcggagtagtagtcgttttggtatattattacgtcgtcgttttcgtttatttggatttttattatcgcggttatcgtcgtcgttagcgcggttcgttattcggtcggcgcgttcggttttttttagttgttttaggtttcgtaggtcgtagttcgtcgtttttcgtagttgttgtcgttttagggtttcgtcgtcgtcgttgtcgaggttgcgttcgttatttatttatcggaagtttcgttttttagtcggagggggcggtgttcgcgcgtttcgtcgtagtcgcgtcgttagggggcgtaggggtcgtgacgttagaggaagtcgggtttcgggtcggaagcgcgggtgagtcgggtagagggagttttcggttaggtcggtgggattcgcggggcggtagtggtcgttttttttagcgcgttgtagtttgattatgttttcgtaatcgtgggttttcggtgatttcgatttcgtttttaggttttgtatatttcggcggatttaggtgaaggtttagcgtttgcgttttaatttcggtcgttttgatgagttttcgttttttatagtatcgcgttt

SEQ ID NO: 18280 - DNA, 1114 bp, Artificial Sequence
  chemically treated genomic DNA (Homo sapiens) CpG-island No: 18280
aaacgcgatactataaaaaacgaaaactcatcaaaacgaccgaaattaaaacgcaaacgctaaaccttcacctaaatccgccgaaatatacaaaacctaaaaacgaaatcgaaatcaccgaaaacccacgattacgaaaacataatcaaactacaacgcgctaaaaaaaacgaccactaccgccccgcgaatcccaccgacctaaccgaaaactccctctacccgactcacccgcgcttccgacccgaaacccgacttcctctaacgtcacgacccctacgccccctaacgacgcgactacgacgaaacgcgcgaacaccgccccctccgactaaaaaacgaaacttccgataaataaataacgaacgcaacctcgacaacgacgacgacgaaaccctaaaacgacaacaactacgaaaaacgacgaactacgacctacgaaacctaaaacaactaaaaaaaaccgaacgcgccgaccgaataacgaaccgcgctaacgacgacgataaccgcgataataaaaatccaaataaacgaaaacgacgacgtaataatataccaaaacgactactactccgactcgataatatcgaaacgaatatcgaacctaacgaactccatctaccgcgaattcgaacgcctcatccactactacgacgaaaaaataatcaaaaaactcataccgctaataataaacgtactaaaaaacctaaactcgatactcaacgaaaaccaaaaacacgaaataaaactaaaactactacgcgaaaacaacgaacaactactcacccaatacgaacgtaaaaaaacgctacgcaaacaaacgaaaaaaatacgtaaaccgcgaaacccgcccgcatccccgtcccgaacccccaaccaaccccgaaccccgaacccaacacccgtcccgaccccaaaccccgctccgacaccccgaaccgcgaaacccctaaacccccaaaccccgccccgaaacccgcctaaaccccatatcccccgccccgaaacttccccaccccctctacccgccgtaaaacacctccctaaaacactcccccgcctaccccgaaaccccaccccgactcccgaaaacccccttttccgcccaaac

SEQ ID NO: 18281 - DNA, 1022 bp, Artificial Sequence
  chemically treated genomic DNA (Homo sapiens) CpG-island No: 18281
gcgcggaattagagagcgatttcgcggcgggtattttttatcgagtcgttgtcgtgaattaggtttttgcgcggaagaggcgcgtgtgagcgtgggaaagagattttcggtacgggtattacgtaggttgaatagggggaggtcggacggggttgggatcgttttcggggcgggttttatttgttaatttcgatgtagaaattttcgcggatggtgtcgggcggggcgtcggtcgggttcgtggtttcgatgagcgttcgcgaggtgcgtattacgtttagtttttgttaaatttgtgcggaggaacgggcgcggtattacgcgggggtgggggtttcggagtcgttcgttcgtttttcggatatttattatggttattatcggttcggaggttatatatttgataaggcggtcgtagaacgggcgtttacgtagttcggcgtagtgtttacgtagtagtttttcggaggtttgcggaagggttaggtcgtttgcgttcgtattcggtatttaggcgtttttaggttttcgttttttttttttttatatcgcgttttcgttcgtttatcgcgtttttatttgtattagttttagcgttattaatttgaagttttttttttcgaagcgtcgtataatttcgtttattagtcgtcgttgtacgtcgttcggttttacggttaggaaggtgcgttcgtgtgcgtcggtgtaggttgcggggtaggcggggacgggtcgttaggtcggtttagtatcggttattcgttttcggttcgcgtcgcgcggtttattcgcggggaagaggttagcgaagatggttagtattaggtagattatgatggcggtgcgggagcgggattcgcggggcggggcggtggcgttcggggcggggtttgcgtttaaagaggtttggtcggggcgttgcggttttcgcggggaggttgttttatttgtatttcggaattcggtagtcgtggggggtcggagggtagttgcggaggttaagttttttttagtagttcgga

SEQ ID NO: 18282 - DNA, 1022 bp, Artificial Sequence
  chemically treated genomic DNA (Homo sapiens) CpG-island No: 18282
tccgaactactaaaaaaaacttaacctccgcaactaccctccgaccccccacgactaccgaattccgaaatacaaataaaacaacctccccgcgaaaaccgcaacgccccgaccaaacctctttaaacgcaaaccccgccccgaacgccaccgccccgccccgcgaatcccgctcccgcaccgccatcataatctacctaatactaaccatcttcgctaacctcttccccgcgaataaaccgcgcgacgcgaaccgaaaacgaataaccgatactaaaccgacctaacgacccgtccccgcctaccccgcaacctacaccgacgcacacgaacgcaccttcctaaccgtaaaaccgaacgacgtacaacgacgactaataaacgaaattatacgacgcttcgaaaaaaaaaacttcaaattaataacgctaaaactaatacaaataaaaacgcgataaacgaacgaaaacgcgatataaaaaaaaaaaaaacgaaaacctaaaaacgcctaaataccgaatacgaacgcaaacgacctaacccttccgcaaacctccgaaaaactactacgtaaacactacgccgaactacgtaaacgcccgttctacgaccgccttatcaaatatataacctccgaaccgataataaccataataaatatccgaaaaacgaacgaacgactccgaaacccccacccccgcgtaataccgcgcccgttcctccgcacaaatttaacaaaaactaaacgtaatacgcacctcgcgaacgctcatcgaaaccacgaacccgaccgacgccccgcccgacaccatccgcgaaaatttctacatcgaaattaacaaataaaacccgccccgaaaacgatcccaaccccgtccgacctccccctattcaacctacgtaatacccgtaccgaaaatctctttcccacgctcacacgcgcctcttccgcgcaaaaacctaattcacgacaacgactcgataaaaaatacccgccgcgaaatcgctctctaattccgcgc

SEQ ID NO: 18283 - DNA, 1022 bp, Artificial Sequence
  chemically treated genomic DNA (Homo sapiens) CpG-island No: 18283
ttcgagttgttggaggagatttggttttcgtagttgtttttcggttttttacggttgtcgggtttcggggtgtaagtgaagtagttttttcgcggaggtcgtagcgtttcgattaggtttttttaagcgtaggtttcgtttcgggcgttatcgtttcgtttcgcggatttcgttttcgtatcgttattatgatttgtttggtgttgattattttcgttaatttttttttcgcgggtgagtcgcgcggcgcgggtcgggggcgggtggtcggtgttgggtcggtttgacggttcgttttcgtttgtttcgtagtttgtatcggcgtatacgaacgtatttttttggtcgtgaagtcggacggcgtgtagcggcggttggtgggcgagattgtgcggcgtttcgagaggaagggttttaagttggtggcgttgaagttggtgtaggtgggggcgcggtgagcgagcgggggcgcggtgtggggggaaggggagcggggatttggggacgtttaggtgtcgggtgcgggcgtaggcggtttgattttttcgtaggttttcgaggagttgttgcgtgagtattacgtcgagttgcgtgaacgttcgttttacggtcgttttgttaagtatatggttttcgggtcggtggtggttatggtgagtattcgggaagcgggcgggcggtttcgggatttttattttcgcgtgatatcgcgttcgttttttcgtataggtttggtaggggttggacgtggtgcgtatttcgcgggcgtttatcggagttacgaattcggtcgacgtttcgttcggtattattcgcggggatttttgtatcgaggttggtaagtaaggttcgtttcggggacggttttagtttcgttcggtttttttttgtttagtttgcgtggtattcgtgtcggaggttttttttttacgtttatacgcgtttttttcgcgtaggaatttgatttacggtagcgattcggtggagagtgttcgtcgcgagatcgttttttggtttcgcgt

SEQ ID NO: 18284 - DNA, 1022 bp, Artificial Sequence
  chemically treated genomic DNA (Homo sapiens) CpG-island No: 18284
acgcgaaaccaaaaaacgatctcgcgacgaacactctccaccgaatcgctaccgtaaatcaaattcctacgcgaaaaaaacgcgtataaacgtaaaaaaaaaacctccgacacgaataccacgcaaactaaacaaaaaaaaaccgaacgaaactaaaaccgtccccgaaacgaaccttacttaccaacctcgatacaaaaatccccgcgaataataccgaacgaaacgtcgaccgaattcgtaactccgataaacgcccgcgaaatacgcaccacgtccaacccctaccaaacctatacgaaaaaacgaacgcgatatcacgcgaaaataaaaatcccgaaaccgcccgcccgcttcccgaatactcaccataaccaccaccgacccgaaaaccatatacttaacaaaacgaccgtaaaacgaacgttcacgcaactcgacgtaatactcacgcaacaactcctcgaaaacctacgaaaaaatcaaaccgcctacgcccgcacccgacacctaaacgtccccaaatccccgctccccttccccccacaccgcgcccccgctcgctcaccgcgcccccacctacaccaacttcaacgccaccaacttaaaacccttcctctcgaaacgccgcacaatctcgcccaccaaccgccgctacacgccgtccgacttcacgaccaaaaaaatacgttcgtatacgccgatacaaactacgaaacaaacgaaaacgaaccgtcaaaccgacccaacaccgaccacccgcccccgacccgcgccgcgcgactcacccgcgaaaaaaaaattaacgaaaataatcaacaccaaacaaatcataataacgatacgaaaacgaaatccgcgaaacgaaacgataacgcccgaaacgaaacctacgcttaaaaaaacctaatcgaaacgctacgacctccgcgaaaaaactacttcacttacaccccgaaacccgacaaccgtaaaaaaccgaaaaacaactacgaaaaccaaatctcctccaacaactcgaa

SEQ ID NO: 18285 - DNA, 1278 bp, Artificial Sequence
  chemically treated genomic DNA (Homo sapiens) CpG-island No: 18285
tttgcgtcgtgtagtcgggtcgtattcgcgtgaggcgttagtagtacggttcgtcgtgttgttatagttaggatttgcgcgtgattaggcggtttaggtcgaagagcgggaggcggtcgagtagttgtaagaggcggttttcgcggcgtacgtcggtttaggttcggatcggtagtcggcgtttagagaacggtcgcgttaaggtttcgtagtttatcgcgtagagttgggagtcgcgcggtttgtttagttgttttcgtagggcgcgtacgcggcgggttagtttcgcgattagtcgcggacgtattttttttcgcgttatggcgggttcgcgtttttagcggttcggtcggaagttatcggaagaggtcggtgttttaggttaaagtgttcggtcgcggtcggaagcgaggaagaggtcggttcggttatggcgcgggttggattcgggagggcgggggttttttgttagggtcggggtcggggacggggcgggagcggttagcggcgatttttaatttgggagattttagatttcgacgttgaggatttcgtcggttcggaggtcgtcgcgagagttcgggatttagcgggtgagcgtagggcggttgtcgaggcgttgcggttgttgcggtcggagtaggtgttgaagcgtttcgcggtgtgcgtggatataggtgcggcggagggtacgggcgatattcggggtaggaaaggttttttttcgttaggcggcgttttttgttcgattgggcggggcgcgcgtgtcgaggggtttggggtcgggttcgttttttagtcgggggtttgtgtcgaatggagatttttcggttcggttattcgtttaggtagggcgttcgcgagggtggaaggaagtagtgatcgcgtttttttttttcggttttagttattttggaagacgtcggtgtcgacgttttgatggaggttttggaggttttgggttgcgagtgtcgtatcgagttttagcgttcggttcgtagtttgcggtggattcgagcgagtttcgatttttgttttcgtagcgtgagtggtcgcgggttttcgagggttagtcgcgagttggttgttttgtttttatgattttagttttggagttgtttttgaggtagttgttttgggtcgtgcgcgtttcgcggatgggtaaagtaaggatggagaacgggaagtggaggtgtttaagtcgttttgttggtatagagtcgagttggttggagaaggtttcgtttcgatttaggttgtggtttggatttttgtcgg

SEQ ID NO: 18286 - DNA, 1278 bp, Artificial Sequence
  chemically treated genomic DNA (Homo sapiens) CpG-island No: 18286
ccgacaaaaatccaaaccacaacctaaatcgaaacgaaaccttctccaaccaactcgactctataccaacaaaacgacttaaacacctccacttcccgttctccatccttactttacccatccgcgaaacgcgcacgacccaaaacaactacctcaaaaacaactccaaaactaaaatcataaaaacaaaacaaccaactcgcgactaaccctcgaaaacccgcgaccactcacgctacgaaaacaaaaatcgaaactcgctcgaatccaccgcaaactacgaaccgaacgctaaaactcgatacgacactcgcaacccaaaacctccaaaacctccatcaaaacgtcgacaccgacgtcttccaaaataactaaaaccgaaaaaaaaaaacgcgatcactacttccttccaccctcgcgaacgccctacctaaacgaataaccgaaccgaaaaatctccattcgacacaaacccccgactaaaaaacgaacccgaccccaaacccctcgacacgcgcgccccgcccaatcgaacaaaaaacgccgcctaacgaaaaaaaacctttcctaccccgaatatcgcccgtaccctccgccgcacctatatccacgcacaccgcgaaacgcttcaacacctactccgaccgcaacaaccgcaacgcctcgacaaccgccctacgctcacccgctaaatcccgaactctcgcgacgacctccgaaccgacgaaatcctcaacgtcgaaatctaaaatctcccaaattaaaaatcgccgctaaccgctcccgccccgtccccgaccccgaccctaacaaaaaacccccgccctcccgaatccaacccgcgccataaccgaaccgacctcttcctcgcttccgaccgcgaccgaacactttaacctaaaacaccgacctcttccgataacttccgaccgaaccgctaaaaacgcgaacccgccataacgcgaaaaaaaatacgtccgcgactaatcgcgaaactaacccgccgcgtacgcgccctacgaaaacaactaaacaaaccgcgcgactcccaactctacgcgataaactacgaaaccttaacgcgaccgttctctaaacgccgactaccgatccgaacctaaaccgacgtacgccgcgaaaaccgcctcttacaactactcgaccgcctcccgctcttcgacctaaaccgcctaatcacgcgcaaatcctaactataacaacacgacgaaccgtactactaacgcctcacgcgaatacgacccgactacacgacgcaaa

SEQ ID NO: 18287 - DNA, 1278 bp, Artificial Sequence
  chemically treated genomic DNA (Homo sapiens) CpG-island No: 18287
tcggtaggaatttagattatagtttgaatcgagacggaattttttttagttagttcggttttatattagtagaacggtttgggtatttttatttttcgttttttatttttgttttatttattcgcgagacgcgtacggtttagggtagttgttttagggatagttttagggttgaaattatggaagtaaaatagttaattcgcggttggttttcgggaattcgcgattatttacgttgcgggggtaggggtcgggattcgttcgggtttatcgtaggttgcgggtcgggcgttggggttcgatgcggtattcgtagtttagggtttttagggtttttattaggacgtcggtatcggcgttttttaggatggttgggatcgggggagaggagcgcggttattgtttttttttattttcgcgagcgttttatttgggcgggtggtcggatcggggagtttttattcggtataaattttcgattgggaggcgggttcggttttaggtttttcggtacgcgcgtttcgtttagtcggatagagggcgtcgtttggcggagaaaggttttttttatttcgagtatcgttcgtgtttttcgtcgtatttgtgtttacgtatatcgcgaggcgttttagtatttgtttcggtcgtagtagtcgtaacgtttcggtagtcgttttgcgtttattcgttgggtttcgggttttcgcggcggttttcgagtcggcggagtttttagcgtcggagtttgagattttttaggttggaggtcgtcgttgatcgttttcgtttcgttttcggtttcggttttggtaagagattttcgttttttcgggtttaattcgcgttatggtcggatcgatttttttttcgttttcggtcgcgatcgaatattttagtttgggatatcggtttttttcggtgattttcggtcggatcgttgaggacgcggattcgttatggcgcggaagaaggtgcgttcgcggttgatcgcggagttggttcgtcgcgtgcgcgttttgcgggagtaattgaataggtcgcgcgatttttagttttacgcggtggattacgagattttgacgcggtcgttttttggacgtcggttgtcggttcgggtttgggtcgacgtgcgtcgcgagagtcgttttttgtagttgttcggtcgtttttcgtttttcggtttgggtcgtttggttacgcgtaagttttggttgtggtagtacgacgagtcgtgttattggcgttttacgcgggtgcggttcgattatacggcgtagg

SEQ ID NO: 18288 - DNA, 1278 bp, Artificial Sequence
  chemically treated genomic DNA (Homo sapiens) CpG-island No: 18288
cctacgccgtataatcgaaccgcacccgcgtaaaacgccaataacacgactcgtcgtactaccacaaccaaaacttacgcgtaaccaaacgacccaaaccgaaaaacgaaaaacgaccgaacaactacaaaaaacgactctcgcgacgcacgtcgacccaaacccgaaccgacaaccgacgtccaaaaaacgaccgcgtcaaaatctcgtaatccaccgcgtaaaactaaaaatcgcgcgacctattcaattactcccgcaaaacgcgcacgcgacgaaccaactccgcgatcaaccgcgaacgcaccttcttccgcgccataacgaatccgcgtcctcaacgatccgaccgaaaatcaccgaaaaaaaccgatatcccaaactaaaatattcgatcgcgaccgaaaacgaaaaaaaaatcgatccgaccataacgcgaattaaacccgaaaaaacgaaaatctcttaccaaaaccgaaaccgaaaacgaaacgaaaacgatcaacgacgacctccaacctaaaaaatctcaaactccgacgctaaaaactccgccgactcgaaaaccgccgcgaaaacccgaaacccaacgaataaacgcaaaacgactaccgaaacgttacgactactacgaccgaaacaaatactaaaacgcctcgcgatatacgtaaacacaaatacgacgaaaaacacgaacgatactcgaaataaaaaaaacctttctccgccaaacgacgccctctatccgactaaacgaaacgcgcgtaccgaaaaacctaaaaccgaacccgcctcccaatcgaaaatttataccgaataaaaactccccgatccgaccacccgcccaaataaaacgctcgcgaaaataaaaaaaaacaataaccgcgctcctctcccccgatcccaaccatcctaaaaaacgccgataccgacgtcctaataaaaaccctaaaaaccctaaactacgaataccgcatcgaaccccaacgcccgacccgcaacctacgataaacccgaacgaatcccgacccctacccccgcaacgtaaataatcgcgaattcccgaaaaccaaccgcgaattaactattttacttccataatttcaaccctaaaactatccctaaaacaactaccctaaaccgtacgcgtctcgcgaataaataaaacaaaaataaaaaacgaaaaataaaaatacccaaaccgttctactaatataaaaccgaactaactaaaaaaaattccgtctcgattcaaactataatctaaattcctaccga

SEQ ID NO: 18289 - DNA, 829 bp, Artificial Sequence
  chemically treated genomic DNA (Homo sapiens) CpG-island No: 18289
tcgcgatatagttcggttttgtcgtgatatagtatatttaaggcgtcgcggtttttcggggttagggatacgcgaggataagttatagattgttcggaatttaggatagggcgggggagtcgtcgacgttagggaaattttcgtattacgcgggttgagtgtaggcgggttaggttaggacgtaggggtcggttttttttcgtttcgtttttttgtttttttttgtttcgtttcgtttcgtttttttgtttcgtttttttgttttttttcggggtatcgatttcgtttagttaggggacgtaggcggttcgagttcgcgttgggaagcggcgagcgttcggtagaggtaggtttcgagaaggcgacgttttcgtttcgtttcgggtttttgagaagttcgggtttatttcgcggttgttatattcggtttcgtgacgcgggggacgtatttggcggggggcgtatttaagggagggttcgtttttgatcgtcgagtaacgagattcgtattttggcggcgtacggttgttacgcgttggggtcgtcgttaatgttgatttacggttcgcggtcgtttcgcgtcgtcgtcggggatttaaattcggttcgcgtttcgtttttttcgcgttggtttcgtttcgtaacgtgattcggtttcgttttcgtcgtattggttacgtttttcgcgttgtttttttttaatttttttttcgattcgggcgtattcggttttcgcggtttttggttacgagttgggcgggtaagtgggcgcgggtagcgggggttagaggtttttaggtagaaagttttagagttgtttcgttgttcg

SEQ ID NO: 18290 - DNA, 829 bp, Artificial Sequence
  chemically treated genomic DNA (Homo sapiens) CpG-island No: 18290
cgaacaacgaaacaactctaaaactttctacctaaaaacctctaacccccgctacccgcgcccacttacccgcccaactcgtaaccaaaaaccgcgaaaaccgaatacgcccgaatcgaaaaaaaaattaaaaaaaaacaacgcgaaaaacgtaaccaatacgacgaaaacgaaaccgaatcacgttacgaaacgaaaccaacgcgaaaaaaacgaaacgcgaaccgaatttaaatccccgacgacgacgcgaaacgaccgcgaaccgtaaatcaacattaacgacgaccccaacgcgtaacaaccgtacgccgccaaaatacgaatctcgttactcgacgatcaaaaacgaaccctcccttaaatacgccccccgccaaatacgtcccccgcgtcacgaaaccgaatataacaaccgcgaaataaacccgaacttctcaaaaacccgaaacgaaacgaaaacgtcgccttctcgaaacctacctctaccgaacgctcgccgcttcccaacgcgaactcgaaccgcctacgtcccctaactaaacgaaatcgataccccgaaaaaaaacaaaaaaacgaaacaaaaaaacgaaacgaaacgaaacaaaaaaaaacaaaaaaacgaaacgaaaaaaaaccgacccctacgtcctaacctaacccgcctacactcaacccgcgtaatacgaaaatttccctaacgtcgacgactcccccgccctatcctaaattccgaacaatctataacttatcctcgcgtatccctaaccccgaaaaaccgcgacgccttaaatatactatatcacgacaaaaccgaactatatcgcga

SEQ ID NO: 18291 - DNA, 829 bp, Artificial Sequence
  chemically treated genomic DNA (Homo sapiens) CpG-island No: 18291
cgggtagcggggtagttttggggttttttgtttgaagatttttggttttcgttgttcgcgtttatttgttcgtttagttcgtagttaggagtcgcggggatcgggtgcgttcgagtcggggggaaggttgggggagggtagcgcggggggcgtggttagtgcgacgggggcggggtcgagttacgttgcggggcggggttagcgcggagggggcggggcgcgggtcgggtttgaattttcggcggcggcgcggggcggtcgcggatcgtgagttagtattggcggcggttttagcgcgtggtagtcgtgcgtcgttaaggtgcgggtttcgttattcggcggttaggagcgggtttttttttaggtgcgtttttcgttaggtgcgtttttcgcgttacggagtcgggtgtgatagtcgcggggtgggttcgggttttttagaggttcggagcgaggcgaaggcgtcgttttttcggaatttgtttttgtcgggcgttcgtcgttttttagcgcgggttcgggtcgtttgcgttttttagttaggcggggtcggtgtttcgagggagggtaggggagcggggtaggagagcggagcggagcggggtaggagagggtaggggaacggggcgggggagggtcgatttttgcgttttggtttggttcgtttgtatttagttcgcgtggtacgggaatttttttggcgtcggcggttttttcgttttgttttgagtttcgagtagtttgtagtttgttttcgcgtgtttttgatttcgggggatcgcggcgttttgaatgtgttgtgttacggtagagtcgggttgtgtcgcgg

SEQ ID NO: 18292 - DNA, 829 bp, Artificial Sequence
  chemically treated genomic DNA (Homo sapiens) CpG-island No: 18292
ccgcgacacaacccgactctaccgtaacacaacacattcaaaacgccgcgatcccccgaaatcaaaaacacgcgaaaacaaactacaaactactcgaaactcaaaacaaaacgaaaaaaccgccgacgccaaaaaaattcccgtaccacgcgaactaaatacaaacgaaccaaaccaaaacgcaaaaatcgaccctcccccgccccgttcccctaccctctcctaccccgctccgctccgctctcctaccccgctcccctaccctccctcgaaacaccgaccccgcctaactaaaaaacgcaaacgacccgaacccgcgctaaaaaacgacgaacgcccgacaaaaacaaattccgaaaaaacgacgccttcgcctcgctccgaacctctaaaaaacccgaacccaccccgcgactatcacacccgactccgtaacgcgaaaaacgcacctaacgaaaaacgcacctaaaaaaaaacccgctcctaaccgccgaataacgaaacccgcaccttaacgacgcacgactaccacgcgctaaaaccgccgccaatactaactcacgatccgcgaccgccccgcgccgccgccgaaaattcaaacccgacccgcgccccgccccctccgcgctaaccccgccccgcaacgtaactcgaccccgcccccgtcgcactaaccacgccccccgcgctaccctcccccaaccttccccccgactcgaacgcacccgatccccgcgactcctaactacgaactaaacgaacaaataaacgcgaacaacgaaaaccaaaaatcttcaaacaaaaaaccccaaaactaccccgctacccg

SEQ ID NO: 18293 - DNA, 1761 bp, Artificial Sequence
  chemically treated genomic DNA (Homo sapiens) CpG-island No: 18293
atttttgtatatagtcggggtataattaatttttgtatatagtcggcgtttaattaattattgtatatagtcggtatttaattaattatagtatatagtcgtcgtttaattaattatagtatatagtcggtatttaattaatttttgtatatagtcggcgtttaattaattatagtatatagtcggcgtttaattaatttttgtatatagtcggcgtttaattaatttttgtatatagtcggcgtttaataaattattgtatatagtcggcgtttaattaattatagtatatagtcggcgtttaattaattatagtatatagtcggcgtttaattaatttttgtatatagtcggcgtttaattaattatagtatatagtcggcgtttaattaattatagtatatagtcggcgtttaattaattatagtatatagtcggtatttaattaatttttgtatatagtcggcgtttaattaattatagtatatagtcggcgtttaattaatttttgtatatagtcggcgtttaattaatttttgtatatagtcggcgtttaataaattattgtatatagtcggcgtttaattaattatagtatatagtcggcgtttaattaatttttgtatatagtcggcgtttaattaatttttgtatatagtcggcgtttaattaatttttgtatatagtcggcgtttaattaattattgtatatagtcggcgtttaattaattatagtatatagtcggcgtttaattaatttttgtatatagtcggtgtttaataaattatagtatatagtcggcgtttaattaatttttgtatatagtcggcgtttaattaattatagtatatagtcggcgtttaattaattatagtatatagtcggcgtttaattaatttttgtatatagtcggcgtttaataaattattgtatatagtcggcgtttaattaatttttgtatatagttagcgtttaataaattattgtatatagtcggcgttgaagtttcgttgttcgtttattttattatatttatatttatttatatatatatatttatatttatttttatatatatatatatagatatatatatatacgcgcgcgcgcgttcggtgtttagtcgcggggttttttattcggttatagttcggcggtcggtttgattaggtggtcgttgaaggtgatgtagaggttttcgtgttcgtcgtagatggcgttgtttcggtcgcgttggaatatgcgtatttagacggcgtcgttcgtcgttagtagtagtattaggttttgggtttgtatgacgttgcgttcgttgggttgcgcgtagagtacggtcgcgggtcgtcggtttagtatgatgtgtaggtaggtttttttgtagttttaggtgtgtacgttgaggttgaggaagtagacgtcgggtatcgtgtagaggaagcggttcgcggttaggtcgaaggcgtcgtttaggtttattagtttcgtgtcgaagggtatcgtttggaagtggtcggagttgtgtaggttttcgcgtcggtttacggagaaggcggcgtaggtacgtcggtacgcggcgttcggcggttttatttgttttttttggtttttgcggttttgtaggtttcgggcgtttggcggtttttttttttcgtttttgtcggttcgatttcggacgtcggttttattttttttatttgtaggggataaacgaaagttacgggtcggggtcgggttgggtaggttttttttattttagtatt

SEQ ID NO: 18294 - DNA, 1761 bp, Artificial Sequence
  chemically treated genomic DNA (Homo sapiens) CpG-island No: 18294
aatactaaaataaaaaaaacctacccaacccgaccccgacccgtaactttcgtttatcccctacaaataaaaaaaataaaaccgacgtccgaaatcgaaccgacaaaaacgaaaaaaaaaaaccgccaaacgcccgaaacctacaaaaccgcaaaaaccaaaaaaaacaaataaaaccgccgaacgccgcgtaccgacgtacctacgccgccttctccgtaaaccgacgcgaaaacctacacaactccgaccacttccaaacgatacccttcgacacgaaactaataaacctaaacgacgccttcgacctaaccgcgaaccgcttcctctacacgatacccgacgtctacttcctcaacctcaacgtacacacctaaaactacaaaaaaacctacctacacatcatactaaaccgacgacccgcgaccgtactctacgcgcaacccaacgaacgcaacgtcatacaaacccaaaacctaatactactactaacgacgaacgacgccgtctaaatacgcatattccaacgcgaccgaaacaacgccatctacgacgaacacgaaaacctctacatcaccttcaacgaccacctaatcaaaccgaccgccgaactataaccgaataaaaaaccccgcgactaaacaccgaacgcgcgcgcgcgtatatatatatatctatatatatatatataaaaataaatataaatatatatatataaataaatataaatataataaaataaacgaacaacgaaacttcaacgccgactatatacaataatttattaaacgctaactatatacaaaaattaattaaacgccgactatatacaataatttattaaacgccgactatatacaaaaattaattaaacgccgactatatactataattaattaaacgccgactatatactataattaattaaacgccgactatatacaaaaattaattaaacgccgactatatactataatttattaaacaccgactatatacaaaaattaattaaacgccgactatatactataattaattaaacgccgactatatacaataattaattaaacgccgactatatacaaaaattaattaaacgccgactatatacaaaaattaattaaacgccgactatatacaaaaattaattaaacgccgactatatactataattaattaaacgccgactatatacaataatttattaaacgccgactatatacaaaaattaattaaacgccgactatatacaaaaattaattaaacgccgactatatactataattaattaaacgccgactatatacaaaaattaattaaataccgactatatactataattaattaaacgccgactatatactataattaattaaacgccgactatatactataattaattaaacgccgactatatacaaaaattaattaaacgccgactatatactataattaattaaacgccgactatatactataattaattaaacgccgactatatacaataatttattaaacgccgactatatacaaaaattaattaaacgccgactatatacaaaaattaattaaacgccgactatatactataattaattaaacgccgactatatacaaaaattaattaaataccgactatatactataattaattaaacgacgactatatactataattaattaaataccgactatatacaataattaattaaacgccgactatatacaaaaattaattataccccgactatatacaaaaat

SEQ ID NO: 18295 - DNA, 1761 bp, Artificial Sequence
  chemically treated genomic DNA (Homo sapiens) CpG-island No: 18295
ggtgttggaatgggggaggtttgtttagttcggtttcgattcgtggttttcgtttgttttttgtaggtgagaagggtgaggtcggcgttcgaggtcgggtcggtaggagcgggaaagaggggtcgttaggcgttcggggtttgtagggtcgtagaggttagaaggggtaggtggggtcgtcgggcgtcgcgtgtcgacgtgtttacgtcgtttttttcgtgggtcggcgcgagggtttgtatagtttcgattatttttaggcggtgtttttcgatacggagttggtgaatttggacggcgttttcgatttggtcgcgggtcgttttttttgtacggtgttcggcgtttatttttttagttttaacgtgtatatttggaattataaggagatttatttgtatattatgttgaatcggcggttcgcggtcgtgttttacgcgtagtttagcgagcgtagcgttatgtaggtttagagtttgatgttgttgttggcggcgggcgacgtcgtttgggtgcgtatgttttagcgcgatcgggataacgttatttacggcgagtacggagatttttatattatttttagcggttatttggttaagtcggtcgtcgagttgtagtcgggtgaggggtttcgcggttgagtatcgggcgcgcgcgcgcgtgtgtgtgtgtgtttgtgtgtgtgtgtgtgggggtgggtgtgggtgtgtgtgtgtgggtgggtgtgggtgtggtggggtgggcgggtagcggagttttagcgtcgattgtgtgtagtgatttgttgagcgttgattgtgtgtagggattggttgagcgtcgattgtgtgtagtgatttgttgagcgtcgattgtgtgtagggattggttgagcgtcgattgtgtgttgtgattggttgagcgtcgattgtgtgttgtgattggttgagcgtcgattgtgtgtagggattgattgagcgtcgattgtgtgttgtgatttgttgagtatcgattgtgtgtagggattggttgagcgtcgattgtgtgttgtgattggttgagcgtcgattgtgtgtagtgattggttgagcgtcgattgtgtgtagggattggttgagcgtcgattgtgtgtagggattgattgagcgtcgattgtgtgtagggattggttgagcgtcgattgtgtgttgtgattggttgagcgtcgattgtgtgtagtgatttgttgagcgtcgattgtgtgtagggattggttgagcgtcgattgtgtgtagggattgattgagcgtcgattgtgtgttgtgattggttgagcgtcgattgtgtgtagggattggttgagtgtcgattgtgtgttgtgattggttgagcgtcgattgtgtgttgtgattggttgagcgtcgattgtgtgttgtgattggttgagcgtcgattgtgtgtagggattggttgagcgtcgattgtgtgttgtgattggttgagcgtcgattgtgtgttgtgattggttgagcgtcgattgtgtgtagtgatttgttgagcgtcgattgtgtgtagggattggttgagcgtcgattgtgtgtagggattgattgagcgtcgattgtgtgttgtgattggttgagcgtcgattgtgtgtagggattggttgagtgtcgattgtgtgttgtgattggttgagcgacgattgtgtgttgtgattggttgagtgtcgattgtgtgtagtgattgattgagcgtcgattgtgtgtagggattggttgtgtttcgattgtgtgtagggat

SEQ ID NO: 18296 - DNA, 1761 bp, Artificial Sequence
  chemically treated genomic DNA (Homo sapiens) CpG-island No: 18296
atccctacacacaatcgaaacacaaccaatccctacacacaatcgacgctcaatcaatcactacacacaatcgacactcaaccaatcacaacacacaatcgtcgctcaaccaatcacaacacacaatcgacactcaaccaatccctacacacaatcgacgctcaaccaatcacaacacacaatcgacgctcaatcaatccctacacacaatcgacgctcaaccaatccctacacacaatcgacgctcaacaaatcactacacacaatcgacgctcaaccaatcacaacacacaatcgacgctcaaccaatcacaacacacaatcgacgctcaaccaatccctacacacaatcgacgctcaaccaatcacaacacacaatcgacgctcaaccaatcacaacacacaatcgacgctcaaccaatcacaacacacaatcgacactcaaccaatccctacacacaatcgacgctcaaccaatcacaacacacaatcgacgctcaatcaatccctacacacaatcgacgctcaaccaatccctacacacaatcgacgctcaacaaatcactacacacaatcgacgctcaaccaatcacaacacacaatcgacgctcaaccaatccctacacacaatcgacgctcaatcaatccctacacacaatcgacgctcaaccaatccctacacacaatcgacgctcaaccaatcactacacacaatcgacgctcaaccaatcacaacacacaatcgacgctcaaccaatccctacacacaatcgatactcaacaaatcacaacacacaatcgacgctcaatcaatccctacacacaatcgacgctcaaccaatcacaacacacaatcgacgctcaaccaatcacaacacacaatcgacgctcaaccaatccctacacacaatcgacgctcaacaaatcactacacacaatcgacgctcaaccaatccctacacacaatcaacgctcaacaaatcactacacacaatcgacgctaaaactccgctacccgcccaccccaccacacccacacccacccacacacacacacccacacccacccccacacacacacacacaaacacacacacacacgcgcgcgcgcgcccgatactcaaccgcgaaacccctcacccgactacaactcgacgaccgacttaaccaaataaccgctaaaaataatataaaaatctccgtactcgccgtaaataacgttatcccgatcgcgctaaaacatacgcacccaaacgacgtcgcccgccgccaacaacaacatcaaactctaaacctacataacgctacgctcgctaaactacgcgtaaaacacgaccgcgaaccgccgattcaacataatatacaaataaatctccttataattccaaatatacacgttaaaactaaaaaaataaacgccgaacaccgtacaaaaaaaacgacccgcgaccaaatcgaaaacgccgtccaaattcaccaactccgtatcgaaaaacaccgcctaaaaataatcgaaactatacaaaccctcgcgccgacccacgaaaaaaacgacgtaaacacgtcgacacgcgacgcccgacgaccccacctaccccttctaacctctacgaccctacaaaccccgaacgcctaacgacccctctttcccgctcctaccgacccgacctcgaacgccgacctcacccttctcacctacaaaaaacaaacgaaaaccacgaatcgaaaccgaactaaacaaacctcccccattccaacacc

SEQ ID NO: 18297 - DNA, 857 bp, Artificial Sequence
  chemically treated genomic DNA (Homo sapiens) CpG-island No: 18297
gtcgggtcgttagtgttttttgtaggaggggcgtgtaggtagcgggcgttttggagttattgttcgagttaggtacgttattaataatttcgttatttagtcgcgttcgagagcgtaggttcggatcgttgtcgggcgtttttagttttcgggtcggggtagagttcgagttcgattcggatcgcgacggttttttttttttttcgttacgtgatttcgtttttttttttatttagcgggtagtagagggttcggtttggcgggtcgggggttaggaaaaagtcgaaaatatcgaggtcgggtcgtttttttttcgtttaaaatagttttcggtcggggttgttacgtatttcgtcgggttcggggcgcgggaaggggcggtcggtttggttttcgttcggttagacgtggttattcggtcgggttggatcgggtgggggtcgagggcgggtcgcgcggtcggtcggtatgtggttttttttcggggagttttggtagttcgggttgcgcgttgcgcggggatgatggagagtttttggaattttttgtagttggagagcgcggtcggtcgggggagcgagttaagcgcgtagttcgggtaggggcgtttggcgttcgattttagggggcgttttcgcggcgagggtggtggggggagatttcgtcgttcggttttagattgcgggagtggagagagtatttttcgttttttcggttttttttttcgggtttggcgggggtttagtttcgtttttttcggtttgcgcggcggagaagggttaggtgtaggtaacgttttttttttagtcgtttggttttttttttcgttcgttattttttttaggagttagaaattt

SEQ ID NO: 18298 - DNA, 857 bp, Artificial Sequence
  chemically treated genomic DNA (Homo sapiens) CpG-island No: 18298
aaatttctaactcctaaaaaaaataacgaacgaaaaaaaaaaccaaacgactaaaaaaaaaacgttacctacacctaacccttctccgccgcgcaaaccgaaaaaaacgaaactaaacccccgccaaacccgaaaaaaaaaaccgaaaaaacgaaaaatactctctccactcccgcaatctaaaaccgaacgacgaaatctccccccaccaccctcgccgcgaaaacgccccctaaaatcgaacgccaaacgcccctacccgaactacgcgcttaactcgctcccccgaccgaccgcgctctccaactacaaaaaattccaaaaactctccatcatccccgcgcaacgcgcaacccgaactaccaaaactccccgaaaaaaaaccacataccgaccgaccgcgcgacccgccctcgacccccacccgatccaacccgaccgaataaccacgtctaaccgaacgaaaaccaaaccgaccgccccttcccgcgccccgaacccgacgaaatacgtaacaaccccgaccgaaaactattttaaacgaaaaaaaaacgacccgacctcgatattttcgactttttcctaacccccgacccgccaaaccgaaccctctactacccgctaaataaaaaaaaaaacgaaatcacgtaacgaaaaaaaaaaaaaaccgtcgcgatccgaatcgaactcgaactctaccccgacccgaaaactaaaaacgcccgacaacgatccgaacctacgctctcgaacgcgactaaataacgaaattattaataacgtacctaactcgaacaataactccaaaacgcccgctacctacacgcccctcctacaaaaaacactaacgacccgac

SEQ ID NO: 18299 - DNA, 857 bp, Artificial Sequence
  chemically treated genomic DNA (Homo sapiens) CpG-island No: 18299
gagtttttggtttttggaggaggtgacgggcggagagggaaattaggcggttgggggaggggcgttgtttgtatttggttttttttcgtcgcgtaagtcgggaggggcgggattggattttcgttagattcgaaaagagaggtcgaggaggcgaggggtgttttttttattttcgtagtttggggtcgggcggcgaggtttttttttattattttcgtcgcggaggcgttttttagggtcgggcgttaggcgtttttgttcgagttgcgcgtttagttcgttttttcggtcggtcgcgttttttagttgtaggaaattttagaagttttttattattttcgcgtagcgcgtagttcgggttgttaaggtttttcgaaggagagttatatgtcggtcggtcgcgcggttcgttttcggtttttattcggtttaattcggtcgggtagttacgtttggtcgggcgggggttaagtcggtcgttttttttcgcgtttcgggttcggcggaatgcgtggtagtttcgatcgggggttattttgagcgggaggggagcggttcggtttcggtgttttcggtttttttttggttttcggttcgttaggtcgggttttttgttgttcgttgaatgggagggggggcggggttacgtggcggggggaggggagggtcgtcgcgattcgggtcgggttcgggttttgtttcggttcggggattggaggcgttcggtagcggttcggatttgcgttttcggacgcggttgagtggcggggttattaatagcgtgtttggttcgggtagtggttttagggcgttcgttatttgtacgttttttttgtagagagtattggcggttcggt

SEQ ID NO: 18300 - DNA, 857 bp, Artificial Sequence
  chemically treated genomic DNA (Homo sapiens) CpG-island No: 18300
accgaaccgccaatactctctacaaaaaaaacgtacaaataacgaacgccctaaaaccactacccgaaccaaacacgctattaataaccccgccactcaaccgcgtccgaaaacgcaaatccgaaccgctaccgaacgcctccaatccccgaaccgaaacaaaacccgaacccgacccgaatcgcgacgaccctcccctccccccgccacgtaaccccgccccccctcccattcaacgaacaacaaaaaacccgacctaacgaaccgaaaaccaaaaaaaaaccgaaaacaccgaaaccgaaccgctcccctcccgctcaaaataacccccgatcgaaactaccacgcattccgccgaacccgaaacgcgaaaaaaaacgaccgacttaacccccgcccgaccaaacgtaactacccgaccgaattaaaccgaataaaaaccgaaaacgaaccgcgcgaccgaccgacatataactctccttcgaaaaaccttaacaacccgaactacgcgctacgcgaaaataataaaaaacttctaaaatttcctacaactaaaaaacgcgaccgaccgaaaaaacgaactaaacgcgcaactcgaacaaaaacgcctaacgcccgaccctaaaaaacgcctccgcgacgaaaataataaaaaaaaacctcgccgcccgaccccaaactacgaaaataaaaaaaacacccctcgcctcctcgacctctcttttcgaatctaacgaaaatccaatcccgcccctcccgacttacgcgacgaaaaaaaaccaaatacaaacaacgcccctcccccaaccgcctaatttccctctccgcccgtcacctcctccaaaaaccaaaaactc

SEQ ID NO: 18301 - DNA, 627 bp, Artificial Sequence
  chemically treated genomic DNA (Homo sapiens) CpG-island No: 18301
cgcgtttggaaagcgtttgcgtattttttttattgggggtggtgttaaagcgggaaggtgggcgtggttttagggaacgtttgcgcgttgttttttcgaaggggtggggcgatttttgaattggagttagtgggcgtggttttagaggcgtttgcgcggaggcggttggagggaggttcgatttttttttgttcgggttcgttattttgttaggtagcggtagtggcggcggtagcggcggttggagtttttgattgggtttcggagttcggtattggagttaattagcgcgggtagcgaatcgggggagcgaggtacggtgagtgtgaggagttaatatttagcggtttagagtcggttttagcgtttcgattggcgggtttcgttgattatttaggagaggtttaggcgttcgtcgagttcggggagtcgagttgagtttagtcgagtcgggcggttagcggtttcggttcggggtttgcgagcgtttcggggtattttcggtcgaggtttgtaggggtcgtttcgcgcggggatggcgtttcggggagtaggtatttcggggtttcgattttcgtagggtgttagggttagttgggaatgcgtttttgtttttcgatttaggtt

SEQ ID NO: 18302 - DNA, 627 bp, Artificial Sequence
  chemically treated genomic DNA (Homo sapiens) CpG-island No: 18302
aacctaaatcgaaaaacaaaaacgcattcccaactaaccctaacaccctacgaaaatcgaaaccccgaaatacctactccccgaaacgccatccccgcgcgaaacgacccctacaaacctcgaccgaaaataccccgaaacgctcgcaaaccccgaaccgaaaccgctaaccgcccgactcgactaaactcaactcgactccccgaactcgacgaacgcctaaacctctcctaaataatcaacgaaacccgccaatcgaaacgctaaaaccgactctaaaccgctaaatattaactcctcacactcaccgtacctcgctcccccgattcgctacccgcgctaattaactccaataccgaactccgaaacccaatcaaaaactccaaccgccgctaccgccgccactaccgctacctaacaaaataacgaacccgaacaaaaaaaaatcgaacctccctccaaccgcctccgcgcaaacgcctctaaaaccacgcccactaactccaattcaaaaatcgccccaccccttcgaaaaaacaacgcgcaaacgttccctaaaaccacgcccaccttcccgctttaacaccacccccaataaaaaaaatacgcaaacgctttccaaacgcg

SEQ ID NO: 18303 - DNA, 627 bp, Artificial Sequence
  chemically treated genomic DNA (Homo sapiens) CpG-island No: 18303
ggtttgagtcggggaatagggacgtatttttaattggttttggtattttgcgagggtcggagtttcgaggtgtttgtttttcgaggcgttattttcgcgcggggcggtttttgtaggtttcggtcgggagtgtttcgaggcgttcgtaggtttcgggtcggggtcgttggtcgttcggttcggttaggtttagttcgatttttcgggttcgacgggcgtttgggttttttttgagtggttagcgagattcgttaatcggggcgttggggtcggttttgggtcgttggatattggttttttatatttatcgtgtttcgttttttcggttcgttgttcgcgttgattggttttagtatcggatttcgaaatttaattagaggttttagtcgtcgttgtcgtcgttattgtcgttgtttagtaaaatggcgaattcgaataaaggggaatcgggtttttttttaatcgttttcgcgtaggcgtttttgaggttacgtttattaattttagtttagggatcgttttattttttcggaggagtaacgcgtaggcgttttttgaagttacgtttattttttcgttttgatattatttttagtgaaaggaatacgtaggcgttttttagacgcg

SEQ ID NO: 18304 - DNA, 627 bp, Artificial Sequence
  chemically treated genomic DNA (Homo sapiens) CpG-island No: 18304
cgcgtctaaaaaacgcctacgtattcctttcactaaaaataatatcaaaacgaaaaaataaacgtaacttcaaaaaacgcctacgcgttactcctccgaaaaaataaaacgatccctaaactaaaattaataaacgtaacctcaaaaacgcctacgcgaaaacgattaaaaaaaaacccgattcccctttattcgaattcgccattttactaaacaacgacaataacgacgacaacgacgactaaaacctctaattaaatttcgaaatccgatactaaaaccaatcaacgcgaacaacgaaccgaaaaaacgaaacacgataaatataaaaaaccaatatccaacgacccaaaaccgaccccaacgccccgattaacgaatctcgctaaccactcaaaaaaaacccaaacgcccgtcgaacccgaaaaatcgaactaaacctaaccgaaccgaacgaccaacgaccccgacccgaaacctacgaacgcctcgaaacactcccgaccgaaacctacaaaaaccgccccgcgcgaaaataacgcctcgaaaaacaaacacctcgaaactccgaccctcgcaaaataccaaaaccaattaaaaatacgtccctattccccgactcaaacc

SEQ ID NO: 18305 - DNA, 709 bp, Artificial Sequence
  chemically treated genomic DNA (Homo sapiens) CpG-island No: 18305
ttacgcgcgcgcgtatacgcgcgtattcggttttttttttcgttttatatatatatatatatatatacgtatatatatatatatacggattatacgttttaatttgggagggagtcgggcgggttgcggagatagcgtagggttagtagtggagaaaatttagcggttagaggcgtttaggaattcggcggtcgtgcgtatcgttttcgtcgagtttttcggcgcggtagtttttagtggcgaatcgcggagttgtaggagtcgaaggtagtttttgcgttcgttgttttgttcgttgtcgagcgtattcgttttcgagacgattaatatcgtcgcggaaattagagggatttacggttttggtaggggtggcgcggggacgtacggtggggcgggagtgggttggggtcgtagtcgcggagggaggtgggtaggtcgcgagtttcggaatcgggagggcggttttcgcggtttagcggtacgggtagtttttgcggaaggcgagtcgggcggttagggttgtatttttgtagttggcgacggcgttgttattttacgtgtttagcgcgttttgtagtcgttagttcgtcgtttgttggaggaaaattcgatcgcgtcggttttaggttgggagtgggggttggggcgatcgcgtttatttagttttggggtttagtttagattttcgaattttggtaagggatttatg

SEQ ID NO: 18306 - DNA, 709 bp, Artificial Sequence
  chemically treated genomic DNA (Homo sapiens) CpG-island No: 18306
cataaatcccttaccaaaattcgaaaatctaaactaaaccccaaaactaaataaacgcgatcgccccaacccccactcccaacctaaaaccgacgcgatcgaattttcctccaacaaacgacgaactaacgactacaaaacgcgctaaacacgtaaaataacaacgccgtcgccaactacaaaaatacaaccctaaccgcccgactcgccttccgcaaaaactacccgtaccgctaaaccgcgaaaaccgccctcccgattccgaaactcgcgacctacccacctccctccgcgactacgaccccaacccactcccgccccaccgtacgtccccgcgccacccctaccaaaaccgtaaatccctctaatttccgcgacgatattaatcgtctcgaaaacgaatacgctcgacaacgaacaaaacaacgaacgcaaaaactaccttcgactcctacaactccgcgattcgccactaaaaactaccgcgccgaaaaactcgacgaaaacgatacgcacgaccgccgaattcctaaacgcctctaaccgctaaattttctccactactaaccctacgctatctccgcaacccgcccgactccctcccaaattaaaacgtataatccgtatatatatatatatacgtatatatatatatatatatataaaacgaaaaaaaaaaccgaatacgcgcgtatacgcgcgcgcgtaa

SEQ ID NO: 18307 - DNA, 709 bp, Artificial Sequence
  chemically treated genomic DNA (Homo sapiens) CpG-island No: 18307
tataggttttttattaggattcgagaatttgaattgggttttaggattgggtgggcgcgatcgttttagtttttatttttagtttagggtcggcgcggtcgggtttttttttagtaggcggcgggttgacggttgtagggcgcgttaggtacgtgaggtggtagcgtcgtcgttagttgtagaggtgtagttttggtcgttcggttcgtttttcgtaggggttgttcgtgtcgttggatcgcggagatcgttttttcggtttcggggttcgcggtttgtttattttttttcgcgattgcggttttagtttattttcgttttatcgtgcgttttcgcgttatttttgttaggatcgtgaatttttttggttttcgcggcggtgttggtcgtttcggaagcgggtgcgttcggtagcgggtagggtagcgggcgtagaggttgttttcggtttttgtagtttcgcggttcgttattgggggttgtcgcgtcggagagttcggcggggacggtgcgtacggtcgtcgggtttttgggcgtttttggtcgttgggttttttttattgttggttttgcgttgttttcgtagttcgttcgatttttttttagattggagcgtgtgattcgtgtgtgtgtgtgtgtgcgtgtgtgtgtgtgtgtgtgtgtggagcggagagagaaatcgggtacgcgcgtatgcgcgcgcgcgtgg

SEQ ID NO: 18308 - DNA, 709 bp, Artificial Sequence
  chemically treated genomic DNA (Homo sapiens) CpG-island No: 18308
ccacgcgcgcgcgcatacgcgcgtacccgatttctctctccgctccacacacacacacacacacacacgcacacacacacacacacgaatcacacgctccaatctaaaaaaaaatcgaacgaactacgaaaacaacgcaaaaccaacaataaaaaaaacccaacgaccaaaaacgcccaaaaacccgacgaccgtacgcaccgtccccgccgaactctccgacgcgacaacccccaataacgaaccgcgaaactacaaaaaccgaaaacaacctctacgcccgctaccctacccgctaccgaacgcacccgcttccgaaacgaccaacaccgccgcgaaaaccaaaaaaattcacgatcctaacaaaaataacgcgaaaacgcacgataaaacgaaaataaactaaaaccgcaatcgcgaaaaaaaataaacaaaccgcgaaccccgaaaccgaaaaaacgatctccgcgatccaacgacacgaacaacccctacgaaaaacgaaccgaacgaccaaaactacacctctacaactaacgacgacgctaccacctcacgtacctaacgcgccctacaaccgtcaacccgccgcctactaaaaaaaaacccgaccgcgccgaccctaaactaaaaataaaaactaaaacgatcgcgcccacccaatcctaaaacccaattcaaattctcgaatcctaataaaaaacctata

SEQ ID NO: 18309 - DNA, 657 bp, Artificial Sequence
  chemically treated genomic DNA (Homo sapiens) CpG-island No: 18309
gcggtcgttcgtttcgggcgcgagacggatatttagtcgttcgtagaaggcggttgtcgttttatttcgcgggggcgttttcgggtcgtagtcggcggagggagggttttgttcgtttcggtttttcggcggcggtttttggcgtttaggtgatagattttgggttcgacgtatcgcgcggaggcgaaggtagaagatcgagagtaggcgggacggttttcggttcggcggtttcgtttttttcgttgttttttttttcgtttcgatgcggcggcggcggattttacggtcgcgttgtcgcggcggttttcgtttttttttgtcggtttggtgtattggtttttttttatttgtgattaaaatttgcgtcgtcgcggagtatgtttagtttttgcgttcgttagttcgtcgtttttgggcgcgattttgcgttttaggttttatagattacgggcgaaggcggggagaggaggcggtgtagcggcggaggcgtggtttgaagttcggtgggaatcgcgggggtttaggaggcgtgtgtaagggtgattgggtcgtagttgaggggagtagttcgcgagaagggggcgtgcggtcggtttcgttttacgtaaacgcgatatattaaaatgtatttttttttttaattagaagagataa

SEQ ID NO: 18310 - DNA, 657 bp, Artificial Sequence
  chemically treated genomic DNA (Homo sapiens) CpG-island No: 18310
ttatctcttctaattaaaaaaaaaaatacattttaatatatcgcgtttacgtaaaacgaaaccgaccgcacgcccccttctcgcgaactactcccctcaactacgacccaatcacccttacacacgcctcctaaacccccgcgattcccaccgaacttcaaaccacgcctccgccgctacaccgcctcctctccccgccttcgcccgtaatctataaaacctaaaacgcaaaatcgcgcccaaaaacgacgaactaacgaacgcaaaaactaaacatactccgcgacgacgcaaattttaatcacaaataaaaaaaaaccaatacaccaaaccgacaaaaaaaaacgaaaaccgccgcgacaacgcgaccgtaaaatccgccgccgccgcatcgaaacgaaaaaaaaaacaacgaaaaaaacgaaaccgccgaaccgaaaaccgtcccgcctactctcgatcttctaccttcgcctccgcgcgatacgtcgaacccaaaatctatcacctaaacgccaaaaaccgccgccgaaaaaccgaaacgaacaaaaccctccctccgccgactacgacccgaaaacgcccccgcgaaataaaacgacaaccgccttctacgaacgactaaatatccgtctcgcgcccgaaacgaacgaccgc

SEQ ID NO: 18311 - DNA, 657 bp, Artificial Sequence
  chemically treated genomic DNA (Homo sapiens) CpG-island No: 18311
ttattttttttgattaggaaaaaaaatgtattttgatatgtcgcgtttgcgtaaagcgaggtcgatcgtacgtttttttttcgcgagttgttttttttaattgcgatttaattatttttgtatacgttttttgagttttcgcggtttttatcgggttttaggttacgttttcgtcgttgtatcgtttttttttttcgttttcgttcgtagtttataaaatttggagcgtaggatcgcgtttaggagcggcgagttagcggacgtaaagattgggtatgtttcgcggcggcgtaggttttggttataagtaggaagaagttagtgtattagatcggtaaagagaagcgggagtcgtcgcggtagcgcggtcgtggggttcgtcgtcgtcgtatcggagcgggaggaggagtagcggggagggcgaggtcgtcgggtcgagagtcgtttcgtttgttttcggttttttgttttcgttttcgcgcggtgcgtcggatttagggtttgttatttgggcgttaggggtcgtcgtcggggagtcggagcgggtaggatttttttttcgtcgattgcggttcgagagcgttttcgcggggtggagcggtagtcgttttttgcgggcggttgagtgttcgtttcgcgttcggagcgggcgatcgt

SEQ ID NO: 18312 - DNA, 657 bp, Artificial Sequence
  chemically treated genomic DNA (Homo sapiens) CpG-island No: 18312
acgatcgcccgctccgaacgcgaaacgaacactcaaccgcccgcaaaaaacgactaccgctccaccccgcgaaaacgctctcgaaccgcaatcgacgaaaaaaaaatcctacccgctccgactccccgacgacgacccctaacgcccaaataacaaaccctaaatccgacgcaccgcgcgaaaacgaaaacaaaaaaccgaaaacaaacgaaacgactctcgacccgacgacctcgccctccccgctactcctcctcccgctccgatacgacgacgacgaaccccacgaccgcgctaccgcgacgactcccgcttctctttaccgatctaatacactaacttcttcctacttataaccaaaacctacgccgccgcgaaacatacccaatctttacgtccgctaactcgccgctcctaaacgcgatcctacgctccaaattttataaactacgaacgaaaacgaaaaaaaaaaacgatacaacgacgaaaacgtaacctaaaacccgataaaaaccgcgaaaactcaaaaaacgtatacaaaaataattaaatcgcaattaaaaaaaacaactcgcgaaaaaaaaacgtacgatcgacctcgctttacgcaaacgcgacatatcaaaatacattttttttcctaatcaaaaaaaataa

SEQ ID NO: 18313 - DNA, 591 bp, Artificial Sequence
  chemically treated genomic DNA (Homo sapiens) CpG-island No: 18313
agggattgcgttttcgtttttaggatcgttaatattttcgtttcgtttagtgggttttcgttttcgttttatttgaggatttcggagaggttgtattacggtttagtcgtcgttttgggtcgcgttttttcggcggttggttcggagggggtttaagttgagtaaatttttttttcgattcgtcggggttttgttatcgttttcgggagacgtggaagggaagcgaggattttataatagagtggttttcgagttgtttgtacggtagggagacgcgaatagttatttgtaggcgatttaggcggtggcgttggcggttacggggttttcgcgtatggttacgtttttttttcgttcgcggcgagaataggcgcggcgtatggtttgcgtgcgtgtgacgtggttcgtcgtcggtggacggttcgtacgtcgtgaaaggttatatttataaagggcggggttttattgcgggttacgtgggtgattaaaggcggtgtttagtttggaaggaacgcgaggtttgagttgggcggggtttgagattcgggtggatcggttagatttcgtgtttttttttttttttattatttt

SEQ ID NO: 18314 - DNA, 591 bp, Artificial Sequence
  chemically treated genomic DNA (Homo sapiens) CpG-island No: 18314
aaaataataaaaaaaaaaaaaaacacgaaatctaaccgatccacccgaatctcaaaccccgcccaactcaaacctcgcgttccttccaaactaaacaccgcctttaatcacccacgtaacccgcaataaaaccccgccctttataaatataacctttcacgacgtacgaaccgtccaccgacgacgaaccacgtcacacgcacgcaaaccatacgccgcgcctattctcgccgcgaacgaaaaaaaaacgtaaccatacgcgaaaaccccgtaaccgccaacgccaccgcctaaatcgcctacaaataactattcgcgtctccctaccgtacaaacaactcgaaaaccactctattataaaatcctcgcttcccttccacgtctcccgaaaacgataacaaaaccccgacgaatcgaaaaaaaaatttactcaacttaaaccccctccgaaccaaccgccgaaaaaacgcgacccaaaacgacgactaaaccgtaatacaacctctccgaaatcctcaaataaaacgaaaacgaaaacccactaaacgaaacgaaaatattaacgatcctaaaaacgaaaacgcaatccct

SEQ ID NO: 18315 - DNA, 591 bp, Artificial Sequence
  chemically treated genomic DNA (Homo sapiens) CpG-island No: 18315
gagatggtgaggaaagggagaaatacgaggtttagtcggtttattcgggttttaagtttcgtttaatttaggtttcgcgttttttttaggttgggtatcgtttttggttatttacgtggttcgtagtaaggtttcgttttttgtgggtgtggttttttacggcgtgcgggtcgtttatcggcggcgagttacgttatacgtacgtaggttatgcgtcgcgtttgttttcgtcgcgggcggaaaaggggcgtggttatgcgcgaggatttcgtagtcgttagcgttatcgtttgagtcgtttgtaggtggttgttcgcgtttttttgtcgtgtaggtagttcgaaagttattttgttgtggggttttcgttttttttttacgtttttcggaagcggtagtagggtttcggcgggtcggggaggaggtttatttagtttgggtttttttcgggttagtcgtcgagggggcgcggtttaggacggcggttaggtcgtagtgtagttttttcggagtttttaggtgaggcggaggcgagggtttattggacgagacgggggtgttaacggttttaggagcgggggcgtagttttt

SEQ ID NO: 18316 - DNA, 591 bp, Artificial Sequence
  chemically treated genomic DNA (Homo sapiens) CpG-island No: 18316
aaaaactacgcccccgctcctaaaaccgttaacacccccgtctcgtccaataaaccctcgcctccgcctcacctaaaaactccgaaaaaactacactacgacctaaccgccgtcctaaaccgcgccccctcgacgactaacccgaaaaaaacccaaactaaataaacctcctccccgacccgccgaaaccctactaccgcttccgaaaaacgtaaaaaaaaaacgaaaaccccacaacaaaataactttcgaactacctacacgacaaaaaaacgcgaacaaccacctacaaacgactcaaacgataacgctaacgactacgaaatcctcgcgcataaccacgccccttttccgcccgcgacgaaaacaaacgcgacgcataacctacgtacgtataacgtaactcgccgccgataaacgacccgcacgccgtaaaaaaccacacccacaaaaaacgaaaccttactacgaaccacgtaaataaccaaaaacgatacccaacctaaaaaaaacgcgaaacctaaattaaacgaaacttaaaacccgaataaaccgactaaacctcgtatttctccctttcctcaccatctc

SEQ ID NO: 18317 - DNA, 778 bp, Artificial Sequence
  chemically treated genomic DNA (Homo sapiens) CpG-island No: 18317
cgtttggtggcgttttttgttcgtagtttcgcgtcgttttaggtgagttttgcgcgttttttattttggggttcgcgggaggggttggagcgtaggcggagggtcggtcggggtaggggaggatcgggattcgggtttcgattgtagttttttcgcggtggggtcgtatttttaggtattttcgtcgtttttgttcgcgcgcggcgagcggtttttgggcgtgtcgttcggaggcgcggagtttgttcggcgcgttttagttttgtagattcggtttcggcggaggcggtcggatcgcggagatgcggggagggggtagggcgcggggtaggtgattttatttcgtttttgtttttttgtttcggggagtaatgatattacgcggttttttttaggcgtcgatataaagagcggggcggagaggtagttgcggggggagtcggcggtcgttgttgtcgtttagggttttggggtttcgtcggttaggttcgtcgttcgcggttagtgttttttttttttttttttttttgtcgtcgtttttttagtcgtcgtcgtttttttagtcgtcgtcgttcgcgtcgttcgcgtttttcgcgcgtttttgagttcgcgtcgggtcgcgtcggtttttttttatgcgggcggcgcgggttttgggaggggcgttcggagttagtcgcgtagtatgtattggggggttggttttgtttcgtttaggtcgtgcgtggtggatttgagttggaattagagtattttttttttcggttggtgggtcggg

SEQ ID NO: 18318 - DNA, 778 bp, Artificial Sequence
  chemically treated genomic DNA (Homo sapiens) CpG-island No: 18318
cccgacccaccaaccgaaaaaaaaaatactctaattccaactcaaatccaccacgcacgacctaaacgaaacaaaaccaaccccccaatacatactacgcgactaactccgaacgcccctcccaaaacccgcgccgcccgcataaaaaaaaaccgacgcgacccgacgcgaactcaaaaacgcgcgaaaaacgcgaacgacgcgaacgacgacgactaaaaaaacgacgacgactaaaaaaacgacgacaaaaaaaaaaaaaaaaaaaaaacactaaccgcgaacgacgaacctaaccgacgaaaccccaaaaccctaaacgacaacaacgaccgccgactccccccgcaactacctctccgccccgctctttatatcgacgcctaaaaaaaaccgcgtaatatcattactccccgaaacaaaaaaacaaaaacgaaataaaatcacctaccccgcgccctaccccctccccgcatctccgcgatccgaccgcctccgccgaaaccgaatctacaaaactaaaacgcgccgaacaaactccgcgcctccgaacgacacgcccaaaaaccgctcgccgcgcgcgaacaaaaacgacgaaaatacctaaaaatacgaccccaccgcgaaaaaactacaatcgaaacccgaatcccgatcctcccctaccccgaccgaccctccgcctacgctccaacccctcccgcgaaccccaaaataaaaaacgcgcaaaactcacctaaaacgacgcgaaactacgaacaaaaaacgccaccaaacg

SEQ ID NO: 18319 - DNA, 778 bp, Artificial Sequence
  chemically treated genomic DNA (Homo sapiens) CpG-island No: 18319
ttcggtttattagtcgaagaaggagatgttttggttttagtttagatttattacgtacggtttggacgaagtaaagttaattttttagtgtatgttgcgcggttggtttcgggcgttttttttagggttcgcgtcgttcgtatgggaaggggtcggcgcggttcggcgcgggtttagaggcgcgcggagggcgcgggcggcgcgggcggcggcgattgaggaggcggcggcgattgaggaggcggcggtagaggaggaggaggaggaagggtattggtcgcggacggcgggtttggtcggcggggttttagagttttgggcggtagtagcggtcgtcggtttttttcgtagttgttttttcgtttcgttttttgtgtcggcgtttggagaaggtcgcgtgatgttattgtttttcggggtagggaaatagaggcgggataaagttatttatttcgcgttttgtttttttttcgtattttcgcggttcggtcgttttcgtcggggtcggatttgtagggttgaggcgcgtcgggtaggtttcgcgttttcgggcggtacgtttaaaaatcgttcgtcgcgcgcgggtaagggcggcggaggtgtttggaaatgcggttttatcgcgaggaagttgtagtcggggttcggatttcggtttttttttatttcggtcggtttttcgtttgcgttttagtttttttcgcgggttttagagtagggaacgcgtaggatttatttggggcggcgcggagttgcgggtaggagacgttattaggcg

SEQ ID NO: 18320 - DNA, 778 bp, Artificial Sequence
  chemically treated genomic DNA (Homo sapiens) CpG-island No: 18320
cgcctaataacgtctcctacccgcaactccgcgccgccccaaataaatcctacgcgttccctactctaaaacccgcgaaaaaaactaaaacgcaaacgaaaaaccgaccgaaataaaaaaaaaccgaaatccgaaccccgactacaacttcctcgcgataaaaccgcatttccaaacacctccgccgcccttacccgcgcgcgacgaacgatttttaaacgtaccgcccgaaaacgcgaaacctacccgacgcgcctcaaccctacaaatccgaccccgacgaaaacgaccgaaccgcgaaaatacgaaaaaaaaacaaaacgcgaaataaataactttatcccgcctctatttccctaccccgaaaaacaataacatcacgcgaccttctccaaacgccgacacaaaaaacgaaacgaaaaaacaactacgaaaaaaaccgacgaccgctactaccgcccaaaactctaaaaccccgccgaccaaacccgccgtccgcgaccaatacccttcctcctcctcctcctctaccgccgcctcctcaatcgccgccgcctcctcaatcgccgccgcccgcgccgcccgcgccctccgcgcgcctctaaacccgcgccgaaccgcgccgaccccttcccatacgaacgacgcgaaccctaaaaaaaacgcccgaaaccaaccgcgcaacatacactaaaaaattaactttacttcgtccaaaccgtacgtaataaatctaaactaaaaccaaaacatctccttcttcgactaataaaccgaa

SEQ ID NO: 18321 - DNA, 1032 bp, Artificial Sequence
  chemically treated genomic DNA (Homo sapiens) CpG-island No: 18321
cggacggaaggttcgtagggttaacggaagcggagagaataggataaaaaggaaaggtcggagagtttttttagcggcgttcggtgttcgtagattttcgtataggtttttcgaatttattcgggtttcgtcgattttaaagaaagcgcgtttttttcgagagcgttttttcggttttttcgtcgcgcgtttcggttcgtagggcgggaggatttaggcggatagatttattttttcgcgtttggtgtgggtacggtgtcgtgtttcgcggcgtttgttagcgcgtataggtgggatcgtagtatagagaacgttttcgagcgttttgttttagtttcggcgtggggcgagtcgttcgcgttcgtattcgtattttttttttcgcgttcgaggagtcgggttgtatttcggagtcggcggagttggaggtcgcgggcggagcgcgggttgtttcggtagttttttttcggtattaggttcgagatttaacggtagttttttttgatcgtttttcggtcgcgcgttcgcgcgggtgttatggtcgagcggcggttttcgacgaagtttttcggagttgacggttttattttttagtttaaggggcggtagtagttttgagtagtagtaaggcggcggcggcggagggagcgcgggtggtagtcggcgtagaggcggatgtagaaggagatatcggtggttaggattcgcgcgatgggaagaggaaggcgtcggttatttataattagaacgtgggttgatcgtgacgttataatggcgcggttagttaatcgggattcgaaggatgaattaagcgttatgatgttatgcggttcgggagttaatcgcgggataatagaattttcgtgatcgtaaattttagaattcgatgcggtggagagtttaggtcggggttggtttttcggttttacgtgtttttgggaaattttttttttttttttttttaataagtttgcgtggaacgtagagtttgcgtaatagtttcggtgaagttgtcgatgttttgaattttgg

SEQ ID NO: 18322 - DNA, 1032 bp, Artificial Sequence
  chemically treated genomic DNA (Homo sapiens) CpG-island No: 18322
ccaaaattcaaaacatcgacaacttcaccgaaactattacgcaaactctacgttccacgcaaacttattaaaaaaaaaaaaaaaaaaaatttcccaaaaacacgtaaaaccgaaaaaccaaccccgacctaaactctccaccgcatcgaattctaaaatttacgatcacgaaaattctattatcccgcgattaactcccgaaccgcataacatcataacgcttaattcatccttcgaatcccgattaactaaccgcgccattataacgtcacgatcaacccacgttctaattataaataaccgacgccttcctcttcccatcgcgcgaatcctaaccaccgatatctccttctacatccgcctctacgccgactaccacccgcgctccctccgccgccgccgccttactactactcaaaactactaccgccccttaaactaaaaaataaaaccgtcaactccgaaaaacttcgtcgaaaaccgccgctcgaccataacacccgcgcgaacgcgcgaccgaaaaacgatcaaaaaaaactaccgttaaatctcgaacctaataccgaaaaaaaactaccgaaacaacccgcgctccgcccgcgacctccaactccgccgactccgaaatacaacccgactcctcgaacgcgaaaaaaaaaatacgaatacgaacgcgaacgactcgccccacgccgaaactaaaacaaaacgctcgaaaacgttctctatactacgatcccacctatacgcgctaacaaacgccgcgaaacacgacaccgtacccacaccaaacgcgaaaaaataaatctatccgcctaaatcctcccgccctacgaaccgaaacgcgcgacgaaaaaaccgaaaaaacgctctcgaaaaaaacgcgctttctttaaaatcgacgaaacccgaataaattcgaaaaacctatacgaaaatctacgaacaccgaacgccgctaaaaaaactctccgacctttcctttttatcctattctctccgcttccgttaaccctacgaaccttccgtccg

SEQ ID NO: 18323 - DNA, 1032 bp, Artificial Sequence
  chemically treated genomic DNA (Homo sapiens) CpG-island No: 18323
ttagagtttagggtatcgataattttatcggggttattgcgtaggttttgcgttttacgtaggtttattaggaagaaaggggaaaaaaattttttagagatacgtggaatcgaggggttaatttcggtttaggttttttatcgtatcggattttggaatttacgattacgaaagttttattgtttcgcgattggttttcgggtcgtatgatattatagcgtttgatttatttttcgggtttcgattggttggtcgcgttattgtgacgttacggttagtttacgttttgattgtagatagtcggcgtttttttttttttatcgcgcgggttttagttatcggtgtttttttttatattcgtttttgcgtcggttgttattcgcgtttttttcgtcgtcgtcgttttgttgttgtttaaagttgttgtcgttttttgggttaaaaggtaaagtcgttagtttcgggaaatttcgtcgggggtcgtcgttcggttatgatattcgcgcgagcgcgcggtcgggaagcggttagagagaattgtcgttaggtttcggatttggtgtcgagaaagagttgtcggggtaattcgcgtttcgttcgcggtttttagtttcgtcggtttcggggtatagttcggtttttcgggcgcggggaaaggggtgcgggtgcgggcgcgggcggttcgttttacgtcgaggttgaggtagggcgttcgggagcgttttttgtgttgcggttttatttgtgcgcgttgataggcgtcgcggggtacgatatcgtgtttatattagacgcggagggatggatttgttcgtttgggttttttcgttttgcgggtcggagcgcgcggcgggagagtcgggggagcgttttcggagggagcgcgttttttttggagtcggcgaaattcgggtgagttcgaagagtttgtgcgagggtttgcgggtatcgggcgtcgttggggggatttttcggttttttttttttgttttgtttttttcgttttcgttaattttgcggatttttcgttcg

SEQ ID NO: 18324 - DNA, 1032 bp, Artificial Sequence
  chemically treated genomic DNA (Homo sapiens) CpG-island No: 18324
cgaacgaaaaatccgcaaaattaacgaaaacgaaaaaaacaaaacaaaaaaaaaaaaccgaaaaatccccccaacgacgcccgatacccgcaaaccctcgcacaaactcttcgaactcacccgaatttcgccgactccaaaaaaaacgcgctccctccgaaaacgctcccccgactctcccgccgcgcgctccgacccgcaaaacgaaaaaacccaaacgaacaaatccatccctccgcgtctaatataaacacgatatcgtaccccgcgacgcctatcaacgcgcacaaataaaaccgcaacacaaaaaacgctcccgaacgccctacctcaacctcgacgtaaaacgaaccgcccgcgcccgcacccgcacccctttccccgcgcccgaaaaaccgaactataccccgaaaccgacgaaactaaaaaccgcgaacgaaacgcgaattaccccgacaactctttctcgacaccaaatccgaaacctaacgacaattctctctaaccgcttcccgaccgcgcgctcgcgcgaatatcataaccgaacgacgacccccgacgaaatttcccgaaactaacgactttaccttttaacccaaaaaacgacaacaactttaaacaacaacaaaacgacgacgacgaaaaaaacgcgaataacaaccgacgcaaaaacgaatataaaaaaaaacaccgataactaaaacccgcgcgataaaaaaaaaaaaacgccgactatctacaatcaaaacgtaaactaaccgtaacgtcacaataacgcgaccaaccaatcgaaacccgaaaaataaatcaaacgctataatatcatacgacccgaaaaccaatcgcgaaacaataaaactttcgtaatcgtaaattccaaaatccgatacgataaaaaacctaaaccgaaattaacccctcgattccacgtatctctaaaaaatttttttcccctttcttcctaataaacctacgtaaaacgcaaaacctacgcaataaccccgataaaattatcgataccctaaactctaa

SEQ ID NO: 18325 - DNA, 621 bp, Artificial Sequence
  chemically treated genomic DNA (Homo sapiens) CpG-island No: 18325
cgttcgggataggagggtaagtgtaggcgatgggggagggggttgtgtttcgaggattttttgtgggaatttacgaaggcgtacggagttttagtttcggttttcgttgtacgttcggtttgttagttttggatattttaaattttggcggtcgggacggtcgagtggattgtattgcgagttggcgggcgcgcgtagaggttttaggttgtaagcgtttcgcggggtgggtagacgcgattcgtcgatgcgttcgtcgggttcgggtatagggggcgttttttttttggtttcgttttgtagcgggcgtttttcgtcgtcggagtttagggtagttgtcgcgttcgtcggtggttaagacggaggcggtagttcggaggtttaggttattcgcgtttggttatacgttttattttttttcgcgtttttttgttatatttttcgttttattatatataagggtttaaatttttcgagcgttttttgtttggaggcgcggaggtagtgggagtcgttattttcggggttcgtgtagtttaggcgggtagtgaggatgagcgtgttattttggattgcgcgttggtttgttgtttttgtatttaatttagcgtttgatattaa

SEQ ID NO: 18326 - DNA, 621 bp, Artificial Sequence
  chemically treated genomic DNA (Homo sapiens) CpG-island No: 18326
ttaatatcaaacgctaaattaaatacaaaaacaacaaaccaacgcgcaatccaaaataacacgctcatcctcactacccgcctaaactacacgaaccccgaaaataacgactcccactacctccgcgcctccaaacaaaaaacgctcgaaaaatttaaacccttatatataataaaacgaaaaatataacaaaaaaacgcgaaaaaaaataaaacgtataaccaaacgcgaataacctaaacctccgaactaccgcctccgtcttaaccaccgacgaacgcgacaactaccctaaactccgacgacgaaaaacgcccgctacaaaacgaaaccaaaaaaaaaacgccccctatacccgaacccgacgaacgcatcgacgaatcgcgtctacccaccccgcgaaacgcttacaacctaaaacctctacgcgcgcccgccaactcgcaatacaatccactcgaccgtcccgaccgccaaaatttaaaatatccaaaactaacaaaccgaacgtacaacgaaaaccgaaactaaaactccgtacgccttcgtaaattcccacaaaaaatcctcgaaacacaaccccctcccccatcgcctacacttaccctcctatcccgaacg

SEQ ID NO: 18327 - DNA, 621 bp, Artificial Sequence
  chemically treated genomic DNA (Homo sapiens) CpG-island No: 18327
ttagtgttaggcgttgggttaggtgtagaggtagtaggttagcgcgtagtttagagtagtacgtttatttttattgttcgtttaggttatacgaatttcggaggtggcggtttttattgttttcgcgtttttaaataaagggcgttcggagagtttgagtttttgtgtgtggtggggcggagggtgtggtaggagggcgcgggaagaaatgaggcgtgtagttagacgcgggtggtttaagttttcgagttgtcgttttcgttttagttatcggcgggcgcgatagttgttttgagtttcggcggcgaggggcgttcgttgtaaagcgaaattaaggaaagggcgttttttatgttcgagttcggcgagcgtatcggcgagtcgcgtttgtttatttcgcggagcgtttgtagtttagggtttttgcgcgcgttcgttagttcgtagtgtagtttattcggtcgtttcggtcgttaggatttagggtgtttagggttggtaggtcgggcgtgtagcgagggtcggggttgaggtttcgtgcgttttcgtgggtttttatagagggttttcgaaatatagtttttttttttatcgtttatatttgtttttttgtttcgagcg

SEQ ID NO: 18328 - DNA, 621 bp, Artificial Sequence
  chemically treated genomic DNA (Homo sapiens) CpG-island No: 18328
cgctcgaaacaaaaaaacaaatataaacgataaaaaaaaaaactatatttcgaaaaccctctataaaaacccacgaaaacgcacgaaacctcaaccccgaccctcgctacacgcccgacctaccaaccctaaacaccctaaatcctaacgaccgaaacgaccgaataaactacactacgaactaacgaacgcgcgcaaaaaccctaaactacaaacgctccgcgaaataaacaaacgcgactcgccgatacgctcgccgaactcgaacataaaaaacgccctttccttaatttcgctttacaacgaacgcccctcgccgccgaaactcaaaacaactatcgcgcccgccgataactaaaacgaaaacgacaactcgaaaacttaaaccacccgcgtctaactacacgcctcatttcttcccgcgccctcctaccacaccctccgccccaccacacacaaaaactcaaactctccgaacgccctttatttaaaaacgcgaaaacaataaaaaccgccacctccgaaattcgtataacctaaacgaacaataaaaataaacgtactactctaaactacgcgctaacctactacctctacacctaacccaacgcctaacactaa

SEQ ID NO: 18329 - DNA, 1056 bp, Artificial Sequence
  chemically treated genomic DNA (Homo sapiens) CpG-island No: 18329
tttcgtttaacgagtgtttcgttaaggtgtcgcgcgacgataagaagtcgggtaagggtagttattggacgttggattcggatttttataatatgttcgagaacggtagttttttgcggcggcggcggcgttttaagaagaaggacgcggtgaaggataaggaggagaaggataggttgtattttaaggagtcgttttcgttcggtcgttagttttcgttcgcgtcgtcggagtaggtcgacggtaacgcgttcggttcgtagtcgtcgttcgtgcgtatttaggatattaagatcgagaacggtacgtgtttttcgtcgttttagtttttgttttcggtcgtcgttttgggtagcggtagcgtcgtcgcggtgtttaagatcgagagtttcgatagtagtagtagtagtttgtttagcgggagtagtttttcgggtagtttgtcgtcggcgcggtcgtttagtttggacggtgcggatttcgcgtcgtcgtcgttcgcgtttttcgtttcgtcgtcgtattatagttagggttttagcgtggataatattatgacgtcgttgcgggggtcgtcgtagagcgcggtcgcggagtttagtttcggttttttggtttcggcggtcgcgttttcgcgcgcggggatcgtattttcgttggcgttcggcgtttattcgttcggttagagttttttttatagttttttttgtagttagatttttagcgcgggtagttcgggcggcggcggcggcgcgggggtcgcggggggcgcgggcggcgtcgggatttattattgtaatttgtaagttatgagtttgtacgcggtcggcgagcgcgggggttatttgtagggcgcgttcgggggcgcgggcggttcggtcgtggacgattttttgttcgattattttttgttttcggttattagtagtagttcgtcgtttttgagttacggcggcggcggcggcggcggcgggggaggttaggaggtcggttattattttgcggtttattaaggtcgttttatttcgtggtatttgaattaggcgggcggagatttgg

SEQ ID NO: 18330 - DNA, 1056 bp, Artificial Sequence
  chemically treated genomic DNA (Homo sapiens) CpG-island No: 18330
ccaaatctccgcccgcctaattcaaataccacgaaataaaacgaccttaataaaccgcaaaataataaccgacctcctaacctcccccgccgccgccgccgccgccgccgtaactcaaaaacgacgaactactactaataaccgaaaacaaaaaataatcgaacaaaaaatcgtccacgaccgaaccgcccgcgcccccgaacgcgccctacaaataacccccgcgctcgccgaccgcgtacaaactcataacttacaaattacaataataaatcccgacgccgcccgcgccccccgcgacccccgcgccgccgccgccgcccgaactacccgcgctaaaaatctaactacaaaaaaaactataaaaaaaactctaaccgaacgaataaacgccgaacgccaacgaaaatacgatccccgcgcgcgaaaacgcgaccgccgaaaccaaaaaaccgaaactaaactccgcgaccgcgctctacgacgacccccgcaacgacgtcataatattatccacgctaaaaccctaactataatacgacgacgaaacgaaaaacgcgaacgacgacgacgcgaaatccgcaccgtccaaactaaacgaccgcgccgacgacaaactacccgaaaaactactcccgctaaacaaactactactactactatcgaaactctcgatcttaaacaccgcgacgacgctaccgctacccaaaacgacgaccgaaaacaaaaactaaaacgacgaaaaacacgtaccgttctcgatcttaatatcctaaatacgcacgaacgacgactacgaaccgaacgcgttaccgtcgacctactccgacgacgcgaacgaaaactaacgaccgaacgaaaacgactccttaaaatacaacctatccttctcctccttatccttcaccgcgtccttcttcttaaaacgccgccgccgccgcaaaaaactaccgttctcgaacatattataaaaatccgaatccaacgtccaataactacccttacccgacttcttatcgtcgcgcgacaccttaacgaaacactcgttaaacgaaa

SEQ ID NO: 18331 - DNA, 1056 bp, Artificial Sequence
  chemically treated genomic DNA (Homo sapiens) CpG-island No: 18331
ttaggttttcgttcgtttggtttaggtattacgaggtgaggcggttttggtgggtcgtagggtggtggtcggttttttggtttttttcgtcgtcgtcgtcgtcgtcgtcgtgatttagggacgacgagttgttgttggtgatcggaggtagagagtagtcgggtagggggtcgtttacggtcgagtcgttcgcgttttcgggcgcgttttgtaagtggttttcgcgttcgtcggtcgcgtataggtttatggtttgtaggttgtagtggtaggtttcggcgtcgttcgcgtttttcgcggttttcgcgtcgtcgtcgtcgttcgagttgttcgcgttggaggtttggttgtagggggagttgtagagggagttttggtcgggcgagtaggcgtcgagcgttagcgggggtgcgattttcgcgcgcgaggacgcggtcgtcgaggttagaaggtcggagttgagtttcgcggtcgcgttttgcggcgattttcgtagcgacgttatgatgttgtttacgttgaagttttggttatggtgcggcggcggggcggagggcgcgggcggcggcggcgcggaattcgtatcgtttaggttgagcggtcgcgtcgacggtaggttgttcggggggttgttttcgttggataggttgttgttgttgttgtcggggttttcgattttgggtatcgcggcggcgttgtcgttgtttagggcggcggtcggggataggggttggggcggcgaggggtacgtatcgttttcggttttgatgttttggatgcgtacgggcggcggttgcggatcgggcgcgttgtcgtcggtttgtttcggcggcgcgggcgggggttggcggtcgggcgggggcggttttttgaggtgtagtttgttttttttttttttgttttttatcgcgtttttttttttgaagcgtcgtcgtcgtcgtaggaagttgtcgttttcgaatatgttgtaggagttcgggtttagcgtttagtagttgtttttgttcggttttttgtcgtcgcgcggtattttgacgaagtattcgttgagcgaga

SEQ ID NO: 18332 - DNA, 1056 bp, Artificial Sequence
  chemically treated genomic DNA (Homo sapiens) CpG-island No: 18332
tctcgctcaacgaatacttcgtcaaaataccgcgcgacgacaaaaaaccgaacaaaaacaactactaaacgctaaacccgaactcctacaacatattcgaaaacgacaacttcctacgacgacgacgacgcttcaaaaaaaaaaacgcgataaaaaacaaaaaaaaaaaaaacaaactacacctcaaaaaaccgcccccgcccgaccgccaacccccgcccgcgccgccgaaacaaaccgacgacaacgcgcccgatccgcaaccgccgcccgtacgcatccaaaacatcaaaaccgaaaacgatacgtacccctcgccgccccaacccctatccccgaccgccgccctaaacaacgacaacgccgccgcgatacccaaaatcgaaaaccccgacaacaacaacaacaacctatccaacgaaaacaaccccccgaacaacctaccgtcgacgcgaccgctcaacctaaacgatacgaattccgcgccgccgccgcccgcgccctccgccccgccgccgcaccataaccaaaacttcaacgtaaacaacatcataacgtcgctacgaaaatcgccgcaaaacgcgaccgcgaaactcaactccgaccttctaacctcgacgaccgcgtcctcgcgcgcgaaaatcgcacccccgctaacgctcgacgcctactcgcccgaccaaaactccctctacaactccccctacaaccaaacctccaacgcgaacaactcgaacgacgacgacgacgcgaaaaccgcgaaaaacgcgaacgacgccgaaacctaccactacaacctacaaaccataaacctatacgcgaccgacgaacgcgaaaaccacttacaaaacgcgcccgaaaacgcgaacgactcgaccgtaaacgaccccctacccgactactctctacctccgatcaccaacaacaactcgtcgtccctaaatcacgacgacgacgacgacgacgacgaaaaaaaccaaaaaaccgaccaccaccctacgacccaccaaaaccgcctcacctcgtaatacctaaaccaaacgaacgaaaacctaa

SEQ ID NO: 18333 - DNA, 834 bp, Artificial Sequence
  chemically treated genomic DNA (Homo sapiens) CpG-island No: 18333
gttagtttcgttgggtttttcgcgggttgggtcggggtgtcgggaagcgcgcgttgagggagggtggtaggcgcgcggtgtcggggacggggacggggcggggggcgtcgagtcgggagaagcgttttcggggtttcggtcgagaagttcggaggagttcgttttttcgttcggttatttcgcgttttcgtttggcgtcgtagggtttcgtcgagtttttatttttttttcgttggttttttttgttgtgaagacgtacgtgtgtttaggagcgtagttggggtggaaaggttagaggtattttattgtttacgggtgatagttcgtttcgcgtcggttcgtagtttttaggcgcgggattcggagttgcgcgtttgtagggttattttcggtttattcgtttcggtttggtcgtattagatttgttcgggtcggcgttgcggttttaggcggttttttcggtagggttgcgttttcgcgcggtgtgtgaggtttgtagaggttattagtcgtttggtagtggtcgtgcggggagtcgttcggttttaaggatgttagaagttttcgggcgagttgtaggtttagcgtgtttcgagtttacgtgtttgcgattttttattttttttgggtttcggttttgcggttcggaggaggtggcggtcgtagttagtttcggtttaggtttaggtcggtagtggaaagttcggcgggtttttttgtatcgtttttagcggcgggagcgagttgggaaagagtcgattcgttttcggttgggggttttgtcgagtttggtttgtcgaggagtgggtcgagagtagtttttgtttttttttg

SEQ ID NO: 18334 - DNA, 834 bp, Artificial Sequence
  chemically treated genomic DNA (Homo sapiens) CpG-island No: 18334
caaaaaaaaacaaaaactactctcgacccactcctcgacaaaccaaactcgacaaaacccccaaccgaaaacgaatcgactctttcccaactcgctcccgccgctaaaaacgatacaaaaaaacccgccgaactttccactaccgacctaaacctaaaccgaaactaactacgaccgccacctcctccgaaccgcaaaaccgaaacccaaaaaaaataaaaaatcgcaaacacgtaaactcgaaacacgctaaacctacaactcgcccgaaaacttctaacatccttaaaaccgaacgactccccgcacgaccactaccaaacgactaataacctctacaaacctcacacaccgcgcgaaaacgcaaccctaccgaaaaaaccgcctaaaaccgcaacgccgacccgaacaaatctaatacgaccaaaccgaaacgaataaaccgaaaataaccctacaaacgcgcaactccgaatcccgcgcctaaaaactacgaaccgacgcgaaacgaactatcacccgtaaacaataaaatacctctaacctttccaccccaactacgctcctaaacacacgtacgtcttcacaacaaaaaaaaccaacgaaaaaaaaataaaaactcgacgaaaccctacgacgccaaacgaaaacgcgaaataaccgaacgaaaaaacgaactcctccgaacttctcgaccgaaaccccgaaaacgcttctcccgactcgacgccccccgccccgtccccgtccccgacaccgcgcgcctaccaccctccctcaacgcgcgcttcccgacaccccgacccaacccgcgaaaaacccaacgaaactaac

SEQ ID NO: 18335 - DNA, 834 bp, Artificial Sequence
  chemically treated genomic DNA (Homo sapiens) CpG-island No: 18335
taaggaaggataggggttgttttcggtttatttttcggtaggttagattcggtagggtttttagtcgggagcgggtcgatttttttttagttcgttttcgtcgttgggaacggtgtagaaaagttcgtcgagttttttattgtcgatttgggtttaggtcggggttgattgcggtcgttatttttttcgggtcgtaaagtcgagatttaaggagagtggagagtcgtaggtacgtgggttcggaatacgttgagtttgtagttcgttcgagggtttttggtatttttgaggtcgagcgatttttcgtacggttattgttaagcgattggtggtttttgtaaattttatatatcgcgcgaggacgtagttttgtcggggaggtcgtttggggtcgtagcgtcggttcgggtaggtttggtgcggttaggtcgaggcgggtgggtcgggggtggttttgtaaacgcgtagtttcgggtttcgcgtttggaggttgcgggtcggcgcggggcgagttgttattcgtgagtaatgaagtgtttttgatttttttattttagttgcgtttttaaatatacgtgcgtttttataataaaggaggttagcgaggaggaagtgagagttcggcggggttttgcggcgttaggcggagacgcggggtgatcgggcgagggagcgggttttttcgagtttttcggtcggagtttcgagggcgtttttttcggttcggcgtttttcgtttcgttttcgttttcggtatcgcgcgtttgttatttttttttagcgcgcgtttttcggtatttcgatttagttcgcgaggaatttagcgaaattaat

SEQ ID NO: 18336 - DNA, 834 bp, Artificial Sequence
  chemically treated genomic DNA (Homo sapiens) CpG-island No: 18336
attaatttcgctaaattcctcgcgaactaaatcgaaataccgaaaaacgcgcgctaaaaaaaaataacaaacgcgcgataccgaaaacgaaaacgaaacgaaaaacgccgaaccgaaaaaaacgccctcgaaactccgaccgaaaaactcgaaaaaacccgctccctcgcccgatcaccccgcgtctccgcctaacgccgcaaaaccccgccgaactctcacttcctcctcgctaacctcctttattataaaaacgcacgtatatttaaaaacgcaactaaaataaaaaaatcaaaaacacttcattactcacgaataacaactcgccccgcgccgacccgcaacctccaaacgcgaaacccgaaactacgcgtttacaaaaccacccccgacccacccgcctcgacctaaccgcaccaaacctacccgaaccgacgctacgaccccaaacgacctccccgacaaaactacgtcctcgcgcgatatataaaatttacaaaaaccaccaatcgcttaacaataaccgtacgaaaaatcgctcgacctcaaaaataccaaaaaccctcgaacgaactacaaactcaacgtattccgaacccacgtacctacgactctccactctccttaaatctcgactttacgacccgaaaaaaataacgaccgcaatcaaccccgacctaaacccaaatcgacaataaaaaactcgacgaacttttctacaccgttcccaacgacgaaaacgaactaaaaaaaaatcgacccgctcccgactaaaaaccctaccgaatctaacctaccgaaaaataaaccgaaaacaacccctatccttcctta

SEQ ID NO: 18337 - DNA, 500 bp, Artificial Sequence
  chemically treated genomic DNA (Homo sapiens) CpG-island No: 18337
tacgtttttttgttcgcggttcgttattttcgttcgggtttcgggttgtgtagtttttttttaggtttgttcgggtttatgtttttttcgaagcggcgggagtcggtgtagttttaatttttattgcgtgttttaggtcgttaattagttttgttcgcgtgtcgttggttcggaggttgtcgcgttagtttttgcgtgcgtttgagcgcgttggagtatttgcgaggttagggttgtcgacggcgagaggatattttgaggaatacggtgttttagtttcgttttcgtttttcgttcgagttggaggttggggcgcgttgagtcgtagcgtttggataagtgcgcgggtcggagtcgtttaggtttgtattcgggggttcgcggtcgacgtatgcgtacgcgcggtggcgggtttgtaggttcgaaggttcggttttttttttaaattcggagcggggaagtttaggggttgagagtttcggttcgggtcgtaggagttg

SEQ ID NO: 18338 - DNA, 500 bp, Artificial Sequence
  chemically treated genomic DNA (Homo sapiens) CpG-island No: 18338
caactcctacgacccgaaccgaaactctcaacccctaaacttccccgctccgaatttaaaaaaaaaaccgaaccttcgaacctacaaacccgccaccgcgcgtacgcatacgtcgaccgcgaacccccgaatacaaacctaaacgactccgacccgcgcacttatccaaacgctacgactcaacgcgccccaacctccaactcgaacgaaaaacgaaaacgaaactaaaacaccgtattcctcaaaatatcctctcgccgtcgacaaccctaacctcgcaaatactccaacgcgctcaaacgcacgcaaaaactaacgcgacaacctccgaaccaacgacacgcgaacaaaactaattaacgacctaaaacacgcaataaaaattaaaactacaccgactcccgccgcttcgaaaaaaacataaacccgaacaaacctaaaaaaaaactacacaacccgaaacccgaacgaaaataacgaaccgcgaacaaaaaaacgta

SEQ ID NO: 18339 - DNA, 500 bp, Artificial Sequence
  chemically treated genomic DNA (Homo sapiens) CpG-island No: 18339
tagtttttgcgattcgggtcgaggtttttagtttttgggttttttcgtttcgggtttgagggaggggtcgggttttcgggtttgtagattcgttatcgcgcgtgcgtatgcgtcggtcgcgagttttcgggtgtaggtttgggcggtttcggttcgcgtatttgtttaggcgttgcggtttagcgcgttttaatttttagttcgggcggagagcgggggcgggattgaagtatcgtgttttttaaagtattttttcgtcgtcggtagttttggtttcgtaaatgttttagcgcgtttaggcgtacgtagagattggcgcggtagttttcgggttaacggtacgcgagtaaagttggttggcgatttgggatacgtagtagaagttgaggttgtatcgattttcgtcgtttcgggggaggtatgggttcgggtaggtttaggaggaagttgtatagttcgaggttcgggcgggagtggcgggtcgcgggtaagggaacgta

SEQ ID NO: 18340 - DNA, 500 bp, Artificial Sequence
  chemically treated genomic DNA (Homo sapiens) CpG-island No: 18340
tacgttcccttacccgcgacccgccactcccgcccgaacctcgaactatacaacttcctcctaaacctacccgaacccatacctcccccgaaacgacgaaaatcgatacaacctcaacttctactacgtatcccaaatcgccaaccaactttactcgcgtaccgttaacccgaaaactaccgcgccaatctctacgtacgcctaaacgcgctaaaacatttacgaaaccaaaactaccgacgacgaaaaaatactttaaaaaacacgatacttcaatcccgcccccgctctccgcccgaactaaaaattaaaacgcgctaaaccgcaacgcctaaacaaatacgcgaaccgaaaccgcccaaacctacacccgaaaactcgcgaccgacgcatacgcacgcgcgataacgaatctacaaacccgaaaacccgacccctccctcaaacccgaaacgaaaaaacccaaaaactaaaaacctcgacccgaatcgcaaaaacta

SEQ ID NO: 18341 - DNA, 692 bp, Artificial Sequence
  chemically treated genomic DNA (Homo sapiens) CpG-island No: 18341
cgtcgtcgtagtcgtatttatgtcgagtttgggagaagttttaagtagttttgtaaagagttgtcggggggatcgtcgcgaaatttacgacggaggagcgggtcgggtttcgcggggtgaggacggtgagaggatagtcgttcgttcgtttttttttttttttcgcggtcgttaaattattttaggggcgaaagcgtcgttagcgtcgtcggtcggtcgcggcggtagttttttatgttcggcggaggttgtttttgttagttaagagttattttgttcggggagggacgggggcggagtcgggggtgacgtcgtttcgcgggtttcgggcgtttttgaggaatgcgggttcgggcgcggcgtcgttatcgttttttgtcggagagacgcgcgttagtttcggtcgcgcgtttcgcgtcgtttttgttcgtagtttgggtttcgtcgttagtcgttgttcggagggagcgagcgagaaaggggagtcggcgtagttcgttgttttgttttagaatttagaatttgagaggcgagagttcggtaagtcgtgcgattagacgatcgaggacgcgcgtagagaaattttcgtcgttcgaggagaggcgttttggggtttcgttttaaggtggaggttttttcgagcggttgttgattgaaaggggagtgtggaagcgttttgaggaaatattcgt

SEQ ID NO: 18342 - DNA, 692 bp, Artificial Sequence
  chemically treated genomic DNA (Homo sapiens) CpG-island No: 18342
acgaatatttcctcaaaacgcttccacactcccctttcaatcaacaaccgctcgaaaaaacctccaccttaaaacgaaaccccaaaacgcctctcctcgaacgacgaaaatttctctacgcgcgtcctcgatcgtctaatcgcacgacttaccgaactctcgcctctcaaattctaaattctaaaacaaaacaacgaactacgccgactcccctttctcgctcgctccctccgaacaacgactaacgacgaaacccaaactacgaacaaaaacgacgcgaaacgcgcgaccgaaactaacgcgcgtctctccgacaaaaaacgataacgacgccgcgcccgaacccgcattcctcaaaaacgcccgaaacccgcgaaacgacgtcacccccgactccgcccccgtccctccccgaacaaaataactcttaactaacaaaaacaacctccgccgaacataaaaaactaccgccgcgaccgaccgacgacgctaacgacgctttcgcccctaaaataatttaacgaccgcgaaaaaaaaaaaaaaacgaacgaacgactatcctctcaccgtcctcaccccgcgaaacccgacccgctcctccgtcgtaaatttcgcgacgatccccccgacaactctttacaaaactacttaaaacttctcccaaactcgacataaatacgactacgacgacg

SEQ ID NO: 18343 - DNA, 692 bp, Artificial Sequence
  chemically treated genomic DNA (Homo sapiens) CpG-island No: 18343
gcgggtgtttttttagggcgtttttatattttttttttaattagtaatcgttcggggggatttttattttgggacggaattttaggacgttttttttcggacggcgggggtttttttgcgcgcgttttcggtcgtttggtcgtacggtttatcgaattttcgttttttaaattttgagttttggaatagggtagcgagttgcgtcggtttttttttttcgttcgtttttttcgagtagcggttggcggcggggtttaggttgcgaataaaggcggcgcggggcgcgcggtcggggttggcgcgcgttttttcggtaggaggcggtggcggcgtcgcgttcgagttcgtattttttagaagcgttcggagttcgcggggcgacgttattttcggtttcgttttcgttttttttcgagtaaagtaatttttgattaataggagtagttttcgtcgagtatggagagttgtcgtcgcggtcggtcggcgacgttggcgacgttttcgtttttgaggtagtttggcgatcgcgaagaaggaaaaagggcgggcgggcggttgtttttttatcgtttttatttcgcgaggttcggttcgttttttcgtcgtggatttcgcggcgattttttcggtagttttttgtaaagttgtttgaaattttttttaaattcggtatggatacgattgcggcggcg

SEQ ID NO: 18344 - DNA, 692 bp, Artificial Sequence
  chemically treated genomic DNA (Homo sapiens) CpG-island No: 18344
cgccgccgcaatcgtatccataccgaatttaaaaaaaatttcaaacaactttacaaaaaactaccgaaaaaatcgccgcgaaatccacgacgaaaaaacgaaccgaacctcgcgaaataaaaacgataaaaaaacaaccgcccgcccgccctttttccttcttcgcgatcgccaaactacctcaaaaacgaaaacgtcgccaacgtcgccgaccgaccgcgacgacaactctccatactcgacgaaaactactcctattaatcaaaaattactttactcgaaaaaaaacgaaaacgaaaccgaaaataacgtcgccccgcgaactccgaacgcttctaaaaaatacgaactcgaacgcgacgccgccaccgcctcctaccgaaaaaacgcgcgccaaccccgaccgcgcgccccgcgccgcctttattcgcaacctaaaccccgccgccaaccgctactcgaaaaaaacgaacgaaaaaaaaaaaccgacgcaactcgctaccctattccaaaactcaaaatttaaaaaacgaaaattcgataaaccgtacgaccaaacgaccgaaaacgcgcgcaaaaaaacccccgccgtccgaaaaaaaacgtcctaaaattccgtcccaaaataaaaatccccccgaacgattactaattaaaaaaaaaatataaaaacgccctaaaaaaacacccgc

SEQ ID NO: 18345 - DNA, 1117 bp, Artificial Sequence
  chemically treated genomic DNA (Homo sapiens) CpG-island No: 18345
cgggtaatttcgcgagcgtaggttgcgggacgaggatttttatgttcgtcgttttcgaattttcgttcgtttttgcggtttcggtgttgcggggacgtatttcgggcgttcgggtgtatggtttcggttagtcgaggggtcgcgcgacgattatagtcggcgtggagaaggcggcgggcgtcggtatttcgcggcgtttttaggttcgggttgcgtcgtcggggagggtttcgttttttatattttaatggggagaagttcgcgagcgatcggtcggtttttttttttattttagagatttcgcgtcgcggcgatttttttcgcgttttttacgttttcgttttcgcgtcggggagtcgtttggatttcggcgttcggcgcggggttttttgagggaacggagcgttgcgtggttttttttatttttttagcgcgttaggttttttatttcggaggagcggcggttgtttcgcggcgttttttcgcgtatgttcgtttcggttggtttagcgtcgcgggtttaggggttcggatatcgcgtaggcgttttttgttggttcgcgttttcgttagtattttgtttcgtatcggatcgtcgtcgtcgcggttgtcgtcgtcgtttttatatatagtataggtcgtcgggtcgtgaggtcgtcgcgtttcgtttcgttttttttcgtagttaattagggcgcgcgtcgtttaaaggggcgatgtcgtggtcgaggcgttgcgtcgggtttatcgtggcgtatcgcggcgttgtagggagtcggttttgtttttcggagaggcgttttcgggttgatcgcggtcgtagtttcgtttttttgtttgagtcgtgcggtagttttgggagttttttaacgtcgagttttttttagaagttcgcggcgattcgggtttcggtcgttgtttttgttcgaattgagggtatatcgcgtttcgcgcgggattttttataaatttaggtttcgggtaagattgtgtgttttttttttttcgcgggtcgtcgttggtcgtgtgggtcgaagaagttttggagggggagaggggagtcgttttcgattgggtttgcggcgtgggagggatagtgagggatatttagggattg

SEQ ID NO: 18346 - DNA, 1117 bp, Artificial Sequence
  chemically treated genomic DNA (Homo sapiens) CpG-island No: 18346
caatccctaaatatccctcactatccctcccacgccgcaaacccaatcgaaaacgactcccctctccccctccaaaacttcttcgacccacacgaccaacgacgacccgcgaaaaaaaaaaaacacacaatcttacccgaaacctaaatttataaaaaatcccgcgcgaaacgcgatataccctcaattcgaacaaaaacaacgaccgaaacccgaatcgccgcgaacttctaaaaaaaactcgacgttaaaaaactcccaaaactaccgcacgactcaaacaaaaaaacgaaactacgaccgcgatcaacccgaaaacgcctctccgaaaaacaaaaccgactccctacaacgccgcgatacgccacgataaacccgacgcaacgcctcgaccacgacatcgcccctttaaacgacgcgcgccctaattaactacgaaaaaaaacgaaacgaaacgcgacgacctcacgacccgacgacctatactatatataaaaacgacgacgacaaccgcgacgacgacgatccgatacgaaacaaaatactaacgaaaacgcgaaccaacaaaaaacgcctacgcgatatccgaacccctaaacccgcgacgctaaaccaaccgaaacgaacatacgcgaaaaaacgccgcgaaacaaccgccgctcctccgaaataaaaaacctaacgcgctaaaaaaataaaaaaaaccacgcaacgctccgttccctcaaaaaaccccgcgccgaacgccgaaatccaaacgactccccgacgcgaaaacgaaaacgtaaaaaacgcgaaaaaaatcgccgcgacgcgaaatctctaaaataaaaaaaaaaaccgaccgatcgctcgcgaacttctccccattaaaatataaaaaacgaaaccctccccgacgacgcaacccgaacctaaaaacgccgcgaaataccgacgcccgccgccttctccacgccgactataatcgtcgcgcgacccctcgactaaccgaaaccatacacccgaacgcccgaaatacgtccccgcaacaccgaaaccgcaaaaacgaacgaaaattcgaaaacgacgaacataaaaatcctcgtcccgcaacctacgctcgcgaaattacccg

SEQ ID NO: 18347 - DNA, 1117 bp, Artificial Sequence
  chemically treated genomic DNA (Homo sapiens) CpG-island No: 18347
tagtttttaagtgttttttattgttttttttacgtcgtaagtttagtcgagagcggtttttttttttttttttagggttttttcggtttatacggttagcggcggttcgcggagaggaaaaaatatataattttgttcggagtttgaatttatgggaaatttcgcgcgaagcgcgatgtgtttttagttcgggtaggaatagcggtcgaggttcgggtcgtcgcgggtttttgaggaaagttcggcgttgagaggtttttagggttgtcgtacggtttaggtagaggagcggagttgcggtcgcggttagttcggagacgttttttcgggagataaagtcggttttttgtagcgtcgcgatacgttacggtgggttcggcgtaacgtttcggttacggtatcgtttttttaagcggcgcgcgttttgattggttgcgggaggaggcggggcgggacgcggcgattttacggttcggcggtttatgttatatatagaggcggcggcggtagtcgcggcgacggcggttcggtgcgaggtagagtgttagcgggagcgcgagttagtaagaggcgtttgcgcgatgttcgggtttttgagttcgcggcgttgagttagtcgggacggatatgcgcgggagggcgtcgcggggtagtcgtcgttttttcggggtaaggggtttggcgcgttgagggggtggggagggttacgtagcgtttcgtttttttagggggtttcgcgtcgggcgtcgggatttaggcggtttttcgacgcgagggcgggggcgtggagggcgcggggagggtcgtcgcgacgcggagtttttgggatggagggagaggtcggtcggtcgttcgcgggtttttttttattgaggtgtggagagcgggatttttttcggcggcgtagttcgggtttggggacgtcgcgaagtgtcggcgttcgtcgttttttttacgtcggttgtggtcgtcgcgcggtttttcggttggtcggggttatgtattcgagcgttcgggatacgttttcgtagtatcgggatcgtaggagcggacgggggttcgggagcggcgagtatgaaggttttcgtttcgtagtttgcgttcgcggggttgttcg

SEQ ID NO: 18348 - DNA, 1117 bp, Artificial Sequence
  chemically treated genomic DNA (Homo sapiens) CpG-island No: 18348
cgaacaaccccgcgaacgcaaactacgaaacgaaaaccttcatactcgccgctcccgaacccccgtccgctcctacgatcccgatactacgaaaacgtatcccgaacgctcgaatacataaccccgaccaaccgaaaaaccgcgcgacgaccacaaccgacgtaaaaaaaacgacgaacgccgacacttcgcgacgtccccaaacccgaactacgccgccgaaaaaaatcccgctctccacacctcaataaaaaaaaacccgcgaacgaccgaccgacctctccctccatcccaaaaactccgcgtcgcgacgaccctccccgcgccctccacgcccccgccctcgcgtcgaaaaaccgcctaaatcccgacgcccgacgcgaaaccccctaaaaaaacgaaacgctacgtaaccctccccaccccctcaacgcgccaaaccccttaccccgaaaaaacgacgactaccccgcgacgccctcccgcgcatatccgtcccgactaactcaacgccgcgaactcaaaaacccgaacatcgcgcaaacgcctcttactaactcgcgctcccgctaacactctacctcgcaccgaaccgccgtcgccgcgactaccgccgccgcctctatatataacataaaccgccgaaccgtaaaatcgccgcgtcccgccccgcctcctcccgcaaccaatcaaaacgcgcgccgcttaaaaaaacgataccgtaaccgaaacgttacgccgaacccaccgtaacgtatcgcgacgctacaaaaaaccgactttatctcccgaaaaaacgtctccgaactaaccgcgaccgcaactccgctcctctacctaaaccgtacgacaaccctaaaaacctctcaacgccgaactttcctcaaaaacccgcgacgacccgaacctcgaccgctattcctacccgaactaaaaacacatcgcgcttcgcgcgaaatttcccataaattcaaactccgaacaaaattatatattttttcctctccgcgaaccgccgctaaccgtataaaccgaaaaaaccctaaaaaaaaaaaaaaaaaccgctctcgactaaacttacgacgtaaaaaaaacaataaaaaacacttaaaaacta

SEQ ID NO: 18349 - DNA, 780 bp, Artificial Sequence
  chemically treated genomic DNA (Homo sapiens) CpG-island No: 18349
gttcggcgacgtcgttttcggtaggttttttatggtcgggacgtatagttcgattttgaagacgttggaggatttgattttggatttcgggtatggggtcggggattcgtgtcgttcgtttagtttttcgttttttaagtttaattcgtaggcgtttaatttttcggcgtagtagtatcgcggggcggtttggtggtgttatttcggttttatgaatagtcgttataatagttgggatacggtgaatacggtgttgttcgaggatttcgaagtggtcgattttttttcgcgttgttcgcggtttttcgagttggaggagtttttttggatcgaaggagacgtggttcgggtgtttcgtaaaggcgttggcggtcggcggttgttttagtttttcgtcgaggcggtgaggcgtttggtcgggttgtttcgtagggtattgattcgcgtggttcgcgaggcgtagcgtttgagcgtgttgtacgttaagtgtattcgttttgaggtgtagagcgtcgtgcgtttggtgtatagttgggcgttggtcgagagttgcgcgttggtagtcgttaaggcgttgtttttgtatagtatgagcgtcggcgacgggttgcgtcggggtaagttcgcgcgttgcggttttatttttttagtgggtcgtttttttcgttggatggtggatattcgaattttcgtgcgtatttacgagtacgtagttattttttttatcgtttgtatggagaatttggtggaggagattcgggttagggtgatggttagtta

SEQ ID NO: 18350 - DNA, 780 bp, Artificial Sequence
  chemically treated genomic DNA (Homo sapiens) CpG-island No: 18350
taactaaccatcaccctaacccgaatctcctccaccaaattctccatacaaacgataaaaaaaataactacgtactcgtaaatacgcacgaaaattcgaatatccaccatccaacgaaaaaaacgacccactaaaaaaataaaaccgcaacgcgcgaacttaccccgacgcaacccgtcgccgacgctcatactatacaaaaacaacgccttaacgactaccaacgcgcaactctcgaccaacgcccaactatacaccaaacgcacgacgctctacacctcaaaacgaatacacttaacgtacaacacgctcaaacgctacgcctcgcgaaccacgcgaatcaataccctacgaaacaacccgaccaaacgcctcaccgcctcgacgaaaaactaaaacaaccgccgaccgccaacgcctttacgaaacacccgaaccacgtctccttcgatccaaaaaaactcctccaactcgaaaaaccgcgaacaacgcgaaaaaaaatcgaccacttcgaaatcctcgaacaacaccgtattcaccgtatcccaactattataacgactattcataaaaccgaaataacaccaccaaaccgccccgcgatactactacgccgaaaaattaaacgcctacgaattaaacttaaaaaacgaaaaactaaacgaacgacacgaatccccgaccccatacccgaaatccaaaatcaaatcctccaacgtcttcaaaatcgaactatacgtcccgaccataaaaaacctaccgaaaacgacgtcgccgaac

SEQ ID NO: 18351 - DNA, 780 bp, Artificial Sequence
  chemically treated genomic DNA (Homo sapiens) CpG-island No: 18351
tggttggttattattttggttcggattttttttattaggttttttatgtaggcggtgagggagatggttgcgtattcgtggatgcgtacggagattcgggtgtttattatttagcggaaaaagcgatttattgagaaggtgaggtcgtagcgcgcggatttgtttcggcgtagttcgtcgtcggcgtttatgttgtatagggatagcgttttgacggttgttagcgcgtagttttcggttagcgtttagttgtgtattaggcgtacggcgttttgtattttaaagcgggtgtatttggcgtgtagtacgtttaggcgttgcgtttcgcgggttacgcggattagtgttttgcggagtagttcggttaggcgttttatcgtttcggcggagaattggggtagtcgtcggtcgttagcgtttttgcggagtattcgggttacgtttttttcggtttaggggaatttttttagttcggggagtcgcggatagcgcgagaagaggtcggttatttcggggttttcgggtagtatcgtgtttatcgtgttttagttgttgtggcggttgtttatggagtcggagtagtattattaggtcgtttcgcggtgttgttgcgtcgaagagttgagcgtttgcgagttggatttggaggacgagaggttgagcgagcggtacgagttttcggttttatattcggagtttaaggttaagttttttagcgtttttagagtcgagttgtacgtttcggttatggggagtttgtcgagggcggcgtcgtcgagt

SEQ ID NO: 18352 - DNA, 780 bp, Artificial Sequence
  chemically treated genomic DNA (Homo sapiens) CpG-island No: 18352
actcgacgacgccgccctcgacaaactccccataaccgaaacgtacaactcgactctaaaaacgctaaaaaacttaaccttaaactccgaatataaaaccgaaaactcgtaccgctcgctcaacctctcgtcctccaaatccaactcgcaaacgctcaactcttcgacgcaacaacaccgcgaaacgacctaataatactactccgactccataaacaaccgccacaacaactaaaacacgataaacacgatactacccgaaaaccccgaaataaccgacctcttctcgcgctatccgcgactccccgaactaaaaaaattcccctaaaccgaaaaaaacgtaacccgaatactccgcaaaaacgctaacgaccgacgactaccccaattctccgccgaaacgataaaacgcctaaccgaactactccgcaaaacactaatccgcgtaacccgcgaaacgcaacgcctaaacgtactacacgccaaatacacccgctttaaaatacaaaacgccgtacgcctaatacacaactaaacgctaaccgaaaactacgcgctaacaaccgtcaaaacgctatccctatacaacataaacgccgacgacgaactacgccgaaacaaatccgcgcgctacgacctcaccttctcaataaatcgctttttccgctaaataataaacacccgaatctccgtacgcatccacgaatacgcaaccatctccctcaccgcctacataaaaaacctaataaaaaaaatccgaaccaaaataataaccaacca

SEQ ID NO: 18353 - DNA, 501 bp, Artificial Sequence
  chemically treated genomic DNA (Homo sapiens) CpG-island No: 18353
aggtggttcgcgggaggcggttgggaggcgggtttcgggttttcgcgtgtcggttacgagggagtcgcgtttataggtttttgagtgtagtgcgggtcggtaggtaacgttgggttcggtttttttttattttcgttggcggggattttcgttcgttttaggaggttttcgattttatagtatttcgtcgttttgggcgttcgttttttgtgaggttttttcggtgatattagttttttttttcgtttttattttgtgtgtttacgtcgagtagttgttaagtcgtttttttatgtcgtttttttttgttcgtagcgttattggcggtggtgtgtttagaaagtttcgaaaaacgcggtttcgtagatttggtttgtttttttagaacgcgttgcgttaaggcgtgttatttttttgtttggtttttaagtttatttttttaaagttcgggatgcgttcggatgtttttatcgttttttttttttgaggtgtttgtgtgtg

SEQ ID NO: 18354 - DNA, 501 bp, Artificial Sequence
  chemically treated genomic DNA (Homo sapiens) CpG-island No: 18354
cacacacaaacacctcaaaaaaaaaaaacgataaaaacatccgaacgcatcccgaactttaaaaaaataaacttaaaaaccaaacaaaaaaataacacgccttaacgcaacgcgttctaaaaaaacaaaccaaatctacgaaaccgcgtttttcgaaactttctaaacacaccaccgccaataacgctacgaacaaaaaaaaacgacataaaaaaacgacttaacaactactcgacgtaaacacacaaaataaaaacgaaaaaaaaaactaatatcaccgaaaaaacctcacaaaaaacgaacgcccaaaacgacgaaatactataaaatcgaaaacctcctaaaacgaacgaaaatccccgccaacgaaaataaaaaaaaaccgaacccaacgttacctaccgacccgcactacactcaaaaacctataaacgcgactccctcgtaaccgacacgcgaaaacccgaaacccgcctcccaaccgcctcccgcgaaccacct

SEQ ID NO: 18355 - DNA, 501 bp, Artificial Sequence
  chemically treated genomic DNA (Homo sapiens) CpG-island No: 18355
tatatataaatattttaggagaaaggaacggtgagggtattcgggcgtatttcgggttttagaaagatgggtttgaaaattagataaggaaatggtacgttttggcgtagcgcgttttgaaaggataggttaagtttgcggggtcgcgtttttcggggttttttagatatattatcgttaatgacgttgcggatagggaggaacgatatggagagacgatttggtagttgttcggcgtaaatatataaagtgagggcgggaagaggggttggtgttatcggagagattttatagaggacgggcgtttagagcggcgggatgttgtggggtcggaagttttttgaggcgaacggggattttcgttagcggagatgaggaaaggtcgggtttagcgttgtttgtcggttcgtattgtatttaaagatttatgggcgcggttttttcgtggtcgatacgcgagggttcgggattcgttttttagtcgtttttcgcgagttattt

SEQ ID NO: 18356 - DNA, 501 bp, Artificial Sequence
  chemically treated genomic DNA (Homo sapiens) CpG-island No: 18356
aaataactcgcgaaaaacgactaaaaaacgaatcccgaaccctcgcgtatcgaccacgaaaaaaccgcgcccataaatctttaaatacaatacgaaccgacaaacaacgctaaacccgacctttcctcatctccgctaacgaaaatccccgttcgcctcaaaaaacttccgaccccacaacatcccgccgctctaaacgcccgtcctctataaaatctctccgataacaccaacccctcttcccgccctcactttatatatttacgccgaacaactaccaaatcgtctctccatatcgttcctccctatccgcaacgtcattaacgataatatatctaaaaaaccccgaaaaacgcgaccccgcaaacttaacctatcctttcaaaacgcgctacgccaaaacgtaccatttccttatctaattttcaaacccatctttctaaaacccgaaatacgcccgaataccctcaccgttcctttctcctaaaatatttatatata

SEQ ID NO: 18357 - DNA, 1022 bp, Artificial Sequence
  chemically treated genomic DNA (Homo sapiens) CpG-island No: 18357
attcggtcgttaaggaggttgagtgaaacgcggatacggttttagttcgagggttcgttgttgttttttttcgagtttaaggcgtgtaaagagtttagaagaggcgggagtcgaggtaggataagttttgcgcgttttcgggagttcgtagatttagttcgggttaggagagtcggaagtagtcgcggtcgggttcgtttgcggttttttcggagtagttttcgttttttttttttcgtttttcgtcgggcggggcggggtacgagtataaaagattttaattttcgagcgggcgcgggtttatttagttaattattggtttagatttggttcgcggagagagtagatagggaacgtcgggagtaggatcgggcgcggagggttggggtcggggattcggggcggcgggttcgagtgggagaaaggagcggcggagggggtttagagttattcgggttttcgggatttttcgaagggtagaaataagtttttaaaaataggtagcggtttgtcggaagaagtgagtgaacggaaaggtataaagtatatatttttttcgtatttttaaggagacgttcgtagtttttatttattcgcgtcgagaggtttggaggaagtcgcgcggttgggaaggaggcggtattgtcgtattcggggacgtaagggagggaggaaaagggcggttgcggcgggaagaggttgggtatacgcgcgggagtcgtcgtcgtcgtcgtcgtcgtcgttatcgtttttttagtttttttgggtttcgttgtttcgagttggcgtcgttcgcgcgtttcgtcgtattgatagcggcgcgagtttcgtaatcgcgagttttgttttcggtcggtattattgaggcgcgcgggggtgggggtattcggagcggtttttcgtagttcggtttcgttcgtcgtttcggttttggtttcgggtttttttttttttttgttttttgggaaggatacggtgatacgagtacgaggagtttgtagtttcgtttagaaatagttcgg

SEQ ID NO: 18358 - DNA, 1022 bp, Artificial Sequence
  chemically treated genomic DNA (Homo sapiens) CpG-island No: 18358
ccgaactatttctaaacgaaactacaaactcctcgtactcgtatcaccgtatccttcccaaaaaacaaaaaaaaaaaaaaacccgaaaccaaaaccgaaacgacgaacgaaaccgaactacgaaaaaccgctccgaatacccccacccccgcgcgcctcaataataccgaccgaaaacaaaactcgcgattacgaaactcgcgccgctatcaatacgacgaaacgcgcgaacgacgccaactcgaaacaacgaaacccaaaaaaactaaaaaaacgataacgacgacgacgacgacgacgacgactcccgcgcgtatacccaacctcttcccgccgcaaccgcccttttcctccctcccttacgtccccgaatacgacaataccgcctccttcccaaccgcgcgacttcctccaaacctctcgacgcgaataaataaaaactacgaacgtctccttaaaaatacgaaaaaaatatatactttatacctttccgttcactcacttcttccgacaaaccgctacctatttttaaaaacttatttctacccttcgaaaaatcccgaaaacccgaataactctaaaccccctccgccgctcctttctcccactcgaacccgccgccccgaatccccgaccccaaccctccgcgcccgatcctactcccgacgttccctatctactctctccgcgaaccaaatctaaaccaataattaactaaataaacccgcgcccgctcgaaaattaaaatcttttatactcgtaccccgccccgcccgacgaaaaacgaaaaaaaaaaaacgaaaactactccgaaaaaaccgcaaacgaacccgaccgcgactacttccgactctcctaacccgaactaaatctacgaactcccgaaaacgcgcaaaacttatcctacctcgactcccgcctcttctaaactctttacacgccttaaactcgaaaaaaaacaacaacgaaccctcgaactaaaaccgtatccgcgtttcactcaacctccttaacgaccgaat

SEQ ID NO: 18359 - DNA, 1022 bp, Artificial Sequence
  chemically treated genomic DNA (Homo sapiens) CpG-island No: 18359
tcgggttgtttttgggcggggttgtagatttttcgtgttcgtgttatcgtgttttttttaggagatagagaaggaggagagttcggaattagggtcggagcggcgggcggagtcgagttgcggggagtcgtttcgggtgtttttattttcgcgcgttttagtggtgtcggtcgagggtagggttcgcggttgcggggttcgcgtcgttgttagtgcggcggggcgcgcgagcggcgttagttcggggtagcggaatttagagaagttgagggggcggtagcggcggcgacggcgacgacgacgattttcgcgcgtgtgtttagttttttttcgtcgtagtcgtttttttttttttttttttacgttttcgagtgcggtagtatcgttttttttttagtcgcgcggttttttttagatttttcggcgcgggtgagtggggattgcgggcgtttttttaggggtgcggggagggtgtgtgttttgtgttttttcgtttatttatttttttcggtaggtcgttgtttatttttagaaatttatttttgtttttcggggagtttcgggagttcgagtaattttaggtttttttcgtcgttttttttttttattcggattcgtcgtttcgggttttcggttttagtttttcgcgttcggttttgttttcggcgttttttgtttgtttttttcgcgggttaagtttgggttagtagttggttgggtgggttcgcgttcgttcggaagttggagttttttgtgttcgtgtttcgtttcgttcggcgaggggcggagggaggggaacggaggttgtttcggggaggtcgtaggcgggttcggtcgcggttgttttcggtttttttaattcggattgggtttacgggttttcggaggcgcgtagagtttgttttgtttcggttttcgttttttttgggttttttgtacgttttgggttcggagagaaataataacgggttttcgaattggggtcgtattcgcgttttatttagtttttttggcggtcgagt

SEQ ID NO: 18360 - DNA, 1022 bp, Artificial Sequence
  chemically treated genomic DNA (Homo sapiens) CpG-island No: 18360
actcgaccgccaaaaaaactaaataaaacgcgaatacgaccccaattcgaaaacccgttattatttctctccgaacccaaaacgtacaaaaaacccaaaaaaaacgaaaaccgaaacaaaacaaactctacgcgcctccgaaaacccgtaaacccaatccgaattaaaaaaaccgaaaacaaccgcgaccgaacccgcctacgacctccccgaaacaacctccgttcccctccctccgcccctcgccgaacgaaacgaaacacgaacacaaaaaactccaacttccgaacgaacgcgaacccacccaaccaactactaacccaaacttaacccgcgaaaaaaacaaacaaaaaacgccgaaaacaaaaccgaacgcgaaaaactaaaaccgaaaacccgaaacgacgaatccgaataaaaaaaaaaaacgacgaaaaaaacctaaaattactcgaactcccgaaactccccgaaaaacaaaaataaatttctaaaaataaacaacgacctaccgaaaaaaataaataaacgaaaaaacacaaaacacacaccctccccgcacccctaaaaaaacgcccgcaatccccactcacccgcgccgaaaaatctaaaaaaaaccgcgcgactaaaaaaaaaacgatactaccgcactcgaaaacgtaaaaaaaaaaaaaaaaaaacgactacgacgaaaaaaaactaaacacacgcgcgaaaatcgtcgtcgtcgccgtcgccgccgctaccgccccctcaacttctctaaattccgctaccccgaactaacgccgctcgcgcgccccgccgcactaacaacgacgcgaaccccgcaaccgcgaaccctaccctcgaccgacaccactaaaacgcgcgaaaataaaaacacccgaaacgactccccgcaactcgactccgcccgccgctccgaccctaattccgaactctcctccttctctatctcctaaaaaaaacacgataacacgaacacgaaaaatctacaaccccgcccaaaaacaacccga

SEQ ID NO: 18361 - DNA, 1195 bp, Artificial Sequence
  chemically treated genomic DNA (Homo sapiens) CpG-island No: 18361
gttgcgcggggatttcgtgggcgttgcgcggcgaagttggaaattagcgttgagatttttcggatttttttcggcggttgtttcgggggttcggttttatttttgtcgtttcgggaaaagcggacgttagttatagattttagtttagtaggaggggtcgcgcgcggggaagggcgtataatattagggagtttcgcgcgggcggcgttgggttcgagttcgtttttttcgagtttcgtttgtttttttcgaatttcgggttagtcggcgcgtcgagtcgtagtttcgttttttttttgtttttcgtttttttttttggttttcgttttagtcgtatcgtttttttatcgtttgggtcgcgttcggcgcgattgtattagagtcggcggtcggttgcgtacgtggagtcgggcgtgcggtttatgtcgttaggcgtttattggagatgtttacgtttatttgcgttgcgggttcggtcgggtattggatttttcgtttttcgttagcgttttcggtcgtagtgtttaagttcgcgtttttcgatatatcgttcggtttttttaatgagttggtattaaatattcgtagtttcgcgtttcgttttttacggcggtttcgggcgtttcgtttttgggtcggggttatagtcgttggagatttgggttagggttagattcgatatttatttgacgatggagtttcgcgtcgcgggcgttcggtcgtcggggttgtagttgtttcgggtttggttattttgcggtcgtcgttgtttaagtaggttttttcggttatcgtcgtcgttttcgtcgtcgtcgttgttagcgcgatagggtatacggaggcggcgcggagggttcgggggttggggcgggcggcggagttggcgtaggacgagcggtagacgcgtgtttatggcgcgggacggttggtttttaggggatacggagttgcggttgtcgagggcggcggggcgcgtgttaggggagtaggcggcggcggcggcggcggcggcgggaaggatttggcgtttttttttcgttttaggggtttttagggggtattgtattcggcggtcgtgacgtgcggagggcgggggtttgcgagtcgtcggtcgggatgttacggttttgggtattttggtttggtaagttgtattagatagagggtggggtgcggagtgggatttagattttgt

SEQ ID NO: 18362 - DNA, 1195 bp, Artificial Sequence
  chemically treated genomic DNA (Homo sapiens) CpG-island No: 18362
acaaaatctaaatcccactccgcaccccaccctctatctaatacaacttaccaaaccaaaatacccaaaaccgtaacatcccgaccgacgactcgcaaacccccgccctccgcacgtcacgaccgccgaatacaataccccctaaaaacccctaaaacgaaaaaaaaacgccaaatccttcccgccgccgccgccgccgccgccgcctactcccctaacacgcgccccgccgccctcgacaaccgcaactccgtatcccctaaaaaccaaccgtcccgcgccataaacacgcgtctaccgctcgtcctacgccaactccgccgcccgccccaacccccgaaccctccgcgccgcctccgtataccctatcgcgctaacaacgacgacgacgaaaacgacgacgataaccgaaaaaacctacttaaacaacgacgaccgcaaaataaccaaacccgaaacaactacaaccccgacgaccgaacgcccgcgacgcgaaactccatcgtcaaataaatatcgaatctaaccctaacccaaatctccaacgactataaccccgacccaaaaacgaaacgcccgaaaccgccgtaaaaaacgaaacgcgaaactacgaatatttaataccaactcattaaaaaaaccgaacgatatatcgaaaaacgcgaacttaaacactacgaccgaaaacgctaacgaaaaacgaaaaatccaatacccgaccgaacccgcaacgcaaataaacgtaaacatctccaataaacgcctaacgacataaaccgcacgcccgactccacgtacgcaaccgaccgccgactctaatacaatcgcgccgaacgcgacccaaacgataaaaaaacgatacgactaaaacgaaaaccaaaaaaaaaaacgaaaaacaaaaaaaaaacgaaactacgactcgacgcgccgactaacccgaaattcgaaaaaaacaaacgaaactcgaaaaaaacgaactcgaacccaacgccgcccgcgcgaaactccctaatattatacgcccttccccgcgcgcgacccctcctactaaactaaaatctataactaacgtccgcttttcccgaaacgacaaaaataaaaccgaacccccgaaacaaccgccgaaaaaaatccgaaaaatctcaacgctaatttccaacttcgccgcgcaacgcccacgaaatccccgcgcaac

SEQ ID NO: 18363 - DNA, 1195 bp, Artificial Sequence
  chemically treated genomic DNA (Homo sapiens) CpG-island No: 18363
gtagagtttgagttttatttcgtattttattttttgtttggtatagtttattaaattaaagtgtttaaagtcgtgatatttcggtcggcggttcgtaggttttcgtttttcgtacgttacggtcgtcgggtgtagtgttttttaggggtttttgggacgaggaggaagcgttaggtttttttcgtcgtcgtcgtcgtcgtcgtcgtttgtttttttggtacgcgtttcgtcgttttcggtagtcgtagtttcgtgttttttgagaattagtcgtttcgcgttatgggtacgcgtttgtcgttcgttttgcgttagtttcgtcgttcgttttagttttcgggtttttcgcgtcgttttcgtgtgttttgtcgcgttagtagcggcggcggcggaggcggcggcggtggtcgggagggtttgtttggatagcggcggtcgtaggatggttaggttcggagtagttgtagtttcggcggtcgaacgttcgcggcgcgggattttatcgttaggtgagtgtcgggtttggttttggtttaggtttttagcggttgtggtttcgatttaggggcggagcgttcgggatcgtcgtggggagcggggcgcggggttgcgagtgtttggtgttaatttattaggggggtcgggcggtgtgtcgggaaacgcgggtttgggtattgcggtcgggagcgttggcggagaacgggggatttagtattcgatcgggttcgtagcgtaggtgggcgtgggtatttttaatgggcgtttagcggtatggatcgtacgttcggttttacgtgcgtagtcggtcgtcggttttgatgtaatcgcgtcgggcgcgatttagacggtaaaggggcggtgcggttggggcggaaattaggggagggggcgaggagtaggaggagggcggggttgcggttcggcgcgtcggttggttcggggttcgggaagggtaagcggagttcgggagaggcgggttcgggtttagcgtcgttcgcgcgaagttttttggtgttgtgcgttttttttcgcgcgcggttttttttgttgggttggggtttgtggttgacgttcgtttttttcggaacggtaaaggtggagtcgggttttcgggatagtcgtcggggggaattcgagaggttttagcgttggtttttagtttcgtcgcgtagcgtttacggagttttcgcgtagt

SEQ ID NO: 18364 - DNA, 1195 bp, Artificial Sequence
  chemically treated genomic DNA (Homo sapiens) CpG-island No: 18364
actacgcgaaaactccgtaaacgctacgcgacgaaactaaaaaccaacgctaaaacctctcgaattccccccgacgactatcccgaaaacccgactccacctttaccgttccgaaaaaaacgaacgtcaaccacaaaccccaacccaacaaaaaaaaccgcgcgcgaaaaaaaacgcacaacaccaaaaaacttcgcgcgaacgacgctaaacccgaacccgcctctcccgaactccgcttacccttcccgaaccccgaaccaaccgacgcgccgaaccgcaaccccgccctcctcctactcctcgccccctcccctaatttccgccccaaccgcaccgcccctttaccgtctaaatcgcgcccgacgcgattacatcaaaaccgacgaccgactacgcacgtaaaaccgaacgtacgatccataccgctaaacgcccattaaaaatacccacgcccacctacgctacgaacccgatcgaatactaaatcccccgttctccgccaacgctcccgaccgcaatacccaaacccgcgtttcccgacacaccgcccgacccccctaataaattaacaccaaacactcgcaaccccgcgccccgctccccacgacgatcccgaacgctccgcccctaaatcgaaaccacaaccgctaaaaacctaaaccaaaaccaaacccgacactcacctaacgataaaatcccgcgccgcgaacgttcgaccgccgaaactacaactactccgaacctaaccatcctacgaccgccgctatccaaacaaaccctcccgaccaccgccgccgcctccgccgccgccgctactaacgcgacaaaacacacgaaaacgacgcgaaaaacccgaaaactaaaacgaacgacgaaactaacgcaaaacgaacgacaaacgcgtacccataacgcgaaacgactaattctcaaaaaacacgaaactacgactaccgaaaacgacgaaacgcgtaccaaaaaaacaaacgacgacgacgacgacgacgacgaaaaaaacctaacgcttcctcctcgtcccaaaaacccctaaaaaacactacacccgacgaccgtaacgtacgaaaaacgaaaacctacgaaccgccgaccgaaatatcacgactttaaacactttaatttaataaactataccaaacaaaaaataaaatacgaaataaaactcaaactctac

SEQ ID NO: 18365 - DNA, 608 bp, Artificial Sequence
  chemically treated genomic DNA (Homo sapiens) CpG-island No: 18365
gagtcgggtagcggttcgtgtcgggacgggggattcgtcggcgtcggggtgtgtaaaggagcgtgtgtgcggttggagggcggcgatgcgaataataatgcgttcgcgttcggggttaggttgtattggcggtcgcgcgggtcggggtcgggaagttaggtagggtagggtcgcgggttcgcgcgcggcggcgtcgggtttattttgattcggtttcgaggcgcgcgcggggtcggcgtgttcgggggtcggatagcggcggcggcggcgggcggatggcggcggtacggcggtggcggtagcggggagggcgcgttcggggtttcgtcgcgtttcggttcggcggatttcggttcgcgtcgcggtcgcgggtgttgtcggggggcgcggcgggcgtagtagagcggcgggcggcggcggcgtcgtcgagcggtgtagataaaggaggggcggagggaggagacggagggtgtgggagaggcggttttatcggcgcgggcggcggcggtcgcgtttttttcgttttttagtagcggggatcgagagagggagttgtgtttgagaagacgttaaaattttttttagcgttgtttgcgggagggggaggg

SEQ ID NO: 18366 - DNA, 608 bp, Artificial Sequence
  chemically treated genomic DNA (Homo sapiens) CpG-island No: 18366
ccctccccctcccgcaaacaacgctaaaaaaaattttaacgtcttctcaaacacaactccctctctcgatccccgctactaaaaaacgaaaaaaacgcgaccgccgccgcccgcgccgataaaaccgcctctcccacaccctccgtctcctccctccgcccctcctttatctacaccgctcgacgacgccgccgccgcccgccgctctactacgcccgccgcgccccccgacaacacccgcgaccgcgacgcgaaccgaaatccgccgaaccgaaacgcgacgaaaccccgaacgcgccctccccgctaccgccaccgccgtaccgccgccatccgcccgccgccgccgccgctatccgacccccgaacacgccgaccccgcgcgcgcctcgaaaccgaatcaaaataaacccgacgccgccgcgcgcgaacccgcgaccctaccctacctaacttcccgaccccgacccgcgcgaccgccaatacaacctaaccccgaacgcgaacgcattattattcgcatcgccgccctccaaccgcacacacgctcctttacacaccccgacgccgacgaatcccccgtcccgacacgaaccgctacccgactc

SEQ ID NO: 18367 - DNA, 608 bp, Artificial Sequence
  chemically treated genomic DNA (Homo sapiens) CpG-island No: 18367
ttttttttttttcgtaggtagcgttaagggggattttggcgtttttttagatatagttttttttttcggttttcgttgttgaggagcgagaggagcgcggtcgtcgtcgttcgcgtcggtgaagtcgttttttttatatttttcgtttttttttttcgttttttttttgtttgtatcgttcgacgacgtcgtcgtcgttcgtcgttttgttgcgttcgtcgcgtttttcggtagtattcgcggtcgcggcgcgagtcggagttcgtcgagtcggagcgcgacgaggtttcgggcgcgtttttttcgttgtcgttatcgtcgtgtcgtcgttattcgttcgtcgtcgtcgtcgttgttcggttttcgagtacgtcggtttcgcgcgcgtttcgaggtcgagttaaggtaagttcggcgtcgtcgcgcgcggattcgcggttttgttttgtttggtttttcgatttcggttcgcgcggtcgttagtgtagtttggtttcgggcgcgggcgtattgttgttcgtatcgtcgttttttagtcgtatatacgtttttttgtatatttcggcgtcgacgggtttttcgtttcggtacggatcgttattcgattt

SEQ ID NO: 18368 - DNA, 608 bp, Artificial Sequence
  chemically treated genomic DNA (Homo sapiens) CpG-island No: 18368
aaatcgaataacgatccgtaccgaaacgaaaaacccgtcgacgccgaaatatacaaaaaaacgtatatacgactaaaaaacgacgatacgaacaacaatacgcccgcgcccgaaaccaaactacactaacgaccgcgcgaaccgaaatcgaaaaaccaaacaaaacaaaaccgcgaatccgcgcgcgacgacgccgaacttaccttaactcgacctcgaaacgcgcgcgaaaccgacgtactcgaaaaccgaacaacgacgacgacgacgaacgaataacgacgacacgacgataacgacaacgaaaaaaacgcgcccgaaacctcgtcgcgctccgactcgacgaactccgactcgcgccgcgaccgcgaatactaccgaaaaacgcgacgaacgcaacaaaacgacgaacgacgacgacgtcgtcgaacgatacaaacaaaaaaaaaacgaaaaaaaaaaacgaaaaatataaaaaaaacgacttcaccgacgcgaacgacgacgaccgcgctcctctcgctcctcaacaacgaaaaccgaaaaaaaaaactatatctaaaaaaacgccaaaatcccccttaacgctacctacgaaaaaaaaaaaa

SEQ ID NO: 18369 - DNA, 813 bp, Artificial Sequence
  chemically treated genomic DNA (Homo sapiens) CpG-island No: 18369
cggtcgttcggtcgtttcgtcgttattcgttatttcgtagtttgtcgtatttttggagcgagagagcgacgagcgagttacggcgatggtgtcgttcgcggcgtagttatgaagttcgttcgaggagttcgcgcgcgtttttgttattttgttcgtagttcgtcgtttgcgcgttagtttttcgcgtttcgggttagttgttgtcgttttgttaatttttgttcgtttcgtcgttcggcgttattgagttttaagtttatgtcgggttcgggggtacgggtgttttagtttcgttgtcgtcgtcgtcgtcgtcgtcgttgcgtcgtcgttgtcgcgtcgttgaggaggcggaggaggaggaggaggaggaggaagaggaggaggaagaggagggggaggaaggtaagaggcgcgttgtttttaggggggcgcgttcgttgttttagtttaatcgggggtgggtcgcggcgggagcgtttcgtttcgggtcggttggggggcgattggcgtttgggcgttttcgggagtcgggggtagggcggggggcgtcgaacgtttggtcgttcggagtttgggcgggcggggtaacggttcgttgcgtgtttattgtttcggcgagtttttggtttggcgggttcgtttggttttcgcgggtgcggggtgaggagtcgagcgtaggggagtgtagcgcgtttattatggagtttttgtgtgcgcgtttgggttgtgggtatagttgggagagttggcgagacgcggggtttggttgttaggaggtggttatttagtcggggtgttcggcgaagttcgagt

SEQ ID NO: 18370 - DNA, 813 bp, Artificial Sequence
  chemically treated genomic DNA (Homo sapiens) CpG-island No: 18370
actcgaacttcgccgaacaccccgactaaataaccacctcctaacaaccaaaccccgcgtctcgccaactctcccaactatacccacaacccaaacgcgcacacaaaaactccataataaacgcgctacactcccctacgctcgactcctcaccccgcacccgcgaaaaccaaacgaacccgccaaaccaaaaactcgccgaaacaataaacacgcaacgaaccgttaccccgcccgcccaaactccgaacgaccaaacgttcgacgccccccgccctacccccgactcccgaaaacgcccaaacgccaatcgccccccaaccgacccgaaacgaaacgctcccgccgcgacccacccccgattaaactaaaacaacgaacgcgcccccctaaaaacaacgcgcctcttaccttcctccccctcctcttcctcctcctcttcctcctcctcctcctcctcctccgcctcctcaacgacgcgacaacgacgacgcaacgacgacgacgacgacgacgacaacgaaactaaaacacccgtacccccgaacccgacataaacttaaaactcaataacgccgaacgacgaaacgaacaaaaattaacaaaacgacaacaactaacccgaaacgcgaaaaactaacgcgcaaacgacgaactacgaacaaaataacaaaaacgcgcgcgaactcctcgaacgaacttcataactacgccgcgaacgacaccatcgccgtaactcgctcgtcgctctctcgctccaaaaatacgacaaactacgaaataacgaataacgacgaaacgaccgaacgaccg

SEQ ID NO: 18371 - DNA, 813 bp, Artificial Sequence
  chemically treated genomic DNA (Homo sapiens) CpG-island No: 18371
gttcgggtttcgtcgggtatttcggttaagtggttattttttagtagttaggtttcgcgtttcgttagtttttttaattgtgtttatagtttaggcgcgtatataaaggttttataatgaacgcgttgtatttttttgcgttcgattttttatttcgtattcgcggaggttaaacgagttcgttaagttagagattcgtcggggtagtgggtacgtaacgggtcgttatttcgttcgtttaaatttcgggcggttagacgttcggcgtttttcgttttgttttcggttttcgggggcgtttaagcgttagtcgttttttagtcggttcggggcggaacgttttcgtcgcgatttattttcggttgggttgagatagcgggcgcgtttttttgaaggtagcgcgttttttatttttttttttttttttttttttttttttttttttttttttttttttttttttcgtttttttagcggcgcggtagcggcggcgtagcggcggcggcggcggcggcggtagcgggattagggtattcgtgttttcgagttcggtatgggtttggggtttagtggcgtcgggcggcggggcgggtagaggttggtagggcggtagtagttggttcgggacgcggggagttggcgcgtaggcggcgggttgcgggtaggatggtaggagcgcgcgcgggtttttcgggcgggttttatggttgcgtcgcgggcggtattatcgtcgtggttcgttcgtcgttttttcgttttaggagtgcggtaggttgcgaggtgacggatggcggcgaggcggtcggacggtcg

SEQ ID NO: 18372 - DNA, 813 bp, Artificial Sequence
  chemically treated genomic DNA (Homo sapiens) CpG-island No: 18372
cgaccgtccgaccgcctcgccgccatccgtcacctcgcaacctaccgcactcctaaaacgaaaaaacgacgaacgaaccacgacgataataccgcccgcgacgcaaccataaaacccgcccgaaaaacccgcgcgcgctcctaccatcctacccgcaacccgccgcctacgcgccaactccccgcgtcccgaaccaactactaccgccctaccaacctctacccgccccgccgcccgacgccactaaaccccaaacccataccgaactcgaaaacacgaataccctaatcccgctaccgccgccgccgccgccgccgctacgccgccgctaccgcgccgctaaaaaaacgaaaaaaaaaaaaaaaaaaaaaaaaaaaaaaaaaaaaaaaaaaaaaaaaaaaaataaaaaacgcgctaccttcaaaaaaacgcgcccgctatctcaacccaaccgaaaataaatcgcgacgaaaacgttccgccccgaaccgactaaaaaacgactaacgcttaaacgcccccgaaaaccgaaaacaaaacgaaaaacgccgaacgtctaaccgcccgaaatttaaacgaacgaaataacgacccgttacgtacccactaccccgacgaatctctaacttaacgaactcgtttaacctccgcgaatacgaaataaaaaatcgaacgcaaaaaaatacaacgcgttcattataaaacctttatatacgcgcctaaactataaacacaattaaaaaaactaacgaaacgcgaaacctaactactaaaaaataaccacttaaccgaaatacccgacgaaacccgaac

SEQ ID NO: 18373 - DNA, 639 bp, Artificial Sequence
  chemically treated genomic DNA (Homo sapiens) CpG-island No: 18373
ttcggcgagtaggcgggagaagggcgcgttggcgagtttgggtcgtaaagattcgggtcgcggcgggcggcgaggttttagttgggcgttagggaagcggaggtattcgcggtcgggattcgcggcgacggcggcggcggcggcggtcgttgcgttttatgttggtggattttttaggatgtatttttcgttttttttcgtttcgcggttttgtttcgttttttttttgagtttcgcgtttgtcgttcgcggggttggcgggcggtcgcgaggttttcgttatcgtaggacgtttcgcgagggatagttggggtcgagaaggcgcgggttttgcggggttcggtcgattttagggatttcgaggggcgttcgttagtcggagttcgcgaatcgtagatttttcgtttttcgtagttcggaagggagttgttcgtattcgtcgcggttcgcgtgggaagggatcgcgtttggttatcgtttcgcgcgggggaggggaagtggagtggaatttagcgtagggcgttgtttaggggtagtcgggttaacgttttgtttggagtttattatttgatttttcgggttattttgagggattttagtatttagttttttgatcgcgatttttttttttgcgtttta

SEQ ID NO: 18374 - DNA, 639 bp, Artificial Sequence
  chemically treated genomic DNA (Homo sapiens) CpG-island No: 18374
taaaacgcaaaaaaaaaaatcgcgatcaaaaaactaaatactaaaatccctcaaaataacccgaaaaatcaaataataaactccaaacaaaacgttaacccgactacccctaaacaacgccctacgctaaattccactccacttcccctcccccgcgcgaaacgataaccaaacgcgatcccttcccacgcgaaccgcgacgaatacgaacaactcccttccgaactacgaaaaacgaaaaatctacgattcgcgaactccgactaacgaacgcccctcgaaatccctaaaatcgaccgaaccccgcaaaacccgcgccttctcgaccccaactatccctcgcgaaacgtcctacgataacgaaaacctcgcgaccgcccgccaaccccgcgaacgacaaacgcgaaactcaaaaaaaaaacgaaacaaaaccgcgaaacgaaaaaaaacgaaaaatacatcctaaaaaatccaccaacataaaacgcaacgaccgccgccgccgccgccgtcgccgcgaatcccgaccgcgaatacctccgcttccctaacgcccaactaaaacctcgccgcccgccgcgacccgaatctttacgacccaaactcgccaacgcgcccttctcccgcctactcgccgaa

SEQ ID NO: 18375 - DNA, 639 bp, Artificial Sequence
  chemically treated genomic DNA (Homo sapiens) CpG-island No: 18375
tggggcgtagagaaagaaatcgcgattagggaattgagtattggagttttttaaaataattcgaagggttaaatagtgagttttaagtaaagcgttgattcggttatttttgagtagcgttttacgttgggttttattttattttttttttttcgcgcggggcgatagttaggcgcggtttttttttacgcgggtcgcggcgagtgcggatagttttttttcgggttgcggaaggcgggaagtttgcggttcgcgggtttcggttggcgggcgtttttcggagtttttgaagtcggtcgggtttcgtaggattcgcgttttttcggttttaattgtttttcgcgaagcgttttgcggtggcggaggtttcgcggtcgttcgttagtttcgcgagcggtaagcgcggggtttagaggggaggcggggtaaggtcgcggggcggaggggggcgggaggtgtattttgggaaatttattaatatggggcgtagcggtcgtcgtcgtcgtcgtcgtcgtcgcgagtttcggtcgcgggtgttttcgtttttttgacgtttagttggggtttcgtcgttcgtcgcggttcgggtttttgcggtttagattcgttagcgcgtttttttttcgtttgttcgtcggg

SEQ ID NO: 18376 - DNA, 639 bp, Artificial Sequence
  chemically treated genomic DNA (Homo sapiens) CpG-island No: 18376
cccgacgaacaaacgaaaaaaaaacgcgctaacgaatctaaaccgcaaaaacccgaaccgcgacgaacgacgaaaccccaactaaacgtcaaaaaaacgaaaacacccgcgaccgaaactcgcgacgacgacgacgacgacgacgaccgctacgccccatattaataaatttcccaaaatacacctcccgcccccctccgccccgcgaccttaccccgcctcccctctaaaccccgcgcttaccgctcgcgaaactaacgaacgaccgcgaaacctccgccaccgcaaaacgcttcgcgaaaaacaattaaaaccgaaaaaacgcgaatcctacgaaacccgaccgacttcaaaaactccgaaaaacgcccgccaaccgaaacccgcgaaccgcaaacttcccgccttccgcaacccgaaaaaaaactatccgcactcgccgcgacccgcgtaaaaaaaaaccgcgcctaactatcgccccgcgcgaaaaaaaaaaaataaaataaaacccaacgtaaaacgctactcaaaaataaccgaatcaacgctttacttaaaactcactatttaacccttcgaattattttaaaaaactccaatactcaattccctaatcgcgatttctttctctacgcccca

SEQ ID NO: 18377 - DNA, 553 bp, Artificial Sequence
  chemically treated genomic DNA (Homo sapiens) CpG-island No: 18377
ttttttcggtcgttaggttttcggttttcggcgtttttaaatttcggcgacgtttcgggtttcgtttttcgtagggtttggatggttttcgcgcgtaaatttgggaagggtttggggttcgtagaggggcgttcggggaatacgcgcggggtgaggttttgtttcggttcggggaggcggtcgacggaggacgggaggaggcggttatttggggatatttggtcgcgttttatttttcgggggtcgggtttatttgcggcgagcgggcgggtagtgggtcggcgtttttcgggagttcgcgttgcgtttttagtcgttttagtttttgttttattttcgggcgggttagtcgtttgtcgttagttttggtttcgttttggcggcgcgggtggttgtttttcgatttgtgtttgtattcggcgtttttaatgattttaatttaggaagtatttcggtttttagttttaagtagagcgttttcggcgcgtttagggtttttcgttttgggttttattgggttaggagttttgtggttattttaggttaattgttt

SEQ ID NO: 18378 - DNA, 553 bp, Artificial Sequence
  chemically treated genomic DNA (Homo sapiens) CpG-island No: 18378
aaacaattaacctaaaataaccacaaaactcctaacccaataaaacccaaaacgaaaaaccctaaacgcgccgaaaacgctctacttaaaactaaaaaccgaaatacttcctaaattaaaatcattaaaaacgccgaatacaaacacaaatcgaaaaacaaccacccgcgccgccaaaacgaaaccaaaactaacgacaaacgactaacccgcccgaaaataaaacaaaaactaaaacgactaaaaacgcaacgcgaactcccgaaaaacgccgacccactacccgcccgctcgccgcaaataaacccgacccccgaaaaataaaacgcgaccaaatatccccaaataaccgcctcctcccgtcctccgtcgaccgcctccccgaaccgaaacaaaacctcaccccgcgcgtattccccgaacgcccctctacgaaccccaaacccttcccaaatttacgcgcgaaaaccatccaaaccctacgaaaaacgaaacccgaaacgtcgccgaaatttaaaaacgccgaaaaccgaaaacctaacgaccgaaaaaa

SEQ ID NO: 18379 - DNA, 553 bp, Artificial Sequence
  chemically treated genomic DNA (Homo sapiens) CpG-island No: 18379
gaatagttgatttaaggtaattataggatttttggtttagtgggatttaaagcgaaaagttttggacgcgtcgagggcgttttgtttaagattgagaatcgaaatgttttttgaattaggattattgagaacgtcgagtgtagatataaatcgaaaagtagttattcgcgtcgttaaggcggggttagaattggcggtaggcggttggttcgttcggggatggggtagaagttggggcggttgagagcgtagcgcgggttttcgggagacgtcggtttattgttcgttcgttcgtcgtaggtaggttcggttttcgggaggtggggcgcggttaggtgtttttaggtagtcgttttttttcgtttttcgtcggtcgttttttcggatcgaggtaggattttatttcgcgcgtgtttttcgggcgtttttttgcgaattttaggttttttttaggtttgcgcgcgggggttatttagattttgcggagagcgaggttcggagcgtcgtcgaggtttgagggcgtcggagatcgagggtttggcggtcgaaggaa

SEQ ID NO: 18380 - DNA, 553 bp, Artificial Sequence
  chemically treated genomic DNA (Homo sapiens) CpG-island No: 18380
ttccttcgaccgccaaaccctcgatctccgacgccctcaaacctcgacgacgctccgaacctcgctctccgcaaaatctaaataacccccgcgcgcaaacctaaaaaaaacctaaaattcgcaaaaaaacgcccgaaaaacacgcgcgaaataaaatcctacctcgatccgaaaaaacgaccgacgaaaaacgaaaaaaaacgactacctaaaaacacctaaccgcgccccacctcccgaaaaccgaacctacctacgacgaacgaacgaacaataaaccgacgtctcccgaaaacccgcgctacgctctcaaccgccccaacttctaccccatccccgaacgaaccaaccgcctaccgccaattctaaccccgccttaacgacgcgaataactacttttcgatttatatctacactcgacgttctcaataatcctaattcaaaaaacatttcgattctcaatcttaaacaaaacgccctcgacgcgtccaaaacttttcgctttaaatcccactaaaccaaaaatcctataattaccttaaatcaactattc

SEQ ID NO: 18381 - DNA, 692 bp, Artificial Sequence
  chemically treated genomic DNA (Homo sapiens) CpG-island No: 18381
cgcgtcggcggggcgcggtcgtagagggtgcggggtgcggagttttttcggtggtcgattttaggcgggaagcgttcggcggatagacggacggataggagatttaaacgggtttcggtttttttatacggttttgtggggaatcgatagcgcgtcgcgggaagtagcgggcgtaaggcgcggcggttgagatttattcgggaggcggcgggttcggtttcgtttcggttgggcggttcgggattgcgggtttcgcgattttcgcgttttattcgggcggttttttcggtgggcgtcgcgatcgcggggttggggttcgggggatttttagtcgagggaacgtagtggtggagagggcgtattgtttttttagggatcgggttggggacgtaggaagcgcggtttgggagcgtcggcgtgcgggagggagggatcgcgggaggcggagggcggtgtcggttaggagcggtttttagttcggagaagtatcgtttatcggtcgattttttttttcggttttcggtattattttcgggttcgaggcgagggatcgtagttgagcgaggcgggtatttattttttagcgtatgtcgttggagcgcgttgagcgtgtgtcgggggttgggtttaagttttttttaatttttgttagtcgagttggataagagggggtcgggagaaaatagagtttt

SEQ ID NO: 18382 - DNA, 692 bp, Artificial Sequence
  chemically treated genomic DNA (Homo sapiens) CpG-island No: 18382
aaaactctattttctcccgaccccctcttatccaactcgactaacaaaaattaaaaaaaacttaaacccaacccccgacacacgctcaacgcgctccaacgacatacgctaaaaaataaatacccgcctcgctcaactacgatccctcgcctcgaacccgaaaataataccgaaaaccgaaaaaaaaaatcgaccgataaacgatacttctccgaactaaaaaccgctcctaaccgacaccgccctccgcctcccgcgatccctccctcccgcacgccgacgctcccaaaccgcgcttcctacgtccccaacccgatccctaaaaaaacaatacgccctctccaccactacgttccctcgactaaaaatcccccgaaccccaaccccgcgatcgcgacgcccaccgaaaaaaccgcccgaataaaacgcgaaaatcgcgaaacccgcaatcccgaaccgcccaaccgaaacgaaaccgaacccgccgcctcccgaataaatctcaaccgccgcgccttacgcccgctacttcccgcgacgcgctatcgattccccacaaaaccgtataaaaaaaccgaaacccgtttaaatctcctatccgtccgtctatccgccgaacgcttcccgcctaaaatcgaccaccgaaaaaactccgcaccccgcaccctctacgaccgcgccccgccgacgcg

SEQ ID NO: 18383 - DNA, 692 bp, Artificial Sequence
  chemically treated genomic DNA (Homo sapiens) CpG-island No: 18383
agggttttattttttttcgatttttttttatttaattcggttggtaagggttggggagaatttaggtttagttttcggtatacgtttagcgcgttttagcggtatacgttggggagtgggtgttcgtttcgtttagttgcgatttttcgtttcgggttcgggggtggtgtcgagggtcgggagggagggtcggtcggtgggcggtgttttttcgggttggaggtcgtttttggtcggtatcgtttttcgtttttcgcggtttttttttttcgtacgtcggcgtttttaggtcgcgttttttgcgtttttaattcggtttttgagagggtagtgcgttttttttattattgcgttttttcggttaagaatttttcgaattttagtttcgcgatcgcggcgtttatcgaggaggtcgttcgggtggggcgcgggggtcgcgaagttcgtagtttcggatcgtttagtcgagacggagtcggattcgtcgtttttcgggtgagttttagtcgtcgcgttttgcgttcgttgtttttcgcggcgcgttgtcggttttttatagggtcgtgtaagggggtcgaggttcgtttgggttttttgttcgttcgtttgttcgtcgagcgtttttcgtttggggtcgattatcgggaggatttcgtatttcgtattttttgcggtcgcgtttcgtcggcgcg

SEQ ID NO: 18384 - DNA, 692 bp, Artificial Sequence
  chemically treated genomic DNA (Homo sapiens) CpG-island No: 18384
cgcgccgacgaaacgcgaccgcaaaaaatacgaaatacgaaatcctcccgataatcgaccccaaacgaaaaacgctcgacgaacaaacgaacgaacaaaaaacccaaacgaacctcgacccccttacacgaccctataaaaaaccgacaacgcgccgcgaaaaacaacgaacgcaaaacgcgacgactaaaactcacccgaaaaacgacgaatccgactccgtctcgactaaacgatccgaaactacgaacttcgcgacccccgcgccccacccgaacgacctcctcgataaacgccgcgatcgcgaaactaaaattcgaaaaattcttaaccgaaaaaacgcaataataaaaaaaacgcactaccctctcaaaaaccgaattaaaaacgcaaaaaacgcgacctaaaaacgccgacgtacgaaaaaaaaaaaccgcgaaaaacgaaaaacgataccgaccaaaaacgacctccaacccgaaaaaacaccgcccaccgaccgaccctccctcccgaccctcgacaccacccccgaacccgaaacgaaaaatcgcaactaaacgaaacgaacacccactccccaacgtataccgctaaaacgcgctaaacgtataccgaaaactaaacctaaattctccccaacccttaccaaccgaattaaataaaaaaaaatcgaaaaaaaataaaaccct

SEQ ID NO: 18385 - DNA, 637 bp, Artificial Sequence
  chemically treated genomic DNA (Homo sapiens) CpG-island No: 18385
attgtatttcggtttcgtggcgggcgatttttttttgttagggaatcgtcgttttggtttcgggttggggagttcgttagggtgggtgagggagcgtcggcgttttcgtcgggtcgtcgttaatttcggtttttttttttcgtcgtaaagttttcgagttcgttcggtcgttacgttttagtaaaaggtcgtgcgtagcggtttatattgaagattttttatttgtttttatatttgttttagttggtcgttgttatgtggttcgagtgcgtaagaagtcggggtcgtagacgttagtagcgtttcggtttcgagatttttcggtagtagtcgtgattgtcgtcggcgggcgttgatttattttcgtgttagtttgtagtcgattaattcgcgtttttttgaggcggggtcggagtcgcgaggtttcgtttttaagtcgaggttttataaatgttgcgacgtacgtttagtcgtaaatagtcggggttttagcgggagaacgataatgtaaagtgttatgtttttggttgtttaatacgattgtagatttatggataagagcgtaggtagtggttataagagcgaggagaagcgagaaaagatgaaacggattttgtgagtatggtttttttttttt

SEQ ID NO: 18386 - DNA, 637 bp, Artificial Sequence
  chemically treated genomic DNA (Homo sapiens) CpG-island No: 18386
aaaaaaaaaaaaccatactcacaaaatccgtttcatcttttctcgcttctcctcgctcttataaccactacctacgctcttatccataaatctacaatcgtattaaacaaccaaaaacataacactttacattatcgttctcccgctaaaaccccgactatttacgactaaacgtacgtcgcaacatttataaaacctcgacttaaaaacgaaacctcgcgactccgaccccgcctcaaaaaaacgcgaattaatcgactacaaactaacacgaaaataaatcaacgcccgccgacgacaatcacgactactaccgaaaaatctcgaaaccgaaacgctactaacgtctacgaccccgacttcttacgcactcgaaccacataacaacgaccaactaaaacaaatataaaaacaaataaaaaatcttcaatataaaccgctacgcacgaccttttactaaaacgtaacgaccgaacgaactcgaaaactttacgacgaaaaaaaaaaaccgaaattaacgacgacccgacgaaaacgccgacgctccctcacccaccctaacgaactccccaacccgaaaccaaaacgacgattccctaacaaaaaaaaatcgcccgccacgaaaccgaaatacaat

SEQ ID NO: 18387 - DNA, 637 bp, Artificial Sequence
  chemically treated genomic DNA (Homo sapiens) CpG-island No: 18387
gagggaagaaagttatatttatagggttcgttttattttttttcgttttttttcgtttttgtggttattgtttgcgtttttgtttatgggtttgtagtcgtgttgaatagttaagaatatagtattttgtattatcgttttttcgttggagtttcggttgtttgcggttgggcgtgcgtcgtagtatttatgaggtttcggtttgggggcggggtttcgcggtttcggtttcgttttaagaggacgcggattggtcggttgtagattggtacggggatgggttagcgttcgtcggcggtagttacggttgttgtcgaagggtttcgaagtcggggcgttgttgacgtttgcggtttcggttttttgcgtattcgggttatatagtagcggttagttggggtaggtgtgggagtagatggagagtttttagtgtgggtcgttgcgtacgattttttgttgaagcgtggcggtcgggcgggttcgagggttttgcgacggagggagggagtcgaagttggcggcggttcggcgggggcgtcggcgtttttttatttattttgacgggttttttagttcgaggttagagcggcgattttttggtaggaggaggtcgttcgttacgaggtcggagtgtagt

SEQ ID NO: 18388 - DNA, 637 bp, Artificial Sequence
  chemically treated genomic DNA (Homo sapiens) CpG-island No: 18388
actacactccgacctcgtaacgaacgacctcctcctaccaaaaaatcgccgctctaacctcgaactaaaaaacccgtcaaaataaataaaaaaacgccgacgcccccgccgaaccgccgccaacttcgactccctccctccgtcgcaaaaccctcgaacccgcccgaccgccacgcttcaacaaaaaatcgtacgcaacgacccacactaaaaactctccatctactcccacacctaccccaactaaccgctactatataacccgaatacgcaaaaaaccgaaaccgcaaacgtcaacaacgccccgacttcgaaacccttcgacaacaaccgtaactaccgccgacgaacgctaacccatccccgtaccaatctacaaccgaccaatccgcgtcctcttaaaacgaaaccgaaaccgcgaaaccccgcccccaaaccgaaacctcataaatactacgacgcacgcccaaccgcaaacaaccgaaactccaacgaaaaaacgataatacaaaatactatattcttaactattcaacacgactacaaacccataaacaaaaacgcaaacaataaccacaaaaacgaaaaaaaacgaaaaaaaataaaacgaaccctataaatataactttcttccctc

SEQ ID NO: 18389 - DNA, 746 bp, Artificial Sequence
  chemically treated genomic DNA (Homo sapiens) CpG-island No: 18389
gtttagggtttcggaagtggttttagagttttttagtaatatgttcgtagagaattttttcggaggcggttatagatattttcgtgacgtagaacgagttagagcgttttttggggtttttatggtgttgtttttagtttgtagtatttttattttttttttcgtttgagcgtcgggaacggaaaagtaggcggtcggttttagttgcgacgtagacgtcgcgtgggggtggggttgggcgagtaggtgacgttttaggcgagttcgttggtttttttatggtgtcgagcgcgttcgttcggacgttgtttttttaatcggtagagggcggtgtttaggaggtttcgcgagagttgcggggggcgggggggcggtgtcgaggttgggggtcggtggcggatggagttcgcgatggagtcggagattttggaggcgcgaattagtgagtgttcgggaggggcgcgggtcggatcggaatcggaatcgggggtacgaggcgggttttttttcggcgggggcggggtacgggtcgttttttttttacgtttcgttttcggttcgggaggggcggtgtttttagtcggttttttagattttggagcgatggaggatttcggtttcggcgcggtttagcggtgggagcgggcgtcgtttatttgtcggatttttgggttatgatttttgggacggcgagtgagttgcgtcgggaattttcgggacggagagagtagtttttaatttttaag

SEQ ID NO: 18390 - DNA, 746 bp, Artificial Sequence
  chemically treated genomic DNA (Homo sapiens) CpG-island No: 18390
cttaaaaattaaaaactactctctccgtcccgaaaattcccgacgcaactcactcgccgtcccaaaaatcataacccaaaaatccgacaaataaacgacgcccgctcccaccgctaaaccgcgccgaaaccgaaatcctccatcgctccaaaatctaaaaaaccgactaaaaacaccgcccctcccgaaccgaaaacgaaacgtaaaaaaaaaacgacccgtaccccgcccccgccgaaaaaaaacccgcctcgtacccccgattccgattccgatccgacccgcgcccctcccgaacactcactaattcgcgcctccaaaatctccgactccatcgcgaactccatccgccaccgacccccaacctcgacaccgcccccccgccccccgcaactctcgcgaaacctcctaaacaccgccctctaccgattaaaaaaacaacgtccgaacgaacgcgctcgacaccataaaaaaaccaacgaactcgcctaaaacgtcacctactcgcccaaccccacccccacgcgacgtctacgtcgcaactaaaaccgaccgcctacttttccgttcccgacgctcaaacgaaaaaaaaaataaaaatactacaaactaaaaacaacaccataaaaaccccaaaaaacgctctaactcgttctacgtcacgaaaatatctataaccgcctccgaaaaaattctctacgaacatattactaaaaaactctaaaaccacttccgaaaccctaaac

SEQ ID NO: 18391 - DNA, 746 bp, Artificial Sequence
  chemically treated genomic DNA (Homo sapiens) CpG-island No: 18391
tttgggggttggaggttgtttttttcgtttcgggggttttcggcgtagtttattcgtcgttttaggggttatggtttagggattcgataggtgggcggcgttcgtttttatcgttggatcgcgtcggggtcggggttttttatcgttttagggtttgaggggtcgattgaggatatcgtttttttcgggtcgggggcggggcgtgaggagggggcgattcgtatttcgttttcgtcgggaaggggttcgtttcgtgttttcggtttcggtttcggttcggttcgcgtttttttcggatatttattgattcgcgtttttagagttttcggttttatcgcgggttttattcgttatcggtttttagtttcggtatcgttttttcgtttttcgtagttttcgcgggattttttgggtatcgttttttgtcgattaaaggggtaacgttcgaacgggcgcgttcggtattatagagaggttaacgagttcgtttagagcgttatttattcgtttaattttatttttacgcggcgtttacgtcgtagttgggatcggtcgtttgttttttcgttttcggcgtttaggcgggagaggaagtggagatattgtaggttaagggtagtattatggaaattttaagggacgttttaattcgttttgcgttacggagatgtttgtgatcgttttcggaagaattttttgcgggtatgttgttgaggggttttgaggttattttcggagttttgagt

SEQ ID NO: 18392 - DNA, 746 bp, Artificial Sequence
  chemically treated genomic DNA (Homo sapiens) CpG-island No: 18392
actcaaaactccgaaaataacctcaaaacccctcaacaacatacccgcaaaaaattcttccgaaaacgatcacaaacatctccgtaacgcaaaacgaattaaaacgtcccttaaaatttccataatactacccttaacctacaatatctccacttcctctcccgcctaaacgccgaaaacgaaaaaacaaacgaccgatcccaactacgacgtaaacgccgcgtaaaaataaaattaaacgaataaataacgctctaaacgaactcgttaacctctctataataccgaacgcgcccgttcgaacgttacccctttaatcgacaaaaaacgatacccaaaaaatcccgcgaaaactacgaaaaacgaaaaaacgataccgaaactaaaaaccgataacgaataaaacccgcgataaaaccgaaaactctaaaaacgcgaatcaataaatatccgaaaaaaacgcgaaccgaaccgaaaccgaaaccgaaaacacgaaacgaaccccttcccgacgaaaacgaaatacgaatcgccccctcctcacgccccgcccccgacccgaaaaaaacgatatcctcaatcgacccctcaaaccctaaaacgataaaaaaccccgaccccgacgcgatccaacgataaaaacgaacgccgcccacctatcgaatccctaaaccataacccctaaaacgacgaataaactacgccgaaaacccccgaaacgaaaaaaacaacctccaacccccaaa

SEQ ID NO: 18393 - DNA, 997 bp, Artificial Sequence
  chemically treated genomic DNA (Homo sapiens) CpG-island No: 18393
ttcggcggcgagcgcgcgcggtcggggtttggtttattttgcgttttcggggaggacggggattcgggggtggttatagagggtagttatttttgtttcgaattgtaatttcgcggttttcgttcgcggtttagcgagtcgatttatttcggtaggcggttttttatcgggggtttcggtttgttaaagttgtcgggtcggggttggggtcggggtttgcgtcgggggtcgcgggacggttaggtcggggttcggggtcgttagggttaggtcgggtcgtatttgggaatcgttgtggaggtggtttttatttatgtcggttcggagggacgagcgcggcggtaggcgaggcggcgtgggggagacgtagacggcgaatcggtttgtgcgggcggacggggatttcggaggttcgaggaggcgtaggtaagcggcggtgattgtgggttcgagattttagaaacggttgaggttgttattacggcggcgacgttgtttgattgtcgggcgggcggcgagaatagattttagtagttgtgtaatagtttaagttcgtatttgggtttattgcgtttgcgcggtcgtttttaaataatacgtcggcgacgttagcgttcgcggaaagaggtagagggttgcggttcgttttttcgttgttcgttagacggatttgtttttgtatcgtaagtttcgttttcggatcgtgcgcgtttcgttgtgatttgtataaggagtcgattttttttacggcgttttattttaagtagttttttttttttttttagacgttttttttcggaattttagtttttttgttaggtagtgcgtaggcgttattcgggtatcgttttcggattagggttggtcgcgtagttacgtggtgggtttttaaaggtcgcggcgggatttagtaattttgggtagagttggtattcggcgttcgtatttttttggagcggcgagtattttggtagttgggattttagaggttttttta

SEQ ID NO: 18394 - DNA, 997 bp, Artificial Sequence
  chemically treated genomic DNA (Homo sapiens) CpG-island No: 18394
taaaaaaacctctaaaatcccaactaccaaaatactcgccgctccaaaaaaatacgaacgccgaataccaactctacccaaaattactaaatcccgccgcgacctttaaaaacccaccacgtaactacgcgaccaaccctaatccgaaaacgatacccgaataacgcctacgcactacctaacaaaaaaactaaaattccgaaaaaaaacgtctaaaaaaaaaaaaaaaactacttaaaataaaacgccgtaaaaaaaatcgactccttatacaaatcacaacgaaacgcgcacgatccgaaaacgaaacttacgatacaaaaacaaatccgtctaacgaacaacgaaaaaacgaaccgcaaccctctacctctttccgcgaacgctaacgtcgccgacgtattatttaaaaacgaccgcgcaaacgcaataaacccaaatacgaacttaaactattacacaactactaaaatctattctcgccgcccgcccgacaatcaaacaacgtcgccgccgtaataacaacctcaaccgtttctaaaatctcgaacccacaatcaccgccgcttacctacgcctcctcgaacctccgaaatccccgtccgcccgcacaaaccgattcgccgtctacgtctcccccacgccgcctcgcctaccgccgcgctcgtccctccgaaccgacataaataaaaaccacctccacaacgattcccaaatacgacccgacctaaccctaacgaccccgaaccccgacctaaccgtcccgcgacccccgacgcaaaccccgaccccaaccccgacccgacaactttaacaaaccgaaacccccgataaaaaaccgcctaccgaaataaatcgactcgctaaaccgcgaacgaaaaccgcgaaattacaattcgaaacaaaaataactaccctctataaccacccccgaatccccgtcctccccgaaaacgcaaaataaaccaaaccccgaccgcgcgcgctcgccgccgaa

SEQ ID NO: 18395 - DNA, 997 bp, Artificial Sequence
  chemically treated genomic DNA (Homo sapiens) CpG-island No: 18395
tggggagatttttggggttttagttgttaaggtattcgtcgttttaaggagatgcggacgtcggatattagttttgtttaagattgttgggtttcgtcgcggtttttaaaggtttattacgtggttgcgcggttagttttggttcggaggcggtgttcgggtggcgtttgcgtattgtttagtagaggggttggggtttcgagaaaaagcgtttggagaggaaggggaggttgtttggggtgggacgtcgtgggaggagtcggttttttatgtaaattatagcggagcgcgtacggttcggaggcggggtttgcgatgtaaagataggttcgtttggcgaatagcgagggggcgggtcgtaattttttgttttttttcgcgagcgttgacgtcgtcgacgtgttgtttaaaagcggtcgcgtaggcgtagtgagtttaaatgcgaatttaggttgttatataattgttggggtttgttttcgtcgttcgttcggtagttaggtagcgtcgtcgtcgtggtagtagttttagtcgtttttggagtttcgggtttatagttatcgtcgtttatttgcgttttttcgagttttcggagttttcgttcgttcgtataggtcggttcgtcgtttgcgttttttttacgtcgtttcgtttgtcgtcgcgttcgttttttcgggtcgatatgagtggggattatttttataacgatttttaggtacggttcggtttgattttggcggtttcggatttcggtttggtcgtttcgcgattttcggcgtaggtttcgattttagtttcggttcggtagttttgataggtcggagttttcggtgaggggtcgtttgtcggagtagatcggttcgttaggtcgcgagcgagggtcgcgaagttatagttcgaggtagggatggttgttttttgtggttattttcgggttttcgtttttttcgggggcgtagggtgagttagatttcggtcgcgcgcgttcgtcgtcgga

SEQ ID NO: 18396 - DNA, 997 bp, Artificial Sequence
  chemically treated genomic DNA (Homo sapiens) CpG-island No: 18396
tccgacgacgaacgcgcgcgaccgaaatctaactcaccctacgcccccgaaaaaaacgaaaacccgaaaataaccacaaaaaacaaccatccctacctcgaactataacttcgcgaccctcgctcgcgacctaacgaaccgatctactccgacaaacgacccctcaccgaaaactccgacctatcaaaactaccgaaccgaaactaaaatcgaaacctacgccgaaaatcgcgaaacgaccaaaccgaaatccgaaaccgccaaaatcaaaccgaaccgtacctaaaaatcgttataaaaataatccccactcatatcgacccgaaaaaacgaacgcgacgacaaacgaaacgacgtaaaaaaaacgcaaacgacgaaccgacctatacgaacgaacgaaaactccgaaaactcgaaaaaacgcaaataaacgacgataactataaacccgaaactccaaaaacgactaaaactactaccacgacgacgacgctacctaactaccgaacgaacgacgaaaacaaaccccaacaattatataacaacctaaattcgcatttaaactcactacgcctacgcgaccgcttttaaacaacacgtcgacgacgtcaacgctcgcgaaaaaaaacaaaaaattacgacccgccccctcgctattcgccaaacgaacctatctttacatcgcaaaccccgcctccgaaccgtacgcgctccgctataatttacataaaaaaccgactcctcccacgacgtcccaccccaaacaacctccccttcctctccaaacgctttttctcgaaaccccaacccctctactaaacaatacgcaaacgccacccgaacaccgcctccgaaccaaaactaaccgcgcaaccacgtaataaacctttaaaaaccgcgacgaaacccaacaatcttaaacaaaactaatatccgacgtccgcatctccttaaaacgacgaataccttaacaactaaaaccccaaaaatctcccca

SEQ ID NO: 18397 - DNA, 647 bp, Artificial Sequence
  chemically treated genomic DNA (Homo sapiens) CpG-island No: 18397
ttattttttttcggttttaggttcgggttttggtttttggtaaggtcggagtagtagggcggtgatagcgtagttcggcgcgggttacgtttttattttcggtgggcggggagggtgtttggggcgttggcgttcggttgcggtgggaggtggtgcgtgtcgcgtgggcgtcggttttacggggtttttttttcgttttttttgcgggatttcggggcgcggattcgcgggcgcgtcgggcgggatagggggaggggcgggacgtgttttcgggtttggcgcgaatggttttcggtcgttttcggttgcgggttatggtcgtttttcggcgcgtttttatacggttttcgttttagtttggtcgtagtttatttcgcgtcgttattgggtagatgggggcggcggtttttgtttttcggttttcggaagagtagagcggagcgcgtttgatcgagttaggttttcgagtgggattggaattcggggcgttttgaagtttggggaaagtaggagtagaagggaagggatgcgtttttcgtttttcggcggcgcggaatgggtttttttttagtttttgcgtaggtaagatttttttagttgcgcgttgtatcggggattttttagttcgtgaggtagttaagaggaga

SEQ ID NO: 18398 - DNA, 647 bp, Artificial Sequence
  chemically treated genomic DNA (Homo sapiens) CpG-island No: 18398
tctcctcttaactacctcacgaactaaaaaatccccgatacaacgcgcaactaaaaaaatcttacctacgcaaaaactaaaaaaaaacccattccgcgccgccgaaaaacgaaaaacgcatcccttcccttctactcctactttccccaaacttcaaaacgccccgaattccaatcccactcgaaaacctaactcgatcaaacgcgctccgctctactcttccgaaaaccgaaaaacaaaaaccgccgcccccatctacccaataacgacgcgaaataaactacgaccaaactaaaacgaaaaccgtataaaaacgcgccgaaaaacgaccataacccgcaaccgaaaacgaccgaaaaccattcgcgccaaacccgaaaacacgtcccgcccctccccctatcccgcccgacgcgcccgcgaatccgcgccccgaaatcccgcaaaaaaaacgaaaaaaaaaccccgtaaaaccgacgcccacgcgacacgcaccacctcccaccgcaaccgaacgccaacgccccaaacaccctccccgcccaccgaaaataaaaacgtaacccgcgccgaactacgctatcaccgccctactactccgaccttaccaaaaaccaaaacccgaacctaaaaccgaaaaaaaataa

SEQ ID NO: 18399 - DNA, 647 bp, Artificial Sequence
  chemically treated genomic DNA (Homo sapiens) CpG-island No: 18399
tttttttttggttgttttacgggttggggagttttcggtgtagcgcgtaattggggaaattttgtttacgtagaggttggaaggaggtttatttcgcgtcgtcggagagcggggagcgtatttttttttttttgtttttgttttttttaaattttagggcgtttcgggttttaattttattcggaagtttgattcggttaggcgcgtttcgttttgttttttcgaaagtcgggaggtaggagtcgtcgtttttatttgtttagtggcggcgcggggtgggttgcggttagattggggcggggatcgtgtggggacgcgtcggggagcggttatggttcgtagtcgagagcggtcggaggttattcgcgttaggttcgggagtacgtttcgtttttttttttgtttcgttcgacgcgttcgcgagttcgcgtttcgggatttcgtagggagggcggagagggggtttcgtggggtcggcgtttacgcggtacgtattattttttatcgtaatcggacgttagcgttttaagtatttttttcgtttatcgggagtgggggcgtggttcgcgtcggattgcgttgttatcgttttgttgtttcggttttgttaggggttaaggttcgaatttgaggtcggggaggggtgg

SEQ ID NO: 18400 - DNA, 647 bp, Artificial Sequence
  chemically treated genomic DNA (Homo sapiens) CpG-island No: 18400
ccacccctccccgacctcaaattcgaaccttaacccctaacaaaaccgaaacaacaaaacgataacaacgcaatccgacgcgaaccacgcccccactcccgataaacgaaaaaaatacttaaaacgctaacgtccgattacgataaaaaataatacgtaccgcgtaaacgccgaccccacgaaaccccctctccgccctccctacgaaatcccgaaacgcgaactcgcgaacgcgtcgaacgaaacaaaaaaaaaaacgaaacgtactcccgaacctaacgcgaataacctccgaccgctctcgactacgaaccataaccgctccccgacgcgtccccacacgatccccgccccaatctaaccgcaacccaccccgcgccgccactaaacaaataaaaacgacgactcctacctcccgactttcgaaaaaacaaaacgaaacgcgcctaaccgaatcaaacttccgaataaaattaaaacccgaaacgccctaaaatttaaaaaaaacaaaaacaaaaaaaaaaaaatacgctccccgctctccgacgacgcgaaataaacctccttccaacctctacgtaaacaaaatttccccaattacgcgctacaccgaaaactccccaacccgtaaaacaaccaaaaaaaaa

SEQ ID NO: 18401 - DNA, 633 bp, Artificial Sequence
  chemically treated genomic DNA (Homo sapiens) CpG-island No: 18401
ggaatagacgcgagtttcgtcgggggtgcgggtgagggttgtagggagttcgcgaacgatagaaagtcgtttttcgtattttatcggagtattcgggaatacggtttttaggtgttttagcggtcgcgttttttcgttttcggttttttttcgtcgcgggtaggtttaatcgggaggcggcgtggtttcggagtcggttttaggttcgtattttttttttatttcgttttgggtagtcgtagttaaaagtcggaggttttaaagtggaattacgttgttttgtcgagtttggggcgattcgtttcggggagggcgagtttgaattgtagttttgcgttttttttacggttcgaggagttagttaagtttttagaggggttcggttcggttcgagtaagtttaggggcgaacggcgttatggagtttataggggcgcggttaagtttggaggcgtcgggattagcgttttttcgagaggtttcgtcggtcgaggagttgttcgtttcggtggttttttgtgtgtagggtggcggcgacggcggtggcgtttcggagatttcgagttttgacgtttagttaggggataggtttttgttttcgaaggaagaggtcgttttttaggagtaggaggag

SEQ ID NO: 18402 - DNA, 633 bp, Artificial Sequence
  chemically treated genomic DNA (Homo sapiens) CpG-island No: 18402
ctcctcctactcctaaaaaacgacctcttccttcgaaaacaaaaacctatcccctaactaaacgtcaaaactcgaaatctccgaaacgccaccgccgtcgccgccaccctacacacaaaaaaccaccgaaacgaacaactcctcgaccgacgaaacctctcgaaaaaacgctaatcccgacgcctccaaacttaaccgcgcccctataaactccataacgccgttcgcccctaaacttactcgaaccgaaccgaacccctctaaaaacttaactaactcctcgaaccgtaaaaaaaacgcaaaactacaattcaaactcgccctccccgaaacgaatcgccccaaactcgacaaaacaacgtaattccactttaaaacctccgacttttaactacgactacccaaaacgaaataaaaaaaaaatacgaacctaaaaccgactccgaaaccacgccgcctcccgattaaacctacccgcgacgaaaaaaaaccgaaaacgaaaaaacgcgaccgctaaaacacctaaaaaccgtattcccgaatactccgataaaatacgaaaaacgactttctatcgttcgcgaactccctacaaccctcacccgcacccccgacgaaactcgcgtctattcc

SEQ ID NO: 18403 - DNA, 633 bp, Artificial Sequence
  chemically treated genomic DNA (Homo sapiens) CpG-island No: 18403
ttttttttgtttttggggggcggttttttttttcggggataggggtttattttttagttgagcgttaggattcggggttttcgaagcgttatcgtcgtcgtcgttattttgtatataggggattatcggggcgggtagtttttcggtcggcggggtttttcggaagggcgttggtttcggcgtttttaaatttagtcgcgtttttatgggttttatgacgtcgttcgtttttggatttgttcgggtcgaatcgggtttttttggagatttaattaatttttcgggtcgtggaaggagcgtagggttgtagtttaggttcgtttttttcgaggcgagtcgttttaggttcgataagataacgtagttttattttggagttttcggtttttagttgcggttgtttagggcgaagtgggaggaggatgcgggtttggggtcggtttcggggttacgtcgtttttcggttgaatttgttcgcgacgggggagggtcgggggcggggaggcgcggtcgttgggatatttggaagtcgtgttttcgagtgtttcggtggaatgcggggggcgattttttgtcgttcgcgggttttttgtagtttttattcgtattttcggcggggttcgcgtttgtttt

SEQ ID NO: 18404 - DNA, 633 bp, Artificial Sequence
  chemically treated genomic DNA (Homo sapiens) CpG-island No: 18404
aaaacaaacgcgaaccccgccgaaaatacgaataaaaactacaaaaaacccgcgaacgacaaaaaatcgccccccgcattccaccgaaacactcgaaaacacgacttccaaatatcccaacgaccgcgcctccccgcccccgaccctcccccgtcgcgaacaaattcaaccgaaaaacgacgtaaccccgaaaccgaccccaaacccgcatcctcctcccacttcgccctaaacaaccgcaactaaaaaccgaaaactccaaaataaaactacgttatcttatcgaacctaaaacgactcgcctcgaaaaaaacgaacctaaactacaaccctacgctccttccacgacccgaaaaattaattaaatctccaaaaaaacccgattcgacccgaacaaatccaaaaacgaacgacgtcataaaacccataaaaacgcgactaaatttaaaaacgccgaaaccaacgcccttccgaaaaaccccgccgaccgaaaaactacccgccccgataatcccctatatacaaaataacgacgacgacgataacgcttcgaaaaccccgaatcctaacgctcaactaaaaaataaacccctatccccgaaaaaaaaaaccgccccccaaaaacaaaaaaaa

SEQ ID NO: 18405 - DNA, 627 bp, Artificial Sequence
  chemically treated genomic DNA (Homo sapiens) CpG-island No: 18405
ttgtcgcgcgcgttttttttttttgttcgtcgattttattttgtaggcggttaagtttttgtagtagtagtagtaataggcggtggtattgggcggcgagggggcggaggacgtatagttcggttcgggcggttgttgcgttaagtgtaagaagcgggtgtagttcgcggatacgttggggttaagtttggttagcgtgaagtattttagcgaggcggaggagtcgtaggtgtcgttcgtcgtgttttcgcgtttgcgaagtttttttatgcgtgtcgaggatttggagtagttcggggggttgttggtcgcggcggtagtggtcgcgttttttttagcgtcgttttttcggtttcggtcgtttttttagttttcggggtcgagcgtcgcggtcgagcgtttgtagcggtagcgcgtgtgtttggagcgcgtgtagtgttcgacggtttcgggcgttgaggtgaagggtttcggtcgggtgtttagttgttttgggtttagggtcgtgatcgtgcgttatatttttatcgagtggcgtttttttttggacgtgtcggttgagttgtagttcgagtcgttggagttatagtagttagaggtatcgtttggggttttcgagttagggtt

SEQ ID NO: 18406 - DNA, 627 bp, Artificial Sequence
  chemically treated genomic DNA (Homo sapiens) CpG-island No: 18406
aaccctaactcgaaaaccccaaacgatacctctaactactataactccaacgactcgaactacaactcaaccgacacgtccaaaaaaaaacgccactcgataaaaatataacgcacgatcacgaccctaaacccaaaacaactaaacacccgaccgaaacccttcacctcaacgcccgaaaccgtcgaacactacacgcgctccaaacacacgcgctaccgctacaaacgctcgaccgcgacgctcgaccccgaaaactaaaaaaacgaccgaaaccgaaaaaacgacgctaaaaaaaacgcgaccactaccgccgcgaccaacaaccccccgaactactccaaatcctcgacacgcataaaaaaacttcgcaaacgcgaaaacacgacgaacgacacctacgactcctccgcctcgctaaaatacttcacgctaaccaaacttaaccccaacgtatccgcgaactacacccgcttcttacacttaacgcaacaaccgcccgaaccgaactatacgtcctccgccccctcgccgcccaataccaccgcctattactactactactacaaaaacttaaccgcctacaaaataaaatcgacgaacaaaaaaaaaaaacgcgcgcgacaa

SEQ ID NO: 18407 - DNA, 627 bp, Artificial Sequence
  chemically treated genomic DNA (Homo sapiens) CpG-island No: 18407
gattttggttcggaggttttagacggtgtttttggttgttgtggttttagcggttcgggttgtagtttagtcggtacgtttaggaaggagcgttattcggtaaaggtgtagcgtacggttacggttttgggtttagggtagttgagtattcggtcggagttttttattttagcgttcgaggtcgtcgagtattgtacgcgttttaggtatacgcgttgtcgttgtagacgttcggtcgcggcgttcggtttcgggagttggaagagcggtcggagtcgggaaggcggcgttgaaaggggcgcggttattgtcgtcgcggttagtagtttttcgagttgttttaggttttcggtacgtatagggaagtttcgtaggcgcgagagtacggcgggcggtatttgcggttttttcgtttcgttgaagtgttttacgttggttaggtttagttttagcgtgttcgcgaattgtattcgttttttgtatttggcgtagtagtcgttcgggtcgagttgtgcgtttttcgttttttcgtcgtttagtgttatcgtttgttgttgttgttgttgtaggaatttggtcgtttgtaagatggggtcggcgggtaaggaaaaggagcgcgcgcggtag

SEQ ID NO: 18408 - DNA, 627 bp, Artificial Sequence
  chemically treated genomic DNA (Homo sapiens) CpG-island No: 18408
ctaccgcgcgcgctccttttccttacccgccgaccccatcttacaaacgaccaaattcctacaacaacaacaacaacaaacgataacactaaacgacgaaaaaacgaaaaacgcacaactcgacccgaacgactactacgccaaatacaaaaaacgaatacaattcgcgaacacgctaaaactaaacctaaccaacgtaaaacacttcaacgaaacgaaaaaaccgcaaataccgcccgccgtactctcgcgcctacgaaacttccctatacgtaccgaaaacctaaaacaactcgaaaaactactaaccgcgacgacaataaccgcgcccctttcaacgccgccttcccgactccgaccgctcttccaactcccgaaaccgaacgccgcgaccgaacgtctacaacgacaacgcgtatacctaaaacgcgtacaatactcgacgacctcgaacgctaaaataaaaaactccgaccgaatactcaactaccctaaacccaaaaccgtaaccgtacgctacacctttaccgaataacgctccttcctaaacgtaccgactaaactacaacccgaaccgctaaaaccacaacaaccaaaaacaccgtctaaaacctccgaaccaaaatc

SEQ ID NO: 18409 - DNA, 706 bp, Artificial Sequence
  chemically treated genomic DNA (Homo sapiens) CpG-island No: 18409
agagttttcgcgagggttcggcgcgttagttgattttttttttgagagtagggagtggaggcgcgagcgttttttttggcggtcgcgcgttttcgtttttcgttttatttcgtcgcggttgttcgggcgcgtcgtttatatttttgcgcgtagttttcgttcgttcggggattttcggcgagtcgcgtcgcgaagggggaggtgttcggtcgcggtcgggagggagtcggtaggcggcgttttttttaaaagtcgcgagcgtcgcgttacggcgtcgtcgtcgtcgtcgtcgtcgtcggagttttcgtttcgtcgcgttgcgttcggttcgcgttgcgttagtcgtttcgttttttatatttcgtcggggattggtagtcgtcgtcgtatatttgtcgttatagttttcgtcggttattcgaacgttttcggggttagcgtcgagtggattatcggggatcgcgaggtattcgcgcgtcgtagatttcgcgcgggttggagtattcggtagagcgcgttatagcgtcgtggtttttgttgttcgggttgcgttagagtcgcggacgggcgcgtagagcgtcggggatttcggagtcgatttttagcgtcgcgatgcggagtatttattgtaggagatcgggggtttgggacgcgttggtcgaggtgtgatcggattttaggttagttataaagggtatttggtttt

SEQ ID NO: 18410 - DNA, 706 bp, Artificial Sequence
  chemically treated genomic DNA (Homo sapiens) CpG-island No: 18410
aaaaccaaataccctttataactaacctaaaatccgatcacacctcgaccaacgcgtcccaaacccccgatctcctacaataaatactccgcatcgcgacgctaaaaatcgactccgaaatccccgacgctctacgcgcccgtccgcgactctaacgcaacccgaacaacaaaaaccacgacgctataacgcgctctaccgaatactccaacccgcgcgaaatctacgacgcgcgaatacctcgcgatccccgataatccactcgacgctaaccccgaaaacgttcgaataaccgacgaaaactataacgacaaatatacgacgacgactaccaatccccgacgaaatataaaaaacgaaacgactaacgcaacgcgaaccgaacgcaacgcgacgaaacgaaaactccgacgacgacgacgacgacgacgacgccgtaacgcgacgctcgcgacttttaaaaaaaacgccgcctaccgactccctcccgaccgcgaccgaacacctcccccttcgcgacgcgactcgccgaaaatccccgaacgaacgaaaactacgcgcaaaaatataaacgacgcgcccgaacaaccgcgacgaaataaaacgaaaaacgaaaacgcgcgaccgccaaaaaaaacgctcgcgcctccactccctactctcaaaaaaaaaatcaactaacgcgccgaaccctcgcgaaaactct

SEQ ID NO: 18411 - DNA, 706 bp, Artificial Sequence
  chemically treated genomic DNA (Homo sapiens) CpG-island No: 18411
ggggttaagtgttttttgtggttagtttggggttcgattatatttcggttagcgcgttttaggttttcgattttttgtagtaggtgtttcgtatcgcggcgttagggatcggtttcggagttttcggcgttttgcgcgttcgttcgcggttttggcgtagttcgggtagtagaggttacggcgttgtggcgcgttttgtcgggtgttttagttcgcgcggggtttgcggcgcgcgggtgtttcgcggttttcggtgatttattcggcgttggtttcgagaacgttcgggtagtcggcggaggttgtggcggtagatgtgcggcggcggttgttagttttcggcggggtgtgggaagcggagcgattagcgtagcgcgagtcgggcgtagcgcggcggggcgaggatttcggcggcggcgacggcggcggcggcgtcgtggcgcggcgttcgcggtttttaaaggggacgtcgtttgtcggttttttttcggtcgcggtcgaatattttttttttcgcggcgcggttcgtcggggattttcgagcgggcgggagttgcgcgtaggggtgtggacggcgcgttcgggtagtcgcggcggggtggggcggagggcgggggcgcgcggtcgttaaggggggcgttcgcgtttttattttttgtttttaaaggagagattagttggcgcgtcggattttcgcggggatttt

SEQ ID NO: 18412 - DNA, 706 bp, Artificial Sequence
  chemically treated genomic DNA (Homo sapiens) CpG-island No: 18412
aaaatccccgcgaaaatccgacgcgccaactaatctctcctttaaaaacaaaaaataaaaacgcgaacgccccccttaacgaccgcgcgcccccgccctccgccccaccccgccgcgactacccgaacgcgccgtccacacccctacgcgcaactcccgcccgctcgaaaatccccgacgaaccgcgccgcgaaaaaaaaaatattcgaccgcgaccgaaaaaaaaccgacaaacgacgtcccctttaaaaaccgcgaacgccgcgccacgacgccgccgccgccgtcgccgccgccgaaatcctcgccccgccgcgctacgcccgactcgcgctacgctaatcgctccgcttcccacaccccgccgaaaactaacaaccgccgccgcacatctaccgccacaacctccgccgactacccgaacgttctcgaaaccaacgccgaataaatcaccgaaaaccgcgaaacacccgcgcgccgcaaaccccgcgcgaactaaaacacccgacaaaacgcgccacaacgccgtaacctctactacccgaactacgccaaaaccgcgaacgaacgcgcaaaacgccgaaaactccgaaaccgatccctaacgccgcgatacgaaacacctactacaaaaaatcgaaaacctaaaacgcgctaaccgaaatataatcgaaccccaaactaaccacaaaaaacacttaacccc

SEQ ID NO: 18413 - DNA, 823 bp, Artificial Sequence
  chemically treated genomic DNA (Homo sapiens) CpG-island No: 18413
gaaggcgcgggtcgtcgagtgggcggcggtcgttcgcgaggcgagtttggaagtagtatttgaatcgtttggagggtgattaggttgcgcggcgagttttgcgattgatacggttaatgcgttagtggttgagtggttttggttatgtagggacgcggcgcgtacgtatatttatagattcgtagaagtttaggttcgcgtcggagagaagttataggtaggaaggggtttatttattcgcggtttcgcgttttaggtttgcgttatttcgagtcggtttagacgtcgttttagtcggcggcgggagcgtagcgttttcgttttttttagaagaatttttttcgttcgcgtcgtcgtcgcggttgtagttttcgtcgtttacggttttcgtcgttttttcggcgtttagttttcgtcgttttttttgaagttgttgttgtttttcggcgtcgattagcgtttttatcgagaaagcgtgcgttttgaggtttagtatgttgtacggcgagttttttcgtttttcggttatttttttcgtttcgcgttcgttcgttttttttttatatatatttacgcgggtatacgcgcgttttcgttttttttttattaaaaattaaaaggttttcggggtttttcgagatttgtttttttttttatcgcgggtaaaaaatagatttggcgttttcgttttttcgtttgtgttgggatttaggaatcggcgacgcgtcggttaagtttttttttttgggtttttttcgcgcgtttttttattgatgtatttttttgtttttattttttttatttttttttgttgtttcgaggt

SEQ ID NO: 18414 - DNA, 823 bp, Artificial Sequence
  chemically treated genomic DNA (Homo sapiens) CpG-island No: 18414
acctcgaaacaacaaaaaaaaataaaaaaaataaaaacaaaaaaatacatcaataaaaaaacgcgcgaaaaaaacccaaaaaaaaaaacttaaccgacgcgtcgccgattcctaaatcccaacacaaacgaaaaaacgaaaacgccaaatctattttttacccgcgataaaaaaaaaaacaaatctcgaaaaaccccgaaaaccttttaatttttaataaaaaaaaaacgaaaacgcgcgtatacccgcgtaaatatatataaaaaaaaaacgaacgaacgcgaaacgaaaaaaataaccgaaaaacgaaaaaactcgccgtacaacatactaaacctcaaaacgcacgctttctcgataaaaacgctaatcgacgccgaaaaacaacaacaacttcaaaaaaaacgacgaaaactaaacgccgaaaaaacgacgaaaaccgtaaacgacgaaaactacaaccgcgacgacgacgcgaacgaaaaaaattcttctaaaaaaaacgaaaacgctacgctcccgccgccgactaaaacgacgtctaaaccgactcgaaataacgcaaacctaaaacgcgaaaccgcgaataaataaaccccttcctacctataacttctctccgacgcgaacctaaacttctacgaatctataaatatacgtacgcgccgcgtccctacataaccaaaaccactcaaccactaacgcattaaccgtatcaatcgcaaaactcgccgcgcaacctaatcaccctccaaacgattcaaatactacttccaaactcgcctcgcgaacgaccgccgcccactcgacgacccgcgccttc

SEQ ID NO: 18415 - DNA, 823 bp, Artificial Sequence
  chemically treated genomic DNA (Homo sapiens) CpG-island No: 18415
atttcggagtagtaggaggaggtggaaggggtgggagtaaaggagtgtattagtgagagagcgcgcgagagagatttaggaaaggagatttggtcggcgcgtcgtcggtttttggattttaatataagcgagaaagcggaaacgttaaatttgttttttgttcgcggtggggaagggggtagatttcgggaggtttcgagagttttttagtttttggtgggggaagagcgagagcgcgcgtgtgttcgcgtgagtgtatatgagagaggggcgggcgggcgcggggcgggggggatggtcgagaagcgaaggggttcgtcgtgtagtatgttaagttttaaggcgtacgttttttcggtggaggcgttgatcggcgtcgagaagtagtaatagttttagaagaagcggcgaaaattgggcgtcgaagaggcggcgggggtcgtggacgacggaggttgtagtcgcggcggcggcgcgggcgaaaagggtttttttgagggagacgaaggcgttgcgttttcgtcgtcggttggggcgacgtttgggtcggttcggagtggcgtagatttggagcgcggagtcgcgggtgagtgggtttttttttgtttataattttttttcggcgcgaatttgaatttttgcgagtttgtgggtgtgcgtgcgcgtcgcgtttttatatggttaaggttatttagttattagcgtattggtcgtgttagtcgtaaagttcgtcgcgtaatttggttattttttagacggtttagatattgtttttaggttcgtttcgcgggcggtcgtcgtttattcggcgattcgcgttttt

SEQ ID NO: 18416 - DNA, 823 bp, Artificial Sequence
  chemically treated genomic DNA (Homo sapiens) CpG-island No: 18416
aaaaacgcgaatcgccgaataaacgacgaccgcccgcgaaacgaacctaaaaacaatatctaaaccgtctaaaaaataaccaaattacgcgacgaactttacgactaacacgaccaatacgctaataactaaataaccttaaccatataaaaacgcgacgcgcacgcacacccacaaactcgcaaaaattcaaattcgcgccgaaaaaaaattataaacaaaaaaaaacccactcacccgcgactccgcgctccaaatctacgccactccgaaccgacccaaacgtcgccccaaccgacgacgaaaacgcaacgccttcgtctccctcaaaaaaacccttttcgcccgcgccgccgccgcgactacaacctccgtcgtccacgacccccgccgcctcttcgacgcccaattttcgccgcttcttctaaaactattactacttctcgacgccgatcaacgcctccaccgaaaaaacgtacgccttaaaacttaacatactacacgacgaaccccttcgcttctcgaccatcccccccgccccgcgcccgcccgcccctctctcatatacactcacgcgaacacacgcgcgctctcgctcttcccccaccaaaaactaaaaaactctcgaaacctcccgaaatctacccccttccccaccgcgaacaaaaaacaaatttaacgtttccgctttctcgcttatattaaaatccaaaaaccgacgacgcgccgaccaaatctcctttcctaaatctctctcgcgcgctctctcactaatacactcctttactcccaccccttccacctcctcctactactccgaaat

SEQ ID NO: 18417 - DNA, 527 bp, Artificial Sequence
  chemically treated genomic DNA (Homo sapiens) CpG-island No: 18417
ttagtgtaagttttcgtttcggaatttcggttttagtttagttcgcgtttttttttttggaaagatttggtcggtcgcgttttcgaattttcgaggcgtgggtgttaggttaagcggggttggttcgatcggtcgtttttagttttttttatttgttggaaagtttaggtttaagaatcgcgttagcggcggtagtacgttattcggcggttacggggagttagggagcgcggaacgcgggtttttgttgataagtgtaaagtacggttttttcggtgttaagtgtatagtaagtgcgaagaataaatatattatttttcggggcggttgtttcgaaaacgttttttagttgtttgcgttttagagttcgttaagggttatagtttagtgtgggcgttcgcgtcgcgtttgcgttttcgagcgtcggtcgagaagggcgcgtagttatagttattatatgttattagtttcgtaaggcgtttgatttttttaaggggaattcgtaatgtttattaaaagttttagaa

SEQ ID NO: 18418 - DNA, 527 bp, Artificial Sequence
  chemically treated genomic DNA (Homo sapiens) CpG-island No: 18418
ttctaaaacttttaataaacattacgaattccccttaaaaaaatcaaacgccttacgaaactaataacatataataactataactacgcgcccttctcgaccgacgctcgaaaacgcaaacgcgacgcgaacgcccacactaaactataacccttaacgaactctaaaacgcaaacaactaaaaaacgttttcgaaacaaccgccccgaaaaataatatatttattcttcgcacttactatacacttaacaccgaaaaaaccgtactttacacttatcaacaaaaacccgcgttccgcgctccctaactccccgtaaccgccgaataacgtactaccgccgctaacgcgattcttaaacctaaactttccaacaaataaaaaaaactaaaaacgaccgatcgaaccaaccccgcttaacctaacacccacgcctcgaaaattcgaaaacgcgaccgaccaaatctttccaaaaaaaaaaacgcgaactaaactaaaaccgaaattccgaaacgaaaacttacactaa

SEQ ID NO: 18419 - DNA, 527 bp, Artificial Sequence
  chemically treated genomic DNA (Homo sapiens) CpG-island No: 18419
ttttgaggtttttggtgagtattacgagttttttttagaggagttaggcgttttgcggggttagtggtatgtggtggttgtggttgcgcgtttttttcggtcggcgttcggaggcgtaggcgcggcgcggacgtttatattaagttataatttttgacgggttttgaaacgtaggtagttgagaggcgttttcgagatagtcgtttcgggagatgatgtatttatttttcgtatttattgtgtatttagtatcgagagggtcgtattttgtatttattaatagaaattcgcgtttcgcgttttttgatttttcgtggtcgtcgagtgacgtgttgtcgtcgttggcgcggtttttgggtttgggttttttaataggtggagagagttggaagcgatcggtcggattagtttcgtttagtttgatatttacgtttcgggggttcgggggcgcggtcggttaggtttttttagggaagggggcgcgggttgggttggagtcgggatttcggagcgggggtttatattgg

SEQ ID NO: 18420 - DNA, 527 bp, Artificial Sequence
  chemically treated genomic DNA (Homo sapiens) CpG-island No: 18420
ccaatataaacccccgctccgaaatcccgactccaacccaacccgcgcccccttccctaaaaaaacctaaccgaccgcgcccccgaacccccgaaacgtaaatatcaaactaaacgaaactaatccgaccgatcgcttccaactctctccacctattaaaaaacccaaacccaaaaaccgcgccaacgacgacaacacgtcactcgacgaccacgaaaaatcaaaaaacgcgaaacgcgaatttctattaataaatacaaaatacgaccctctcgatactaaatacacaataaatacgaaaaataaatacatcatctcccgaaacgactatctcgaaaacgcctctcaactacctacgtttcaaaacccgtcaaaaattataacttaatataaacgtccgcgccgcgcctacgcctccgaacgccgaccgaaaaaaacgcgcaaccacaaccaccacataccactaaccccgcaaaacgcctaactcctctaaaaaaaactcgtaatactcaccaaaaacctcaaaa

SEQ ID NO: 18421 - DNA, 501 bp, Artificial Sequence
  chemically treated genomic DNA (Homo sapiens) CpG-island No: 18421
tttttcgtcggtagcgttttggttttgggcgttcgtcgttttggttatggaggtatagtggtcgcgtttcggggagtttgggtttttttgcggtttcgagttttcgcggcgttcgcgtttcgatttttcggtttcggttttttttaggttcggttgttttcggttttttattgatttcgttagtcgtattatttatttttttttttcgtagacgtaaattcgaatacgtttcggttttgggtttagggtttcggtttcgtttggttttataggattcgggggcggggtaggtcggtagagtttagttcgcgtcgtgggtttatatgtttttatttcgtgattttgatcgcgtttcggttataattttttttgcgttataacggggataataattttcggtcggtttgtcggatggtggcgggataatatatttcggtgagggaaggatcgagtttggtagagatatttaattgttttattgtgtggttgtttatagttcgt

SEQ ID NO: 18422 - DNA, 501 bp, Artificial Sequence
  chemically treated genomic DNA (Homo sapiens) CpG-island No: 18422
acgaactataaacaaccacacaataaaacaattaaatatctctaccaaactcgatccttccctcaccgaaatatattatcccgccaccatccgacaaaccgaccgaaaattattatccccgttataacgcaaaaaaaattataaccgaaacgcgatcaaaatcacgaaataaaaacatataaacccacgacgcgaactaaactctaccgacctaccccgcccccgaatcctataaaaccaaacgaaaccgaaaccctaaacccaaaaccgaaacgtattcgaatttacgtctacgaaaaaaaaaaataaataatacgactaacgaaatcaataaaaaaccgaaaacaaccgaacctaaaaaaaaccgaaaccgaaaaatcgaaacgcgaacgccgcgaaaactcgaaaccgcaaaaaaacccaaactccccgaaacgcgaccactatacctccataaccaaaacgacgaacgcccaaaaccaaaacgctaccgacgaaaaa

SEQ ID NO: 18423 - DNA, 501 bp, Artificial Sequence
  chemically treated genomic DNA (Homo sapiens) CpG-island No: 18423
gcggattgtgaatagttatatagtgggatagttaagtgtttttgttaagttcggttttttttttatcgggatatattatttcgttattattcggtaggtcggtcggggattattattttcgttgtaacgtagaggaagttatggtcgggacgcggttagggttacgaaataaaaatatgtggatttacggcgcgagttgagttttgtcggtttatttcgttttcgaattttgtagagttaggcgaggtcgaggttttaggtttaaggtcggggcgtattcgggtttacgtttgcgggagaaagaggtgggtggtgcggttggcgaagttagtgagggatcggagatagtcgggtttggagagagtcgggatcggagagtcggggcgcgggcgtcgcggaggttcggagtcgtaaggaggtttaggtttttcgggacgcggttattgtatttttatagttaaagcggcgggcgtttaaggttagagcgttatcgacgagaaa

SEQ ID NO: 18424 - DNA, 501 bp, Artificial Sequence
  chemically treated genomic DNA (Homo sapiens) CpG-island No: 18424
tttctcgtcgataacgctctaaccttaaacgcccgccgctttaactataaaaatacaataaccgcgtcccgaaaaacctaaacctccttacgactccgaacctccgcgacgcccgcgccccgactctccgatcccgactctctccaaacccgactatctccgatccctcactaacttcgccaaccgcaccacccacctctttctcccgcaaacgtaaacccgaatacgccccgaccttaaacctaaaacctcgacctcgcctaactctacaaaattcgaaaacgaaataaaccgacaaaactcaactcgcgccgtaaatccacatatttttatttcgtaaccctaaccgcgtcccgaccataacttcctctacgttacaacgaaaataataatccccgaccgacctaccgaataataacgaaataatatatcccgataaaaaaaaaaccgaacttaacaaaaacacttaactatcccactatataactattcacaatccgc

SEQ ID NO: 18425 - DNA, 611 bp, Artificial Sequence
  chemically treated genomic DNA (Homo sapiens) CpG-island No: 18425
tgcgtcgggaggcgggtttcgcgttgcggaaagtttatcgcggcgggcggggggaggtttcggtttcgttcgtcggcgtttttttgtagattttattattaattagttttaaggattgtttattggtaatttaaataaagcgaatgtttcgaattttttttcggtttagcggtttggttgcgagattagtagagcgttcgggacgcgggtcggcgcggtcgatagttgcggcggtcgcgggattttttttcgttcggttcgcggttcgcgtttcgcgttcgtagttggtttcgtacgtcggttcgacgcgtttttaaatcgtttttttttttttgttgttgtagttttcgggttttttttgtttgattatttttttttttcggtgttcgtcgggtttcgcgtagttttttttacggtcgtttcgtcgtttttcgtttttgtcggttcgcgtttttttttttaattttaaattttattttcgaaatttttcgtcgttttttcgaaaatgtttttttcgcgtttttgttttaaatatttttttttagagtttcgtttttattaagaagtttttttagaattttttttttttttttcgaggaaaaattttttta

SEQ ID NO: 18426 - DNA, 611 bp, Artificial Sequence
  chemically treated genomic DNA (Homo sapiens) CpG-island No: 18426
taaaaaaatttttcctcgaaaaaaaaaaaaaaaattctaaaaaaacttcttaataaaaacgaaactctaaaaaaaaatatttaaaacaaaaacgcgaaaaaaacattttcgaaaaaacgacgaaaaatttcgaaaataaaatttaaaattaaaaaaaaaaacgcgaaccgacaaaaacgaaaaacgacgaaacgaccgtaaaaaaaactacgcgaaacccgacgaacaccgaaaaaaaaaaataatcaaacaaaaaaaacccgaaaactacaacaacaaaaaaaaaaaaacgatttaaaaacgcgtcgaaccgacgtacgaaaccaactacgaacgcgaaacgcgaaccgcgaaccgaacgaaaaaaaatcccgcgaccgccgcaactatcgaccgcgccgacccgcgtcccgaacgctctactaatctcgcaaccaaaccgctaaaccgaaaaaaaattcgaaacattcgctttatttaaattaccaataaacaatccttaaaactaattaataataaaatctacaaaaaaacgccgacgaacgaaaccgaaacctccccccgcccgccgcgataaactttccgcaacgcgaaacccgcctcccgacgca

SEQ ID NO: 18427 - DNA, 611 bp, Artificial Sequence
  chemically treated genomic DNA (Homo sapiens) CpG-island No: 18427
tgaggagattttttttcgggagggggagggaaggttttgaggagattttttggtgggagcgagattttgaggagaaatgtttggggtagagacgcggaggagatattttcgagggggcggcgaagagtttcgggggtagagtttggggttgggggagggggcgcgggtcgataggggcggggggcgacgaggcggtcgtggagggggttgcgcggggttcggcgggtatcggaggaaggaagtgattagataggaagggttcgggagttgtagtagtaggaggaggagggcggtttgggagcgcgtcgggtcggcgtgcggggttagttgcgggcgcggggcgcgggtcgcgggtcgggcggggaggggtttcgcggtcgtcgtagttgtcggtcgcgtcggttcgcgtttcgggcgttttgttggtttcgtagttagatcgttgggtcgggaaggaattcgaggtattcgttttgtttaagttgttagtagatagtttttaggattaattaatggtggaatttgtagggggacgtcggcgagcggggtcggggttttttttcgttcgtcgcggtgaatttttcgtagcgcggggttcgtttttcggcgta

SEQ ID NO: 18428 - DNA, 611 bp, Artificial Sequence
  chemically treated genomic DNA (Homo sapiens) CpG-island No: 18428
tacgccgaaaaacgaaccccgcgctacgaaaaattcaccgcgacgaacgaaaaaaaaccccgaccccgctcgccgacgtccccctacaaattccaccattaattaatcctaaaaactatctactaacaacttaaacaaaacgaatacctcgaattccttcccgacccaacgatctaactacgaaaccaacaaaacgcccgaaacgcgaaccgacgcgaccgacaactacgacgaccgcgaaacccctccccgcccgacccgcgacccgcgccccgcgcccgcaactaaccccgcacgccgacccgacgcgctcccaaaccgccctcctcctcctactactacaactcccgaacccttcctatctaatcacttccttcctccgatacccgccgaaccccgcgcaaccccctccacgaccgcctcgtcgccccccgcccctatcgacccgcgccccctcccccaaccccaaactctacccccgaaactcttcgccgccccctcgaaaatatctcctccgcgtctctaccccaaacatttctcctcaaaatctcgctcccaccaaaaaatctcctcaaaaccttccctccccctcccgaaaaaaaatctcctca

SEQ ID NO: 18429 - DNA, 766 bp, Artificial Sequence
  chemically treated genomic DNA (Homo sapiens) CpG-island No: 18429
atgacgaatttttggttgaagagcgggtaatttttcgtttttttgcggaaagttatggtagcgggcgcgtagcggtcggcggggttcgtattttgcgtttacgaatcgtagcgtaaatttttttagtatcggttcggttcgttcgtcggttcgtcgttcgtttttttatagtcgttcgttcgtttagcgcggaataatttcggggttcgtttttttttttcgttcgttttcggtcgttcgtaatcgttttcggtcgtagttttcgtttagttttcgtttagttcgcggttcgtattcggcgcgtttggtttcgtttttcgcgggtttaattttttagtcgttgggtacgcgcgggttatcggggcggaggcgtacgggggcggcgagcggggttcggttttttttcgtttcgcgttagcgtcgcgttcggtcgtattttcggggttcgaggtttagtcgttcgcggtggagaaagtaggtcgcggaggaggcgggcgtttaggtttgttcggataggaagtgggtttagtttttttatttttcgtttcgttttttttttcgcgggaagggtaggtttcggaggtagcgagcgtttcgggggtggtcgggtagtcggatgttttcggggttgcgggttgtggtttcgggggttgagggcggcgcgggtgcggcggaagtagggaagtcgcgaatcggttttttggttggttatagcgttttgtacggacgattagtgaatggagattatttaagtatttatcgagaa

SEQ ID NO: 18430 - DNA, 766 bp, Artificial Sequence
  chemically treated genomic DNA (Homo sapiens) CpG-island No: 18430
ttctcgataaatacttaaataatctccattcactaatcgtccgtacaaaacgctataaccaaccaaaaaaccgattcgcgacttccctacttccgccgcacccgcgccgccctcaacccccgaaaccacaacccgcaaccccgaaaacatccgactacccgaccacccccgaaacgctcgctacctccgaaacctacccttcccgcgaaaaaaaaaacgaaacgaaaaataaaaaaactaaacccacttcctatccgaacaaacctaaacgcccgcctcctccgcgacctactttctccaccgcgaacgactaaacctcgaaccccgaaaatacgaccgaacgcgacgctaacgcgaaacgaaaaaaaaccgaaccccgctcgccgcccccgtacgcctccgccccgataacccgcgcgtacccaacgactaaaaaattaaacccgcgaaaaacgaaaccaaacgcgccgaatacgaaccgcgaactaaacgaaaactaaacgaaaactacgaccgaaaacgattacgaacgaccgaaaacgaacgaaaaaaaaaaacgaaccccgaaattattccgcgctaaacgaacgaacgactataaaaaaacgaacgacgaaccgacgaacgaaccgaaccgatactaaaaaaatttacgctacgattcgtaaacgcaaaatacgaaccccgccgaccgctacgcgcccgctaccataactttccgcaaaaaaacgaaaaattacccgctcttcaaccaaaaattcgtcat

SEQ ID NO: 18431 - DNA, 766 bp, Artificial Sequence
  chemically treated genomic DNA (Homo sapiens) CpG-island No: 18431
ttttcgataaatatttgagtaatttttatttattgatcgttcgtgtagggcgttgtggttagttagaaggtcggttcgcggtttttttgttttcgtcgtattcgcgtcgtttttagttttcggggttatagttcgtaatttcgggagtattcggttgttcggttattttcggggcgttcgttgttttcggggtttgtttttttcgcggaggaaggagcggagcgaggagtgggaaagttgggtttattttttgttcgggtaggtttgggcgttcgtttttttcgcggtttgttttttttatcgcgagcggttgagtttcgggtttcgagaatgcggtcgggcgcggcgttggcgcgggacgaggaggagtcgagtttcgttcgtcgttttcgtacgttttcgtttcggtagttcgcgcgtgtttagcggttagagggttaagttcgcggggggcggggttaggcgcgtcgagtgcgggtcgcgggttgggcgggggttgggcgggggttgcggtcgggggcggttacgggcggtcgggggcgggcggaggaagggggcgggtttcgaagttgtttcgcgttgggcgggcgagcggttgtgggagagcgggcggcgggtcggcgggcggatcgggtcggtgttggagaagtttgcgttgcggttcgtgagcgtagggtgcgggtttcgtcggtcgttgcgcgttcgttgttatggtttttcgtaggaggacgaaaagttattcgttttttagttaggagttcgttat

SEQ ID NO: 18432 - DNA, 766 bp, Artificial Sequence
  chemically treated genomic DNA (Homo sapiens) CpG-island No: 18432
ataacgaactcctaactaaaaaacgaataacttttcgtcctcctacgaaaaaccataacaacgaacgcgcaacgaccgacgaaacccgcaccctacgctcacgaaccgcaacgcaaacttctccaacaccgacccgatccgcccgccgacccgccgcccgctctcccacaaccgctcgcccgcccaacgcgaaacaacttcgaaacccgcccccttcctccgcccgcccccgaccgcccgtaaccgcccccgaccgcaacccccgcccaacccccgcccaacccgcgacccgcactcgacgcgcctaaccccgccccccgcgaacttaaccctctaaccgctaaacacgcgcgaactaccgaaacgaaaacgtacgaaaacgacgaacgaaactcgactcctcctcgtcccgcgccaacgccgcgcccgaccgcattctcgaaacccgaaactcaaccgctcgcgataaaaaaaacaaaccgcgaaaaaaacgaacgcccaaacctacccgaacaaaaaataaacccaactttcccactcctcgctccgctccttcctccgcgaaaaaaacaaaccccgaaaacaacgaacgccccgaaaataaccgaacaaccgaatactcccgaaattacgaactataaccccgaaaactaaaaacgacgcgaatacgacgaaaacaaaaaaaccgcgaaccgaccttctaactaaccacaacgccctacacgaacgatcaataaataaaaattactcaaatatttatcgaaaa

SEQ ID NO: 18433 - DNA, 528 bp, Artificial Sequence
  chemically treated genomic DNA (Homo sapiens) CpG-island No: 18433
ggagcgtcggtgtagttcgcggtagcgttgtagcgaggggacgtgcgcggagcggttgatttcgggcggcggagattaatttcgcgttcggttttcggttttagtttttttttggtttcggttttcgttgtcgtttcggattcgttttttaggaagttttattacgttaagtttttagaatcgcggtcgtttttgcggtcgcggcgggtgtcgggattgagaaaataggtcgaattagaggcggggttttcgtagaggggcggggtttggtgagtgggggagtggtttagtttggcgggtgggcggtgttagagggggcggggtcgtgtttggttggggagggatcgaggttggtaaggatagaaatattataaggaaaagtcgagggataggggtggagttgatttgtcggaaggagtgacgtcgtcgagtgaaagtagaaggggcggggtcgggtgtgataagggagagggtggaatcgtggagtgttaagggaggggcggggttaggcgggataggagaggaggt

SEQ ID NO: 18434 - DNA, 528 bp, Artificial Sequence
  chemically treated genomic DNA (Homo sapiens) CpG-island No: 18434
acctcctctcctatcccgcctaaccccgcccctcccttaacactccacgattccaccctctcccttatcacacccgaccccgccccttctactttcactcgacgacgtcactccttccgacaaatcaactccacccctatccctcgacttttccttataatatttctatccttaccaacctcgatccctccccaaccaaacacgaccccgccccctctaacaccgcccacccgccaaactaaaccactcccccactcaccaaaccccgcccctctacgaaaaccccgcctctaattcgacctattttctcaatcccgacacccgccgcgaccgcaaaaacgaccgcgattctaaaaacttaacgtaataaaacttcctaaaaaacgaatccgaaacgacaacgaaaaccgaaaccaaaaaaaaactaaaaccgaaaaccgaacgcgaaattaatctccgccgcccgaaatcaaccgctccgcgcacgtcccctcgctacaacgctaccgcgaactacaccgacgctcc

SEQ ID NO: 18435 - DNA, 528 bp, Artificial Sequence
  chemically treated genomic DNA (Homo sapiens) CpG-island No: 18435
atttttttttttgtttcgtttggtttcgttttttttttggtattttacggttttatttttttttttgttatattcggtttcgttttttttgtttttattcgacggcgttatttttttcggtaagttagttttatttttatttttcgatttttttttatagtatttttgtttttgttaatttcgatttttttttaattagatacggtttcgttttttttggtatcgtttattcgttagattaagttatttttttatttattaggtttcgtttttttacggaggtttcgtttttagttcggtttgtttttttagtttcggtattcgtcgcgatcgtaaaggcggtcgcggttttaggaatttgacgtgatggggttttttgaggagcgggttcggagcggtagcgggagtcggggttaggaggaagttggagtcggaggtcgggcgcggagttggttttcgtcgttcgaggttagtcgtttcgcgtacgttttttcgttgtagcgttatcgcgagttgtatcggcgtttt

SEQ ID NO: 18436 - DNA, 528 bp, Artificial Sequence
  chemically treated genomic DNA (Homo sapiens) CpG-island No: 18436
aaaacgccgatacaactcgcgataacgctacaacgaaaaaacgtacgcgaaacgactaacctcgaacgacgaaaaccaactccgcgcccgacctccgactccaacttcctcctaaccccgactcccgctaccgctccgaacccgctcctcaaaaaaccccatcacgtcaaattcctaaaaccgcgaccgcctttacgatcgcgacgaataccgaaactaaaaaaacaaaccgaactaaaaacgaaacctccgtaaaaaaacgaaacctaataaataaaaaaataacttaatctaacgaataaacgataccaaaaaaaacgaaaccgtatctaattaaaaaaaaatcgaaattaacaaaaacaaaaatactataaaaaaaaatcgaaaaataaaaataaaactaacttaccgaaaaaaataacgccgtcgaataaaaacaaaaaaaacgaaaccgaatataacaaaaaaaaaaataaaaccgtaaaataccaaaaaaaaaacgaaaccaaacgaaacaaaaaaaaaaat

SEQ ID NO: 18437 - DNA, 668 bp, Artificial Sequence
  chemically treated genomic DNA (Homo sapiens) CpG-island No: 18437
cgaagggagttggcgcgcgttttatttcgcgttttcggggacgtttggttacgtgggtaatgtttcgtttttcgagttcgtttcgttttttttcgcgtttttttttttttttttttttttttttttttttttcggttcggttcggtttattttttttttcgtcggtttcgtgaggttttgtcgggtcgggttgcgggcggtcgggcgcgggcggcgggatagacgggcgtacgcgaggattgacggacggacgtatcgagggcggcgggtacgtacggttcgggtcggcgttttaaggttcgttcgggagggtcggggtcgcgtttaggtgaggggacggcggcgcgggttcgtaaggggtgggttcgtcgggcgttcgcggtttttgtcgggttggtttcgcggggaggaggcgtcgttcgggttcgcgcggaaaaatggcgtcgggcgatcgagtggtacggtttgagagcgggttcggttcggagtcgtttcgttcgtcgcgtttgtgttttcgtcgttatgttggggagcgggttttaggtttgcgggcgggggcgttggagggagcggcggtcgggttgggtggggagggtgttgggcgcgggggtcggtgtattgagggagtgtagggttggtcggggtttgtacggggtggcgttttaggt

SEQ ID NO: 18438 - DNA, 668 bp, Artificial Sequence
  chemically treated genomic DNA (Homo sapiens) CpG-island No: 18438
acctaaaacgccaccccgtacaaaccccgaccaaccctacactccctcaatacaccgacccccgcgcccaacaccctccccacccaacccgaccgccgctccctccaacgcccccgcccgcaaacctaaaacccgctccccaacataacgacgaaaacacaaacgcgacgaacgaaacgactccgaaccgaacccgctctcaaaccgtaccactcgatcgcccgacgccatttttccgcgcgaacccgaacgacgcctcctccccgcgaaaccaacccgacaaaaaccgcgaacgcccgacgaacccaccccttacgaacccgcgccgccgtcccctcacctaaacgcgaccccgaccctcccgaacgaaccttaaaacgccgacccgaaccgtacgtacccgccgccctcgatacgtccgtccgtcaatcctcgcgtacgcccgtctatcccgccgcccgcgcccgaccgcccgcaacccgacccgacaaaacctcacgaaaccgacgaaaaaaaaaataaaccgaaccgaaccgaaaaaaaaaaaaaaaaaaaaaaaaaaaaaaaaaaacgcgaaaaaaaacgaaacgaactcgaaaaacgaaacattacccacgtaaccaaacgtccccgaaaacgcgaaataaaacgcgcgccaactcccttcg

SEQ ID NO: 18439 - DNA, 668 bp, Artificial Sequence
  chemically treated genomic DNA (Homo sapiens) CpG-island No: 18439
gtttggagcgttatttcgtgtagatttcggttagttttgtatttttttagtgtatcggttttcgcgtttagtattttttttatttagttcggtcgtcgttttttttagcgttttcgttcgtaggtttggggttcgttttttaatatggcgacggggatataagcgcggcgggcggggcggtttcgggtcgggttcgtttttagatcgtgttattcggtcgttcggcgttattttttcgcgcgggttcgggcggcgtttttttttcgcgaagttagttcgataaggatcgcggacgttcggcgggtttattttttacgggttcgcgtcgtcgtttttttatttgagcgcggtttcggttttttcgggcgggttttggagcgtcggttcgggtcgtgcgtgttcgtcgttttcggtgcgttcgttcgttagttttcgcgtgcgttcgtttgtttcgtcgttcgcgttcggtcgttcgtagttcgattcggtagggttttacggagtcggcggggagggggatgggtcggatcgggtcggggagggagggggagggagggagagagggagggagcgcgagagggggcggggcggattcgaggggcggggtattgtttacgtgattagacgttttcgggagcgcgaggtggagcgcgcgttagtttttttcg

SEQ ID NO: 18440 - DNA, 668 bp, Artificial Sequence
  chemically treated genomic DNA (Homo sapiens) CpG-island No: 18440
cgaaaaaaactaacgcgcgctccacctcgcgctcccgaaaacgtctaatcacgtaaacaataccccgcccctcgaatccgccccgccccctctcgcgctccctccctctctccctccctccccctccctccccgacccgatccgacccatccccctccccgccgactccgtaaaaccctaccgaatcgaactacgaacgaccgaacgcgaacgacgaaacaaacgaacgcacgcgaaaactaacgaacgaacgcaccgaaaacgacgaacacgcacgacccgaaccgacgctccaaaacccgcccgaaaaaaccgaaaccgcgctcaaataaaaaaacgacgacgcgaacccgtaaaaaataaacccgccgaacgtccgcgatccttatcgaactaacttcgcgaaaaaaaaacgccgcccgaacccgcgcgaaaaaataacgccgaacgaccgaataacacgatctaaaaacgaacccgacccgaaaccgccccgcccgccgcgcttatatccccgtcgccatattaaaaaacgaaccccaaacctacgaacgaaaacgctaaaaaaaacgacgaccgaactaaataaaaaaaatactaaacgcgaaaaccgatacactaaaaaaatacaaaactaaccgaaatctacacgaaataacgctccaaac

SEQ ID NO: 18441 - DNA, 575 bp, Artificial Sequence
  chemically treated genomic DNA (Homo sapiens) CpG-island No: 18441
taattgcgatagtcgcgtagcgtttttttcgtttgttttttttagggaaaaattttttttttggagttcgcgaaagttttcgtttttgtttaagtattaattatttattttttcgatgttttcgtcgattgttaggttgcggtagttaatattattgtgggtgtattcgcgaagagattttatgttttaagcgttgtcgataaagttgtgtatttttgtagattttgtgcgtggtttcgcggcgatttcggggttggaattggttttgggattaatggttcgggcgagcgtttttttggcgtcgggatttttttttggcgtcgtttggtatttgcgcgttttatatagcggtacggtgtttttcgtaggtttaaagcgtatgtatacgcgtcggttaaacgttttttattagtatttatagtatatttagttgtgagtgcgattttcgggggacgtattcgtgtttagggcgtacgaaaaatagggcgagcgtgcgtaagtatggtgtaggtagtgaatatgttttgcggggaatagtggttttaaattgttgtttaattaattatttttaattt

SEQ ID NO: 18442 - DNA, 575 bp, Artificial Sequence
  chemically treated genomic DNA (Homo sapiens) CpG-island No: 18442
aaattaaaaataattaattaaacaacaatttaaaaccactattccccgcaaaacatattcactacctacaccatacttacgcacgctcgccctatttttcgtacgccctaaacacgaatacgtcccccgaaaatcgcactcacaactaaatatactataaatactaataaaaaacgtttaaccgacgcgtatacatacgctttaaacctacgaaaaacaccgtaccgctatataaaacgcgcaaataccaaacgacgccaaaaaaaaatcccgacgccaaaaaaacgctcgcccgaaccattaatcccaaaaccaattccaaccccgaaatcgccgcgaaaccacgcacaaaatctacaaaaatacacaactttatcgacaacgcttaaaacataaaatctcttcgcgaatacacccacaataatattaactaccgcaacctaacaatcgacgaaaacatcgaaaaaataaataattaatacttaaacaaaaacgaaaactttcgcgaactccaaaaaaaaaatttttccctaaaaaaaacaaacgaaaaaaacgctacgcgactatcgcaatta

SEQ ID NO: 18443 - DNA, 575 bp, Artificial Sequence
  chemically treated genomic DNA (Homo sapiens) CpG-island No: 18443
aagttgggagtagttagttaagtagtaatttggggttattgtttttcgtaaagtatgtttattatttgtattatgtttgcgtacgttcgttttatttttcgtacgttttggatacgaatgcgtttttcgggggtcgtatttataattagatgtattgtgaatgttaatagggggcgtttaatcgacgcgtgtgtatacgttttgaatttgcggaaggtatcgtatcgttatatagggcgcgtaagtgttagacggcgttagaaagaggtttcggcgttagaaaagcgttcgttcgagttattggttttagagttagttttaatttcgggatcgtcgcggaattacgtatagagtttgtagaagtgtatagttttatcgatagcgtttgaagtatggagttttttcgcgggtatatttatagtgatattggttatcgtagtttggtagtcggcgaggatatcgaggaagtgaatggttagtgtttggatagggacgggagttttcgcgaattttaaaagaggaatttttttttgggagaggtaagcggaggagacgttgcgcggttgtcgtagttg

SEQ ID NO: 18444 - DNA, 575 bp, Artificial Sequence
  chemically treated genomic DNA (Homo sapiens) CpG-island No: 18444
caactacgacaaccgcgcaacgtctcctccgcttacctctcccaaaaaaaaattcctcttttaaaattcgcgaaaactcccgtccctatccaaacactaaccattcacttcctcgatatcctcgccgactaccaaactacgataaccaatatcactataaatatacccgcgaaaaaactccatacttcaaacgctatcgataaaactatacacttctacaaactctatacgtaattccgcgacgatcccgaaattaaaactaactctaaaaccaataactcgaacgaacgcttttctaacgccgaaacctctttctaacgccgtctaacacttacgcgccctatataacgatacgataccttccgcaaattcaaaacgtatacacacgcgtcgattaaacgccccctattaacattcacaatacatctaattataaatacgacccccgaaaaacgcattcgtatccaaaacgtacgaaaaataaaacgaacgtacgcaaacataatacaaataataaacatactttacgaaaaacaataaccccaaattactacttaactaactactcccaactt

SEQ ID NO: 18445 - DNA, 997 bp, Artificial Sequence
  chemically treated genomic DNA (Homo sapiens) CpG-island No: 18445
gcgcgttgtgtatgttgggattcgcgcgatgagggtttgcggggtcgttaaaggagtttacggattttatttatttgcggttgtagtagattgattttttttattttttttagcgttagtagcgcgtagtcgatcgcgtgtttaaatagtacgtgtaatagtatttggaacgggagtcggggcgcgagcgttaacgtaattttagcgtttgtcggaattcgtttttagggtaggcgtaggcgtaggcgtaggtttaggtttaggtttaggttttgtttgcggttcgaacgtaggtcgaaatttttatcgtcgcgtcgttcgcgtttcgtaattattttttattatggcgttagttttcgggttcggttcgtaatgcggttagcgcgtttcggcgcgcggaattaggttttagaggttacgttttcgttttttcgattaatcggaggtcggggacgatattattttcggtttttggaggggtcgtttagggtggtatcgttcggagcgcgggttgggtggtgtcgagcgcgggcgagcgggtttttttcggtttttgtagttgcgcgggcgggcgtggttgtcggggacgcgcggttttcggtcgggtattgtaggcggcgaaacgatttgggaaggttttttcggggtaatagttcggtttttgatgtttttgttatatgagttacgggtagtagagttgggtgaagtcggggcgggaggttcgcgtggggcgcggcgtttattttagatagagatcgttgtttagtcggtttttcgtttcgttcgtggtttcgggttttagattttgcgttttacgttttcgggatttaggcgttttcgttttttattcggggacgagttttttcggcgtcgggtgggcggtgtattttttttttttattcgtaacgggagcggtgtttggcgcgttttggcgtagattttgttgggaatgtagttcgcgtagtttttttcgtattattaatttattttttttttt

SEQ ID NO: 18446 - DNA, 997 bp, Artificial Sequence
  chemically treated genomic DNA (Homo sapiens) CpG-island No: 18446
aaaaaaaaaaataaattaataatacgaaaaaaactacgcgaactacattcccaacaaaatctacgccaaaacgcgccaaacaccgctcccgttacgaataaaaaaaaaaaatacaccgcccacccgacgccgaaaaaactcgtccccgaataaaaaacgaaaacgcctaaatcccgaaaacgtaaaacgcaaaatctaaaacccgaaaccacgaacgaaacgaaaaaccgactaaacaacgatctctatctaaaataaacgccgcgccccacgcgaacctcccgccccgacttcacccaactctactacccgtaactcatataacaaaaacatcaaaaaccgaactattaccccgaaaaaaccttcccaaatcgtttcgccgcctacaatacccgaccgaaaaccgcgcgtccccgacaaccacgcccgcccgcgcaactacaaaaaccgaaaaaaacccgctcgcccgcgctcgacaccacccaacccgcgctccgaacgataccaccctaaacgacccctccaaaaaccgaaaataatatcgtccccgacctccgattaatcgaaaaaacgaaaacgtaacctctaaaacctaattccgcgcgccgaaacgcgctaaccgcattacgaaccgaacccgaaaactaacgccataataaaaaataattacgaaacgcgaacgacgcgacgataaaaatttcgacctacgttcgaaccgcaaacaaaacctaaacctaaacctaaacctacgcctacgcctacgcctaccctaaaaacgaattccgacaaacgctaaaattacgttaacgctcgcgccccgactcccgttccaaatactattacacgtactatttaaacacgcgatcgactacgcgctactaacgctaaaaaaaataaaaaaaatcaatctactacaaccgcaaataaataaaatccgtaaactcctttaacgaccccgcaaaccctcatcgcgcgaatcccaacatacacaacgcgc

SEQ ID NO: 18447 - DNA, 997 bp, Artificial Sequence
  chemically treated genomic DNA (Homo sapiens) CpG-island No: 18447
aaaaaaagaaataaattaatagtacgaagaaaattgcgcgagttatatttttagtagggtttgcgttagagcgcgttaggtatcgttttcgttacgggtgggaggaaaggatgtatcgtttattcggcgtcggggaggttcgttttcgagtaggggacgggaacgtttgggtttcggggacgtggggcgtagggtttggggttcgaggttacggacgaagcgggaagtcggttaggtagcggtttttgtttgggatggacgtcgcgttttacgcggatttttcgtttcgattttatttagttttgttgttcgtaatttatatgataagaatattaggaatcggattattatttcgaaagggtttttttaagtcgtttcgtcgtttgtagtgttcgatcgggggtcgcgcgttttcggtaattacgttcgttcgcgtagttgtagaggtcggaaaaggttcgttcgttcgcgttcggtattatttagttcgcgtttcgggcgatattattttgggcggtttttttaaaggtcggagatggtgtcgttttcggttttcgattggtcgggggggcgggggcgtggtttttggagtttggtttcgcgcgtcggagcgcgttagtcgtattgcgagtcgaattcgggagttggcgttatggtgaggagtggttgcggggcgcgggcgacgcgacggtgggggtttcggtttgcgttcgggtcgtagatagggtttgggtttgggtttgggtttgcgtttgcgtttgcgtttgttttgggaacgggtttcggtagacgttgaggttgcgttgacgttcgcgtttcggttttcgttttaggtgttgttgtacgtgttgtttgagtacgcggtcggttacgcgttgttggcgttgaaggaagtggaggagattagtttgttgtagtcgtaggtgggtgagattcgtgggtttttttggcggtttcgtagatttttatcgcgcgggttttagtatgtatagcgcgt

SEQ ID NO: 18448 - DNA, 997 bp, Artificial Sequence
  chemically treated genomic DNA (Homo sapiens) CpG-island No: 18448
acgcgctatacatactaaaacccgcgcgataaaaatctacgaaaccgccaaaaaaacccacgaatctcacccacctacgactacaacaaactaatctcctccacttccttcaacgccaacaacgcgtaaccgaccgcgtactcaaacaacacgtacaacaacacctaaaacgaaaaccgaaacgcgaacgtcaacgcaacctcaacgtctaccgaaacccgttcccaaaacaaacgcaaacgcaaacgcaaacccaaacccaaacccaaaccctatctacgacccgaacgcaaaccgaaacccccaccgtcgcgtcgcccgcgccccgcaaccactcctcaccataacgccaactcccgaattcgactcgcaatacgactaacgcgctccgacgcgcgaaaccaaactccaaaaaccacgcccccgcccccccgaccaatcgaaaaccgaaaacgacaccatctccgacctttaaaaaaaccgcccaaaataatatcgcccgaaacgcgaactaaataataccgaacgcgaacgaacgaaccttttccgacctctacaactacgcgaacgaacgtaattaccgaaaacgcgcgacccccgatcgaacactacaaacgacgaaacgacttaaaaaaaccctttcgaaataataatccgattcctaatattcttatcatataaattacgaacaacaaaactaaataaaatcgaaacgaaaaatccgcgtaaaacgcgacgtccatcccaaacaaaaaccgctacctaaccgacttcccgcttcgtccgtaacctcgaaccccaaaccctacgccccacgtccccgaaacccaaacgttcccgtcccctactcgaaaacgaacctccccgacgccgaataaacgatacatcctttcctcccacccgtaacgaaaacgatacctaacgcgctctaacgcaaaccctactaaaaatataactcgcgcaattttcttcgtactattaatttatttcttttttt

SEQ ID NO: 18449 - DNA, 585 bp, Artificial Sequence
  chemically treated genomic DNA (Homo sapiens) CpG-island No: 18449
cgtttcggcggaggcggaggaggcggtggcggggttcggggacgcgcgggcggcgggtatggtcgttatttagtgtatttacgcgttggtgtgtttggtggggttggtgggtaacgttttggttattttcgtgatttttcgttacgttaagatgaagacggttattaatatttatttgtttaatttggtcgtagtcgacgagttttttatgttgagcgtgtttttcgtggtttcgtcggtcgttttgcgttattggtttttcggtttcgtgttgtgtcgcgcggtgtttagcgtcgacggttttaatatgtttattagcgttttttgttttatcgtgtttagcgtggatcgttacgtggtcgtggtgtattttttgcgcgcggcgatttatcggcggtttagcgtggttaagtttattaatttgggcgtgtggttggtatttttgttggttattttttttatcgttattttcgtagatattagatcggttcgcggcggttaggtcgtggtttgtaatttgtagtggttatattcggtttggtcggtagttttcgtggtttatatttttttgttgggttttttgtt

SEQ ID NO: 18450 - DNA, 585 bp, Artificial Sequence
  chemically treated genomic DNA (Homo sapiens) CpG-island No: 18450
aacaaaaaacccaacaaaaaaatataaaccacgaaaactaccgaccaaaccgaatataaccactacaaattacaaaccacgacctaaccgccgcgaaccgatctaatatctacgaaaataacgataaaaaaaataaccaacaaaaataccaaccacacgcccaaattaataaacttaaccacgctaaaccgccgataaatcgccgcgcgcaaaaaatacaccacgaccacgtaacgatccacgctaaacacgataaaacaaaaaacgctaataaacatattaaaaccgtcgacgctaaacaccgcgcgacacaacacgaaaccgaaaaaccaataacgcaaaacgaccgacgaaaccacgaaaaacacgctcaacataaaaaactcgtcgactacgaccaaattaaacaaataaatattaataaccgtcttcatcttaacgtaacgaaaaatcacgaaaataaccaaaacgttacccaccaaccccaccaaacacaccaacgcgtaaatacactaaataacgaccatacccgccgcccgcgcgtccccgaaccccgccaccgcctcctccgcctccgccgaaacg

SEQ ID NO: 18451 - DNA, 585 bp, Artificial Sequence
  chemically treated genomic DNA (Homo sapiens) CpG-island No: 18451
agtaggaagtttagtaggaaagtgtagattacgaagattgtcgattaggtcgggtgtggttattgtaggttgtaggttacggtttggtcgtcgcgagtcggtttggtgtttgcgaagatggcgatggggagagtgattaatagggatgttagttatacgtttaggttgatgagtttggttacgttgggtcgtcggtaggtcgtcgcgcgtagagggtgtattacggttacgtagcggtttacgttgagtacggtgagatagaagacgttggtgaatatgttgaggtcgtcgacgttgagtatcgcgcggtatagtacggagtcgaagggttagtggcgtagggcggtcgacgaggttacgaagggtacgtttagtatgaagagttcgtcggttacggttaggttgagtaggtagatgttggtagtcgtttttattttggcgtagcgaaggattacgaagatgattagggcgttgtttattagttttattaggtatattagcgcgtagatgtattggatagcgattatgttcgtcgttcgcgcgttttcgggtttcgttatcgtttttttcgttttcgtcggagcg

SEQ ID NO: 18452 - DNA, 585 bp, Artificial Sequence
  chemically treated genomic DNA (Homo sapiens) CpG-island No: 18452
cgctccgacgaaaacgaaaaaaacgataacgaaacccgaaaacgcgcgaacgacgaacataatcgctatccaatacatctacgcgctaatatacctaataaaactaataaacaacgccctaatcatcttcgtaatccttcgctacgccaaaataaaaacgactaccaacatctacctactcaacctaaccgtaaccgacgaactcttcatactaaacgtacccttcgtaacctcgtcgaccgccctacgccactaacccttcgactccgtactataccgcgcgatactcaacgtcgacgacctcaacatattcaccaacgtcttctatctcaccgtactcaacgtaaaccgctacgtaaccgtaatacaccctctacgcgcgacgacctaccgacgacccaacgtaaccaaactcatcaacctaaacgtataactaacatccctattaatcactctccccatcgccatcttcgcaaacaccaaaccgactcgcgacgaccaaaccgtaacctacaacctacaataaccacacccgacctaatcgacaatcttcgtaatctacactttcctactaaacttcctact

SEQ ID NO: 18453 - DNA, 722 bp, Artificial Sequence
  chemically treated genomic DNA (Homo sapiens) CpG-island No: 18453
gcgaagttttcggcgtagacgtagaggtagttagtttggtttaggggttggtattggtattcgtagttggttttgaagtacgggtttacgggttttatatattcgtcgtttattaggtcgtagttagggtagtagtggtattcgaagttattttgtgtgttgatatagcgttgcggatacggattgggttttagtatgtagttatttacgttttcgtatcggtgttggtcggtcgttagtcggtagtcggtttcgtatatgtacgagtaggagttcggttggtcggggttgggaacgtagaagtgttcgtagaggtcgttgtaggattgcgtcgcggatgcggtgtaggagcgttcgtttgtttgtagggcggcgtcggttgggtattggtagcggggagttttagggatcgtattgtacgcgtgttcgtagtcgtcgttttttacgttgtagttttaagcgttcggcgtttttttggtttagtgtttttggatcgtttcgggcggcgcggtgtatattagttgtaagtcgaggggagttatcgcggcggagttgtttatcggtagcgtttggaagttcgtttcgcgggtcgcgaacggggtgtcgtaggtgatcgagacggcggtagtcgcggcgtcgggttttatagttagtggtttgtaggtggttgggaagtggaattcgtagaggaagttatcggtttttatttcgtattgttgttt

SEQ ID NO: 18454 - DNA, 722 bp, Artificial Sequence
  chemically treated genomic DNA (Homo sapiens) CpG-island No: 18454
aaacaacaatacgaaataaaaaccgataacttcctctacgaattccacttcccaaccacctacaaaccactaactataaaacccgacgccgcgactaccgccgtctcgatcacctacgacaccccgttcgcgacccgcgaaacgaacttccaaacgctaccgataaacaactccgccgcgataactcccctcgacttacaactaatatacaccgcgccgcccgaaacgatccaaaaacactaaaccaaaaaaacgccgaacgcttaaaactacaacgtaaaaaacgacgactacgaacacgcgtacaatacgatccctaaaactccccgctaccaatacccaaccgacgccgccctacaaacaaacgaacgctcctacaccgcatccgcgacgcaatcctacaacgacctctacgaacacttctacgttcccaaccccgaccaaccgaactcctactcgtacatatacgaaaccgactaccgactaacgaccgaccaacaccgatacgaaaacgtaaataactacatactaaaacccaatccgtatccgcaacgctatatcaacacacaaaataacttcgaataccactactaccctaactacgacctaataaacgacgaatatataaaacccgtaaacccgtacttcaaaaccaactacgaataccaataccaacccctaaaccaaactaactacctctacgtctacgccgaaaacttcgc

SEQ ID NO: 18455 - DNA, 722 bp, Artificial Sequence
  chemically treated genomic DNA (Homo sapiens) CpG-island No: 18455
gagtagtagtgcgaagtgaaggtcgatggttttttttgcgagttttattttttagttatttgtaggttattggttgtggagttcggcgtcgcggttgtcgtcgtttcgattatttacggtatttcgttcgcggttcgcggagcggatttttaggcgttgtcggtgggtagtttcgtcgcggtggtttttttcggtttatagttaatgtgtatcgcgtcgttcggagcggtttaggggtattgggttagggaggcgtcgggcgtttgggattgtagcgtggagaacggcggttgcgagtacgcgtgtaatgcgatttttggggtttttcgttgttagtgtttagtcggcgtcgttttgtaggtagacgggcgtttttgtatcgtattcgcgacgtagttttgtaacgatttttgcgagtatttttgcgtttttaatttcgattagtcgggtttttattcgtgtatgtgcgagatcggttatcggttggcggtcgattaatatcggtgcgaggacgtggatgattgtatattggagtttagttcgtgttcgtagcgttgtgttaatatatagggtggtttcgagtgttattgttattttaattacgatttggtggacggcgagtgtgtggagttcgtggattcgtgttttagagttaattgcgagtattagtgttagtttttgaattaaattagttatttttgcgtttgcgtcgagggtttcgt

SEQ ID NO: 18456 - DNA, 722 bp, Artificial Sequence
  chemically treated genomic DNA (Homo sapiens) CpG-island No: 18456
acgaaaccctcgacgcaaacgcaaaaataactaatttaattcaaaaactaacactaatactcgcaattaactctaaaacacgaatccacgaactccacacactcgccgtccaccaaatcgtaattaaaataacaataacactcgaaaccaccctatatattaacacaacgctacgaacacgaactaaactccaatatacaatcatccacgtcctcgcaccgatattaatcgaccgccaaccgataaccgatctcgcacatacacgaataaaaacccgactaatcgaaattaaaaacgcaaaaatactcgcaaaaatcgttacaaaactacgtcgcgaatacgatacaaaaacgcccgtctacctacaaaacgacgccgactaaacactaacaacgaaaaaccccaaaaatcgcattacacgcgtactcgcaaccgccgttctccacgctacaatcccaaacgcccgacgcctccctaacccaatacccctaaaccgctccgaacgacgcgatacacattaactataaaccgaaaaaaaccaccgcgacgaaactacccaccgacaacgcctaaaaatccgctccgcgaaccgcgaacgaaataccgtaaataatcgaaacgacgacaaccgcgacgccgaactccacaaccaataacctacaaataactaaaaaataaaactcgcaaaaaaaaccatcgaccttcacttcgcactactactc

SEQ ID NO: 18457 - DNA, 708 bp, Artificial Sequence
  chemically treated genomic DNA (Homo sapiens) CpG-island No: 18457
gagatagcgacgtataacgggtcgtagaggggagttttattgaggtcgagtcgtgtttatttgttatagttggtgttgttgtttttcgtaatttattggaagtcgcgtaggggttcgaggcgtttggggtcgtcgtagtcgggtggtagttgtaggtcgatttagaggcgtcggcggttaacgtcgtcgtcgtcgtttagtagtaaggaaatgatatcggtagttatcgaggagcgtattgttattaggtggtttcgtagttcgtcgtagatttgattggtattgaggaaggtcgcggggttcgggtagagcgcgaagtagtcgtgttcgacgtattggttgttattcggttgcggttttgcgggtgcggggaattttaggtcggttagggttagcgcgttaaggattaggattttaagtatgttatttaggcgcgtcgcgtgtaggcgtcggggaaagcgcgggtattgcgatagggtcgtgtcggagtagaggggtataggacgtcgatggcgatagttttttttgttcgttttagtttagatattttttgtcgttgcgcgtagtttttgcgaggtagtttttgatatgcggatcggttagggttcgagtttataagtgttcggttttttttttttggacgttcgggaaaaggaaggaagtgtttggtgggaagggttgatgtcgtatattcggattgttgggttt

SEQ ID NO: 18458 - DNA, 708 bp, Artificial Sequence
  chemically treated genomic DNA (Homo sapiens) CpG-island No: 18458
aaacccaacaatccgaatatacgacatcaacccttcccaccaaacacttccttccttttcccgaacgtccaaaaaaaaaaaaccgaacacttataaactcgaaccctaaccgatccgcatatcaaaaactacctcgcaaaaactacgcgcaacgacaaaaaatatctaaactaaaacgaacaaaaaaaactatcgccatcgacgtcctatacccctctactccgacacgaccctatcgcaatacccgcgctttccccgacgcctacacgcgacgcgcctaaataacatacttaaaatcctaatccttaacgcgctaaccctaaccgacctaaaattccccgcacccgcaaaaccgcaaccgaataacaaccaatacgtcgaacacgactacttcgcgctctacccgaaccccgcgaccttcctcaataccaatcaaatctacgacgaactacgaaaccacctaataacaatacgctcctcgataactaccgatatcatttccttactactaaacgacgacgacgacgttaaccgccgacgcctctaaatcgacctacaactaccacccgactacgacgaccccaaacgcctcgaacccctacgcgacttccaataaattacgaaaaacaacaacaccaactataacaaataaacacgactcgacctcaataaaactcccctctacgacccgttatacgtcgctatctc

SEQ ID NO: 18459 - DNA, 708 bp, Artificial Sequence
  chemically treated genomic DNA (Homo sapiens) CpG-island No: 18459
gaatttagtaattcgagtatgcggtattagttttttttattaggtatttttttttttttttcgaacgtttagggagggagggtcgggtatttataaattcgagttttggtcgattcgtatgttagaggttgtttcgtaggggttgcgcgtagcggtaagaagtgtttgggttgggacggataggagaggttgtcgttatcggcgttttgtgtttttttgtttcggtacggttttgtcgtagtgttcgcgtttttttcggcgtttgtacgcggcgcgtttgggtaatatgtttggggttttggtttttggcgcgttggttttggtcggtttggggtttttcgtattcgtagagtcgtagtcgggtggtagttagtgcgtcgagtacgattgtttcgcgttttattcgggtttcgcgattttttttaatgttagttagatttgcgacggattgcggggttatttaatgatagtgcgtttttcggtggttgtcgatgttatttttttgttattgaacggcgacggcggcgttggtcgtcggcgtttttggatcggtttgtagttgttattcggttgcggcgattttaagcgtttcgggtttttgcgcggtttttagtgggttacgggagataataatattagttatagtaggtgggtacggttcgattttaatggggtttttttttgcggttcgttgtgcgtcgttgtttt

SEQ ID NO: 18460 - DNA, 708 bp, Artificial Sequence
  chemically treated genomic DNA (Homo sapiens) CpG-island No: 18460
aaaacaacgacgcacaacgaaccgcaaaaaaaaaccccattaaaatcgaaccgtacccacctactataactaatattattatctcccgtaacccactaaaaaccgcgcaaaaacccgaaacgcttaaaatcgccgcaaccgaataacaactacaaaccgatccaaaaacgccgacgaccaacgccgccgtcgccgttcaataacaaaaaaataacatcgacaaccaccgaaaaacgcactatcattaaataaccccgcaatccgtcgcaaatctaactaacattaaaaaaaatcgcgaaacccgaataaaacgcgaaacaatcgtactcgacgcactaactaccacccgactacgactctacgaatacgaaaaaccccaaaccgaccaaaaccaacgcgccaaaaaccaaaaccccaaacatattacccaaacgcgccgcgtacaaacgccgaaaaaaacgcgaacactacgacaaaaccgtaccgaaacaaaaaaacacaaaacgccgataacgacaacctctcctatccgtcccaacccaaacacttcttaccgctacgcgcaacccctacgaaacaacctctaacatacgaatcgaccaaaactcgaatttataaatacccgaccctccctccctaaacgttcgaaaaaaaaaaaaaaatacctaataaaaaaaactaataccgcatactcgaattactaaattc

SEQ ID NO: 18461 - DNA, 502 bp, Artificial Sequence
  chemically treated genomic DNA (Homo sapiens) CpG-island No: 18461
ttatttgcgcgtttggtattatttattgttatcgcggaggaacgagcgttcgagatattattagtgttcgtaaattttcgcgttaaggcgttgagttattttttttcgaggtgcgtttttggtttttcgtttttggtgtttagtagcggcgaggcggtattttcgttttcgtcgtcgtgtttatcgagttttgggattagggtggtagtttttaacgatgggtaggagggatttcggcggcgatttttaaaataatattatgtttcgggattttcgttgttgtcgcgttagcgttttttttttttatttttttgattttgtcggattcggatgagtttattgtaaggagaagacgtagtcgttaggtaaaaggggttgcgttgttaggtgaagtttttagtaatcggtcgagttgttgttacgttggtattacgttgttttttcgggggattttttttttttgaaagagttgggggtggttattttaagtggggtgttttag

SEQ ID NO: 18462 - DNA, 502 bp, Artificial Sequence
  chemically treated genomic DNA (Homo sapiens) CpG-island No: 18462
ctaaaacaccccacttaaaataaccacccccaactctttcaaaaaaaaaaaatcccccgaaaaaacaacgtaataccaacgtaacaacaactcgaccgattactaaaaacttcacctaacaacgcaaccccttttacctaacgactacgtcttctccttacaataaactcatccgaatccgacaaaatcaaaaaaataaaaaaaaaaaacgctaacgcgacaacaacgaaaatcccgaaacataatattattttaaaaatcgccgccgaaatccctcctacccatcgttaaaaactaccaccctaatcccaaaactcgataaacacgacgacgaaaacgaaaataccgcctcgccgctactaaacaccaaaaacgaaaaaccaaaaacgcacctcgaaaaaaaataactcaacgccttaacgcgaaaatttacgaacactaataatatctcgaacgctcgttcctccgcgataacaataaataataccaaacgcgcaaataa

SEQ ID NO: 18463 - DNA, 502 bp, Artificial Sequence
  chemically treated genomic DNA (Homo sapiens) CpG-island No: 18463
ttagagtattttatttaagatgattatttttagtttttttaaaaaaaaaaaatttttcgaagagatagcgtggtgttagcgtagtagtagttcggtcggttattggaaattttatttggtaacgtagttttttttatttgacggttgcgttttttttttgtaatgggtttattcgaattcgatagggttagggaggtggaaagggaagacgttggcgcggtagtagcggggatttcggggtatggtattgttttaggggtcgtcgtcgaggttttttttgtttatcgttgagaattgttattttgattttagggttcggtggatacggcggcgggagcggagatgtcgtttcgtcgttgttgggtattagggacggaggattagaggcgtatttcggaaaggagtagtttagcgttttggcgcggagatttgcgggtattgatgatatttcgagcgttcgttttttcgcggtgataatggataatgttaaacgcgtaagtga

SEQ ID NO: 18464 - DNA, 502 bp, Artificial Sequence
  chemically treated genomic DNA (Homo sapiens) CpG-island No: 18464
tcacttacgcgtttaacattatccattatcaccgcgaaaaaacgaacgctcgaaatatcatcaatacccgcaaatctccgcgccaaaacgctaaactactcctttccgaaatacgcctctaatcctccgtccctaatacccaacaacgacgaaacgacatctccgctcccgccgccgtatccaccgaaccctaaaatcaaaataacaattctcaacgataaacaaaaaaaacctcgacgacgacccctaaaacaataccataccccgaaatccccgctactaccgcgccaacgtcttccctttccacctccctaaccctatcgaattcgaataaacccattacaaaaaaaaaacgcaaccgtcaaataaaaaaaactacgttaccaaataaaatttccaataaccgaccgaactactactacgctaacaccacgctatctcttcgaaaaattttttttttttaaaaaaactaaaaataatcatcttaaataaaatactctaa

SEQ ID NO: 18465 - DNA, 991 bp, Artificial Sequence
  chemically treated genomic DNA (Homo sapiens) CpG-island No: 18465
ttagagcgcgagggacggagggagaggaggagcgcgggagttgcggaggcgatttcgcgaatttattattgtaaatatattcgggggtgttaggaggggtaggggtgggggtcgcggcgtttatattagttcggtcgcgtcggattgaggtagtagtgtggtttgagtagtttttagatttacgtcgggcgggcgtagtatttggagcgagttttgcgttcgttttcgcgtagcgtcgtacgttcggtttcgagttgttcgtatatacgcgtcggaggagagttcgtttagttttttcgtcgagtttcgggattttttaaattcgaggagtttcggcgtcgcggggtagttttttgtcgtttttttcgttcgttgtattttttttggggttcgttggtttggcgaagcggagagggggaggcggaggaggagagaaggcgggggtcgcggcggtcgaagttaagagaaagtggtatgttcgaattttggaggcggtggtggcggaggacgggggaagacgatgtcgtagtttcgtaggggacgtaggcgagagtaagcgaggcgagttgggcgtttcggtttcggttcgttgcggggaggcgcgcgtcgttttgaggtttcggttttcgtattttcgcgtttcgacgttgcgggcgatagggtttggttttagtagtcgtcgtcgtcgtcgtcgtcgttattcggaggatttagtaaaagtttggatttgggggagggcgcggcgttgagcgggattattattagggttggaaggagatttcgagaatttttgtaggtaacgcgcgtttttaattttttttttttatgtttcgtcgttgcgttttcgtttttttttagagttttttttggttttcgcgggtttggtagaaagtaagagggaggcgaagtttaagatttcggggatgagtatcgagcgttggtagattattagttacgttagaggggtagttgtgttgagaggtaaattttt

SEQ ID NO: 18466 - DNA, 991 bp, Artificial Sequence
  chemically treated genomic DNA (Homo sapiens) CpG-island No: 18466
aaaaatttacctctcaacacaactacccctctaacgtaactaataatctaccaacgctcgatactcatccccgaaatcttaaacttcgcctccctcttactttctaccaaacccgcgaaaaccaaaaaaaactctaaaaaaaaacgaaaacgcaacgacgaaacataaaaaaaaaaaattaaaaacgcgcgttacctacaaaaattctcgaaatctccttccaaccctaataataatcccgctcaacgccgcgccctcccccaaatccaaacttttactaaatcctccgaataacgacgacgacgacgacgacgactactaaaaccaaaccctatcgcccgcaacgtcgaaacgcgaaaatacgaaaaccgaaacctcaaaacgacgcgcgcctccccgcaacgaaccgaaaccgaaacgcccaactcgcctcgcttactctcgcctacgtcccctacgaaactacgacatcgtcttcccccgtcctccgccaccaccgcctccaaaattcgaacataccactttctcttaacttcgaccgccgcgacccccgccttctctcctcctccgcctccccctctccgcttcgccaaaccaacgaaccccaaaaaaaatacaacgaacgaaaaaaacgacaaaaaactaccccgcgacgccgaaactcctcgaatttaaaaaatcccgaaactcgacgaaaaaactaaacgaactctcctccgacgcgtatatacgaacaactcgaaaccgaacgtacgacgctacgcgaaaacgaacgcaaaactcgctccaaatactacgcccgcccgacgtaaatctaaaaactactcaaaccacactactacctcaatccgacgcgaccgaactaatataaacgccgcgacccccacccctacccctcctaacacccccgaatatatttacaataataaattcgcgaaatcgcctccgcaactcccgcgctcctcctctccctccgtccctcgcgctctaa

SEQ ID NO: 18467 - DNA, 991 bp, Artificial Sequence
  chemically treated genomic DNA (Homo sapiens) CpG-island No: 18467
gggaatttgttttttagtatagttgtttttttaacgtgattagtgatttgttagcgttcggtgtttattttcgggattttgaatttcgttttttttttattttttgttagattcgcgagggttaggaagggttttgggaggaagcgggagcgtagcggcggggtatggaagaagagggttgggggcgcgcgttatttgtaaaggttttcgaggtttttttttagttttggtggtaatttcgtttagcgtcgcgtttttttttagatttaaatttttgttgggtttttcgggtggcggcggcggcgacggcggcggttgttggagttaagttttgtcgttcgtagcgtcggggcgcgggggtgcggaggtcggagttttagagcggcgcgcgttttttcgtagcgggtcggggtcggggcgtttagttcgtttcgtttgttttcgtttacgttttttacggagttgcggtatcgttttttttcgtttttcgttattatcgtttttagggttcgggtatgttatttttttttggtttcggtcgtcgcgattttcgtttttttttttttttcgttttttttttttcgtttcgttaagttaacgaattttaaaagaagtatagcgagcggggaaggcggtagaaagttgtttcgcggcgtcggagtttttcggatttggaggatttcgggattcggcgggagagttaggcgggttttttttcgacgcgtgtgtgcggatagttcggagtcgggcgtgcggcgttgcgcgggggcgggcgtagggttcgttttaagtgttgcgttcgttcggcgtgggtttggaggttgtttagattatattattgttttaattcgacgcggtcgggttaatgtaggcgtcgcggtttttatttttattttttttgatattttcggatatgtttatagtaatgaattcgcgggatcgttttcgtagttttcgcgtttttttttttttttcgtttttcgcgttttgg

SEQ ID NO: 18468 - DNA, 991 bp, Artificial Sequence
  chemically treated genomic DNA (Homo sapiens) CpG-island No: 18468
ccaaaacgcgaaaaacgaaaaaaaaaaaaaaacgcgaaaactacgaaaacgatcccgcgaattcattactataaacatatccgaaaatatcaaaaaaaataaaaataaaaaccgcgacgcctacattaacccgaccgcgtcgaattaaaacaataatataatctaaacaacctccaaacccacgccgaacgaacgcaacacttaaaacgaaccctacgcccgcccccgcgcaacgccgcacgcccgactccgaactatccgcacacacgcgtcgaaaaaaaacccgcctaactctcccgccgaatcccgaaatcctccaaatccgaaaaactccgacgccgcgaaacaactttctaccgccttccccgctcgctatacttcttttaaaattcgttaacttaacgaaacgaaaaaaaaaaaacgaaaaaaaaaaaaaaacgaaaatcgcgacgaccgaaaccaaaaaaaaataacatacccgaaccctaaaaacgataataacgaaaaacgaaaaaaaacgataccgcaactccgtaaaaaacgtaaacgaaaacaaacgaaacgaactaaacgccccgaccccgacccgctacgaaaaaacgcgcgccgctctaaaactccgacctccgcacccccgcgccccgacgctacgaacgacaaaacttaactccaacaaccgccgccgtcgccgccgccgccacccgaaaaacccaacaaaaatttaaatctaaaaaaaaacgcgacgctaaacgaaattaccaccaaaactaaaaaaaaacctcgaaaacctttacaaataacgcgcgcccccaaccctcttcttccataccccgccgctacgctcccgcttcctcccaaaacccttcctaaccctcgcgaatctaacaaaaaataaaaaaaaaacgaaattcaaaatcccgaaaataaacaccgaacgctaacaaatcactaatcacgttaaaaaaacaactatactaaaaaacaaattccc

SEQ ID NO: 18469 - DNA, 650 bp, Artificial Sequence
  chemically treated genomic DNA (Homo sapiens) CpG-island No: 18469
ttgtcgtcgtcggggtcgtcggttttttatattcgttgagacgtcggtacggggattttcgtgtttttttagggattggcgtcgcgtttaggtggtcgagtttgcgttgttggaggaggcgttttcgcgtcggttttatttcggggtcggtagggggcgaaggcggagttggaagtcgtcgtcgggtttcgggggatcggttttcgcgttttttttcgcgtttttcgtatagtgtttatgcgtacggtttagtttttatagcggtcgcgggggttttgtttttcgtattcgggcgtagtcgggtggatttcgagtaggtgcggagtttcgggcggcgggcgcgggtgcgagggatttttgacgtttttgtttttgtttttttgtcgtttttagtttgtttgtcgtcgttttggcgttttcgttttttcgcggtgcggggttgtatatcgattttgggtttcgttcgatttgtcgtcgaggcgttttttagatttagaggggcgttggtttggagtagcgggtcgtttgtgtttttttttttttgcgtcgcgttcggggattcgaagggtgcggggttttgaggaggtgacgcgcggggtttttcgtattttggttttgttcgtatttttttttttttttaggtgtgagta

SEQ ID NO: 18470 - DNA, 650 bp, Artificial Sequence
  chemically treated genomic DNA (Homo sapiens) CpG-island No: 18470
tactcacacctaaaaaaaaaaaaaaatacgaacaaaaccaaaatacgaaaaaccccgcgcgtcacctcctcaaaaccccgcacccttcgaatccccgaacgcgacgcaaaaaaaaaaaaacacaaacgacccgctactccaaaccaacgcccctctaaatctaaaaaacgcctcgacgacaaatcgaacgaaacccaaaatcgatatacaaccccgcaccgcgaaaaaacgaaaacgccaaaacgacgacaaacaaactaaaaacgacaaaaaaacaaaaacaaaaacgtcaaaaatccctcgcacccgcgcccgccgcccgaaactccgcacctactcgaaatccacccgactacgcccgaatacgaaaaacaaaacccccgcgaccgctataaaaactaaaccgtacgcataaacactatacgaaaaacgcgaaaaaaaacgcgaaaaccgatcccccgaaacccgacgacgacttccaactccgccttcgccccctaccgaccccgaaataaaaccgacgcgaaaacgcctcctccaacaacgcaaactcgaccacctaaacgcgacgccaatccctaaaaaaacacgaaaatccccgtaccgacgtctcaacgaatataaaaaaccgacgaccccgacgacgacaa

SEQ ID NO: 18471 - DNA, 650 bp, Artificial Sequence
  chemically treated genomic DNA (Homo sapiens) CpG-island No: 18471
tgtttatatttgggagagagggagaatgcgggtaaggttagggtgcgggaggtttcgcgcgttatttttttagagtttcgtatttttcggattttcgggcgcggcgtagaggagagaggatatagacgattcgttgttttaggttagcgtttttttaggtttgggaggcgtttcggcggtaaatcgagcgaagtttaggatcggtgtgtaatttcgtatcgcggggaggcgggggcgttaaaacgacgatagataggttgggagcgataaagaaatagggatagaggcgttagggatttttcgtattcgcgttcgtcgttcggggtttcgtatttgttcgagatttattcggttgcgttcgagtgcggaaggtaaggttttcgcggtcgttataaaggttgggtcgtgcgtatgagtattgtgcggggggcgcgggaggaagcgcgggagtcggtttttcggggttcggcggcgatttttagtttcgttttcgttttttgtcggtttcggggtgaggtcggcgcggaggcgttttttttagtagcgtaggttcggttatttggacgcggcgttagtttttagaggggtacgaaggttttcgtgtcggcgttttaacgagtgtggagggtcggcggtttcgacggcggtag

SEQ ID NO: 18472 - DNA, 650 bp, Artificial Sequence
  chemically treated genomic DNA (Homo sapiens) CpG-island No: 18472
ctaccgccgtcgaaaccgccgaccctccacactcgttaaaacgccgacacgaaaaccttcgtacccctctaaaaactaacgccgcgtccaaataaccgaacctacgctactaaaaaaaacgcctccgcgccgacctcaccccgaaaccgacaaaaaacgaaaacgaaactaaaaatcgccgccgaaccccgaaaaaccgactcccgcgcttcctcccgcgccccccgcacaatactcatacgcacgacccaacctttataacgaccgcgaaaaccttaccttccgcactcgaacgcaaccgaataaatctcgaacaaatacgaaaccccgaacgacgaacgcgaatacgaaaaatccctaacgcctctatccctatttctttatcgctcccaacctatctatcgtcgttttaacgcccccgcctccccgcgatacgaaattacacaccgatcctaaacttcgctcgatttaccgccgaaacgcctcccaaacctaaaaaaacgctaacctaaaacaacgaatcgtctatatcctctctcctctacgccgcgcccgaaaatccgaaaaatacgaaactctaaaaaaataacgcgcgaaacctcccgcaccctaaccttacccgcattctccctctctcccaaatataaaca

SEQ ID NO: 18473 - DNA, 641 bp, Artificial Sequence
  chemically treated genomic DNA (Homo sapiens) CpG-island No: 18473
cgtcgcgtagcgttttttttatcggttttagggtttcgcgaaagaggtcggtattgagtttttcgaagcgggcgcgcgtgatggacgtatagaagtttacgttttcgtagagcgagtcgatttcgatgttcgtttgcgtggacgagtttagggtgcgtttggcgcgttcgtaagcggtgcgtagcgttttacggcgcgtttgttgggtttaatgttttttttgtgtttgcgtttgaattttttcgttaggtggtttattatgcggttgtcgaagtttttatcgtttaggtgggtgtcgtcggtcgtggattttatttcgaagatgttattttcgatggttaggatggatacgtcgaaagtgttatcgtttaggttaaagatgagtacgtttttttcgtcgttcgcgtagttttttttgtttaggtcgtaggcgatggtcgtcgtcgtgggttcgttgatgatgcgtagtatattgagtttcgtgatggtgtttgcgtttttggtggtttggcgttgcgagtcgttgaaataggtcgggatcgttatgatcgcgttgtgtattttgttttttaggtaggttttcgcgattttttttattttcgtgaggattatggaggatattttttttgggaagaaggttt

SEQ ID NO: 18474 - DNA, 641 bp, Artificial Sequence
  chemically treated genomic DNA (Homo sapiens) CpG-island No: 18474
aaaccttcttcccaaaaaaaatatcctccataatcctcacgaaaataaaaaaaatcgcgaaaacctacctaaaaaacaaaatacacaacgcgatcataacgatcccgacctatttcaacgactcgcaacgccaaaccaccaaaaacgcaaacaccatcacgaaactcaatatactacgcatcatcaacgaacccacgacgacgaccatcgcctacgacctaaacaaaaaaaactacgcgaacgacgaaaaaaacgtactcatctttaacctaaacgataacactttcgacgtatccatcctaaccatcgaaaataacatcttcgaaataaaatccacgaccgacgacacccacctaaacgataaaaacttcgacaaccgcataataaaccacctaacgaaaaaattcaaacgcaaacacaaaaaaaacattaaacccaacaaacgcgccgtaaaacgctacgcaccgcttacgaacgcgccaaacgcaccctaaactcgtccacgcaaacgaacatcgaaatcgactcgctctacgaaaacgtaaacttctatacgtccatcacgcgcgcccgcttcgaaaaactcaataccgacctctttcgcgaaaccctaaaaccgataaaaaaaacgctacgcgacg

SEQ ID NO: 18475 - DNA, 641 bp, Artificial Sequence
  chemically treated genomic DNA (Homo sapiens) CpG-island No: 18475
agattttttttttagaggagatattttttatggtttttacgaagatgaaggagatcgcggaagtttatttggggggtaaggtgtatagcgcggttataacggtttcggtttattttaacgattcgtagcgttaggttattaaggacgtaggtattattacggggtttaatgtgttgcgtattattaacgagtttacggcggcggttatcgtttacggtttggataagaagggttgcgcgggcggcgagaagaacgtgtttatttttgatttgggcggtggtattttcgacgtgtttattttgattatcgaggatggtattttcgaggtgaagtttacggtcggcgatatttatttgggcggtgaggatttcgataatcgtatggtgagttatttggcggaggagtttaagcgtaagtataagaaggatattgggtttaataagcgcgtcgtgaggcgttgcgtatcgtttgcgagcgcgttaagcgtattttgagttcgtttacgtaggcgagtatcgagatcgattcgttttacgagggcgtggatttttatacgtttattacgcgcgttcgtttcgaggagtttaatgtcgatttttttcgcgggattttggagtcggtggagaaggcgttgcgcgacg

SEQ ID NO: 18476 - DNA, 641 bp, Artificial Sequence
  chemically treated genomic DNA (Homo sapiens) CpG-island No: 18476
cgtcgcgcaacgccttctccaccgactccaaaatcccgcgaaaaaaatcgacattaaactcctcgaaacgaacgcgcgtaataaacgtataaaaatccacgccctcgtaaaacgaatcgatctcgatactcgcctacgtaaacgaactcaaaatacgcttaacgcgctcgcaaacgatacgcaacgcctcacgacgcgcttattaaacccaatatccttcttatacttacgcttaaactcctccgccaaataactcaccatacgattatcgaaatcctcaccgcccaaataaatatcgccgaccgtaaacttcacctcgaaaataccatcctcgataatcaaaataaacacgtcgaaaataccaccgcccaaatcaaaaataaacacgttcttctcgccgcccgcgcaacccttcttatccaaaccgtaaacgataaccgccgccgtaaactcgttaataatacgcaacacattaaaccccgtaataatacctacgtccttaataacctaacgctacgaatcgttaaaataaaccgaaaccgttataaccgcgctatacaccttaccccccaaataaacttccgcgatctccttcatcttcgtaaaaaccataaaaaatatctcctctaaaaaaaaaatct

SEQ ID NO: 18477 - DNA, 700 bp, Artificial Sequence
  chemically treated genomic DNA (Homo sapiens) CpG-island No: 18477
tcgggatttgacgcgtcggtaataagtaggcggtttggtagtcgttcgttatcgggttttcgtagcgcgttcgtcgcgtttcggtttttcgtacggatcggcgttttttcggtttcgtatttcgttaggttcgcggttcgtcgtttttcggtttgggttaaagttgcgtaaatagttttataattggtaaatatttatcggtcgtaataggaattagagttgcggagattttagggagtttaaggtaaattagtcgcgggaaaggcgggcgaaggcgaaggggtcgcgagttgtagtggcggcggcgcgcggcgttcggcgttcgggttgggttgcgcggagaggttttggttttgttagggattgtgttgtaataaaggattttcgttgtcgtatagtcgcgtttgtcgtatcgtattgagtcggtttcgtttacgcggcgatttcgggtttgtttattagttcgttgcggcgttcgttagtttttttttttttttcgttcgtttatttattttgtcgttggttgttaggggtattcgcggtcgtttgtttgttgtaataagtttttgcgtcgagtttcgaggaggttggcgtaattcgtatcgcgggggtcgtcgcggcggcggcggtttgattattttttttgttttttttaagggtaggtttgggatttttttttttttttgtttgtatagttgga

SEQ ID NO: 18478 - DNA, 700 bp, Artificial Sequence
  chemically treated genomic DNA (Homo sapiens) CpG-island No: 18478
tccaactatacaaacaaaaaaaaaaaaaaatcccaaacctacccttaaaaaaaacaaaaaaaataatcaaaccgccgccgccgcgacgacccccgcgatacgaattacgccaacctcctcgaaactcgacgcaaaaacttattacaacaaacaaacgaccgcgaatacccctaacaaccaacgacaaaataaataaacgaacgaaaaaaaaaaaaaaactaacgaacgccgcaacgaactaataaacaaacccgaaatcgccgcgtaaacgaaaccgactcaatacgatacgacaaacgcgactatacgacaacgaaaatcctttattacaacacaatccctaacaaaaccaaaacctctccgcgcaacccaacccgaacgccgaacgccgcgcgccgccgccactacaactcgcgaccccttcgccttcgcccgcctttcccgcgactaatttaccttaaactccctaaaatctccgcaactctaattcctattacgaccgataaatatttaccaattataaaactatttacgcaactttaacccaaaccgaaaaacgacgaaccgcgaacctaacgaaatacgaaaccgaaaaaacgccgatccgtacgaaaaaccgaaacgcgacgaacgcgctacgaaaacccgataacgaacgactaccaaaccgcctacttattaccgacgcgtcaaatcccga

SEQ ID NO: 18479 - DNA, 700 bp, Artificial Sequence
  chemically treated genomic DNA (Homo sapiens) CpG-island No: 18479
tttagttgtgtaaataggaggaggaggaggttttaagtttatttttgagaggggtaagaggggtggttaagtcgtcgtcgtcgcgacggttttcgcggtgcgggttgcgttagttttttcggagttcgacgtagaaatttgttgtaataaataggcgatcgcgggtgtttttagtagttagcggtagagtgggtgggcgggcgagagggaggggaaggttggcggacgtcgtagcgaattggtgggtagattcggagtcgtcgcgtaagcggggtcggtttagtgcggtgcggtaggcgcggttgtgcggtagcggaagttttttgttgtagtatagtttttggtagagttagagttttttcgcgtagtttagttcgagcgtcgagcgtcgcgcgtcgtcgttattgtagttcgcggttttttcgttttcgttcgtttttttcgcggttgatttgttttaaattttttaaaattttcgtagttttggtttttgttgcggtcggtaagtatttgttagttgtggggttatttgcgtaattttggtttaggtcggagggcgacgggtcgcgggtttggcggagtgcggggtcggaggggcgtcgattcgtgcggggagtcggagcgcggcggacgcgttgcgaggattcggtgacgggcggttgttaggtcgtttgtttgttgtcggcgcgttaggtttcgg

SEQ ID NO: 18480 - DNA, 700 bp, Artificial Sequence
  chemically treated genomic DNA (Homo sapiens) CpG-island No: 18480
ccgaaacctaacgcgccgacaacaaacaaacgacctaacaaccgcccgtcaccgaatcctcgcaacgcgtccgccgcgctccgactccccgcacgaatcgacgcccctccgaccccgcactccgccaaacccgcgacccgtcgccctccgacctaaaccaaaattacgcaaataaccccacaactaacaaatacttaccgaccgcaacaaaaaccaaaactacgaaaattttaaaaaatttaaaacaaatcaaccgcgaaaaaaacgaacgaaaacgaaaaaaccgcgaactacaataacgacgacgcgcgacgctcgacgctcgaactaaactacgcgaaaaaactctaactctaccaaaaactatactacaacaaaaaacttccgctaccgcacaaccgcgcctaccgcaccgcactaaaccgaccccgcttacgcgacgactccgaatctacccaccaattcgctacgacgtccgccaaccttcccctccctctcgcccgcccacccactctaccgctaactactaaaaacacccgcgatcgcctatttattacaacaaatttctacgtcgaactccgaaaaaactaacgcaacccgcaccgcgaaaaccgtcgcgacgacgacgacttaaccacccctcttacccctctcaaaaataaacttaaaacctcctcctcctcctatttacacaactaaa

SEQ ID NO: 18481 - DNA, 782 bp, Artificial Sequence
  chemically treated genomic DNA (Homo sapiens) CpG-island No: 18481
ttcgtatatatattttcgggcgcgcgtttgggcgggtacgttagtttcgttcggtcgcgttgagcgtatacgttttatttcggtcgcggtttttcgttttcggcgacgttttttatttttcgtttttcgaaagttattggatgtaggggtggcgcggcgttcgggtagcgcgcggcgagggcgatttttttcgcggcgcgttttagacgtcgcgtttcggtaagagggagtagggcgagtagcggatcgaggtttttagttgggaaggcgcgttgagttttcggtattcggttcggggtagcgggaggcggtcgcggatttgttcgcggggcggcgggaggcggtgggcggtggcggggaagtcgcggaggggcggggaacgagcggtgggcgcgtcgttatttattggttcggtcggtcggcgggcgggcgtggaggcggtagcggcgcgtttgttggagttgtagtcggagatacgtttggttgtttggaaggcgttgtaggaggcggaggaagggtcgttgcggtttcgtcgtagatttcggttttcgggttatttttttttatcgtttttattttgagttttttttttttttttttttttattttatttttttttttttcgcgtttggttttttcgtttgagtttcgaatttacgttttcgtcgtattttaaggaggttcgtgttagttatgagttttttgttttgggatcgtttcgtatttgttgcgtttttttcgttcggggaagttcgtttttaaggtatagtttggtttttttt

SEQ ID NO: 18482 - DNA, 782 bp, Artificial Sequence
  chemically treated genomic DNA (Homo sapiens) CpG-island No: 18482
aaaaaaaaccaaactataccttaaaaacgaacttccccgaacgaaaaaaacgcaacaaatacgaaacgatcccaaaacaaaaaactcataactaacacgaacctccttaaaatacgacgaaaacgtaaattcgaaactcaaacgaaaaaaccaaacgcgaaaaaaaaaaaaataaaataaaaaaaaaaaaaaaaaaaaaactcaaaataaaaacgataaaaaaaaataacccgaaaaccgaaatctacgacgaaaccgcaacgacccttcctccgcctcctacaacgccttccaaacaaccaaacgtatctccgactacaactccaacaaacgcgccgctaccgcctccacgcccgcccgccgaccgaccgaaccaataaataacgacgcgcccaccgctcgttccccgcccctccgcgacttccccgccaccgcccaccgcctcccgccgccccgcgaacaaatccgcgaccgcctcccgctaccccgaaccgaataccgaaaactcaacgcgccttcccaactaaaaacctcgatccgctactcgccctactccctcttaccgaaacgcgacgtctaaaacgcgccgcgaaaaaaatcgccctcgccgcgcgctacccgaacgccgcgccacccctacatccaataactttcgaaaaacgaaaaataaaaaacgtcgccgaaaacgaaaaaccgcgaccgaaataaaacgtatacgctcaacgcgaccgaacgaaactaacgtacccgcccaaacgcgcgcccgaaaatatatatacgaa

SEQ ID NO: 18483 - DNA, 782 bp, Artificial Sequence
  chemically treated genomic DNA (Homo sapiens) CpG-island No: 18483
ggaagggattaagttgtgttttgggagcgagttttttcgggcggggagagcgtagtagatgcggagcggttttagaataaaaggtttatggttggtacgggtttttttggagtgcggcggggacgtgggttcgggatttaggcgagagagttagacgcgggaggaaaaaaaatgaagtgagaaaagagaaggagggagagtttagggtgagagcggtgagaagaggtgattcggaggtcgaggtttgcggcggagtcgtagcggtttttttttcgttttttgtagcgttttttaggtaattaagcgtgttttcggttgtaattttagtaagcgcgtcgttgtcgtttttacgttcgttcgtcggtcggtcgagttagtaagtagcggcgcgtttatcgttcgtttttcgttttttcgcggttttttcgttatcgtttatcgtttttcgtcgtttcgcgggtaagttcgcgatcgtttttcgttgtttcgagtcgggtgtcgggggtttagcgcgtttttttagttgggagtttcggttcgttgttcgttttgtttttttttgtcggggcgcggcgtttggggcgcgtcgcggggagggtcgttttcgtcgcgcgttgttcgggcgtcgcgttatttttatatttaatggttttcggggagcgggaagtggggggcgtcgtcgggggcgaggagtcgcggtcggggtggggcgtgtgcgtttagcgcggtcgagcgaggttgacgtgttcgtttaagcgcgcgttcgggagtgtgtgtgcggg

SEQ ID NO: 18484 - DNA, 782 bp, Artificial Sequence
  chemically treated genomic DNA (Homo sapiens) CpG-island No: 18484
cccgcacacacactcccgaacgcgcgcttaaacgaacacgtcaacctcgctcgaccgcgctaaacgcacacgccccaccccgaccgcgactcctcgcccccgacgacgccccccacttcccgctccccgaaaaccattaaatataaaaataacgcgacgcccgaacaacgcgcgacgaaaacgaccctccccgcgacgcgccccaaacgccgcgccccgacaaaaaaaaacaaaacgaacaacgaaccgaaactcccaactaaaaaaacgcgctaaacccccgacacccgactcgaaacaacgaaaaacgatcgcgaacttacccgcgaaacgacgaaaaacgataaacgataacgaaaaaaccgcgaaaaaacgaaaaacgaacgataaacgcgccgctacttactaactcgaccgaccgacgaacgaacgtaaaaacgacaacgacgcgcttactaaaattacaaccgaaaacacgcttaattacctaaaaaacgctacaaaaaacgaaaaaaaaaccgctacgactccgccgcaaacctcgacctccgaatcacctcttctcaccgctctcaccctaaactctccctccttctcttttctcacttcattttttttcctcccgcgtctaactctctcgcctaaatcccgaacccacgtccccgccgcactccaaaaaaacccgtaccaaccataaaccttttattctaaaaccgctccgcatctactacgctctccccgcccgaaaaaactcgctcccaaaacacaacttaatcccttcc

SEQ ID NO: 18485 - DNA, 537 bp, Artificial Sequence
  chemically treated genomic DNA (Homo sapiens) CpG-island No: 18485
tcgagatagtcggcggtatttatagatgaggtagcggcggcggcggcggcggcggtagttcgggttttttatgagtaggcggcggcggcgacgggtgcggcggtatcggtagttttcggtttttagggaggtacgaggagtttgttttttggtggacggagattggtcggtgtgggaacgtttttcgcggttcggttttttagtttatttgttcgtagttttgagtattcggcggggtattgttcgggtagaggcgggggcgtttagtcgattcgcgggtttttaattcggggattcgttcgtttcggtgttaggtttttcgggcgcggttgtttagggttagggtgggcgtggtcggaacgtgggggtttttcgggggcgtacgtttagcgttcgttttgtttttgtttcgaagtttcgcgttgttgggagcggtagcgcgtggttgtataggcgtattttaggcgttgatttgagaggggatttttagaatttttgagtttttagggagtttggcgtttaatgttttgggtatgt

SEQ ID NO: 18486 - DNA, 537 bp, Artificial Sequence
  chemically treated genomic DNA (Homo sapiens) CpG-island No: 18486
acatacccaaaacattaaacgccaaactccctaaaaactcaaaaattctaaaaatcccctctcaaatcaacgcctaaaatacgcctatacaaccacgcgctaccgctcccaacaacgcgaaacttcgaaacaaaaacaaaacgaacgctaaacgtacgcccccgaaaaacccccacgttccgaccacgcccaccctaaccctaaacaaccgcgcccgaaaaacctaacaccgaaacgaacgaatccccgaattaaaaacccgcgaatcgactaaacgcccccgcctctacccgaacaataccccgccgaatactcaaaactacgaacaaataaactaaaaaaccgaaccgcgaaaaacgttcccacaccgaccaatctccgtccaccaaaaaacaaactcctcgtacctccctaaaaaccgaaaactaccgataccgccgcacccgtcgccgccgccgcctactcataaaaaacccgaactaccgccgccgccgccgccgccgctacctcatctataaataccgccgactatctcga

SEQ ID NO: 18487 - DNA, 537 bp, Artificial Sequence
  chemically treated genomic DNA (Homo sapiens) CpG-island No: 18487
atatgtttaaggtattgaacgttagattttttaaggatttagggattttaaaagtttttttttaaattagcgtttaaaatacgtttgtatagttacgcgttatcgtttttagtagcgcgggatttcgggatagggataaggcggacgttaggcgtgcgttttcggggagtttttacgtttcggttacgtttattttggttttgggtagtcgcgttcgggaggtttggtatcgaggcgggcgggttttcgagttaggggttcgcgagtcggttgggcgttttcgtttttgttcgggtagtgtttcgtcgagtgtttagaattgcggataaataggttggagggtcgggtcgcggaaggcgtttttatatcggttagttttcgtttattaggaagtaaatttttcgtatttttttggggatcgaaaattgtcggtgtcgtcgtattcgtcgtcgtcgtcgtttgtttatggagagttcgggttgtcgtcgtcgtcgtcgtcgtcgttgttttatttatgagtatcgtcggttgtttcgg

SEQ ID NO: 18488 - DNA, 537 bp, Artificial Sequence
  chemically treated genomic DNA (Homo sapiens) CpG-island No: 18488
ccgaaacaaccgacgatactcataaataaaacaacgacgacgacgacgacgacgacaacccgaactctccataaacaaacgacgacgacgacgaatacgacgacaccgacaattttcgatccccaaaaaaatacgaaaaatttacttcctaataaacgaaaactaaccgatataaaaacgccttccgcgacccgaccctccaacctatttatccgcaattctaaacactcgacgaaacactacccgaacaaaaacgaaaacgcccaaccgactcgcgaacccctaactcgaaaacccgcccgcctcgataccaaacctcccgaacgcgactacccaaaaccaaaataaacgtaaccgaaacgtaaaaactccccgaaaacgcacgcctaacgtccgccttatccctatcccgaaatcccgcgctactaaaaacgataacgcgtaactatacaaacgtattttaaacgctaatttaaaaaaaaacttttaaaatccctaaatccttaaaaaatctaacgttcaataccttaaacatat

SEQ ID NO: 18489 - DNA, 558 bp, Artificial Sequence
  chemically treated genomic DNA (Homo sapiens) CpG-island No: 18489
gaggcggggggttacgggggaggggagacggggcgggtgtgaagtttgtgtcgggaaaagaaaaatatgagtgtttttttttgtgtgcgtataaatagtcgagcgcggggaggtcgggttcggggttacgcggtttcgggttgtagttgtcgtcgtggggcggggggttttaggcggttatcgggcgtcgcggtcgtttgcggtattagtatttcggcggcgcgggcggtcgttgttttcgcgcgattttagttcgtttagagcgcgtttcggtatcgattttcggggcgaggcgagcgtagttttcgttggttaataaggtaagcgcggcgcggggagcggtggtcgggagtttgggcgttaggcgatttttcgatagggcgtacggatcggtttttcgtcgcgcgggtcgatgatcgacggggaggttcgagtttggtttcgacgttttggttcggtgttttcgacgcgtttggagttcgggagggaggcgcgggtttggtttgggtttaggaggatggagttcgatttagggtcgttttttttcgtttgggggtg

SEQ ID NO: 18490 - DNA, 558 bp, Artificial Sequence
  chemically treated genomic DNA (Homo sapiens) CpG-island No: 18490
cacccccaaacgaaaaaaaacgaccctaaatcgaactccatcctcctaaacccaaaccaaacccgcgcctccctcccgaactccaaacgcgtcgaaaacaccgaaccaaaacgtcgaaaccaaactcgaacctccccgtcgatcatcgacccgcgcgacgaaaaaccgatccgtacgccctatcgaaaaatcgcctaacgcccaaactcccgaccaccgctccccgcgccgcgcttaccttattaaccaacgaaaactacgctcgcctcgccccgaaaatcgataccgaaacgcgctctaaacgaactaaaatcgcgcgaaaacaacgaccgcccgcgccgccgaaatactaataccgcaaacgaccgcgacgcccgataaccgcctaaaaccccccgccccacgacgacaactacaacccgaaaccgcgtaaccccgaacccgacctccccgcgctcgactatttatacgcacacaaaaaaaaacactcatatttttcttttcccgacacaaacttcacacccgccccgtctcccctcccccgtaaccccccgcctc

SEQ ID NO: 18491 - DNA, 558 bp, Artificial Sequence
  chemically treated genomic DNA (Homo sapiens) CpG-island No: 18491
tatttttaagcggggagagacggttttgagtcgggttttatttttttgggtttaggttaggttcgcgtttttttttcgggttttaggcgcgtcggggatatcgggttagggcgtcggggttagattcgggttttttcgtcggttatcgattcgcgcggcggagaatcggttcgtgcgttttgtcgaggggtcgtttggcgtttaggttttcggttatcgtttttcgcgtcgcgtttattttgttggttagcgggggttgcgttcgtttcgtttcgagggtcggtgtcggggcgcgttttggacgggttggggtcgcgcgaggatagcggtcgttcgcgtcgtcggaatgttgatgtcgtaggcggtcgcgacgttcggtggtcgtttgggatttttcgttttacggcggtagttgtagttcggagtcgcgtgatttcgggttcgattttttcgcgttcggttgtttgtgcgtatataaaagagaatatttatattttttttttttcggtatagattttatattcgtttcgttttttttttttcgtaatttttcgtttt

SEQ ID NO: 18492 - DNA, 558 bp, Artificial Sequence
  chemically treated genomic DNA (Homo sapiens) CpG-island No: 18492
aaaacgaaaaattacgaaaaaaaaaaaacgaaacgaatataaaatctataccgaaaaaaaaaaaatataaatattctcttttatatacgcacaaacaaccgaacgcgaaaaaatcgaacccgaaatcacgcgactccgaactacaactaccgccgtaaaacgaaaaatcccaaacgaccaccgaacgtcgcgaccgcctacgacatcaacattccgacgacgcgaacgaccgctatcctcgcgcgaccccaacccgtccaaaacgcgccccgacaccgaccctcgaaacgaaacgaacgcaacccccgctaaccaacaaaataaacgcgacgcgaaaaacgataaccgaaaacctaaacgccaaacgacccctcgacaaaacgcacgaaccgattctccgccgcgcgaatcgataaccgacgaaaaaacccgaatctaaccccgacgccctaacccgatatccccgacgcgcctaaaacccgaaaaaaaaacgcgaacctaacctaaacccaaaaaaataaaacccgactcaaaaccgtctctccccgcttaaaaata

SEQ ID NO: 18493 - DNA, 1369 bp, Artificial Sequence
  chemically treated genomic DNA (Homo sapiens) CpG-island No: 18493
  misc_feature (659)..(660): n is either a, c, g or t
atttcgcgtcgcgcgtagcgagggattagaaggtttcggacgtcgcggtagggtcggttagggttttacgagttagggagttgtttcgtatttttaaacgtttagtatttatttacggttgaaagtacgtatttgacgcgttcgggcgttttcgcggtgagtcgcgtcgtcgttttcggggttcgcgaaggtggtttagttcgggcgttttagtttcgacgttttcggggtagagagtaacgttcggggacgaacgggacgggtgcgtttagcggtcggggttgcgttgggcgaggtaagcggcgagaggggagcgtttcggcgtttaggtaatagttatttttagtgggagagtcgttcggggtcggcgtcgtttcgcgttcgttgtttcgcgttttacgttcgtggcgtttcgcgttcgggtcggttgggggcgtagggtcggcgtcgttttttttagtttttcggttttcggcgttcggcggtaattcgttcgcgggttttgtttttcgtattttttagttcggtttcggcggtcgttgatttaggaatcgcggcgtttcgttggaacgagatgggacggggcgggcgcggttagggcggcgcgggttggggcggcgcgcggtacgcgtcgggtagcggcggggggcgcggacggnntgtgcgtggcggggcggtgcggggggcggtcgtgtgcgaggcgcgagtgtgagcgcgcgcgggaggcgggcgggcgggtttcggtaggcgagcggcgttcgcgggcgagttaggaaggcggcgggaacgtaaagttgttttttcgttggttcgcgttttcggtggggcgggagtcggggttatcgaagcggcggtcgcggattcggtttttcgcggtatttgggtagcggtttcgtacgagcggtagcggcgtgggcggcgttggcggcggcgcgcgggaagcgaatcggagtttcggcgcggttcggcggtcgtcggggagttcggtttaggtgcgcggcgaggggggcgcgggtcggagttaggcggcggggattagggcggcgcgtagcgttcgcgttagttggaggatttttttagcggacgtttaggtttttggtcgggttttcggtttttagcggtagcggttgtcggagtttttcgttttcgagagttggttgcggggttcgggttcgtttttatcggttttaggttcggtcgtttcgtttttcgttcgtttgcgttcgtttttagtttaagatttttagggtattggtcgcgttgttgggtgatttttcgggtttaagttgtaagggggcgggtcgggtcggaggtggagtttttcgttaattgaagttttcgttataaattgaattttttgtattgttga

SEQ ID NO: 18494 - DNA, 1369 bp, Artificial Sequence
  chemically treated genomic DNA (Homo sapiens) CpG-island No: 18494
  misc_feature (710)..(711): n is either a, c, g or t
tcaacaatacaaaaaattcaatttataacgaaaacttcaattaacgaaaaactccacctccgacccgacccgcccccttacaacttaaacccgaaaaatcacccaacaacgcgaccaataccctaaaaatcttaaactaaaaacgaacgcaaacgaacgaaaaacgaaacgaccgaacctaaaaccgataaaaacgaacccgaaccccgcaaccaactctcgaaaacgaaaaactccgacaaccgctaccgctaaaaaccgaaaacccgaccaaaaacctaaacgtccgctaaaaaaatcctccaactaacgcgaacgctacgcgccgccctaatccccgccgcctaactccgacccgcgcccccctcgccgcgcacctaaaccgaactccccgacgaccgccgaaccgcgccgaaactccgattcgcttcccgcgcgccgccgccaacgccgcccacgccgctaccgctcgtacgaaaccgctacccaaataccgcgaaaaaccgaatccgcgaccgccgcttcgataaccccgactcccgccccaccgaaaacgcgaaccaacgaaaaaacaactttacgttcccgccgccttcctaactcgcccgcgaacgccgctcgcctaccgaaacccgcccgcccgcctcccgcgcgcgctcacactcgcgcctcgcacacgaccgccccccgcaccgccccgccacgcacannccgtccgcgccccccgccgctacccgacgcgtaccgcgcgccgccccaacccgcgccgccctaaccgcgcccgccccgtcccatctcgttccaacgaaacgccgcgattcctaaatcaacgaccgccgaaaccgaactaaaaaatacgaaaaacaaaacccgcgaacgaattaccgccgaacgccgaaaaccgaaaaactaaaaaaaacgacgccgaccctacgcccccaaccgacccgaacgcgaaacgccacgaacgtaaaacgcgaaacaacgaacgcgaaacgacgccgaccccgaacgactctcccactaaaaataactattacctaaacgccgaaacgctcccctctcgccgcttacctcgcccaacgcaaccccgaccgctaaacgcacccgtcccgttcgtccccgaacgttactctctaccccgaaaacgtcgaaactaaaacgcccgaactaaaccaccttcgcgaaccccgaaaacgacgacgcgactcaccgcgaaaacgcccgaacgcgtcaaatacgtactttcaaccgtaaataaatactaaacgtttaaaaatacgaaacaactccctaactcgtaaaaccctaaccgaccctaccgcgacgtccgaaaccttctaatccctcgctacgcgcgacgcgaaat

SEQ ID NO: 18495 - DNA, 1369 bp, Artificial Sequence
  chemically treated genomic DNA (Homo sapiens) CpG-island No: 18495
  misc_feature (710)..(711): n is either a, c, g or t
ttagtagtgtagggagtttaatttatagcggaggttttaattggcgggagattttattttcggttcggttcgtttttttgtaatttgagttcggaggattatttagtagcgcggttaatgttttagaaattttgggttgagggcgggcgtaggcgggcggagggcggagcggtcgggtttggggtcggtgggggcgggttcgggtttcgtagttagttttcgggggcgggggatttcggtagtcgttgtcgttggggatcgggagttcgattagggatttgggcgttcgttggggaggttttttagttggcgcgagcgttgcgcgtcgttttggttttcgtcgtttggtttcggttcgcgtttttttcgtcgcgtatttgagtcgagtttttcggcggtcgtcgagtcgcgtcggagtttcggttcgtttttcgcgcgtcgtcgttaacgtcgtttacgtcgttgtcgttcgtgcggggtcgttgtttaggtgtcgcgggaggtcgggttcgcggtcgtcgtttcggtggtttcggttttcgttttatcgaggacgcgggttagcgaggaggtaattttgcgttttcgtcgtttttttggttcgttcgcgggcgtcgttcgtttgtcggagttcgttcgttcgtttttcgcgcgcgtttatattcgcgtttcgtatacggtcgtttttcgtatcgtttcgttacgtatanntcgttcgcgtttttcgtcgttgttcgacgcgtgtcgcgcgtcgttttagttcgcgtcgttttggtcgcgttcgtttcgttttatttcgttttagcggggcgtcgcggtttttgggttagcggtcgtcggggtcgggttgagaggtgcggagggtagagttcgcgggcgggttatcgtcgggcgtcggagatcggagagttggggaaagcggcgtcggttttgcgtttttagtcgattcgggcgcggggcgttacgggcgtggggcgcggggtagcgggcgcggggcggcgtcggtttcgggcggtttttttattaggggtagttgttgtttgaacgtcggagcgtttttttttcgtcgtttgtttcgtttagcgtagtttcggtcgttgggcgtattcgtttcgttcgttttcggacgttgttttttatttcgggaacgtcgagattggagcgttcgaattgagttattttcgcggatttcgagagcggcggcgcgatttatcgcggaggcgttcggacgcgttaagtgcgtatttttaatcgtaaatgggtgttgagcgtttaggggtgcggggtaattttttaattcgtggggttttggtcggttttgtcgcggcgttcgagattttttgatttttcgttgcgcgcggcgcggggt

SEQ ID NO: 18496 - DNA, 1369 bp, Artificial Sequence
  chemically treated genomic DNA (Homo sapiens) CpG-island No: 18496
  misc_feature (659)..(660): n is either a, c, g or t
accccgcgccgcgcgcaacgaaaaatcaaaaaatctcgaacgccgcgacaaaaccgaccaaaaccccacgaattaaaaaattaccccgcacccctaaacgctcaacacccatttacgattaaaaatacgcacttaacgcgtccgaacgcctccgcgataaatcgcgccgccgctctcgaaatccgcgaaaataactcaattcgaacgctccaatctcgacgttcccgaaataaaaaacaacgtccgaaaacgaacgaaacgaatacgcccaacgaccgaaactacgctaaacgaaacaaacgacgaaaaaaaaacgctccgacgttcaaacaacaactacccctaataaaaaaaccgcccgaaaccgacgccgccccgcgcccgctaccccgcgccccacgcccgtaacgccccgcgcccgaatcgactaaaaacgcaaaaccgacgccgctttccccaactctccgatctccgacgcccgacgataacccgcccgcgaactctaccctccgcacctctcaacccgaccccgacgaccgctaacccaaaaaccgcgacgccccgctaaaacgaaataaaacgaaacgaacgcgaccaaaacgacgcgaactaaaacgacgcgcgacacgcgtcgaacaacgacgaaaaacgcgaacganntatacgtaacgaaacgatacgaaaaacgaccgtatacgaaacgcgaatataaacgcgcgcgaaaaacgaacgaacgaactccgacaaacgaacgacgcccgcgaacgaaccaaaaaaacgacgaaaacgcaaaattacctcctcgctaacccgcgtcctcgataaaacgaaaaccgaaaccaccgaaacgacgaccgcgaacccgacctcccgcgacacctaaacaacgaccccgcacgaacgacaacgacgtaaacgacgttaacgacgacgcgcgaaaaacgaaccgaaactccgacgcgactcgacgaccgccgaaaaactcgactcaaatacgcgacgaaaaaaacgcgaaccgaaaccaaacgacgaaaaccaaaacgacgcgcaacgctcgcgccaactaaaaaacctccccaacgaacgcccaaatccctaatcgaactcccgatccccaacgacaacgactaccgaaatcccccgcccccgaaaactaactacgaaacccgaacccgcccccaccgaccccaaacccgaccgctccgccctccgcccgcctacgcccgccctcaacccaaaatttctaaaacattaaccgcgctactaaataatcctccgaactcaaattacaaaaaaacgaaccgaaccgaaaataaaatctcccgccaattaaaacctccgctataaattaaactccctacactactaa

SEQ ID NO: 18497 - DNA, 912 bp, Artificial Sequence
  chemically treated genomic DNA (Homo sapiens) CpG-island No: 18497
tttcgcgttttttcggtacggtttttatgttttggtttttcgattttttgtgtattcgtaagtattttttgggtcgtcgtcgtcgggggtagttcgagttcgaagtggagtttaatagtgaaggcgaggaggtgtttttcgatgattcgtttatttgcgtgttcgacgataatcgtttgtgtattttggcgtcgtttaaggcggtgtggtatggttagaagttggatttttttaagtaggcgtacgagggcggttcggcgtttaatttcgaggtggttttgttcgacggtttttagagttagtatattttcgattacgcgtaagggaatcgttcgttggtttttaatttcggtagttgtatttgattatcgtttatggcgcgtatgagcgttttttagcgtttggttattaagtattagcgcgacgtcgatttttttattatttatatcgaggaagcgtattttttcgacggttgggttattacggattttttttatattattttatagtatcggagtttggaggatcgggttagcgtagcgagggtattgtagtaaggtgtattcggttgcgttttggttttcgatattatggttaattttagtagttcggtttatggcgtttatttcgagcgtttttatgttatttagagtggtattattatgtattagggcggtcgtggtttcgacggttattaggtttttgagttgcgtatttggttggaacgttatgatgagtaattgtacggcgttcggtttcggagggtgtaaatatttaacggataattgattgaatttggtgggttgggttttcgagttttcgaagtttacgtgtaagcgttttaaattaagttacgtttggcgaggttttagtgatattgatgtgttgagttattattttagattgagtttg

SEQ ID NO: 18498 - DNA, 912 bp, Artificial Sequence
  chemically treated genomic DNA (Homo sapiens) CpG-island No: 18498
caaactcaatctaaaataataactcaacacatcaatatcactaaaacctcgccaaacgtaacttaatttaaaacgcttacacgtaaacttcgaaaactcgaaaacccaacccaccaaattcaatcaattatccgttaaatatttacaccctccgaaaccgaacgccgtacaattactcatcataacgttccaaccaaatacgcaactcaaaaacctaataaccgtcgaaaccacgaccgccctaatacataataataccactctaaataacataaaaacgctcgaaataaacgccataaaccgaactactaaaattaaccataatatcgaaaaccaaaacgcaaccgaatacaccttactacaataccctcgctacgctaacccgatcctccaaactccgatactataaaataatataaaaaaaatccgtaataacccaaccgtcgaaaaaatacgcttcctcgatataaataataaaaaaatcgacgtcgcgctaatacttaataaccaaacgctaaaaaacgctcatacgcgccataaacgataatcaaatacaactaccgaaattaaaaaccaacgaacgattcccttacgcgtaatcgaaaatatactaactctaaaaaccgtcgaacaaaaccacctcgaaattaaacgccgaaccgccctcgtacgcctacttaaaaaaatccaacttctaaccataccacaccgccttaaacgacgccaaaatacacaaacgattatcgtcgaacacgcaaataaacgaatcatcgaaaaacacctcctcgccttcactattaaactccacttcgaactcgaactacccccgacgacgacgacccaaaaaatacttacgaatacacaaaaaatcgaaaaaccaaaacataaaaaccgtaccgaaaaaacgcgaaa

SEQ ID NO: 18499 - DNA, 912 bp, Artificial Sequence
  chemically treated genomic DNA (Homo sapiens) CpG-island No: 18499
tagatttagtttgaaatggtggtttagtatattagtgttattggggtttcgttaagcgtgatttggtttgaggcgtttgtacgtgggtttcgaaggttcgaaggtttagtttattaagtttagttaattgttcgttggatgtttatatttttcggggtcgagcgtcgtgtagttgtttattatagcgttttaattaagtgcgtagtttagagatttggtagtcgtcggggttacggtcgttttggtatataatagtgttattttggatgatatagagacgttcgaagtaggcgttataggtcgagttgttggagttggttatggtgtcgaggattagagcgtagtcgggtgtattttgttgtagtattttcgttgcgttgattcggttttttaggtttcggtgttgtgggatgatgtagggagagttcgtggtgatttagtcgtcggaggggtgcgttttttcgatgtagatgatgaggaagtcgacgtcgcgttggtatttagtgattaggcgttggaaggcgtttatgcgcgttatgaacggtggttaggtgtagttgtcgaaattgagaattagcgggcggtttttttgcgcgtagtcgaggatgtgttggttttggaagtcgtcgggtagaattatttcggagttgggcgtcggatcgttttcgtgcgtttgtttgaagaaatttaatttttggttatgttatatcgttttgagcgacgttagggtgtataggcggttgtcgtcggatacgtagatgggcgggttatcgggaggtattttttcgtttttattgttgagttttatttcgggttcgggttgttttcggcggcggcggtttaggaaatgtttgcggatatataagaaatcgagaagttagagtatgaaggtcgtgtcgaggaagcgcggga

SEQ ID NO: 18500 - DNA, 912 bp, Artificial Sequence
  chemically treated genomic DNA (Homo sapiens) CpG-island No: 18500
tcccgcgcttcctcgacacgaccttcatactctaacttctcgatttcttatatatccgcaaacatttcctaaaccgccgccgccgaaaacaacccgaacccgaaataaaactcaacaataaaaacgaaaaaatacctcccgataacccgcccatctacgtatccgacgacaaccgcctatacaccctaacgtcgctcaaaacgatataacataaccaaaaattaaatttcttcaaacaaacgcacgaaaacgatccgacgcccaactccgaaataattctacccgacgacttccaaaaccaacacatcctcgactacgcgcaaaaaaaccgcccgctaattctcaatttcgacaactacacctaaccaccgttcataacgcgcataaacgccttccaacgcctaatcactaaataccaacgcgacgtcgacttcctcatcatctacatcgaaaaaacgcacccctccgacgactaaatcaccacgaactctccctacatcatcccacaacaccgaaacctaaaaaaccgaatcaacgcaacgaaaatactacaacaaaatacacccgactacgctctaatcctcgacaccataaccaactccaacaactcgacctataacgcctacttcgaacgtctctatatcatccaaaataacactattatataccaaaacgaccgtaaccccgacgactaccaaatctctaaactacgcacttaattaaaacgctataataaacaactacacgacgctcgaccccgaaaaatataaacatccaacgaacaattaactaaacttaataaactaaaccttcgaaccttcgaaacccacgtacaaacgcctcaaaccaaatcacgcttaacgaaaccccaataacactaatatactaaaccaccatttcaaactaaatcta

SEQ ID NO: 18501 - DNA, 744 bp, Artificial Sequence
  chemically treated genomic DNA (Homo sapiens) CpG-island No: 18501
ttagtatcgaggatagcggatatattttttttttcggggggttttcgtcgttaggaaggcggtgttgatagcgttcgtagggttgtaggtgttcgtatcgcgcgttcgttcgttcgtattttcgcggtatttttgcgcgtttatttttttttttcgtttcgcgtagggtagtcgcgcggcgttttatttttttggttggagtaatttggataatagttatagtagtcggtgattcgtaggattcggttttcgatagtggttatttcgttgggggtcgttttgatatttatagagagcgcggggcgacggtttcgagtgcggcggggcggagagcgtagcgcggggttcgggagttggtgtaggtgtcggagtcgttggtgttgattttgtagtttttgttttcgcgttcgggttttgattttatcgttcggcgtagtatcggtttcgtattatagcggcggcggcggcggcggcggcggagcggtttttattcgggtcggttttttcgttagtttggtagttttttcgcgcgttattcggagtattgttgttcgaatagcgtttttttattttcgacgtttatcgtggtcgggggcgggtgtgggcgttttatttggtcgttagtttttattattaatttttgcgcgatttttttcgaaaattagatattttaattttatttgatgaaagggatgtttggttagtggggcgcgagaggagaaggcgacggtggttaggggttta

SEQ ID NO: 18502 - DNA, 744 bp, Artificial Sequence
  chemically treated genomic DNA (Homo sapiens) CpG-island No: 18502
taaacccctaaccaccgtcgccttctcctctcgcgccccactaaccaaacatccctttcatcaaataaaattaaaatatctaattttcgaaaaaaatcgcgcaaaaattaataataaaaactaacgaccaaataaaacgcccacacccgcccccgaccacgataaacgtcgaaaataaaaaaacgctattcgaacaacaatactccgaataacgcgcgaaaaaactaccaaactaacgaaaaaaccgacccgaataaaaaccgctccgccgccgccgccgccgccgccgctataatacgaaaccgatactacgccgaacgataaaatcaaaacccgaacgcgaaaacaaaaactacaaaatcaacaccaacgactccgacacctacaccaactcccgaaccccgcgctacgctctccgccccgccgcactcgaaaccgtcgccccgcgctctctataaatatcaaaacgacccccaacgaaataaccactatcgaaaaccgaatcctacgaatcaccgactactataactattatccaaattactccaaccaaaaaaataaaacgccgcgcgactaccctacgcgaaacgaaaaaaaaaaataaacgcgcaaaaataccgcgaaaatacgaacgaacgaacgcgcgatacgaacacctacaaccctacgaacgctatcaacaccgccttcctaacgacgaaaaccccccgaaaaaaaaaatatatccgctatcctcgatactaa

SEQ ID NO: 18503 - DNA, 744 bp, Artificial Sequence
  chemically treated genomic DNA (Homo sapiens) CpG-island No: 18503
tgagtttttggttatcgtcgtttttttttttcgcgttttattgattaaatattttttttattaggtggggttggggtgtttagttttcgggaaggatcgcgtaagggttaatgatgaaagttggcgattaggtggggcgtttatattcgttttcggttacggtgggcgtcggaggtgagggggcgttattcgggtagtagtgtttcgggtggcgcgcgggagagttgttaggttgacggagaggtcggttcgagtgggggtcgtttcgtcgtcgtcgtcgtcgtcgtcgttgtgatgcggagtcggtgttgcgtcgggcggtggagttagagttcgggcgcgggagtaggagttgtaagattagtattagcggtttcggtatttgtattagttttcgggtttcgcgttgcgtttttcgtttcgtcgtattcggggtcgtcgtttcgcgttttttatggatgttaaggcggtttttaacggggtggttattatcgaggatcggattttgcggattatcggttattatggttattatttaggttattttagttagaaaagtaagacgtcgcgcggttgttttgcgcgaggcggggaagggaggtgggcgcgtaggggtgtcgcggggatgcggacgggcgggcgcgcggtacggatatttgtagttttgcggacgttgttaatatcgtttttttggcggcggggatttttcggggagaaaagtatgttcgttgttttcggtgttga

SEQ ID NO: 18504 - DNA, 744 bp, Artificial Sequence
  chemically treated genomic DNA (Homo sapiens) CpG-island No: 18504
tcaacaccgaaaacaacgaacatacttttctccccgaaaaatccccgccgccaaaaaaacgatattaacaacgtccgcaaaactacaaatatccgtaccgcgcgcccgcccgtccgcatccccgcgacacccctacgcgcccacctcccttccccgcctcgcgcaaaacaaccgcgcgacgtcttacttttctaactaaaataacctaaataataaccataataaccgataatccgcaaaatccgatcctcgataataaccaccccgttaaaaaccgccttaacatccataaaaaacgcgaaacgacgaccccgaatacgacgaaacgaaaaacgcaacgcgaaacccgaaaactaatacaaataccgaaaccgctaatactaatcttacaactcctactcccgcgcccgaactctaactccaccgcccgacgcaacaccgactccgcatcacaacgacgacgacgacgacgacgacgaaacgacccccactcgaaccgacctctccgtcaacctaacaactctcccgcgcgccacccgaaacactactacccgaataacgccccctcacctccgacgcccaccgtaaccgaaaacgaatataaacgccccacctaatcgccaactttcatcattaacccttacgcgatccttcccgaaaactaaacaccccaaccccacctaataaaaaaaatatttaatcaataaaacgcgaaaaaaaaaaacgacgataaccaaaaactca

SEQ ID NO: 18505 - DNA, 610 bp, Artificial Sequence
  chemically treated genomic DNA (Homo sapiens) CpG-island No: 18505
gttcgcgttattttcgttttttgggttatcgtcgtttagatagttttcggcggcgaatttaatacgtagttttcgtacgaattagtcgtatttgcgtatgaggaattttagtcgaggttgtttcgcgggcgagacgcggaggtagatgcggagttggggttatagggtcggatagaagaggtatttacgttagtgcgagtaggaggtcgaggttcgtagtcggtcgggcgtcggtagaaaagagaagatgtgtacgattagttcgttgggtagcgacgtagcgttcgtcgtttgttcgtatagagttattcggtttcgtcgtcggttgtcggttttcggtcgttttcgtagtattcggagtagttttcgtagtcgtcgtagttgttgtagtcgtagtcgtcgttatcgcgttattcgggcggtttcggttcgggttcgagttttcggcggtcggggttgcggtattgataagaataataatattaatgattaggaagaagggggcggaatcgtcgtgggtttcggcggaattaagtagaatataagttgtggagagggggaaaggtttttgcgggcgtggtttgtcgggagttagtttttgtttttttaa

SEQ ID NO: 18506 - DNA, 610 bp, Artificial Sequence
  chemically treated genomic DNA (Homo sapiens) CpG-island No: 18506
ttaaaaaaacaaaaactaactcccgacaaaccacgcccgcaaaaacctttccccctctccacaacttatattctacttaattccgccgaaacccacgacgattccgcccccttcttcctaatcattaatattattattcttatcaataccgcaaccccgaccgccgaaaactcgaacccgaaccgaaaccgcccgaataacgcgataacgacgactacgactacaacaactacgacgactacgaaaactactccgaatactacgaaaacgaccgaaaaccgacaaccgacgacgaaaccgaataactctatacgaacaaacgacgaacgctacgtcgctacccaacgaactaatcgtacacatcttctcttttctaccgacgcccgaccgactacgaacctcgacctcctactcgcactaacgtaaatacctcttctatccgaccctataaccccaactccgcatctacctccgcgtctcgcccgcgaaacaacctcgactaaaattcctcatacgcaaatacgactaattcgtacgaaaactacgtattaaattcgccgccgaaaactatctaaacgacgataacccaaaaaacgaaaataacgcgaac

SEQ ID NO: 18507 - DNA, 610 bp, Artificial Sequence
  chemically treated genomic DNA (Homo sapiens) CpG-island No: 18507
ttgagaagatagaggttggttttcggtaggttacgttcgtagaggtttttttttttttttataatttgtgttttatttggtttcgtcgagatttacgacggtttcgtttttttttttttagttattgatgttgttgtttttgttagtgtcgtagtttcgatcgtcgggagttcgaattcgagtcggggtcgttcgggtggcgcggtggcggcggttgcggttgtagtagttgcgacggttgcgggggttgtttcgggtattgcgggggcggtcgggagtcggtagtcggcggcggggtcggatggttttgtgcgggtaggcggcgggcgttgcgtcgttgtttagcgagttgatcgtgtatatttttttttttttgtcggcgttcgatcggttgcgggtttcggttttttgttcgtattggcgtgagtgttttttttattcggttttgtggttttagtttcgtatttgttttcgcgtttcgttcgcggagtagtttcggttggaattttttatgcgtaagtgcggttggttcgtgcgagagttgcgtgttgaattcgtcgtcgagaattatttgagcggcggtggtttaggggacggaggtggcgcggat

SEQ ID NO: 18508 - DNA, 610 bp, Artificial Sequence
  chemically treated genomic DNA (Homo sapiens) CpG-island No: 18508
atccgcgccacctccgtcccctaaaccaccgccgctcaaataattctcgacgacgaattcaacacgcaactctcgcacgaaccaaccgcacttacgcataaaaaattccaaccgaaactactccgcgaacgaaacgcgaaaacaaatacgaaactaaaaccacaaaaccgaataaaaaaaacactcacgccaatacgaacaaaaaaccgaaacccgcaaccgatcgaacgccgacaaaaaaaaaaaaatatacacgatcaactcgctaaacaacgacgcaacgcccgccgcctacccgcacaaaaccatccgaccccgccgccgactaccgactcccgaccgcccccgcaatacccgaaacaacccccgcaaccgtcgcaactactacaaccgcaaccgccgccaccgcgccacccgaacgaccccgactcgaattcgaactcccgacgatcgaaactacgacactaacaaaaacaacaacatcaataactaaaaaaaaaaaaacgaaaccgtcgtaaatctcgacgaaaccaaataaaacacaaattataaaaaaaaaaaaaaacctctacgaacgtaacctaccgaaaaccaacctctatcttctcaa

SEQ ID NO: 18509 - DNA, 507 bp, Artificial Sequence
  chemically treated genomic DNA (Homo sapiens) CpG-island No: 18509
ttttatatcgtgatgcggttaagcgcgtatcgttgtaatttatggtcgttatagaatagataaatcgttatttggttttattcggttttgttgagttaggcgattacgatgtcgtgggtcgagagtggtaacgattttttttttttaacgtatttttcgtattacgtattttatacgagatttattttttgggaatttagatttggttcggtttcggatttttacgatatattgagtttaataataggttttgtgtcgcgtcgtttcgtatagtttttagtttagcgtgttatttttatttcgaatcgttatcgtattagtagttaataggagagcgtgattttatacgtaagttcgttttttagcgttagtatggttaatcggaacgttagaattgggcgtcgatttaatgatatgcggggttaaaaatttatcggtcggaagtgttttttttataaagtaaattttttaggggtaagagtttagtttttaggtttcgttaatttt

SEQ ID NO: 18510 - DNA, 507 bp, Artificial Sequence
  chemically treated genomic DNA (Homo sapiens) CpG-island No: 18510
aaaattaacgaaacctaaaaactaaactcttacccctaaaaaatttactttataaaaaaaacacttccgaccgataaatttttaaccccgcatatcattaaatcgacgcccaattctaacgttccgattaaccatactaacgctaaaaaacgaacttacgtataaaatcacgctctcctattaactactaatacgataacgattcgaaataaaaataacacgctaaactaaaaactatacgaaacgacgcgacacaaaacctattattaaactcaatatatcgtaaaaatccgaaaccgaaccaaatctaaattcccaaaaaataaatctcgtataaaatacgtaatacgaaaaatacgttaaaaaaaaaaaatcgttaccactctcgacccacgacatcgtaatcgcctaactcaacaaaaccgaataaaaccaaataacgatttatctattctataacgaccataaattacaacgatacgcgcttaaccgcatcacgatataaaa

SEQ ID NO: 18511 - DNA, 507 bp, Artificial Sequence
  chemically treated genomic DNA (Homo sapiens) CpG-island No: 18511
gaaattggcggaatttagaggttgaatttttgtttttggagggtttgttttgtgaaaagaatattttcggtcggtgagtttttaatttcgtatgttattaggtcggcgtttaattttgacgtttcgattggttatgttgacgttggaaggcgggtttgcgtatggggttacgtttttttattggttgttggtgcggtggcggttcggagtgagggtagtacgttgagttgaaggttgtgcggagcggcgcggtatagagtttgttgttgagtttagtatgtcgtgggaattcggggtcgggttaggtttaggtttttaggggatggatttcgtgtggagtgcgtggtacggaaagtgcgttaaagggaaagggtcgttgttattttcggtttacggtatcgtggtcgtttggtttagtagggtcgagtgggattaggtgacggtttatttgttttgtgacgattataagttgtagcggtacgcgtttaatcgtattacggtgtggag

SEQ ID NO: 18512 - DNA, 507 bp, Artificial Sequence
  chemically treated genomic DNA (Homo sapiens) CpG-island No: 18512
ctccacaccgtaatacgattaaacgcgtaccgctacaacttataatcgtcacaaaacaaataaaccgtcacctaatcccactcgaccctactaaaccaaacgaccacgataccgtaaaccgaaaataacaacgaccctttccctttaacgcactttccgtaccacgcactccacacgaaatccatcccctaaaaacctaaacctaacccgaccccgaattcccacgacatactaaactcaacaacaaactctataccgcgccgctccgcacaaccttcaactcaacgtactaccctcactccgaaccgccaccgcaccaacaaccaataaaaaaacgtaaccccatacgcaaacccgccttccaacgtcaacataaccaatcgaaacgtcaaaattaaacgccgacctaataacatacgaaattaaaaactcaccgaccgaaaatattcttttcacaaaacaaaccctccaaaaacaaaaattcaacctctaaattccgccaatttc

SEQ ID NO: 18513 - DNA, 514 bp, Artificial Sequence
  chemically treated genomic DNA (Homo sapiens) CpG-island No: 18513
gtagtacgaattttttcgttaggcggagggcggcggggttcgatttttttttgttatcgtcgtcgtcgagtttttcgtttaggacgtcgttcgcggggttgttgaagagcggtaataggttttttacgggtatcgttttcgttgtttagtggttcggcgtcgcgtcgtttagtagttaaatttcgtcgtcgttgggagttcgcggttgcggggttgggttttgcgtagttaggtcgttcgattttttcggttgggttgcggattttttttgggggaataatttcgcgtcgggtttttttttcggggcggtttttcgggtatataggtacgcgcgatagatcgttggttgtagtttttgcggggagagaaatagtaaaacgtagtaattacggcgatgataaagtttttagcgggttttcgtttttcgatttttggcgagtttttaggatcgttttttttaagtagagttttgtttagttcgggtatcgttttcgtagtttattttttggatttg

SEQ ID NO: 18514 - DNA, 514 bp, Artificial Sequence
  chemically treated genomic DNA (Homo sapiens) CpG-island No: 18514
caaatccaaaaaataaactacgaaaacgatacccgaactaaacaaaactctacttaaaaaaaacgatcctaaaaactcgccaaaaatcgaaaaacgaaaacccgctaaaaactttatcatcgccgtaattactacgttttactatttctctccccgcaaaaactacaaccaacgatctatcgcgcgtacctatatacccgaaaaaccgccccgaaaaaaaaacccgacgcgaaattattcccccaaaaaaaatccgcaacccaaccgaaaaaatcgaacgacctaactacgcaaaacccaaccccgcaaccgcgaactcccaacgacgacgaaatttaactactaaacgacgcgacgccgaaccactaaacaacgaaaacgatacccgtaaaaaacctattaccgctcttcaacaaccccgcgaacgacgtcctaaacgaaaaactcgacgacgacgataacaaaaaaaaatcgaaccccgccgccctccgcctaacgaaaaaattcgtactac

SEQ ID NO: 18515 - DNA, 514 bp, Artificial Sequence
  chemically treated genomic DNA (Homo sapiens) CpG-island No: 18515
taagtttagagagtgggttgcgagggcggtgttcggattggataggattttgtttaaggggagcggttttggaggttcgttaggagtcggagggcggagattcgttggaaattttattatcgtcgtaattattacgttttattgttttttttttcgtaggggttgtagttagcggtttgtcgcgcgtgtttgtgtgttcgaggagtcgtttcggggagaagattcggcgcggagttgtttttttagggaggattcgtagtttagtcgagggggtcgggcggtttggttacgtaggatttagtttcgtagtcgcggatttttagcggcggcgaagtttggttgttgagcggcgcggcgtcggattattggatagcgggagcgatgttcgtggggggtttgttgtcgttttttagtagtttcgcgggcggcgttttgggcggggggttcggcggcggcggtggtaggaaggggtcgggtttcgtcgtttttcgtttgacggagaagttcgtgttgt

SEQ ID NO: 18516 - DNA, 514 bp, Artificial Sequence
  chemically treated genomic DNA (Homo sapiens) CpG-island No: 18516
acaacacgaacttctccgtcaaacgaaaaacgacgaaacccgaccccttcctaccaccgccgccgccgaaccccccgcccaaaacgccgcccgcgaaactactaaaaaacgacaacaaaccccccacgaacatcgctcccgctatccaataatccgacgccgcgccgctcaacaaccaaacttcgccgccgctaaaaatccgcgactacgaaactaaatcctacgtaaccaaaccgcccgaccccctcgactaaactacgaatcctccctaaaaaaacaactccgcgccgaatcttctccccgaaacgactcctcgaacacacaaacacgcgcgacaaaccgctaactacaacccctacgaaaaaaaaaacaataaaacgtaataattacgacgataataaaatttccaacgaatctccgccctccgactcctaacgaacctccaaaaccgctccccttaaacaaaatcctatccaatccgaacaccgccctcgcaacccactctctaaactta

SEQ ID NO: 18517 - DNA, 797 bp, Artificial Sequence
  chemically treated genomic DNA (Homo sapiens) CpG-island No: 18517
agcgcgcgagtatttcggggaggggtagcgtatttttgggtaggaggggcgtagcgtgggcgggagattcgttaatttcgttcgttttttattttcgcgttgagattgttgttttttttttaggttgggttgagcgcgttgttttacggtttcgtagtttcggcgcggtttaggtgggcgagcgcgtcgatttgcgggcgaatggtagcgagtagagtagtacggtatatttcgtcgcggtttcgcgagtattaattttattgtcggttttggggcggtggaaagcgagggaggcgacgcggtcggagagtgacggcgcggtcgggttaattacgcgtcgtttagggtttcgcgggggcggggtcgaggcgaggagggggatgcgcggggcggggagtttacgggaagcgtagtttcggcggggttcggtcggcggcggggaggtcgcggggtcgggaggcgcgaggtaggcgggagtcgcggtgaggaggacggtcgaattcgtggttgaggtttagcgtcgagaagcggtaggtagagttcggggtcggggagtttattttgcgttggtttcggtaggggttttcggggtggttgattttcgattggttcgggaggcgtttgggttcgcgcgggatttttttgttttttttttcgattcgtgcggggcggtcgggggcgttttcgagggggtttcgggaaaggcggggtttggtagggggttttgggcgttgggtcgtttagaagtacggttttattttagttattttttttttatttaaggtcggggtttttcg

SEQ ID NO: 18518 - DNA, 797 bp, Artificial Sequence
  chemically treated genomic DNA (Homo sapiens) CpG-island No: 18518
cgaaaaaccccgaccttaaataaaaaaaaaataactaaaataaaaccgtacttctaaacgacccaacgcccaaaaccccctaccaaaccccgcctttcccgaaaccccctcgaaaacgcccccgaccgccccgcacgaatcgaaaaaaaaaacaaaaaaatcccgcgcgaacccaaacgcctcccgaaccaatcgaaaatcaaccaccccgaaaacccctaccgaaaccaacgcaaaataaactccccgaccccgaactctacctaccgcttctcgacgctaaacctcaaccacgaattcgaccgtcctcctcaccgcgactcccgcctacctcgcgcctcccgaccccgcgacctccccgccgccgaccgaaccccgccgaaactacgcttcccgtaaactccccgccccgcgcatccccctcctcgcctcgaccccgcccccgcgaaaccctaaacgacgcgtaattaacccgaccgcgccgtcactctccgaccgcgtcgcctccctcgctttccaccgccccaaaaccgacaataaaattaatactcgcgaaaccgcgacgaaatataccgtactactctactcgctaccattcgcccgcaaatcgacgcgctcgcccacctaaaccgcgccgaaactacgaaaccgtaaaacaacgcgctcaacccaacctaaaaaaaaaacaacaatctcaacgcgaaaataaaaaacgaacgaaattaacgaatctcccgcccacgctacgcccctcctacccaaaaatacgctacccctccccgaaatactcgcgcgct

SEQ ID NO: 18519 - DNA, 797 bp, Artificial Sequence
  chemically treated genomic DNA (Homo sapiens) CpG-island No: 18519
cggggaatttcggttttggataaaaagagggtaattggagtaaagtcgtgtttttgaacgatttagcgtttaggattttttgttagatttcgtttttttcgggattttttcgggagcgttttcgatcgtttcgtacgggtcggaggaggaggtagagaggtttcgcgcggatttaggcgtttttcgggttagtcgaggattaattatttcggggatttttgtcgaggttagcgtaggataaatttttcgatttcgaattttgtttgtcgtttttcggcgttgggttttagttacgggttcgatcgttttttttatcgcggttttcgtttatttcgcgtttttcggtttcgcgattttttcgtcgtcggtcgggtttcgtcgaggttgcgtttttcgtaaatttttcgtttcgcgtattttttttttcgtttcggtttcgttttcgcgggattttgggcggcgcgtgattggttcggtcgcgtcgttatttttcggtcgcgtcgtttttttcgttttttatcgttttaagatcggtagtgagattagtgttcgcggggtcgcggcggagtgtatcgtgttgttttattcgttgttattcgttcgtaggtcggcgcgttcgtttatttgagtcgcgtcggggttgcgggatcgtgggatagcgcgtttagtttagtttaggaaagaggtagtagttttagcgcggagatggggagcgggcgaagttgacgagtttttcgtttacgttgcgttttttttgtttagaggtgcgttgttttttttcgaggtgttcgcgcgtt

SEQ ID NO: 18520 - DNA, 797 bp, Artificial Sequence
  chemically treated genomic DNA (Homo sapiens) CpG-island No: 18520
aacgcgcgaacacctcgaaaaaaaacaacgcacctctaaacaaaaaaaacgcaacgtaaacgaaaaactcgtcaacttcgcccgctccccatctccgcgctaaaactactacctctttcctaaactaaactaaacgcgctatcccacgatcccgcaaccccgacgcgactcaaataaacgaacgcgccgacctacgaacgaataacaacgaataaaacaacacgatacactccgccgcgaccccgcgaacactaatctcactaccgatcttaaaacgataaaaaacgaaaaaaacgacgcgaccgaaaaataacgacgcgaccgaaccaatcacgcgccgcccaaaatcccgcgaaaacgaaaccgaaacgaaaaaaaaaatacgcgaaacgaaaaatttacgaaaaacgcaacctcgacgaaacccgaccgacgacgaaaaaatcgcgaaaccgaaaaacgcgaaataaacgaaaaccgcgataaaaaaaacgatcgaacccgtaactaaaacccaacgccgaaaaacgacaaacaaaattcgaaatcgaaaaatttatcctacgctaacctcgacaaaaatccccgaaataattaatcctcgactaacccgaaaaacgcctaaatccgcgcgaaacctctctacctcctcctccgacccgtacgaaacgatcgaaaacgctcccgaaaaaatcccgaaaaaaacgaaatctaacaaaaaatcctaaacgctaaatcgttcaaaaacacgactttactccaattaccctctttttatccaaaaccgaaattccccg

SEQ ID NO: 18521 - DNA, 547 bp, Artificial Sequence
  chemically treated genomic DNA (Homo sapiens) CpG-island No: 18521
cgagtcgggtcgtattacgcgttttttgcgtatcgtgggtttggttcgtagaattcgcggcgttagtattagcgttagtagtagttttagggttaattttaggcggcggtcgcggttatcgcgcgttatcgtttcgaggagagggcggtcgagagggagacgttgagcgagcgataatagcggtagttcgggaatggggattcggagcgcggcggtagcgatagggttggggtcggcgcggaggaggggattggttagttttttcgttagtgttcgtttcgagtcggagtagaggggcgcgtttgggtttcgggttgggaagttgcgggcggtttcgttcgcgcgtttattggtcgttgagttgtcgggggaagtcggggtcgcggagttacgtcgttagttggggtggtgggcgcggggttcgtgtttcgtttcggttttttttcgcgattttgttgttaggggcgggttcgggcgaattgggttagggattggagggttcggaggaggattgggaagttttttgttaagtaatagatgtgtagga

SEQ ID NO: 18522 - DNA, 547 bp, Artificial Sequence
  chemically treated genomic DNA (Homo sapiens) CpG-island No: 18522
tcctacacatctattacttaacaaaaaacttcccaatcctcctccgaaccctccaatccctaacccaattcgcccgaacccgcccctaacaacaaaatcgcgaaaaaaaaccgaaacgaaacacgaaccccgcgcccaccaccccaactaacgacgtaactccgcgaccccgacttcccccgacaactcaacgaccaataaacgcgcgaacgaaaccgcccgcaacttcccaacccgaaacccaaacgcgcccctctactccgactcgaaacgaacactaacgaaaaaactaaccaatcccctcctccgcgccgaccccaaccctatcgctaccgccgcgctccgaatccccattcccgaactaccgctattatcgctcgctcaacgtctccctctcgaccgccctctcctcgaaacgataacgcgcgataaccgcgaccgccgcctaaaattaaccctaaaactactactaacgctaatactaacgccgcgaattctacgaaccaaacccacgatacgcaaaaaacgcgtaatacgacccgactcg

SEQ ID NO: 18523 - DNA, 547 bp, Artificial Sequence
  chemically treated genomic DNA (Homo sapiens) CpG-island No: 18523
ttttgtatatttgttgtttgataaagaattttttaattttttttcgagttttttagtttttagtttagttcgttcgggttcgtttttagtaataagatcgcggggaggggtcgaggcgaaatacgagtttcgcgtttattattttagttggcgacgtggtttcgcggtttcggtttttttcggtagtttagcgattaatgggcgcgcgagcggggtcgttcgtagttttttagttcgaggtttaggcgcgtttttttgtttcggttcggggcgggtattggcggagggattggttagttttttttttcgcgtcggttttaattttgtcgttgtcgtcgcgtttcgagtttttattttcgagttgtcgttgttgtcgttcgtttagcgtttttttttcggtcgtttttttttcgggacgatggcgcgcggtggtcgcggtcgtcgtttggggttagttttggggttgttgttggcgttggtgttggcgtcgcgggttttgcgggttaagtttacggtgcgtaaagagcgcgtggtgcggttcgattcg

SEQ ID NO: 18524 - DNA, 547 bp, Artificial Sequence
  chemically treated genomic DNA (Homo sapiens) CpG-island No: 18524
cgaatcgaaccgcaccacgcgctctttacgcaccgtaaacttaacccgcaaaacccgcgacgccaacaccaacgccaacaacaaccccaaaactaaccccaaacgacgaccgcgaccaccgcgcgccatcgtcccgaaaaaaaaacgaccgaaaaaaaaacgctaaacgaacgacaacaacgacaactcgaaaataaaaactcgaaacgcgacgacaacgacaaaattaaaaccgacgcgaaaaaaaaaactaaccaatccctccgccaatacccgccccgaaccgaaacaaaaaaacgcgcctaaacctcgaactaaaaaactacgaacgaccccgctcgcgcgcccattaatcgctaaactaccgaaaaaaaccgaaaccgcgaaaccacgtcgccaactaaaataataaacgcgaaactcgtatttcgcctcgacccctccccgcgatcttattactaaaaacgaacccgaacgaactaaactaaaaactaaaaaactcgaaaaaaaattaaaaaattctttatcaaacaacaaatatacaaaa

SEQ ID NO: 18525 - DNA, 792 bp, Artificial Sequence
  chemically treated genomic DNA (Homo sapiens) CpG-island No: 18525
tcgaggcgttttcggttcgtttttttttcggttttcggattcgagtcggttttcgggaaagagtttgttatcgcgttttcgtagttatttttttcgcgtgttcggttttttttagtggcgggggtacgtgggcgcgcggggtgcgtggtaagtcgtttttttttttacgttcgttcggtcgtttttcgcgcgcgcgtttcgtatatagttttcgtgtagtgggtagagttcggtttcgcgcgcgtttcgtttcgtttttggttagtcgcgttcgttttcgcgtttttgttttttttttttttttttttttcgttttttaggcgcgtattttttttttcgcgtttttttcgcgttttatatttatcgttcggcggagggggtttagttcgtagtcgtcgtcgttatcgtcgcgtttcggtttcggtgtaggtagcggtcgtcgtcgtcgagatagttgcgcgggcgagtatttttacgtagtaagttcgtttttttttcgtttgtgcgcgcgtgtgtgtttttcgttcgtcggcgttttgggtttcgggggagcggttgtttttttgtttcgtcgtcgtcgtcgttcggggttggtttttgcggtttcggttgtttggttttttagggttgggtattgcggtttcggcggtttcgttgaggtcgggggttaggggtcgtttcgggttgcggggtgcgggacgagggattgcgagtgcgaggttttttttggtgcgtgtttcggttttttttgggtttttggttcgatggggattaagaggtagtggggtggag

SEQ ID NO: 18526 - DNA, 792 bp, Artificial Sequence
  chemically treated genomic DNA (Homo sapiens) CpG-island No: 18526
ctccaccccactacctcttaatccccatcgaaccaaaaacccaaaaaaaaccgaaacacgcaccaaaaaaaacctcgcactcgcaatccctcgtcccgcaccccgcaacccgaaacgacccctaacccccgacctcaacgaaaccgccgaaaccgcaatacccaaccctaaaaaaccaaacaaccgaaaccgcaaaaaccaaccccgaacgacgacgacgacgaaacaaaaaaacaaccgctcccccgaaacccaaaacgccgacgaacgaaaaacacacacgcgcgcacaaacgaaaaaaaaacgaacttactacgtaaaaatactcgcccgcgcaactatctcgacgacgacgaccgctacctacaccgaaaccgaaacgcgacgataacgacgacgactacgaactaaaccccctccgccgaacgataaatataaaacgcgaaaaaaacgcgaaaaaaaaaatacgcgcctaaaaaacgaaaaaaaaaaaaaaaaaaaaaacaaaaacgcgaaaacgaacgcgactaaccaaaaacgaaacgaaacgcgcgcgaaaccgaactctacccactacacgaaaactatatacgaaacgcgcgcgcgaaaaacgaccgaacgaacgtaaaaaaaaaaacgacttaccacgcaccccgcgcgcccacgtacccccgccactaaaaaaaaccgaacacgcgaaaaaaataactacgaaaacgcgataacaaactctttcccgaaaaccgactcgaatccgaaaaccgaaaaaaaaacgaaccgaaaacgcctcga

SEQ ID NO: 18527 - DNA, 792 bp, Artificial Sequence
  chemically treated genomic DNA (Homo sapiens) CpG-island No: 18527
ttttattttattgttttttagtttttatcgagttaaaaatttagggaaggtcgaggtacgtattaggggggatttcgtattcgtagtttttcgtttcgtatttcgtagttcgggacggtttttggttttcggttttagcgaggtcgtcgaagtcgtagtatttagttttggaaggttaggtagtcgggatcgtagggattagtttcgagcggcggcggcggcggggtagaagggtagtcgttttttcgggatttaggacgtcggcgggcgggaggtatatacgcgcgtataagcggaaagaaagcgggtttattgcgtggggatgttcgttcgcgtagttgtttcggcggcggcggtcgttgtttgtatcgaggtcgaggcgcggcggtggcggcggcggttgcggattgagtttttttcgtcgggcggtggatgtagggcgcgggaggggcgcgaggggaggggtgcgcgtttgggaggcggggagggaaagaggggaggaagtaggagcgcgggggcgggcgcggttagttaggggcggggcggggcgcgcgcggggtcgggttttgtttattgtacggaggttgtgtgcggggcgcgcgcgcgggagacggtcggacgggcgtggggagaggggcggtttgttacgtatttcgcgcgtttacgtgttttcgttattggagagggtcgggtacgcggagagggtggttgcggggacgcggtggtaggttttttttcgaggatcggttcggattcgaagatcgggaggagggcgggtcgggggcgtttcgg

SEQ ID NO: 18528 - DNA, 792 bp, Artificial Sequence
  chemically treated genomic DNA (Homo sapiens) CpG-island No: 18528
ccgaaacgcccccgacccgccctcctcccgatcttcgaatccgaaccgatcctcgaaaaaaaacctaccaccgcgtccccgcaaccaccctctccgcgtacccgaccctctccaataacgaaaacacgtaaacgcgcgaaatacgtaacaaaccgcccctctccccacgcccgtccgaccgtctcccgcgcgcgcgccccgcacacaacctccgtacaataaacaaaacccgaccccgcgcgcgccccgccccgcccctaactaaccgcgcccgcccccgcgctcctacttcctcccctctttccctccccgcctcccaaacgcgcacccctcccctcgcgcccctcccgcgccctacatccaccgcccgacgaaaaaaactcaatccgcaaccgccgccgccaccgccgcgcctcgacctcgatacaaacaacgaccgccgccgccgaaacaactacgcgaacgaacatccccacgcaataaacccgctttctttccgcttatacgcgcgtatatacctcccgcccgccgacgtcctaaatcccgaaaaaacgactacccttctaccccgccgccgccgccgctcgaaactaatccctacgatcccgactacctaaccttccaaaactaaatactacgacttcgacgacctcgctaaaaccgaaaaccaaaaaccgtcccgaactacgaaatacgaaacgaaaaactacgaatacgaaatcccccctaatacgtacctcgaccttccctaaatttttaactcgataaaaactaaaaaacaataaaataaaa

SEQ ID NO: 18529 - DNA, 777 bp, Artificial Sequence
  chemically treated genomic DNA (Homo sapiens) CpG-island No: 18529
taggtcggcgtttatttcgtaggttgcgaggcgaggtttttagtattcgtatattttcgtttcggattggttagtttcgtagttatttagtatcgatacgttagggtagtcgtttttttttttttttcgttttttttttttcgcgtttggtaagaaaagcgggtaacgtggagcgggaataaaggatttcgcggtttacggcgatcggggatttcgtgttattttattttaggttcggggttggttgttcgtttatacgagtcgagtttcgagagtttttttagaagagaattttaaattttaggtaaattcgaggcgaggcgttcgtttttgatagtaagaacggggagtttcgcgtttttttttcggcgggttattttcgttcgcggcgttttaatttaggttttttaaaatttttcgaataaaaaatttttgttttttttagtttgttttattcgcgttagtgtagtaaaggggttttagttttcgcgtttttcgaggcgatcggcgttcgttttcggtcgttaacgtaatttggtaattatggtagcgttggagcgcgggtttagcgcggcgcgggttttacgttttagagggcggcggcggtcgtttggggttgttttttttgatgaggatatcgttttcgcgttttttattttttttttattcgtcggcgttatttttttttttcggattttagtcgcgtcgttttttttatttgtcgttcgtagaattagcgcgtattatttggtttatttttgaagagatggaaatatt

SEQ ID NO: 18530 - DNA, 777 bp, Artificial Sequence
  chemically treated genomic DNA (Homo sapiens) CpG-island No: 18530
aatatttccatctcttcaaaaataaaccaaataatacgcgctaattctacgaacgacaaataaaaaaaacgacgcgactaaaatccgaaaaaaaaaaataacgccgacgaataaaaaaaaaataaaaaacgcgaaaacgatatcctcatcaaaaaaaacaaccccaaacgaccgccgccgccctctaaaacgtaaaacccgcgccgcgctaaacccgcgctccaacgctaccataattaccaaattacgttaacgaccgaaaacgaacgccgatcgcctcgaaaaacgcgaaaactaaaacccctttactacactaacgcgaataaaacaaactaaaaaaaacaaaaattttttattcgaaaaattttaaaaaacctaaattaaaacgccgcgaacgaaaataacccgccgaaaaaaaaacgcgaaactccccgttcttactatcaaaaacgaacgcctcgcctcgaatttacctaaaatttaaaattctcttctaaaaaaactctcgaaactcgactcgtataaacgaacaaccaaccccgaacctaaaataaaataacacgaaatccccgatcgccgtaaaccgcgaaatcctttattcccgctccacgttacccgcttttcttaccaaacgcgaaaaaaaaaaaacgaaaaaaaaaaaaaaacgactaccctaacgtatcgatactaaataactacgaaactaaccaatccgaaacgaaaatatacgaatactaaaaacctcgcctcgcaacctacgaaataaacgccgaccta

SEQ ID NO: 18531 - DNA, 777 bp, Artificial Sequence
  chemically treated genomic DNA (Homo sapiens) CpG-island No: 18531
aatgtttttatttttttagagatgaattaggtaatacgcgttggttttacgaacgatagatgagggagacggcgcggttagaattcgagaagaagggatggcgtcggcggatgggaagagggtgggaggcgcggaagcggtgtttttattaggggaggtagttttaagcggtcgtcgtcgttttttgggacgtgaagttcgcgtcgcgttgggttcgcgttttagcgttgttatggttgttaagttgcgttggcggtcgagagcgggcgtcggtcgtttcggagagcgcggaggttggagtttttttgttatattggcgcgggtgaggtaggttgggaggaataagagttttttgttcgaagggttttggggggtttgggttagggcgtcgcgggcggggatgattcgtcggaaggagggcgcgggatttttcgtttttgttgttaggaacggacgtttcgtttcgggtttgtttggggtttgggatttttttttggaagagttttcgagattcggttcgtgtgggcgggtagttagtttcgggtttggagtagggtggtacggagttttcgatcgtcgtgggtcgcggggttttttgttttcgttttacgttgttcgttttttttgttaagcgcggggagaagggggcgggaggagggagggagcggttgttttgacgtgtcggtattgagtgattgcggggttggttaattcggggcgggggtgtgcgggtgttgggggtttcgtttcgtagtttgcggagtgggcgtcggtttg

SEQ ID NO: 18532 - DNA, 777 bp, Artificial Sequence
  chemically treated genomic DNA (Homo sapiens) CpG-island No: 18532
caaaccgacgcccactccgcaaactacgaaacgaaacccccaacacccgcacacccccgccccgaattaaccaaccccgcaatcactcaataccgacacgtcaaaacaaccgctccctccctcctcccgcccccttctccccgcgcttaacaaaaaaaacgaacaacgtaaaacgaaaacaaaaaaccccgcgacccacgacgatcgaaaactccgtaccaccctactccaaacccgaaactaactacccgcccacacgaaccgaatctcgaaaactcttccaaaaaaaaatcccaaaccccaaacaaacccgaaacgaaacgtccgttcctaacaacaaaaacgaaaaatcccgcgccctccttccgacgaatcatccccgcccgcgacgccctaacccaaaccccccaaaacccttcgaacaaaaaactcttattcctcccaacctacctcacccgcgccaatataacaaaaaaactccaacctccgcgctctccgaaacgaccgacgcccgctctcgaccgccaacgcaacttaacaaccataacaacgctaaaacgcgaacccaacgcgacgcgaacttcacgtcccaaaaaacgacgacgaccgcttaaaactacctcccctaataaaaacaccgcttccgcgcctcccaccctcttcccatccgccgacgccatcccttcttctcgaattctaaccgcgccgtctccctcatctatcgttcgtaaaaccaacgcgtattacctaattcatctctaaaaaaataaaaacatt

SEQ ID NO: 18533 - DNA, 658 bp, Artificial Sequence
  chemically treated genomic DNA (Homo sapiens) CpG-island No: 18533
cgggaatcggtttaacggaaagcgttagaaggcggcggaagacgggagcggttaagtagaaggacgaggggttagttcgtggagattgaaaggaagggggagcgttatcgagaattcgcgggaattcgttcgttcgtcgatatagtcgcgtcgaagtagtaggcggagaaattgcgtttagtagttttgagcgatcgatttttacgcgcgatcgggagatattgttttcgtcgtcgtcgatcgttcgcgtcgtattttttcgtacgttattacgtgcgttgtcgtcgtcgacgttttttagttcgttttcgtttcgaatttatttgtaaattataggcgagttttataaagattttattttaagtttcgttttattcgcggtttcgtttatatttcgtttcgtttttttttttggtttattggggttttttttttttcggtgtaattaggttagcgtaaggtgattttgaggagataggcggcgttcggggggcgttttcgttttttttatcgcgtttttgttttttttttcgttttttgtttcgtatttttattttcgtcgttttgtgcgttgtttgtttcggaattggtttttttaagtcgtttttatttgttttgattttttttcgaggtataatagtttgagagattagacgtg

SEQ ID NO: 18534 - DNA, 658 bp, Artificial Sequence
  chemically treated genomic DNA (Homo sapiens) CpG-island No: 18534
cacgtctaatctctcaaactattatacctcgaaaaaaaatcaaaacaaataaaaacgacttaaaaaaaccaattccgaaacaaacaacgcacaaaacgacgaaaataaaaatacgaaacaaaaaacgaaaaaaaaaacaaaaacgcgataaaaaaaacgaaaacgccccccgaacgccgcctatctcctcaaaatcaccttacgctaacctaattacaccgaaaaaaaaaaaaccccaataaaccaaaaaaaaaaacgaaacgaaatataaacgaaaccgcgaataaaacgaaacttaaaataaaatctttataaaactcgcctataatttacaaataaattcgaaacgaaaacgaactaaaaaacgtcgacgacgacaacgcacgtaataacgtacgaaaaaatacgacgcgaacgatcgacgacgacgaaaacaatatctcccgatcgcgcgtaaaaatcgatcgctcaaaactactaaacgcaatttctccgcctactacttcgacgcgactatatcgacgaacgaacgaattcccgcgaattctcgataacgctcccccttcctttcaatctccacgaactaacccctcgtccttctacttaaccgctcccgtcttccgccgccttctaacgctttccgttaaaccgattcccg

SEQ ID NO: 18535 - DNA, 658 bp, Artificial Sequence
  chemically treated genomic DNA (Homo sapiens) CpG-island No: 18535
tacgtttgattttttaggttattgtgtttcgaggggaagttagaataggtgagggcggtttgagggaattagtttcgggataggtaacgtatagggcggcgaaagtgagggtgcggggtaaggaacggagggagggataaaggcgcgataagaggaacgagggcgtttttcgagcgtcgtttatttttttaggattattttgcgttgatttagttatatcgagaaggaaggaattttagtagattagggaggaaggcggggcgggatgtgggcggggtcgcgggtggggcggggtttagagtgggatttttatggagttcgtttgtgatttgtagatggattcgagacggaagcgggttgggaggcgtcggcggcggtagcgtacgtggtgacgtgcgagggggtgcggcgcgagcggtcggcggcggcggaggtagtgtttttcggtcgcgcgtggaggtcggtcgtttagagttgttgggcgtagttttttcgtttgttgtttcggcgcggttgtatcggcgagcgagcgagttttcgcgagttttcggtggcgtttttttttttttttagtttttacggattggtttttcgtttttttatttgatcgttttcgtttttcgtcgttttttggcgtttttcgttgggtcgattttcg

SEQ ID NO: 18536 - DNA, 658 bp, Artificial Sequence
  chemically treated genomic DNA (Homo sapiens) CpG-island No: 18536
cgaaaatcgacccaacgaaaaacgccaaaaaacgacgaaaaacgaaaacgatcaaataaaaaaacgaaaaaccaatccgtaaaaactaaaaaaaaaaaaaaacgccaccgaaaactcgcgaaaactcgctcgctcgccgatacaaccgcgccgaaacaacaaacgaaaaaactacgcccaacaactctaaacgaccgacctccacgcgcgaccgaaaaacactacctccgccgccgccgaccgctcgcgccgcaccccctcgcacgtcaccacgtacgctaccgccgccgacgcctcccaacccgcttccgtctcgaatccatctacaaatcacaaacgaactccataaaaatcccactctaaaccccgccccacccgcgaccccgcccacatcccgccccgccttcctccctaatctactaaaattccttccttctcgatataactaaatcaacgcaaaataatcctaaaaaaataaacgacgctcgaaaaacgccctcgttcctcttatcgcgcctttatccctccctccgttccttaccccgcaccctcactttcgccgccctatacgttacctatcccgaaactaattccctcaaaccgccctcacctattctaacttcccctcgaaacacaataacctaaaaaatcaaacgta

SEQ ID NO: 18537 - DNA, 870 bp, Artificial Sequence
  chemically treated genomic DNA (Homo sapiens) CpG-island No: 18537
gcgcgaattattcggtttcgttcgttttttatgcgcgcgcgcgtttttgggttatatttaaaaggcgtgttttttatcgttagcgtgcgttgtttatttgtattacgttgggttttttgtcggtcgcgggcgcgtcgttgaatttgttggagggttgcggggtcggcgggtgcgggtcgttgtcgtagaggtatgagaagtagggttcgtcgtcgtagtttaggtttatgaggaatttgagtagcgataggtattttatggcgaatatgatggtggcggggaaggcggtggggtgcgtggcgatataggcgtcgatgttcgcgtcgtggtttagtagtagttgtattgtgcgtaggtagtcgtggcggatggttacgagtaaggggttgatgacgtcgcggttggggtcggcgtcgtgttgtagtagtagttcggtggcgtatacgttgttgttgattatcgcgaagtatagcgcggagtgcgtcggttttcgtagaggcgcgcgcgttcgggggttagcggcgtgtttacgtcgaagcgcgcgtttagtagcgtttttagtatttcgtcgtggttgcgttcggtcgttaggtgtagcggattgacgtcgttacggcgtatgcgcgtgcggttggttatcggtagtagtatttgtacgattttgtcgggtcgaggggcgggcgcgggtgaggggagggtcggggtgtggacgggtagggtcggtttcgttagtaggagagttcgggcgttaggttcggttggtcgttttgatcgcgggttgcgacgcggattttatcggtagggggcgtcgcgggttaattatttttattttattgggtagggtgggtcggttgtcgttttcgttttata

SEQ ID NO: 18538 - DNA, 870 bp, Artificial Sequence
  chemically treated genomic DNA (Homo sapiens) CpG-island No: 18538
tataaaacgaaaacgacaaccgacccaccctacccaataaaataaaaataattaacccgcgacgccccctaccgataaaatccgcgtcgcaacccgcgatcaaaacgaccaaccgaacctaacgcccgaactctcctactaacgaaaccgaccctacccgtccacaccccgaccctcccctcacccgcgcccgcccctcgacccgacaaaatcgtacaaatactactaccgataaccaaccgcacgcgcatacgccgtaacgacgtcaatccgctacacctaacgaccgaacgcaaccacgacgaaatactaaaaacgctactaaacgcgcgcttcgacgtaaacacgccgctaacccccgaacgcgcgcgcctctacgaaaaccgacgcactccgcgctatacttcgcgataatcaacaacaacgtatacgccaccgaactactactacaacacgacgccgaccccaaccgcgacgtcatcaaccccttactcgtaaccatccgccacgactacctacgcacaatacaactactactaaaccacgacgcgaacatcgacgcctatatcgccacgcaccccaccgccttccccgccaccatcatattcgccataaaatacctatcgctactcaaattcctcataaacctaaactacgacgacgaaccctacttctcatacctctacgacaacgacccgcacccgccgaccccgcaaccctccaacaaattcaacgacgcgcccgcgaccgacaaaaaacccaacgtaatacaaataaacaacgcacgctaacgataaaaaacacgccttttaaatataacccaaaaacgcgcgcgcgcataaaaaacgaacgaaaccgaataattcgcgc

SEQ ID NO: 18539 - DNA, 870 bp, Artificial Sequence
  chemically treated genomic DNA (Homo sapiens) CpG-island No: 18539
tgtaaagcggagacggtagtcgatttattttgtttagtggggtgagaatggttgattcgcggcgttttttgtcggtgggattcgcgtcgtagttcgcggttagggcgattagtcgagtttggcgttcgagtttttttgttggcggggtcggttttattcgtttatatttcgattttttttttattcgcgttcgtttttcgattcggtaggatcgtgtagatgttgttgtcggtgattagtcgtacgcgtatacgtcgtagcggcgttagttcgttgtatttggcggtcgagcgtaattacgacgaggtgttggaggcgttgttgagcgcgcgtttcgacgtgaatacgtcgttggttttcgagcgcgcgcgtttttacgaagatcggcgtatttcgcgttgtatttcgcggtggttaataataacgtgtacgttatcgagttgttgttgtaatacggcgtcgattttaatcgcgacgttattagttttttgttcgtggttattcgttacggttgtttgcgtataatgtagttgttgttggattacggcgcgaatatcgacgtttatatcgttacgtattttatcgtttttttcgttattattatgttcgttatgaagtgtttgtcgttgtttaagttttttatggatttgggttgcgacggcgagttttgttttttatgtttttacggtaacggttcgtattcgtcggtttcgtagttttttagtaggtttaacgacgcgttcgcggtcgataaggagtttagcgtggtgtaggtgggtagcgtacgttggcggtggggagtacgttttttgggtgtggtttagggacgcgcgcgcgtatgggaggcgggcggggtcgggtggttcgcgt

SEQ ID NO: 18540 - DNA, 870 bp, Artificial Sequence
  chemically treated genomic DNA (Homo sapiens) CpG-island No: 18540
acgcgaaccacccgaccccgcccgcctcccatacgcgcgcgcgtccctaaaccacacccaaaaaacgtactccccaccgccaacgtacgctacccacctacaccacgctaaactccttatcgaccgcgaacgcgtcgttaaacctactaaaaaactacgaaaccgacgaatacgaaccgttaccgtaaaaacataaaaaacaaaactcgccgtcgcaacccaaatccataaaaaacttaaacaacgacaaacacttcataacgaacataataataacgaaaaaaacgataaaatacgtaacgatataaacgtcgatattcgcgccgtaatccaacaacaactacattatacgcaaacaaccgtaacgaataaccacgaacaaaaaactaataacgtcgcgattaaaatcgacgccgtattacaacaacaactcgataacgtacacgttattattaaccaccgcgaaatacaacgcgaaatacgccgatcttcgtaaaaacgcgcgcgctcgaaaaccaacgacgtattcacgtcgaaacgcgcgctcaacaacgcctccaacacctcgtcgtaattacgctcgaccgccaaatacaacgaactaacgccgctacgacgtatacgcgtacgactaatcaccgacaacaacatctacacgatcctaccgaatcgaaaaacgaacgcgaataaaaaaaaaatcgaaatataaacgaataaaaccgaccccgccaacaaaaaaactcgaacgccaaactcgactaatcgccctaaccgcgaactacgacgcgaatcccaccgacaaaaaacgccgcgaatcaaccattctcaccccactaaacaaaataaatcgactaccgtctccgctttaca

SEQ ID NO: 18541 - DNA, 628 bp, Artificial Sequence
  chemically treated genomic DNA (Homo sapiens) CpG-island No: 18541
gtttcgcgtttcggtttttgattgttcgtttgagacgttaatcgtagggcgtgtgttttgttgggatatagtggaggtttaatttttggtttgcggagcggtcgggtgtatttttcgtcgtttttacgttttcgaggttttcgttatcgaattagcggcggagttcgttcgcgtttttcgcggtattttcgtatcggatcgtttttcgttggggcgggatttggtttggcggttttggttattatggttagtgatcgtgggggatcgcgaagggggagcgggtagggggcgcggtgggcggggtcgttgtcggagcgggtgtattcgcgggacgggggtcggacgcgaggtttagtttttagttcgttttcgtcgtttttcgattttttgaaatacggagttcggacggatattgagggttaagtcgcgtttttttgtatttcgtggatgtgtagttgaggaggtttagttcggtttcgagttttcgtttttagcgtgttcgttttaggtggttcggggcgtcgtttcgacggcgttgggtgggcgttttcgacggaagtagggatagggaggttgtagtattacgggtcgttttttttttgttaagtagttttttagttagtagttt

SEQ ID NO: 18542 - DNA, 628 bp, Artificial Sequence
  chemically treated genomic DNA (Homo sapiens) CpG-island No: 18542
aaactactaactaaaaaactacttaacaaaaaaaaaacgacccgtaatactacaacctccctatccctacttccgtcgaaaacgcccacccaacgccgtcgaaacgacgccccgaaccacctaaaacgaacacgctaaaaacgaaaactcgaaaccgaactaaacctcctcaactacacatccacgaaatacaaaaaaacgcgacttaaccctcaatatccgtccgaactccgtatttcaaaaaatcgaaaaacgacgaaaacgaactaaaaactaaacctcgcgtccgacccccgtcccgcgaatacacccgctccgacaacgaccccgcccaccgcgccccctacccgctcccccttcgcgatcccccacgatcactaaccataataaccaaaaccgccaaaccaaatcccgccccaacgaaaaacgatccgatacgaaaataccgcgaaaaacgcgaacgaactccgccgctaattcgataacgaaaacctcgaaaacgtaaaaacgacgaaaaatacacccgaccgctccgcaaaccaaaaattaaacctccactatatcccaacaaaacacacgccctacgattaacgtctcaaacgaacaatcaaaaaccgaaacgcgaaac

SEQ ID NO: 18543 - DNA, 628 bp, Artificial Sequence
  chemically treated genomic DNA (Homo sapiens) CpG-island No: 18543
ggattgttgattggggggttatttaataaagaggaggcgattcgtagtgttgtagtttttttgtttttgttttcgtcgagggcgtttatttagcgtcgtcgaggcggcgtttcgggttatttggggcggatacgttgggggcgggggttcggggtcgagttggatttttttagttgtatatttacggggtataggggggcgcgatttggtttttagtattcgttcggatttcgtattttagggggtcggaaagcggcgggggcgagttgggggttgagtttcgcgttcgattttcgtttcgcgggtgtattcgtttcggtagcgatttcgtttatcgcgttttttgttcgtttttttttcgcgattttttacgattattgattatagtgattagagtcgttaggttaggtttcgttttagcgaggagcgattcggtgcgggaatgtcgcgggaggcgcgggcgggtttcgtcgttggttcggtggcggggatttcgagggcgtgggggcggcggagaatatattcgatcgtttcgtaaattaaaggttagatttttattgtgttttagtaagatatacgttttgcgattgacgttttaggcgggtaattagaagtcgggacgcgggat

SEQ ID NO: 18544 - DNA, 628 bp, Artificial Sequence
  chemically treated genomic DNA (Homo sapiens) CpG-island No: 18544
atcccgcgtcccgacttctaattacccgcctaaaacgtcaatcgcaaaacgtatatcttactaaaacacaataaaaatctaacctttaatttacgaaacgatcgaatatattctccgccgcccccacgccctcgaaatccccgccaccgaaccaacgacgaaacccgcccgcgcctcccgcgacattcccgcaccgaatcgctcctcgctaaaacgaaacctaacctaacgactctaatcactataatcaataatcgtaaaaaatcgcgaaaaaaaaacgaacaaaaaacgcgataaacgaaatcgctaccgaaacgaatacacccgcgaaacgaaaatcgaacgcgaaactcaacccccaactcgcccccgccgctttccgaccccctaaaatacgaaatccgaacgaatactaaaaaccaaatcgcgcccccctataccccgtaaatatacaactaaaaaaatccaactcgaccccgaacccccgcccccaacgtatccgccccaaataacccgaaacgccgcctcgacgacgctaaataaacgccctcgacgaaaacaaaaacaaaaaaactacaacactacgaatcgcctcctctttattaaataaccccccaatcaacaatcc

SEQ ID NO: 18545 - DNA, 619 bp, Artificial Sequence
  chemically treated genomic DNA (Homo sapiens) CpG-island No: 18545
ggggtttaataaggagagggcgaggggtgttacgcgaatcgggcgaggatacggagagcgttaggtagagtagaagggtttttgttttttcgtgacgtcggtttcgcgcggttttttcgttttgttttaggtacgaacgcgcgtacgaaatcgagaaatcgagaagtcgagaagttaaggtcgttaggttttgatgatcggataaggagtttaaggcgcggggatcgtggtacgtagttcggttggacggtttgggtcggcggtcgttttttttggattcgggaatttatcggtttagagcgattcgcgataggaattcgggtttttggttttagtttttttttagagtcggttttaatttcgttcgttttggtatttatcgtgtggagacgttatcgtagtttcgttagtcgcgagtgaagaattttagaaatcgtcgttgtattttagttgtagtagtaattgtagtttcggggcgggatttttacgtacgtattcgtgcgcgttggggaggaagtttcgtttttatggtaaatttagttatttgattggttgtttcgcggatcgtagtagtgtcggcgggagagttggtttggggcgttggtatttttttttatag

SEQ ID NO: 18546 - DNA, 619 bp, Artificial Sequence
  chemically treated genomic DNA (Homo sapiens) CpG-island No: 18546
ctataaaaaaaaataccaacgccccaaaccaactctcccgccgacactactacgatccgcgaaacaaccaatcaaataactaaatttaccataaaaacgaaacttcctccccaacgcgcacgaatacgtacgtaaaaatcccgccccgaaactacaattactactacaactaaaatacaacgacgatttctaaaattcttcactcgcgactaacgaaactacgataacgtctccacacgataaataccaaaacgaacgaaattaaaaccgactctaaaaaaaaactaaaaccaaaaacccgaattcctatcgcgaatcgctctaaaccgataaattcccgaatccaaaaaaaacgaccgccgacccaaaccgtccaaccgaactacgtaccacgatccccgcgccttaaactccttatccgatcatcaaaacctaacgaccttaacttctcgacttctcgatttctcgatttcgtacgcgcgttcgtacctaaaacaaaacgaaaaaaccgcgcgaaaccgacgtcacgaaaaaacaaaaacccttctactctacctaacgctctccgtatcctcgcccgattcgcgtaacacccctcgccctctccttattaaacccc

SEQ ID NO: 18547 - DNA, 619 bp, Artificial Sequence
  chemically treated genomic DNA (Homo sapiens) CpG-island No: 18547
ttgtaagaggaggtgttagcgttttaagttagttttttcgtcggtattgttgcggttcgcgaggtagttaattaggtagttgagtttgttataggggcgggattttttttttagcgcgtacgagtacgtgcgtggaggtttcgtttcggaattgtagttgttgttgtagttgaggtatagcggcggtttttgaggttttttattcgcgattgacggagttgcggtggcgtttttatacggtgagtattaaaacgagcggggttggagtcgattttggagaggggttgaggttaggaattcgggtttttatcgcgggtcgttttgggtcggtgggttttcgggtttagagagggcggtcgtcggtttaagtcgtttaatcgagttgcgtgttacggttttcgcgttttgggttttttgttcggttattagagtttgacggttttggtttttcggtttttcggtttttcggtttcgtgcgcgcgttcgtgtttgagataaagcgagagggtcgcgcgggatcggcgttacgaggagatagaggtttttttattttgtttggcgtttttcgtgttttcgttcggttcgcgtggtatttttcgttttttttttgttgaatttt

SEQ ID NO: 18548 - DNA, 619 bp, Artificial Sequence
  chemically treated genomic DNA (Homo sapiens) CpG-island No: 18548
aaaattcaacaaaaaaaaaacgaaaaataccacgcgaaccgaacgaaaacacgaaaaacgccaaacaaaataaaaaaacctctatctcctcgtaacgccgatcccgcgcgaccctctcgctttatctcaaacacgaacgcgcgcacgaaaccgaaaaaccgaaaaaccgaaaaaccaaaaccgtcaaactctaataaccgaacaaaaaacccaaaacgcgaaaaccgtaacacgcaactcgattaaacgacttaaaccgacgaccgccctctctaaacccgaaaacccaccgacccaaaacgacccgcgataaaaacccgaattcctaacctcaacccctctccaaaatcgactccaaccccgctcgttttaatactcaccgtataaaaacgccaccgcaactccgtcaatcgcgaataaaaaacctcaaaaaccgccgctatacctcaactacaacaacaactacaattccgaaacgaaacctccacgcacgtactcgtacgcgctaaaaaaaaaatcccgcccctataacaaactcaactacctaattaactacctcgcgaaccgcaacaataccgacgaaaaaactaacttaaaacgctaacacctcctcttacaa

SEQ ID NO: 18549 - DNA, 679 bp, Artificial Sequence
  chemically treated genomic DNA (Homo sapiens) CpG-island No: 18549
tgggcggggtcgagttgcgcgcgattttcggcgcgttcggggaggtttagataggggtggtttttttggttttcgttttcgcgggttttatgatatcgtattggttcgcgggacggggcggggtcgggtgagggggaggagatagttttacgttttgcgattcgcggtgatttttacgcggaattttttcgcggtaattcgaagtatcgcgtttgcgtgttgtagtagcgtttggtggcggtggtagtttgttcgcgggtgtgtgaagggagatagtgtggaggttatagggtattcgttacgatgagtagtattttagttaagatcgcggagatagaagtagaggtaatggacgtagttggcggtttatttttagtttgagtattttttttttggtggcgtcgtttttttttgtttttttttgagtcgcgttaggatcgggtttagatttcgcgattttttttagcgaggttcgtgtttcgattgttttttgttacgattaggagttttcgattttttttagttagggtttttttttttttcgtttcgcgtttacgttttcggatttttttttgttcgggttcgcgtttcgtatttttgtattttaggtttttagttcgtttttttttttagtgtttggtttttgttttgatgttgttttttttcgttttgttttgag

SEQ ID NO: 18550 - DNA, 679 bp, Artificial Sequence
  chemically treated genomic DNA (Homo sapiens) CpG-island No: 18550
ctcaaaacaaaacgaaaaaaaacaacatcaaaacaaaaaccaaacactaaaaaaaaaaacgaactaaaaacctaaaatacaaaaatacgaaacgcgaacccgaacaaaaaaaaatccgaaaacgtaaacgcgaaacgaaaaaaaaaaaaaccctaactaaaaaaaatcgaaaactcctaatcgtaacaaaaaacaatcgaaacacgaacctcgctaaaaaaaatcgcgaaatctaaacccgatcctaacgcgactcaaaaaaaaacaaaaaaaaacgacgccaccaaaaaaaaaatactcaaactaaaaataaaccgccaactacgtccattacctctacttctatctccgcgatcttaactaaaatactactcatcgtaacgaataccctataacctccacactatctcccttcacacacccgcgaacaaactaccaccgccaccaaacgctactacaacacgcaaacgcgatacttcgaattaccgcgaaaaaattccgcgtaaaaatcaccgcgaatcgcaaaacgtaaaactatctcctccccctcacccgaccccgccccgtcccgcgaaccaatacgatatcataaaacccgcgaaaacgaaaaccaaaaaaaccacccctatctaaacctccccgaacgcgccgaaaatcgcgcgcaactcgaccccgccca

SEQ ID NO: 18551 - DNA, 679 bp, Artificial Sequence
  chemically treated genomic DNA (Homo sapiens) CpG-island No: 18551
tttagagtaaaacggaaagaaataatattagaataggagttaaatattgggagggggaacggattaagggtttaaggtgtaggggtgcggaacgcgggttcgggtaaaggggagttcgagagcgtagacgcgggacgaggggaaagggggttttgattgaggagagtcggggatttttaatcgtggtagagggtagtcggaatacgggtttcgttgagagaagtcgcggaatttaggttcggttttgacgcggtttaaaggagaataggaaggagcgacgttattaaagaaggaatgtttagattaagagtgaatcgttagttgcgtttattatttttgtttttattttcgcgattttagttaaggtgttgtttatcgtggcgagtattttgtggtttttatattgtttttttttatatattcgcgggtaaattgttatcgttattaggcgttattgtagtacgtaggcgcggtatttcgaattatcgcgagagagtttcgcgtaggggttatcgcgagtcgtaaagcgtggggttgtttttttttttttattcgatttcgtttcgtttcgcgagttagtgcggtgttatagagttcgcgggagcggaggttagagaggttatttttgtttgggttttttcgagcgcgtcgagggtcgcgcgtagttcggtttcgttta

SEQ ID NO: 18552 - DNA, 679 bp, Artificial Sequence
  chemically treated genomic DNA (Homo sapiens) CpG-island No: 18552
taaacgaaaccgaactacgcgcgaccctcgacgcgctcgaaaaaacccaaacaaaaataacctctctaacctccgctcccgcgaactctataacaccgcactaactcgcgaaacgaaacgaaatcgaataaaaaaaaaaaaacaaccccacgctttacgactcgcgataacccctacgcgaaactctctcgcgataattcgaaataccgcgcctacgtactacaataacgcctaataacgataacaatttacccgcgaatatataaaaaaaaacaatataaaaaccacaaaatactcgccacgataaacaacaccttaactaaaatcgcgaaaataaaaacaaaaataataaacgcaactaacgattcactcttaatctaaacattccttctttaataacgtcgctccttcctattctcctttaaaccgcgtcaaaaccgaacctaaattccgcgacttctctcaacgaaacccgtattccgactaccctctaccacgattaaaaatccccgactctcctcaatcaaaaccccctttcccctcgtcccgcgtctacgctctcgaactcccctttacccgaacccgcgttccgcacccctacaccttaaacccttaatccgttccccctcccaatatttaactcctattctaatattatttctttccgttttactctaaa

SEQ ID NO: 18553 - DNA, 1065 bp, Artificial Sequence
  chemically treated genomic DNA (Homo sapiens) CpG-island No: 18553
cgcggtagttcgggcgtcgagacgttttttagggacgcggttttacgggttagtttggttatcgtcgtggttcgtaataggtagaattgtatttgatttacggaaatgggtttttcggcgtcgcggtcgttcgtagatttgggtatttcgaggcggtcgatgaaggtttgtagttttttgcggaaggtttttatttgagcgttgatgcggtagagtagttcgtgttttcggatgcggttgtcgtcgtttttttcgtttatgagttcgaataggttttcgttggttacgtagatgcgcgtttcggtgatgatggtgttcgtgtcggcgatgagtcggtcgatggttttgtttaggcgttcggttttcgagcggatgttttttatttgttgtcgatcggagaagtttttgggttagggttcgggcgtcgggtagaaggagcgagtgggcgtgaggtagcggatgttgcgtatttttttcgagtcgttttcgtcgtcgatgggtttttcgcgtttgcggtgcggaggtcgcgagtcgtcgtcgtttttttttttgttcgcgtcgttttcggcgtcgttgtcgcgggggttgtcgcggatgtttaggtgcgaggttaggtcgtagcgttgtatgttggatataagtacgcggttttcgtattgtagttgtatgattttgtcgttgagttcgttgatttgtaggcgcgtcgtttttagttttttttgtagggtttcggttttggcgttgtcgtggtgtcgcgcgttgtcgtggtcgtcggatttgtatttgtatttgttgagtttcgtcgtgatgcgtttgttttgtttttttaggtcggttacgttttttcgtagtagtttcgtttcgttttttattagttgtaggtgttgtcgtagtttcgatagggattcgttttgtttttttatgagcgggttggtcgagtcgttgaagttatcgtttttaaggtcgtttagtttcgtttttaggtttttgttttttatttttagttcgacgatttttttgtttaggatgttggtttttttttttattagttttagtcgtagtttg

SEQ ID NO: 18554 - DNA, 1065 bp, Artificial Sequence
  chemically treated genomic DNA (Homo sapiens) CpG-island No: 18554
caaactacgactaaaactaataaaaaaaaaaaccaacatcctaaacaaaaaaatcgtcgaactaaaaataaaaaacaaaaacctaaaaacgaaactaaacgaccttaaaaacgataacttcaacgactcgaccaacccgctcataaaaaaacaaaacgaatccctatcgaaactacgacaacacctacaactaataaaaaacgaaacgaaactactacgaaaaaacgtaaccgacctaaaaaaacaaaacaaacgcatcacgacgaaactcaacaaatacaaatacaaatccgacgaccacgacaacgcgcgacaccacgacaacgccaaaaccgaaaccctacaaaaaaaactaaaaacgacgcgcctacaaatcaacgaactcaacgacaaaatcatacaactacaatacgaaaaccgcgtacttatatccaacatacaacgctacgacctaacctcgcacctaaacatccgcgacaacccccgcgacaacgacgccgaaaacgacgcgaacaaaaaaaaaaacgacgacgactcgcgacctccgcaccgcaaacgcgaaaaacccatcgacgacgaaaacgactcgaaaaaaatacgcaacatccgctacctcacgcccactcgctccttctacccgacgcccgaaccctaacccaaaaacttctccgatcgacaacaaataaaaaacatccgctcgaaaaccgaacgcctaaacaaaaccatcgaccgactcatcgccgacacgaacaccatcatcaccgaaacgcgcatctacgtaaccaacgaaaacctattcgaactcataaacgaaaaaaacgacgacaaccgcatccgaaaacacgaactactctaccgcatcaacgctcaaataaaaaccttccgcaaaaaactacaaaccttcatcgaccgcctcgaaatacccaaatctacgaacgaccgcgacgccgaaaaacccatttccgtaaatcaaatacaattctacctattacgaaccacgacgataaccaaactaacccgtaaaaccgcgtccctaaaaaacgtctcgacgcccgaactaccgcg

SEQ ID NO: 18555 - DNA, 1065 bp, Artificial Sequence
  chemically treated genomic DNA (Homo sapiens) CpG-island No: 18555
taagttacggttaaggttggtggaggaagaagttaatattttgggtaggaaaatcgtcgaattggaggtggagaatagaggtttgaaggcggaattggacgattttaggggcgatgattttaacggttcggttaattcgtttatgagggagtagagcgaatttttgtcggagttgcggtagtatttgtagttggtggaagacgagacggagttgttgcggaggaacgtggtcgatttggaggagtagaataagcgtattacggcggagtttaataagtataagtataagttcggcggttacgatagcgcgcggtattacgataacgttaagatcgaggttttgtaggaggagttgaaggcggcgcgtttgtagattaacgagtttagcggtaaggttatgtagttgtagtacgagaatcgcgtgtttatgtttaatatgtagcgttacgatttggtttcgtatttgggtattcgcggtagttttcgcgatagcgacgtcgagagcgacgcgggtaagaaggagagcgacgacgattcgcggttttcgtatcgtaagcgcgaagggtttatcggcggcgagagcgattcggaggaggtgcgtaatattcgttgttttacgtttattcgttttttttattcggcgttcgggttttggtttaagagttttttcgatcggtagtagatgaaggatattcgttcggaggtcgagcgtttgggtaagattatcgatcggtttatcgtcgatacgagtattattattatcgaggcgcgtatttacgtggttaacggggatttgttcggatttatggacgaggaggacgacggtagtcgtattcgggagtacgagttgttttatcgtattaacgtttagatgaaggtttttcgtaaggagttgtagatttttatcgatcgtttcgaggtgtttaagtttgcggacgatcgcggcgtcgaggagtttattttcgtgagttaggtatagttttgtttattgcgagttacggcggtggttaggttggttcgtggagtcgcgtttttggggggcgtttcggcgttcggattgtcgcg

SEQ ID NO: 18556 - DNA, 1065 bp, Artificial Sequence
  chemically treated genomic DNA (Homo sapiens) CpG-island No: 18556
cgcgacaatccgaacgccgaaacgccccccaaaaacgcgactccacgaaccaacctaaccaccgccgtaactcgcaataaacaaaactatacctaactcacgaaaataaactcctcgacgccgcgatcgtccgcaaacttaaacacctcgaaacgatcgataaaaatctacaactccttacgaaaaaccttcatctaaacgttaatacgataaaacaactcgtactcccgaatacgactaccgtcgtcctcctcgtccataaatccgaacaaatccccgttaaccacgtaaatacgcgcctcgataataataatactcgtatcgacgataaaccgatcgataatcttacccaaacgctcgacctccgaacgaatatccttcatctactaccgatcgaaaaaactcttaaaccaaaacccgaacgccgaataaaaaaaacgaataaacgtaaaacaacgaatattacgcacctcctccgaatcgctctcgccgccgataaacccttcgcgcttacgatacgaaaaccgcgaatcgtcgtcgctctccttcttacccgcgtcgctctcgacgtcgctatcgcgaaaactaccgcgaatacccaaatacgaaaccaaatcgtaacgctacatattaaacataaacacgcgattctcgtactacaactacataaccttaccgctaaactcgttaatctacaaacgcgccgccttcaactcctcctacaaaacctcgatcttaacgttatcgtaataccgcgcgctatcgtaaccgccgaacttatacttatacttattaaactccgccgtaatacgcttattctactcctccaaatcgaccacgttcctccgcaacaactccgtctcgtcttccaccaactacaaatactaccgcaactccgacaaaaattcgctctactccctcataaacgaattaaccgaaccgttaaaatcatcgcccctaaaatcgtccaattccgccttcaaacctctattctccacctccaattcgacgattttcctacccaaaatattaacttcttcctccaccaaccttaaccgtaactta

SEQ ID NO: 18557 - DNA, 598 bp, Artificial Sequence
  chemically treated genomic DNA (Homo sapiens) CpG-island No: 18557
gacgttgcgatttatttaaaggtattttttcgtttttttagttcgttgtttcgtcggttattttttcgttttcgtatttcgtagtagttttttcgcggttttcggtcgtcgaatttttagcggttgttaatgtttttatcgttttttttgtcgaggttttatcgtagtttagttttattagttttcgtcggttcgtagtggacgttttcgtttattttcgtcgttttttatttggcgttattggttgtttaggtttggtagtttttcgtgttgtggttttttatttttagttatcgtcgttgtcgtcgttatagtcgtcgtagtagtagttggatttgttgcgatcgtcgttatcgtcgttcgtttttttttatagttaacgtagttgtgcgagattggaagacgttttttaatagttattttcggattttggtttcggaaacggaagtagagttttttaaatagtcgcggggttattgttatattggaaatggtttcgtgtatagacgcgtcgaagggttaggtggggtaaaatttttagtgggaattaagaaagataaaagtgttttgtggggttttaacgttttgtagatttagg

SEQ ID NO: 18558 - DNA, 598 bp, Artificial Sequence
  chemically treated genomic DNA (Homo sapiens) CpG-island No: 18558
cctaaatctacaaaacgttaaaaccccacaaaacacttttatctttcttaattcccactaaaaattttaccccacctaacccttcgacgcgtctatacacgaaaccatttccaatataacaataaccccgcgactatttaaaaaactctacttccgtttccgaaaccaaaatccgaaaataactattaaaaaacgtcttccaatctcgcacaactacgttaactataaaaaaaaacgaacgacgataacgacgatcgcaacaaatccaactactactacgacgactataacgacgacaacgacgataactaaaaataaaaaaccacaacacgaaaaactaccaaacctaaacaaccaataacgccaaataaaaaacgacgaaaataaacgaaaacgtccactacgaaccgacgaaaactaataaaactaaactacgataaaacctcgacaaaaaaaacgataaaaacattaacaaccgctaaaaattcgacgaccgaaaaccgcgaaaaaactactacgaaatacgaaaacgaaaaaataaccgacgaaacaacgaactaaaaaaacgaaaaaatacctttaaataaatcgcaacgtc

SEQ ID NO: 18559 - DNA, 598 bp, Artificial Sequence
  chemically treated genomic DNA (Homo sapiens) CpG-island No: 18559
tttaagtttatagggcgttaggattttataaggtatttttgttttttttggtttttattgaagattttattttatttagtttttcgacgcgtttgtgtacggggttatttttaatatggtagtagtttcgcgattgtttggggggttttgttttcgttttcgggattagaattcggaagtggttgttgaggggcgttttttaatttcgtatagttgcgttggttgtagaagagaacggacggcgatggcgacggtcgtagtaaatttagttgttgttgcggcggttgtggcggcggtagcggcggtgattgaggatagagagttatagtacgaggagttgttaggtttggatagttagtggcgttagatagaaaacggcgagagtgggcgagaacgtttattgcgggtcggcgaaagttggtgaggttgggttgcggtggagtttcggtagagggaacggtgggggtattgataatcgttggggattcggcggtcgagggtcgcgggaaagttgttgcggggtgcgggggcgggggagtggtcggcgggatagcgggttaaaggggcggggaagtgtttttgaatgaatcgtaacgtt

SEQ ID NO: 18560 - DNA, 598 bp, Artificial Sequence
  chemically treated genomic DNA (Homo sapiens) CpG-island No: 18560
aacgttacgattcattcaaaaacacttccccgcccctttaacccgctatcccgccgaccactcccccgcccccgcaccccgcaacaactttcccgcgaccctcgaccgccgaatccccaacgattatcaatacccccaccgttccctctaccgaaactccaccgcaacccaacctcaccaactttcgccgacccgcaataaacgttctcgcccactctcgccgttttctatctaacgccactaactatccaaacctaacaactcctcgtactataactctctatcctcaatcaccgccgctaccgccgccacaaccgccgcaacaacaactaaatttactacgaccgtcgccatcgccgtccgttctcttctacaaccaacgcaactatacgaaattaaaaaacgcccctcaacaaccacttccgaattctaatcccgaaaacgaaaacaaaaccccccaaacaatcgcgaaactactaccatattaaaaataaccccgtacacaaacgcgtcgaaaaactaaataaaataaaatcttcaataaaaaccaaaaaaaacaaaaataccttataaaatcctaacgccctataaacttaaa

SEQ ID NO: 18561 - DNA, 1115 bp, Artificial Sequence
  chemically treated genomic DNA (Homo sapiens) CpG-island No: 18561
ttcgggttcgtgttttattcgtcggtcggcggtggttttttattgttatcgttcgggttttttagaaacgttggttttaagtatagtttcgggtacgttcgtttttttcggggtttacggggtagtttggagtttaatagtttaggggcgaggcgacggcgggttcgacggtagttttttttcgatatagattttcgtgatttattgacgaattaggatcgaggttgttcgttttggggtagttgtaagtgttttagttgacgggaaattcggtcgagtggttaagttttcgatatgattttgattcggagtttcgggagttcgtcgtaatcgatttcgggtttcgcgtaggtaggttcgggtcggggtttcgcgggcggcgggcgcgaacggagaagcgtcgcgtagggtttttagtagtttcgggtcgtcgttgtggtcggtttcggtaggggggacgagcgggttcgaggattcggcgtaggtttgcgagcgcgtttatttttttttgtcgttgcgcgtgggtcgtcgtcgcgtttaggttcgtcgtagtcgaggtcggagtagggtgcggaaaagcggggttcgcgttcgaaatagtcgtatcgtttcgggattgggtttatcgaattcgtcgtagcgtcgtcgtcgtcgttttagtttttaagatggtcgttcgcggggcggaattagtttagtttttgttttcggtgcgcggttcggggcggtgaggagggagggggagggttggtcgttttaggtagattggcggatcgcgtttacgattttttgtcgtcgtcgatttcggggtgggggatggggcggggggcggggcggcgtttgcgtattggcgggcggtttcgggtatcgttagtgggcgcgagagttttagatttcgaagtcgcgcgtttttttttttatgtgttacggtttagggcggtaggttcggttgagggcgatttcggtggagaaagaatttcgattttttcgtttttcggttttcgttttgtttttcgtttttacgttttattcggtttttaggggaggcgcggcgcggttcgggtatggagcgtttcgggtttttggaggtttagtggagggttgggttttaggga

SEQ ID NO: 18562 - DNA, 1115 bp, Artificial Sequence
  chemically treated genomic DNA (Homo sapiens) CpG-island No: 18562
tccctaaaacccaaccctccactaaacctccaaaaacccgaaacgctccatacccgaaccgcgccgcgcctcccctaaaaaccgaataaaacgtaaaaacgaaaaacaaaacgaaaaccgaaaaacgaaaaaatcgaaattctttctccaccgaaatcgccctcaaccgaacctaccgccctaaaccgtaacacataaaaaaaaaaacgcgcgacttcgaaatctaaaactctcgcgcccactaacgatacccgaaaccgcccgccaatacgcaaacgccgccccgccccccgccccatcccccaccccgaaatcgacgacgacaaaaaatcgtaaacgcgatccgccaatctacctaaaacgaccaaccctccccctccctcctcaccgccccgaaccgcgcaccgaaaacaaaaactaaactaattccgccccgcgaacgaccatcttaaaaactaaaacgacgacgacgacgctacgacgaattcgataaacccaatcccgaaacgatacgactatttcgaacgcgaaccccgcttttccgcaccctactccgacctcgactacgacgaacctaaacgcgacgacgacccacgcgcaacgacaaaaaaaaataaacgcgctcgcaaacctacgccgaatcctcgaacccgctcgtcccccctaccgaaaccgaccacaacgacgacccgaaactactaaaaaccctacgcgacgcttctccgttcgcgcccgccgcccgcgaaaccccgacccgaacctacctacgcgaaacccgaaatcgattacgacgaactcccgaaactccgaatcaaaatcatatcgaaaacttaaccactcgaccgaatttcccgtcaactaaaacacttacaactaccccaaaacgaacaacctcgatcctaattcgtcaataaatcacgaaaatctatatcgaaaaaaaactaccgtcgaacccgccgtcgcctcgcccctaaactattaaactccaaactaccccgtaaaccccgaaaaaaacgaacgtacccgaaactatacttaaaaccaacgtttctaaaaaacccgaacgataacaataaaaaaccaccgccgaccgacgaataaaacacgaacccgaa

SEQ ID NO: 18563 - DNA, 1115 bp, Artificial Sequence
  chemically treated genomic DNA (Homo sapiens) CpG-island No: 18563
tttttggagtttaattttttattgagtttttaggggttcgggacgttttatgttcgggtcgcgtcgcgttttttttaagggtcgggtggggcgtgggagcggaggataaggcgggagtcgggaggcgggagggtcggggttttttttttatcggggtcgtttttagtcgggtttgtcgttttgggtcgtggtatatggggagggaagcgcgcggtttcggggtttggggttttcgcgtttattaacggtgttcggagtcgttcgttagtgcgtaagcgtcgtttcgtttttcgttttattttttatttcggggtcgacggcgatagagagtcgtgggcgcggttcgttagtttgtttagagcggttagttttttttttttttttttatcgtttcggatcgcgtatcggaagtagaagttaggttggtttcgtttcgcgagcggttattttggaggttgaggcggcggcggcggcgttgcggcgggttcggtgggtttaatttcggggcggtgcggttgtttcgggcgcgggtttcgttttttcgtattttgtttcggtttcgattacggcgagtttgagcgcggcggcggtttacgcgtagcgatagggagaggtgagcgcgttcgtaggtttgcgtcgggttttcgggttcgttcgttttttttgtcggagtcggttatagcggcggttcggggttgttggggattttgcgcgacgttttttcgttcgcgttcgtcgttcgcggggtttcggttcgagtttgtttgcgcggaattcgaggtcggttacggcgggttttcggagtttcgggttagggttatgtcggggatttgattattcggtcgggtttttcgttagttgggatatttgtagttgttttaggacgggtagtttcgattttggttcgttagtggattacgggagtttgtgtcgggggagggttgtcgtcgagttcgtcgtcgtttcgtttttgaattgttagattttagattgtttcgtaaatttcgagagaaacgagcgtgttcgggattgtgtttagggttagcgtttttgggaaattcgggcggtgatagtgggagattatcgtcggtcggcgagtgagatacgagttcgga

SEQ ID NO: 18564 - DNA, 1115 bp, Artificial Sequence
  chemically treated genomic DNA (Homo sapiens) CpG-island No: 18564
tccgaactcgtatctcactcgccgaccgacgataatctcccactatcaccgcccgaatttcccaaaaacgctaaccctaaacacaatcccgaacacgctcgtttctctcgaaatttacgaaacaatctaaaatctaacaattcaaaaacgaaacgacgacgaactcgacgacaaccctcccccgacacaaactcccgtaatccactaacgaaccaaaatcgaaactacccgtcctaaaacaactacaaatatcccaactaacgaaaaacccgaccgaataatcaaatccccgacataaccctaacccgaaactccgaaaacccgccgtaaccgacctcgaattccgcgcaaacaaactcgaaccgaaaccccgcgaacgacgaacgcgaacgaaaaaacgtcgcgcaaaatccccaacaaccccgaaccgccgctataaccgactccgacaaaaaaaacgaacgaacccgaaaacccgacgcaaacctacgaacgcgctcacctctccctatcgctacgcgtaaaccgccgccgcgctcaaactcgccgtaatcgaaaccgaaacaaaatacgaaaaaacgaaacccgcgcccgaaacaaccgcaccgccccgaaattaaacccaccgaacccgccgcaacgccgccgccgccgcctcaacctccaaaataaccgctcgcgaaacgaaaccaacctaacttctacttccgatacgcgatccgaaacgataaaaaaaaaaaaaaaaaactaaccgctctaaacaaactaacgaaccgcgcccacgactctctatcgccgtcgaccccgaaataaaaaataaaacgaaaaacgaaacgacgcttacgcactaacgaacgactccgaacaccgttaataaacgcgaaaaccccaaaccccgaaaccgcgcgcttccctccccatataccacgacccaaaacgacaaacccgactaaaaacgaccccgataaaaaaaaaaccccgaccctcccgcctcccgactcccgccttatcctccgctcccacgccccacccgacccttaaaaaaaacgcgacgcgacccgaacataaaacgtcccgaacccctaaaaactcaataaaaaattaaactccaaaaa

SEQ ID NO: 18565 - DNA, 911 bp, Artificial Sequence
  chemically treated genomic DNA (Homo sapiens) CpG-island No: 18565
cgtgtttttgtttcgtttcgtgtttttgtttcgtttcgtgtttttgtttcgtttttcgtgtttttgtttcgtttcgtgtttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttcgtgtttttgtttcgtttttcgtgtttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgttttttatgttttcgttttattttatgtttttgtttattttttttgtttttaggtt

SEQ ID NO: 18566 - DNA, 911 bp, Artificial Sequence
  chemically treated genomic DNA (Homo sapiens) CpG-island No: 18566
aacctaaaaacaaaaaaaataaacaaaaacataaaataaaacgaaaacataaaaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaacacgaaaaacgaaacaaaaacacgaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaacacgaaacgaaacaaaaacacgaaaaacgaaacaaaaacacgaaacgaaacaaaaacacgaaacgaaacaaaaacacg

SEQ ID NO: 18567 - DNA, 911 bp, Artificial Sequence
  chemically treated genomic DNA (Homo sapiens) CpG-island No: 18567
ggtttggggataggggggatgagtagggatatgggatggagcggagatatgggggacggggtagagatacgggggacggggtagagatacgggacggggtagggatacgggacggagtagagatacgggacggggtagagatacgggacggggtagagatacgggacggggtagagatacgggacggagtagagatacgggacggagtagagatacgggggacggagtagagatacgggacggagtagagatacgggacggagtagagatacgggacggagtagagatacgggacggagtagggatacgggacggagtagagatacgggacggagtagggatacgggacggagtagggatacgggacggagtagatacgggggacggagtagagatacgggacggagtagagatacgggggacggggtagagatacgggacggagtagagatacgggacggagtagagatacgggacggagtagaaatacgggacggagtagggatacgggacggagtagagatacgggacggggtagagatacgggggacggagtagagatacgggacggagtagagatacgggacggagtagagatacgggacggagtagagatacgggacggagtagagatacgggacggggtagagatacgggacggggtagagatacgggacggagtagagatacgggacggagtagagatacgggggacggagtagagatacgggacggagtagggatacgggacggggtagagatacgggacggagtagagatacgggggacggggtagagatacgggacggagtagggatacgggacggagtagatacgggacggagtagagatacgggggacggagtagagatacgggacggagtagagatacgggacggagtagagatacg

SEQ ID NO: 18568 - DNA, 911 bp, Artificial Sequence
  chemically treated genomic DNA (Homo sapiens) CpG-island No: 18568
cgtatctctactccgtcccgtatctctactccgtcccgtatctctactccgtcccccgtatctctactccgtcccgtatctactccgtcccgtatccctactccgtcccgtatctctaccccgtcccccgtatctctactccgtcccgtatctctaccccgtcccgtatccctactccgtcccgtatctctactccgtcccccgtatctctactccgtcccgtatctctactccgtcccgtatctctaccccgtcccgtatctctaccccgtcccgtatctctactccgtcccgtatctctactccgtcccgtatctctactccgtcccgtatctctactccgtcccgtatctctactccgtcccccgtatctctaccccgtcccgtatctctactccgtcccgtatccctactccgtcccgtatttctactccgtcccgtatctctactccgtcccgtatctctactccgtcccgtatctctaccccgtcccccgtatctctactccgtcccgtatctctactccgtcccccgtatctactccgtcccgtatccctactccgtcccgtatccctactccgtcccgtatctctactccgtcccgtatccctactccgtcccgtatctctactccgtcccgtatctctactccgtcccgtatctctactccgtcccgtatctctactccgtcccccgtatctctactccgtcccgtatctctactccgtcccgtatctctaccccgtcccgtatctctaccccgtcccgtatctctaccccgtcccgtatctctactccgtcccgtatccctaccccgtcccgtatctctaccccgtcccccgtatctctaccccgtcccccatatctccgctccatcccatatccctactcatcccccctatccccaaacc

SEQ ID NO: 18569 - DNA, 806 bp, Artificial Sequence
  chemically treated genomic DNA (Homo sapiens) CpG-island No: 18569
gttggtcgtttgtattgcgatggttaacgggtttcgttgtttttggtttagggcgtgttggttcgcgtttcgttttaggaataggtaaatttggttgaggggcgaggtcggaggggcgtgtcggggcggggcggggcggggcgagtgtggtcgcgggggcgtggtcggatagggtatggcggatagggcgtagtcgggtcggggtaggcgtggtcggggtatagggcggggcgtgggttgcgcgttttattcggtgcggtttagtagcgtggcgtggtgtaggggcgttcggtttcggttgtttttttggtttacgttcgtttcgttttgtagtaggaatttatagacgattaaggagttttggggagtcggggtaatttagacggagttacggtatcggttttttttcgcgtttttgtattttgatttcggttttgggcgtttttagtcgggatcgaatttggtttttatcgcggataggcgatttttgtgtgggcgttatagaagatgtaaacgcgattgtgtatttgtgttttgcgcgtagttttcgtggttcgtttatttttagtacggtttgtattagcggcgttttgtttttatttttcgcgttcgtttagttgatttcggtttcgtgggttagcgtcgtcgttagcgtaggaaggtcgcgggtacgcgttgcgcggtgcgttaagagtttcgggtgtagttcgcgtacgttcgttaggttttaggtttcggttttagtgttttcgtttgttttatcgttggattttttcgattttgtattttttgtggggagggggcgg

SEQ ID NO: 18570 - DNA, 806 bp, Artificial Sequence
  chemically treated genomic DNA (Homo sapiens) CpG-island No: 18570
ccgccccctccccacaaaaaatacaaaatcgaaaaaatccaacgataaaacaaacgaaaacactaaaaccgaaacctaaaacctaacgaacgtacgcgaactacacccgaaactcttaacgcaccgcgcaacgcgtacccgcgaccttcctacgctaacgacgacgctaacccacgaaaccgaaatcaactaaacgaacgcgaaaaataaaaacaaaacgccgctaatacaaaccgtactaaaaataaacgaaccacgaaaactacgcgcaaaacacaaatacacaatcgcgtttacatcttctataacgcccacacaaaaatcgcctatccgcgataaaaaccaaattcgatcccgactaaaaacgcccaaaaccgaaatcaaaatacaaaaacgcgaaaaaaaaccgataccgtaactccgtctaaattaccccgactccccaaaactccttaatcgtctataaattcctactacaaaacgaaacgaacgtaaaccaaaaaaacaaccgaaaccgaacgcccctacaccacgccacgctactaaaccgcaccgaataaaacgcgcaacccacgccccgccctataccccgaccacgcctaccccgacccgactacgccctatccgccataccctatccgaccacgcccccgcgaccacactcgccccgccccgccccgccccgacacgcccctccgacctcgcccctcaaccaaatttacctattcctaaaacgaaacgcgaaccaacacgccctaaaccaaaaacaacgaaacccgttaaccatcgcaatacaaacgaccaac

SEQ ID NO: 18571 - DNA, 806 bp, Artificial Sequence
  chemically treated genomic DNA (Homo sapiens) CpG-island No: 18571
tcgttttttttttatagagggtgtagagtcggaggagtttagcggtgaggtagacggggatattgaggtcgaggtttggggtttggcggacgtgcgcgagttgtattcggggtttttggcgtatcgcgtagcgcgtgttcgcgatttttttgcgttggcggcggcgttggtttacggggtcgaggttaattgggcggacgcggaggatgagggtaagacgtcgttggtgtaggtcgtgttaggggtgagcgagttacgggggttgcgcgtaggatataggtgtatagtcgcgtttgtattttttgtggcgtttatataagggtcgtttgttcgcggtggggattaagttcggtttcggttgggggcgtttaaggtcggggttagggtgtagaggcgcggagaggggtcggtgtcgtggtttcgtttgagttgtttcggttttttagggttttttgatcgtttgtgagtttttgttgtaaaacggagcggacgtgaattaaagagatagtcggggtcgggcgtttttgtattacgttacgttgttgggtcgtatcgggtgagacgcgtaatttacgtttcgttttgtgtttcgattacgtttatttcggttcggttacgttttgttcgttatgttttattcggttacgttttcgcgattatattcgtttcgtttcgtttcgtttcgatacgttttttcgatttcgttttttagttaggtttgtttgtttttgaagcggggcgcggattagtacgttttggattaagagtagcgggattcgttggttatcgtagtgtaggcggttaat

SEQ ID NO: 18572 - DNA, 806 bp, Artificial Sequence
  chemically treated genomic DNA (Homo sapiens) CpG-island No: 18572
attaaccgcctacactacgataaccaacgaatcccgctactcttaatccaaaacgtactaatccgcgccccgcttcaaaaacaaacaaacctaactaaaaaacgaaatcgaaaaaacgtatcgaaacgaaacgaaacgaaacgaatataatcgcgaaaacgtaaccgaataaaacataacgaacaaaacgtaaccgaaccgaaataaacgtaatcgaaacacaaaacgaaacgtaaattacgcgtctcacccgatacgacccaacaacgtaacgtaatacaaaaacgcccgaccccgactatctctttaattcacgtccgctccgttttacaacaaaaactcacaaacgatcaaaaaaccctaaaaaaccgaaacaactcaaacgaaaccacgacaccgacccctctccgcgcctctacaccctaaccccgaccttaaacgcccccaaccgaaaccgaacttaatccccaccgcgaacaaacgacccttatataaacgccacaaaaaatacaaacgcgactatacacctatatcctacgcgcaacccccgtaactcgctcacccctaacacgacctacaccaacgacgtcttaccctcatcctccgcgtccgcccaattaacctcgaccccgtaaaccaacgccgccgccaacgcaaaaaaatcgcgaacacgcgctacgcgatacgccaaaaaccccgaatacaactcgcgcacgtccgccaaaccccaaacctcgacctcaatatccccgtctacctcaccgctaaactcctccgactctacaccctctataaaaaaaaaacga

SEQ ID NO: 18573 - DNA, 642 bp, Artificial Sequence
  chemically treated genomic DNA (Homo sapiens) CpG-island No: 18573
ttcggtttttttttacgttttattatttcggtttttttttacgttgttttattatttcggtttttttttacgttttattatttcggtttttttttacgttttattatttcggtttttttttacgttgttttattatttcggtttttttttacgttttattatttcggtttttttttatattttattatttcggtttttttttatattgttttattatttcggtttttttttacgttgttttattatttcggtttttttttacgttttattatttcggtttttttttatattttattatttcggtttttttttatattgttttattatttcggtttttttttacgttgttttattatttcggtttttttttatattttattatttcggtttttttttatattgttttattatttcggtttttttttatattgttttattatttcggtttttttttacgttttattatttcggtttttttttatattttattatttcggtttttttttacgttgttttattatttcggtttttttttacgttttattatttcggtttttttttatattttattatttcggtttttttttatattgttttattatttcggtttttttttacgttgttttattattttggtttttt

SEQ ID NO: 18574 - DNA, 642 bp, Artificial Sequence
  chemically treated genomic DNA (Homo sapiens) CpG-island No: 18574
aaaaaaccaaaataataaaacaacgtaaaaaaaaaccgaaataataaaacaatataaaaaaaaaccgaaataataaaatataaaaaaaaaccgaaataataaaacgtaaaaaaaaaccgaaataataaaacaacgtaaaaaaaaaccgaaataataaaatataaaaaaaaaccgaaataataaaacgtaaaaaaaaaccgaaataataaaacaatataaaaaaaaaccgaaataataaaacaatataaaaaaaaaccgaaataataaaatataaaaaaaaaccgaaataataaaacaacgtaaaaaaaaaccgaaataataaaacaatataaaaaaaaaccgaaataataaaatataaaaaaaaaccgaaataataaaacgtaaaaaaaaaccgaaataataaaacaacgtaaaaaaaaaccgaaataataaaacaatataaaaaaaaaccgaaataataaaatataaaaaaaaaccgaaataataaaacgtaaaaaaaaaccgaaataataaaacaacgtaaaaaaaaaccgaaataataaaacgtaaaaaaaaaccgaaataataaaacgtaaaaaaaaaccgaaataataaaacaacgtaaaaaaaaaccgaaataataaaacgtaaaaaaaaaccgaa

SEQ ID NO: 18575 - DNA, 642 bp, Artificial Sequence
  chemically treated genomic DNA (Homo sapiens) CpG-island No: 18575
gaggagttaaggtggtggagtagcgtggggaggagtcgaggtgatggagtagtgtggggaggagtcgaggtggtggagtgtggggaggagtcgaggtggtggagcgtgggaaggagtcgaggtggtggagtagcgtggggaggagtcgaggtggtggagtgtggggaggagtcgaggtggtggagcgtgggaaggagtcgaggtggtggagtagtgtggggaggagtcgaggtgatggagtagtgtggggaggagtcgaggtggtggagtgtgggaaggagtcgaggtggtggagtagcgtggggaggagtcgaggtgatggagtagtgtggggaggagtcgaggtggtggagtgtggggaggagtcgaggtggtggagcgtgggaaggagtcgaggtggtggagtagcgtggggaggagtcgaggtgatggagtagtgtggggaggagtcgaggtggtggagtgtggggaggagtcgaggtggtggagcgtggggaggagtcgaggtggtggagtagcgtggggaggagtcgaggtggtggagcgtggggaggagtcgaggtggtggagcgtgggaaggagtcgaggtggtggagtagcgtggggaggagtcgaggtggtggagcgtggggaggagtcgag

SEQ ID NO: 18576 - DNA, 642 bp, Artificial Sequence
  chemically treated genomic DNA (Homo sapiens) CpG-island No: 18576
ctcgactcctccccacgctccaccacctcgactcctccccacgctactccaccacctcgactccttcccacgctccaccacctcgactcctccccacgctccaccacctcgactcctccccacgctactccaccacctcgactcctccccacgctccaccacctcgactcctccccacactccaccacctcgactcctccccacactactccatcacctcgactcctccccacgctactccaccacctcgactccttcccacgctccaccacctcgactcctccccacactccaccacctcgactcctccccacactactccatcacctcgactcctccccacgctactccaccacctcgactccttcccacactccaccacctcgactcctccccacactactccatcacctcgactcctccccacactactccaccacctcgactccttcccacgctccaccacctcgactcctccccacactccaccacctcgactcctccccacgctactccaccacctcgactccttcccacgctccaccacctcgactcctccccacactccaccacctcgactcctccccacactactccatcacctcgactcctccccacgctactccaccaccttaactcctc

SEQ ID NO: 18577 - DNA, 670 bp, Artificial Sequence
  chemically treated genomic DNA (Homo sapiens) CpG-island No: 18577
cgtaggtacgagttgcgtatatagttcgaggagtagcggcggttggcgatattcgagggcggtcgtgggattcggttaggtattttattcgtatacgatgttttcggcgttttcgtgttgtagaacgagtatttattttaggtatagttgcgcgtcgtcgtttttacgttgtttttgtttacggttacgtgggttttcggggcgttggcggtgtcgtagggttattttttggatatggtttttagttgtttgtacggcgttttttgcgtgattttgggatttttcgtgtttatttattattgcgttaagcgtgaggacgtgtggtagtgttggtgggtatgttgttcgtttcgtaaggacgtttattttgtatttgacgttaacggggtcgcgttgggtcgcgtcgtttgtttgtattcgtcgggattgggttagttacggggtttcgcgtatttatcgggtttttgtaagatgattaatttgtaggtcgcgtagggttacgttagttgtttgttatcggttatttcgtgttgcgttaagatgtattgcgagttattgacggcggacgaggcgtacgtgtatttgtaggaggagggcgttttcgggtacgatttttatttgtacgggtgtttttagggtagaattaagtcgttttattttagtcggtatt

SEQ ID NO: 18578 - DNA, 670 bp, Artificial Sequence
  chemically treated genomic DNA (Homo sapiens) CpG-island No: 18578
aataccgactaaaataaaacgacttaattctaccctaaaaacacccgtacaaataaaaatcgtacccgaaaacgccctcctcctacaaatacacgtacgcctcgtccgccgtcaataactcgcaatacatcttaacgcaacacgaaataaccgataacaaacaactaacgtaaccctacgcgacctacaaattaatcatcttacaaaaacccgataaatacgcgaaaccccgtaactaacccaatcccgacgaatacaaacaaacgacgcgacccaacgcgaccccgttaacgtcaaatacaaaataaacgtccttacgaaacgaacaacatacccaccaacactaccacacgtcctcacgcttaacgcaataataaataaacacgaaaaatcccaaaatcacgcaaaaaacgccgtacaaacaactaaaaaccatatccaaaaaataaccctacgacaccgccaacgccccgaaaacccacgtaaccgtaaacaaaaacaacgtaaaaacgacgacgcgcaactatacctaaaataaatactcgttctacaacacgaaaacgccgaaaacatcgtatacgaataaaatacctaaccgaatcccacgaccgccctcgaatatcgccaaccgccgctactcctcgaactatatacgcaactcgtacctacg

SEQ ID NO: 18579 - DNA, 670 bp, Artificial Sequence
  chemically treated genomic DNA (Homo sapiens) CpG-island No: 18579
ggtgtcggttaaagtagggcggtttagttttgttttgaaggtattcgtgtaggtgggggtcgtgttcgaaggcgttttttttttgtaggtgtacgtgcgtttcgttcgtcgttagtggttcgtagtgtattttggcgtagtacggggtggtcggtgataggtaattggcgtggttttgcgcggtttgtaggttggttattttgtaggggttcggtgggtgcgcgaagtttcgtggttggtttagtttcggcgagtgtaggtaggcggcgcggtttagcgcggtttcgttggcgttaagtgtagggtgggcgtttttgcggggcgggtagtatgtttattagtattgttatacgtttttacgtttggcgtagtggtggatgagtacgaagagttttagggttacgtagaaggcgtcgtataggtagttgaagattatgtttaggaagtggttttgcgatatcgttagcgtttcgaaggtttacgtggtcgtgaataggaatagcgtgaaggcggcggcgcgtagttgtgtttggaatgagtgttcgttttgtagtacggaggcgtcgggggtatcgtgtgcgggtggggtgtttggtcggattttacggtcgttttcgggtgtcgttagtcgtcgttgtttttcgggttgtgtgcgtagttcgtatttgcg

SEQ ID NO: 18580 - DNA, 670 bp, Artificial Sequence
  chemically treated genomic DNA (Homo sapiens) CpG-island No: 18580
cgcaaatacgaactacgcacacaacccgaaaaacaacgacgactaacgacacccgaaaacgaccgtaaaatccgaccaaacaccccacccgcacacgatacccccgacgcctccgtactacaaaacgaacactcattccaaacacaactacgcgccgccgccttcacgctattcctattcacgaccacgtaaaccttcgaaacgctaacgatatcgcaaaaccacttcctaaacataatcttcaactacctatacgacgccttctacgtaaccctaaaactcttcgtactcatccaccactacgccaaacgtaaaaacgtataacaatactaataaacatactacccgccccgcaaaaacgcccaccctacacttaacgccaacgaaaccgcgctaaaccgcgccgcctacctacactcgccgaaactaaaccaaccacgaaacttcgcgcacccaccgaacccctacaaaataaccaacctacaaaccgcgcaaaaccacgccaattacctatcaccgaccaccccgtactacgccaaaatacactacgaaccactaacgacgaacgaaacgcacgtacacctacaaaaaaaaaacgccttcgaacacgacccccacctacacgaataccttcaaaacaaaactaaaccgccctactttaaccgacacc

SEQ ID NO: 18581 - DNA, 1269 bp, Artificial Sequence
  chemically treated genomic DNA (Homo sapiens) CpG-island No: 18581
ttttcgcgttagtagggtcggttttgtagtgaggtttttgcgtatttaggtggagttcgattcgtagttttcggttgggtcggttttatttgattcgtcggcgcgttaggcgggggcgttgtagggcggggttttcggggtttttcgcggtttagtgcgtattcgcggtttcgcggtcgggaggagcgtagacggcggcgggcgcgggtcggagttcgaggttgcgcgggttcggttatttgggtcggtagcgattgcgtcgcgttttttttttcgtcgtttttttcgaggagtcggcgtcgagtcgagcgggcgggcgcgcgtttttaggtcggagtagcggcgtttcgcgggcggcgaggcggttcgagattttttgttaattttttcgttttcgttcgtttttttcgcggcgttttttttttttcgttcgttttttttttttttgtttagaaagatataaatcgtttttcggagtggcgtttttagtcgcggcggagcgcggcgttggcggcggatggagggcgcgagcgggcggtcgcggaggttgtattcggcggggcgttgatgcggcgtttggattttcgttgcgcgatttcgggggcgtcggtcgagttgggatttcgcgatgtagtttttgaaggcgttttgggtattggtaggggtcgcgttttgttgttttttcgttttagtgatttacgcgtagttttttaaagaaggtaattgttttcgggcgcgcggatcggtttttcgcgttttgttcggttcgcggcggtttcggcgttcgattcggtttttagtacgtttcgttgtcgtcgcgttcggttgaggttcgtggagcgttattgcgggttcggagcggtcggcggcgcgattttattaggagttcgatttttcgcggatttcgttgtttcgcgtttatcggggtttatcggtagggcgcggggtcggggcgcgttgcgttttcggtgtttttggcgtcgtttcggatttttagtttaagtcgaggttgtcgtttttattttttgttttattgggttcggtggtagcggcgttcgttcgtacgtcgtcgggttttcggtagatggtattagcgttttacggtggtcggtcgggttggggcgggagcggagttgggattcgttagggtgggcgtcgggttgggattcgcggacgtcgggaaatcggtttgcgtatttgttttttagggtttaagtcgttttttagagatttataggtttgggaagtaggggtttggttatcggggtg

SEQ ID NO: 18582 - DNA, 1269 bp, Artificial Sequence
  chemically treated genomic DNA (Homo sapiens) CpG-island No: 18582
caccccgataaccaaacccctacttcccaaacctataaatctctaaaaaacgacttaaaccctaaaaaacaaatacgcaaaccgatttcccgacgtccgcgaatcccaacccgacgcccaccctaacgaatcccaactccgctcccgccccaacccgaccgaccaccgtaaaacgctaataccatctaccgaaaacccgacgacgtacgaacgaacgccgctaccaccgaacccaataaaacaaaaaataaaaacgacaacctcgacttaaactaaaaatccgaaacgacgccaaaaacaccgaaaacgcaacgcgccccgaccccgcgccctaccgataaaccccgataaacgcgaaacaacgaaatccgcgaaaaatcgaactcctaataaaatcgcgccgccgaccgctccgaacccgcaataacgctccacgaacctcaaccgaacgcgacgacaacgaaacgtactaaaaaccgaatcgaacgccgaaaccgccgcgaaccgaacaaaacgcgaaaaaccgatccgcgcgcccgaaaacaattaccttctttaaaaaactacgcgtaaatcactaaaacgaaaaaacaacaaaacgcgacccctaccaatacccaaaacgccttcaaaaactacatcgcgaaatcccaactcgaccgacgcccccgaaatcgcgcaacgaaaatccaaacgccgcatcaacgccccgccgaatacaacctccgcgaccgcccgctcgcgccctccatccgccgccaacgccgcgctccgccgcgactaaaaacgccactccgaaaaacgatttatatctttctaaacaaaaaaaaaaaaaacgaacgaaaaaaaaaaaacgccgcgaaaaaaacgaacgaaaacgaaaaaattaacaaaaaatctcgaaccgcctcgccgcccgcgaaacgccgctactccgacctaaaaacgcgcgcccgcccgctcgactcgacgccgactcctcgaaaaaaacgacgaaaaaaaaaacgcgacgcaatcgctaccgacccaaataaccgaacccgcgcaacctcgaactccgacccgcgcccgccgccgtctacgctcctcccgaccgcgaaaccgcgaatacgcactaaaccgcgaaaaaccccgaaaaccccgccctacaacgcccccgcctaacgcgccgacgaatcaaataaaaccgacccaaccgaaaactacgaatcgaactccacctaaatacgcaaaaacctcactacaaaaccgaccctactaacgcgaaaa

SEQ ID NO: 18583 - DNA, 1269 bp, Artificial Sequence
  chemically treated genomic DNA (Homo sapiens) CpG-island No: 18583
tatttcggtgattaagtttttgttttttaaatttatgggtttttggaaggcggtttgggttttggggaataggtgcgtaggtcggtttttcgacgttcgcgggttttagttcggcgtttattttggcgggttttagtttcgttttcgttttagttcggtcggttatcgtggagcgttggtgttatttatcgagggttcggcggcgtgcgggcgggcgtcgttgttatcgagtttagtggggtaggggatgggaacggtagtttcggtttgggttggggattcggggcggcgttagaggtatcgagaacgtagcgcgtttcgatttcgcgttttgtcggtgagtttcgatgggcgcggggtagcgagattcgcggggggtcgggtttttggtagggtcgcgtcgtcggtcgtttcgggttcgtagtggcgttttacgagttttagtcgagcgcggcggtagcggaacgtgttggaagtcgggtcgggcgtcggagtcgtcgcgagtcgggtagagcgcggaggatcggttcgcgcgttcggggataattattttttttgaggaattgcgcgtggattattaggacgaggaagtagtagagcgcggtttttgttagtgtttagagcgtttttaggagttgtatcgcggagttttaattcggtcgacgttttcgaagtcgcgtagcgaaggtttaggcgtcgtattagcgtttcgtcgggtgtagttttcgcggtcgttcgttcgcgttttttattcgtcgttaacgtcgcgtttcgtcgcgattggaggcgttatttcgggaggcgatttgtgtttttttgggtaggggggaggggagcgggcggggggaggggggcgtcgcggagggggcgggcgggggcggggaggttagtagaaagtttcgggtcgtttcgtcgttcgcgggacgtcgttgtttcggtttggaggcgcgcgttcgttcgttcggttcggcgtcggtttttcgggggaggcggcgggagggggagcgcggcgtagtcgttgtcggtttaggtggtcgggttcgcgtagtttcggatttcggttcgcgttcgtcgtcgtttgcgtttttttcggtcgcggagtcgcggatgcgtattgggtcgcgagggatttcggggatttcgttttgtagcgttttcgtttggcgcgtcggcgggttaggtggggtcggtttagtcgaaaattgcgggtcgggttttatttaggtgcgtaggggttttattgtagagtcggttttgttggcgcgggag

SEQ ID NO: 18584 - DNA, 1269 bp, Artificial Sequence
  chemically treated genomic DNA (Homo sapiens) CpG-island No: 18584
ctcccgcgccaacaaaaccgactctacaataaaacccctacgcacctaaataaaacccgacccgcaattttcgactaaaccgaccccacctaacccgccgacgcgccaaacgaaaacgctacaaaacgaaatccccgaaatccctcgcgacccaatacgcatccgcgactccgcgaccgaaaaaaacgcaaacgacgacgaacgcgaaccgaaatccgaaactacgcgaacccgaccacctaaaccgacaacgactacgccgcgctccccctcccgccgcctcccccgaaaaaccgacgccgaaccgaacgaacgaacgcgcgcctccaaaccgaaacaacgacgtcccgcgaacgacgaaacgacccgaaactttctactaacctccccgcccccgcccgccccctccgcgacgcccccctccccccgcccgctcccctcccccctacccaaaaaaacacaaatcgcctcccgaaataacgcctccaatcgcgacgaaacgcgacgttaacgacgaataaaaaacgcgaacgaacgaccgcgaaaactacacccgacgaaacgctaatacgacgcctaaaccttcgctacgcgacttcgaaaacgtcgaccgaattaaaactccgcgatacaactcctaaaaacgctctaaacactaacaaaaaccgcgctctactacttcctcgtcctaataatccacgcgcaattcctcaaaaaaaataattatccccgaacgcgcgaaccgatcctccgcgctctacccgactcgcgacgactccgacgcccgacccgacttccaacacgttccgctaccgccgcgctcgactaaaactcgtaaaacgccactacgaacccgaaacgaccgacgacgcgaccctaccaaaaacccgaccccccgcgaatctcgctaccccgcgcccatcgaaactcaccgacaaaacgcgaaatcgaaacgcgctacgttctcgatacctctaacgccgccccgaatccccaacccaaaccgaaactaccgttcccatcccctaccccactaaactcgataacaacgacgcccgcccgcacgccgccgaaccctcgataaataacaccaacgctccacgataaccgaccgaactaaaacgaaaacgaaactaaaacccgccaaaataaacgccgaactaaaacccgcgaacgtcgaaaaaccgacctacgcacctattccccaaaacccaaaccgccttccaaaaacccataaatttaaaaaacaaaaacttaatcaccgaaata

SEQ ID NO: 18585 - DNA, 1172 bp, Artificial Sequence
  chemically treated genomic DNA (Homo sapiens) CpG-island No: 18585
cgcgcgcgcgcgcgcgcgcgcgcgcgcgcgcgcgcgcgcgcgcgtacgcgcgcgcgcgcgcgcgcgcgcgcgcgcgcgcgcgtacgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgtacgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcg

SEQ ID NO: 18586 - DNA, 1172 bp, Artificial Sequence
  chemically treated genomic DNA (Homo sapiens) CpG-island No: 18586
cgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgtacgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgtacgcgcgcgcgcgcgcgcgcgcgcgcgcgcgcgcgcgtacgcgcgcgcgcgcgcgcgcgcgcgcgcgcgcgcgcgcgcgcgcg

SEQ ID NO: 18587 - DNA, 1172 bp, Artificial Sequence
  chemically treated genomic DNA (Homo sapiens) CpG-island No: 18587
cgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgtgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgtgcgcgcgcgcgcgcgcgcgcgcgcgcgcgcgcgcgcgtgcgcgcgcgcgcgcgcgcgcgcgcgcgcgcgcgcgcgcgcgcgcg

SEQ ID NO: 18588 - DNA, 1172 bp, Artificial Sequence
  chemically treated genomic DNA (Homo sapiens) CpG-island No: 18588
cgcgcgcgcgcgcgcgcgcgcgcgcgcgcgcgcgcgcgcgcgcgcacgcgcgcgcgcgcgcgcgcgcgcgcgcgcgcgcgcgcacgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcacgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcgcg

SEQ ID NO: 18589 - DNA, 1066 bp, Artificial Sequence
  chemically treated genomic DNA (Homo sapiens) CpG-island No: 18589
tttatagcggaagtttttgtcgtagttcgtatatttgtgcggtttgttgttcgtgtggatgcggcggtggcggattaggtgggagttttggataaagtttttgtcgtattcgatgtacgtgtagggtttttcgttcgtgtgcgtgcgttggtgttgcgtgagcgtggagaagtcgttgaagcgtttttcgtattggttatagcggaagggtttttcgtcggtgtgtacgcgtaggtggtttattaggtgcgagttacgttcgaagtttttttcgtattcgcggtatacgtagggtcgtttattcgagtgcgtgcgtttgtgcgtgaagaggtgcgagttgacgttgaaggtttcgtcgtattcggagtatatgtagggtttttcgttcgtgtgtacgcgttggtgttttattaagttcgagcgttagttgaagcgtttgtcgtattcgttatagtcgtgcggtttttcgttcgtgtggatgcgttggtggttggttaggtgcgaacggcgtacgaagtttttgtcgtatttttcgtaggcgaagggtcgtagcgtcgtcgttttcgcgtcgttggtcgtcgcgtgcgcgcgtcggtggtttaatagatgcgagttgaggttgaaggtttcgtcgtattcggggtacgggtagggtttttcgttcgtgtgtaggcgtcggtgtttgagtaggtcggcgcgttagttgaagtttttgtcgtagtcggcgtataggttgggtcgttcgttcgtgtgtaggcgtaggtggttggttaggtaggtgttgcggttgaagtttttgtcgtatttttcgtagcggaagggtttttcgcggcgggtcgggttagcgggggttcggtttcgaagtttttcgttatatttatttttattatgtttattatcgcgtcgtattcgttcgttaggtcgaagggttttaggttggcggcggtagcggttttagttaggcggtgaatgcgttggtgttgtaggaaggcggcgttaggattgaagtttttttcgtagtcggggtagatggtgggcgcgtttatgatgttggttattaggttat

SEQ ID NO: 18590 - DNA, 1066 bp, Artificial Sequence
  chemically treated genomic DNA (Homo sapiens) CpG-island No: 18590
ataacctaataaccaacatcataaacgcgcccaccatctaccccgactacgaaaaaaacttcaatcctaacgccgccttcctacaacaccaacgcattcaccgcctaactaaaaccgctaccgccgccaacctaaaacccttcgacctaacgaacgaatacgacgcgataataaacataataaaaataaatataacgaaaaacttcgaaaccgaacccccgctaacccgacccgccgcgaaaaacccttccgctacgaaaaatacgacaaaaacttcaaccgcaacacctacctaaccaaccacctacgcctacacacgaacgaacgacccaacctatacgccgactacgacaaaaacttcaactaacgcgccgacctactcaaacaccgacgcctacacacgaacgaaaaaccctacccgtaccccgaatacgacgaaaccttcaacctcaactcgcatctattaaaccaccgacgcgcgcacgcgacgaccaacgacgcgaaaacgacgacgctacgacccttcgcctacgaaaaatacgacaaaaacttcgtacgccgttcgcacctaaccaaccaccaacgcatccacacgaacgaaaaaccgcacgactataacgaatacgacaaacgcttcaactaacgctcgaacttaataaaacaccaacgcgtacacacgaacgaaaaaccctacatatactccgaatacgacgaaaccttcaacgtcaactcgcacctcttcacgcacaaacgcacgcactcgaataaacgaccctacgtataccgcgaatacgaaaaaaacttcgaacgtaactcgcacctaataaaccacctacgcgtacacaccgacgaaaaacccttccgctataaccaatacgaaaaacgcttcaacgacttctccacgctcacgcaacaccaacgcacgcacacgaacgaaaaaccctacacgtacatcgaatacgacaaaaactttatccaaaactcccacctaatccgccaccgccgcatccacacgaacaacaaaccgcacaaatatacgaactacgacaaaaacttccgctataaa

SEQ ID NO: 18591 - DNA, 1066 bp, Artificial Sequence
  chemically treated genomic DNA (Homo sapiens) CpG-island No: 18591
atagtttggtggttagtattatggacgcgtttattatttgtttcgattgcggggagagttttagttttggcgtcgtttttttgtagtattagcgtatttatcgtttggttgaggtcgttgtcgtcgttagtttggagtttttcggtttggcgggcgagtgcgacgcgatggtgggtatgatgggggtgggtgtggcggggggtttcggggtcgggttttcgttggttcggttcgtcgcgaaaagttttttcgttgcggggagtgcggtaagggttttagtcgtaatatttatttgattaattatttgcgtttgtatacgggcgagcggtttaatttgtgcgtcgattgcggtaagagttttagttggcgcgtcgatttgtttaagtatcggcgtttgtatacgggcgagaagttttattcgtgtttcgagtgcggcgaggtttttagttttagttcgtatttgttgagttatcggcgcgcgtacgcggcggttagcggcgcgggggcggcggcgttgcggtttttcgtttgcggggagtgcggtaagggtttcgtgcgtcgttcgtatttggttaattattagcgtatttatacgggcgagaagtcgtacggttgtggcgagtgcggtaagcgttttagttggcgttcggatttggtgaagtattagcgcgtgtatacgggcgagaagttttatatgtgtttcgagtgcggcgagatttttagcgttagttcgtatttttttacgtataagcgtacgtattcgggtgagcggttttacgtgtgtcgcgagtgcgggaagggtttcgggcgtaattcgtatttggtgaattatttgcgcgtgtatatcggcgagaagttttttcgttgtggttagtgcgagaagcgttttagcgatttttttacgtttacgtagtattagcgtacgtatacgggcgagaagttttatacgtgtatcgagtgcggtaagagttttatttagagtttttatttgattcgttatcgtcgtatttatacgggtaataagtcgtataagtgtgcgggttgcggtaaaggttttcgttataaa

SEQ ID NO: 18592 - DNA, 1066 bp, Artificial Sequence
  chemically treated genomic DNA (Homo sapiens) CpG-island No: 18592
tttataacgaaaacctttaccgcaacccgcacacttatacgacttattacccgtataaatacgacgataacgaatcaaataaaaactctaaataaaactcttaccgcactcgatacacgtataaaacttctcgcccgtatacgtacgctaatactacgtaaacgtaaaaaaatcgctaaaacgcttctcgcactaaccacaacgaaaaaacttctcgccgatatacacgcgcaaataattcaccaaatacgaattacgcccgaaacccttcccgcactcgcgacacacgtaaaaccgctcacccgaatacgtacgcttatacgtaaaaaaatacgaactaacgctaaaaatctcgccgcactcgaaacacatataaaacttctcgcccgtatacacgcgctaatacttcaccaaatccgaacgccaactaaaacgcttaccgcactcgccacaaccgtacgacttctcgcccgtataaatacgctaataattaaccaaatacgaacgacgcacgaaacccttaccgcactccccgcaaacgaaaaaccgcaacgccgccgcccccgcgccgctaaccgccgcgtacgcgcgccgataactcaacaaatacgaactaaaactaaaaacctcgccgcactcgaaacacgaataaaacttctcgcccgtatacaaacgccgatacttaaacaaatcgacgcgccaactaaaactcttaccgcaatcgacgcacaaattaaaccgctcgcccgtatacaaacgcaaataattaatcaaataaatattacgactaaaacccttaccgcactccccgcaacgaaaaaacttttcgcgacgaaccgaaccaacgaaaacccgaccccgaaaccccccgccacacccacccccatcatacccaccatcgcgtcgcactcgcccgccaaaccgaaaaactccaaactaacgacgacaacgacctcaaccaaacgataaatacgctaatactacaaaaaaacgacgccaaaactaaaactctccccgcaatcgaaacaaataataaacgcgtccataatactaaccaccaaactat

SEQ ID NO: 18593 - DNA, 548 bp, Artificial Sequence
  chemically treated genomic DNA (Homo sapiens) CpG-island No: 18593
agttggcgaggttcgtagcgaaaatttaaagtagtcgagttcggagagcgtcgttttagcgggcgagggcgtagttcggggaatgtacggaggttcgtttagttagtcggggcgcgttttttggaggaggaggagaaggatttgcggtcggagttatcgggataaatgtaggaggcggggtagttagcgggcgtggttttgcggaggttttcggtcgaaaggaggagataggggtcggtcgcgtatttaaagcggacgcgggggaagttttttcggtgtttgttttagtcgtatagttcggtgggttcgtggcgtagtcgaacgtttttttagaagtttttcggtttcgtttagtttttaaattcgcgacgttgggtttgttgggttcggcgcgtataggttcgaaggagtcgggtttattcggtttggtttagtagttgcgggcggcggggagtagtttagttcggttggagtagtttttcgtaggtgagggcgcggggcgggcggacgggttttagttttcggtagttttgtttatcgcgttcggg

SEQ ID NO: 18594 - DNA, 548 bp, Artificial Sequence
  chemically treated genomic DNA (Homo sapiens) CpG-island No: 18594
cccgaacgcgataaacaaaactaccgaaaactaaaacccgtccgcccgccccgcgccctcacctacgaaaaactactccaaccgaactaaactactccccgccgcccgcaactactaaaccaaaccgaataaacccgactccttcgaacctatacgcgccgaacccaacaaacccaacgtcgcgaatttaaaaactaaacgaaaccgaaaaacttctaaaaaaacgttcgactacgccacgaacccaccgaactatacgactaaaacaaacaccgaaaaaacttcccccgcgtccgctttaaatacgcgaccgacccctatctcctcctttcgaccgaaaacctccgcaaaaccacgcccgctaactaccccgcctcctacatttatcccgataactccgaccgcaaatccttctcctcctcctccaaaaaacgcgccccgactaactaaacgaacctccgtacattccccgaactacgccctcgcccgctaaaacgacgctctccgaactcgactactttaaattttcgctacgaacctcgccaact

SEQ ID NO: 18595 - DNA, 548 bp, Artificial Sequence
  chemically treated genomic DNA (Homo sapiens) CpG-island No: 18595
ttcgggcgcggtaggtagagttgtcgagggttgggattcgttcgttcgtttcgcgtttttatttgcgggaggttgttttagtcgggttgggttgtttttcgtcgttcgtagttgttgggttaaatcgagtagattcggttttttcgagtttgtgcgcgtcggatttagtagatttagcgtcgcgagtttaggggttggacggggtcggggagtttttgggaaaacgttcgattgcgttacgagtttatcgagttgtgcgattgaggtagatatcgggagggtttttttcgcgttcgttttaagtacgcggtcggtttttgtttttttttttcgatcggggattttcgtagggttacgttcgttggttgtttcgttttttgtatttatttcggtagtttcggtcgtaagttttttttttttttttttaggaagcgcgtttcgattgattagacggattttcgtgtatttttcgggttacgttttcgttcgttgagacggcgtttttcgagttcggttgttttgggttttcgttgcgagtttcgttaatt

SEQ ID NO: 18596 - DNA, 548 bp, Artificial Sequence
  chemically treated genomic DNA (Homo sapiens) CpG-island No: 18596
aattaacgaaactcgcaacgaaaacccaaaacaaccgaactcgaaaaacgccgtctcaacgaacgaaaacgtaacccgaaaaatacacgaaaatccgtctaatcaatcgaaacgcgcttcctaaaaaaaaaaaaaaaaaacttacgaccgaaactaccgaaataaatacaaaaaacgaaacaaccaacgaacgtaaccctacgaaaatccccgatcgaaaaaaaaaaacaaaaaccgaccgcgtacttaaaacgaacgcgaaaaaaaccctcccgatatctacctcaatcgcacaactcgataaactcgtaacgcaatcgaacgttttcccaaaaactccccgaccccgtccaacccctaaactcgcgacgctaaatctactaaatccgacgcgcacaaactcgaaaaaaccgaatctactcgatttaacccaacaactacgaacgacgaaaaacaacccaacccgactaaaacaacctcccgcaaataaaaacgcgaaacgaacgaacgaatcccaaccctcgacaactctacctaccgcgcccgaa

SEQ ID NO: 18597 - DNA, 594 bp, Artificial Sequence
  chemically treated genomic DNA (Homo sapiens) CpG-island No: 18597
tcgtagcgcgtcggtttcgagtagggtttttagcgtcggcgcgtatgggtcgttcgtaggggtttcggttaaggttatgacgtttacggttcgcgcggttcgggtgataggcggcggcggcggcgcgggtttatggcggtaggtttcggcgagggttcgatttcgtttcgttttcggtcgtcgttgtttgtaaagtttcggttatttttacgcgttaaattttttttgtcgcgaaagagttacgagtcgtcgagcgtcgttataattggttgtttcggtcgtgacgggaataacggcggcggtttttattggttttaacgcgtcggattcggcggcgaggggcgggatggggcggcggcgcggggcggtacggttaatggcggggcggggcgcgcgtaggttttgttcggatggtattaggcgcggtttgatttttcgtttttagttcgggcgttttttgttggaggcgtggggatatcggaatataggtttcgtttcgtttcgacgttttcgtattttattgatttttttatagtgtaggtttagaatagagttttttttttgtacgtgatttttaatttgtagtttttaata

SEQ ID NO: 18598 - DNA, 594 bp, Artificial Sequence
  chemically treated genomic DNA (Homo sapiens) CpG-island No: 18598
tattaaaaactacaaattaaaaatcacgtacaaaaaaaaaactctattctaaacctacactataaaaaaatcaataaaatacgaaaacgtcgaaacgaaacgaaacctatattccgatatccccacgcctccaacaaaaaacgcccgaactaaaaacgaaaaatcaaaccgcgcctaataccatccgaacaaaacctacgcgcgccccgccccgccattaaccgtaccgccccgcgccgccgccccatcccgcccctcgccgccgaatccgacgcgttaaaaccaataaaaaccgccgccgttattcccgtcacgaccgaaacaaccaattataacgacgctcgacgactcgtaactctttcgcgacaaaaaaaatttaacgcgtaaaaataaccgaaactttacaaacaacgacgaccgaaaacgaaacgaaatcgaaccctcgccgaaacctaccgccataaacccgcgccgccgccgccgcctatcacccgaaccgcgcgaaccgtaaacgtcataaccttaaccgaaacccctacgaacgacccatacgcgccgacgctaaaaaccctactcgaaaccgacgcgctacga

SEQ ID NO: 18599 - DNA, 594 bp, Artificial Sequence
  chemically treated genomic DNA (Homo sapiens) CpG-island No: 18599
tgttgggggttataggttgagggttacgtgtagaagagaggttttgttttgaatttgtattatagaaaggttagtgggatgcgggagcgtcggggcggggcggggtttatgtttcggtgtttttacgtttttagtaggggacgttcgggttgggggcggggagttagatcgcgtttggtattattcggataaagtttgcgcgcgtttcgtttcgttattggtcgtatcgtttcgcgtcgtcgttttatttcgtttttcgtcgtcgggttcggcgcgttaaagttaataggaatcgtcgtcgttgttttcgttacggtcggggtagttaattgtggcggcgttcggcggttcgtggttttttcgcggtaaaaaggatttggcgcgtaaaagtggtcgggattttgtaggtagcggcggtcgggggcggagcgggatcgagttttcgtcgaggtttgtcgttatgggttcgcgtcgtcgtcgtcgtttgttattcgggtcgcgcgggtcgtgagcgttatggttttggtcggggtttttgcgggcggtttatgcgcgtcggcgttggaggttttgttcggggtcggcgcgttgcgg

SEQ ID NO: 18600 - DNA, 594 bp, Artificial Sequence
  chemically treated genomic DNA (Homo sapiens) CpG-island No: 18600
ccgcaacgcgccgaccccgaacaaaacctccaacgccgacgcgcataaaccgcccgcaaaaaccccgaccaaaaccataacgctcacgacccgcgcgacccgaataacaaacgacgacgacgacgcgaacccataacgacaaacctcgacgaaaactcgatcccgctccgcccccgaccgccgctacctacaaaatcccgaccacttttacgcgccaaatcctttttaccgcgaaaaaaccacgaaccgccgaacgccgccacaattaactaccccgaccgtaacgaaaacaacgacgacgattcctattaactttaacgcgccgaacccgacgacgaaaaacgaaataaaacgacgacgcgaaacgatacgaccaataacgaaacgaaacgcgcgcaaactttatccgaataataccaaacgcgatctaactccccgcccccaacccgaacgtcccctactaaaaacgtaaaaacaccgaaacataaaccccgccccgccccgacgctcccgcatcccactaacctttctataatacaaattcaaaacaaaacctctcttctacacgtaaccctcaacctataacccccaaca

SEQ ID NO: 18601 - DNA, 704 bp, Artificial Sequence
  chemically treated genomic DNA (Homo sapiens) CpG-island No: 18601
cgtttagtcggaaggtggtttggtgttacgagtgattcgcgtagatgggcgtggcgtggtatacgttcgcgttcgtttttacggttagttcgttgaacgcgtcggtggagtagagcgttagtaacgcggtgttagttatgtggtacgcgggtattgttagggtttcgaatagtagtttcgttattttttcgcggttcgcgggcggcgttaacggcgagtcgtttattagtacgggttattgttttgggtatattcgtaggtcgtttattagtaggcgtttttatagtttttttagcgttttttagttcgttattacgtcgtgtttgatggggtgcgttcgcgttacgtcgttcgttagttcgtagttcggcgtttcgggtagtatcggtcggttttagttgggtattaagttagagttttttagtattatgcgcggttggttttcgttcgcgaagttcgttttggtgaagttcgagttttggtttattattatcgcgatgcggtttagggaggacggtcggtgtacgcggcggtttttcgatatcgacgttattttcgggttcggtttagtcgcggggttgaaggtttcgttttttcgcgttattcggtttcgtcggttcgatatttttcggtttttgttttagggagtagttttttttagtttttggttttgttttcggagtttaagtttttttttttttgga

SEQ ID NO: 18602 - DNA, 704 bp, Artificial Sequence
  chemically treated genomic DNA (Homo sapiens) CpG-island No: 18602
tccaaaaaaaaaaaaacttaaactccgaaaacaaaaccaaaaactaaaaaaaactactccctaaaacaaaaaccgaaaaatatcgaaccgacgaaaccgaataacgcgaaaaaacgaaaccttcaaccccgcgactaaaccgaacccgaaaataacgtcgatatcgaaaaaccgccgcgtacaccgaccgtcctccctaaaccgcatcgcgataataataaaccaaaactcgaacttcaccaaaacgaacttcgcgaacgaaaaccaaccgcgcataatactaaaaaactctaacttaatacccaactaaaaccgaccgatactacccgaaacgccgaactacgaactaacgaacgacgtaacgcgaacgcaccccatcaaacacgacgtaataacgaactaaaaaacgctaaaaaaactataaaaacgcctactaataaacgacctacgaatatacccaaaacaataacccgtactaataaacgactcgccgttaacgccgcccgcgaaccgcgaaaaaataacgaaactactattcgaaaccctaacaatacccgcgtaccacataactaacaccgcgttactaacgctctactccaccgacgcgttcaacgaactaaccgtaaaaacgaacgcgaacgtataccacgccacgcccatctacgcgaatcactcgtaacaccaaaccaccttccgactaaacg

SEQ ID NO: 18603 - DNA, 704 bp, Artificial Sequence
  chemically treated genomic DNA (Homo sapiens) CpG-island No: 18603
tttagaagaggaagaatttaggtttcggaggtagagttaaaggttgaaggggattattttttaggatagaggtcgggaggtatcgggtcgacgaagtcgagtggcgcggaggagcggagtttttagtttcgcggttgggtcgagttcgaaggtggcgtcggtgtcggggagtcgtcgcgtgtatcggtcgttttttttgggtcgtatcgcggtggtggtggattagggttcgggttttattaaggcgggtttcgcgggcgagaattagtcgcgtatagtgttgaagagttttagtttggtgtttagttgggatcggtcggtgttgttcggagcgtcgggttgcgagttggcgggcggcgtggcgcgggcgtattttattaagtacggcgtggtggcggattgggaggcgttggaagggttgtgggagcgtttgttggtgggcggtttgcgggtgtgtttagagtagtggttcgtgttggtgagcgattcgtcgttggcgtcgttcgcgggtcgcgaaagggtggcggagttgttgttcgagattttggtagtgttcgcgtgttatatggttagtatcgcgttgttggcgttttgttttatcggcgcgtttagcgggttggtcgtggaggcgggcgcgggcgtgtgttacgttacgtttatttacgcgggttattcgtggtattaggttatttttcgattgaacg

SEQ ID NO: 18604 - DNA, 704 bp, Artificial Sequence
  chemically treated genomic DNA (Homo sapiens) CpG-island No: 18604
cgttcaatcgaaaaataacctaataccacgaataacccgcgtaaataaacgtaacgtaacacacgcccgcgcccgcctccacgaccaacccgctaaacgcgccgataaaacaaaacgccaacaacgcgatactaaccatataacacgcgaacactaccaaaatctcgaacaacaactccgccaccctttcgcgacccgcgaacgacgccaacgacgaatcgctcaccaacacgaaccactactctaaacacacccgcaaaccgcccaccaacaaacgctcccacaacccttccaacgcctcccaatccgccaccacgccgtacttaataaaatacgcccgcgccacgccgcccgccaactcgcaacccgacgctccgaacaacaccgaccgatcccaactaaacaccaaactaaaactcttcaacactatacgcgactaattctcgcccgcgaaacccgccttaataaaacccgaaccctaatccaccaccaccgcgatacgacccaaaaaaaacgaccgatacacgcgacgactccccgacaccgacgccaccttcgaactcgacccaaccgcgaaactaaaaactccgctcctccgcgccactcgacttcgtcgacccgatacctcccgacctctatcctaaaaaataatccccttcaacctttaactctacctccgaaacctaaattcttcctcttctaaa

SEQ ID NO: 18605 - DNA, 588 bp, Artificial Sequence
  chemically treated genomic DNA (Homo sapiens) CpG-island No: 18605
ttcgatttcgcgtttagacgttttcgatagggttcgtaggcgttagggttgttacgtattttttattgggcggggttcgggttaagcgtttaaagttgcgggcgagggtagcggtatcgtttgcgcggttgtttttcggcggggtcggtttcgcggggagtttttttcggggatcggaagcgcgagagtagtcgcggttagtttagagttgttttggtttcgttttttttcggtcgtcgcgttttttgtcgtcgtagtagtagtagtatcggtattttcggttcgcgttcgttattttcgttcgtttcgcgtaatttgggtgtcgtcggggagtttagtttagcgtcggacgcgtagttaattcgttgtttagcgttggttagcggttgtcgtttgtttagggggagaattagtacgattttggtttgggggtggaataggggcgtgaggcgggagagcgcgttagggtcgagtttacgattcggggtcgtttcgcgttttttttgggattttcgtttattcgggttttgtcgtttattcgggttttgttattttttcgtgtatagggttggaggggatttttgttta

SEQ ID NO: 18606 - DNA, 588 bp, Artificial Sequence
  chemically treated genomic DNA (Homo sapiens) CpG-island No: 18606
taaacaaaaatcccctccaaccctatacacgaaaaaataacaaaacccgaataaacgacaaaacccgaataaacgaaaatcccaaaaaaaacgcgaaacgaccccgaatcgtaaactcgaccctaacgcgctctcccgcctcacgcccctattccacccccaaaccaaaatcgtactaattctccccctaaacaaacgacaaccgctaaccaacgctaaacaacgaattaactacgcgtccgacgctaaactaaactccccgacgacacccaaattacgcgaaacgaacgaaaataacgaacgcgaaccgaaaataccgatactactactactacgacgacaaaaaacgcgacgaccgaaaaaaaacgaaaccaaaacaactctaaactaaccgcgactactctcgcgcttccgatccccgaaaaaaactccccgcgaaaccgaccccgccgaaaaacaaccgcgcaaacgataccgctaccctcgcccgcaactttaaacgcttaacccgaaccccgcccaataaaaaatacgtaacaaccctaacgcctacgaaccctatcgaaaacgtctaaacgcgaaatcgaa

SEQ ID NO: 18607 - DNA, 588 bp, Artificial Sequence
  chemically treated genomic DNA (Homo sapiens) CpG-island No: 18607
tggataggggttttttttagttttgtgtacgagaggatgataggattcgggtggacgataggattcgggtggacgagggttttaggagaagcgcggagcggtttcgggtcgtgggttcggttttagcgcgttttttcgttttacgtttttgttttatttttagattaggatcgtgttgattttttttttggataagcggtagtcgttggttaacgttgggtaacggattgattacgcgttcggcgttgggttgggtttttcggcggtatttagattgcgcggagcgggcgaaggtagcgagcgcgagtcgaggatgtcggtattgttgttgttgcggcggtaagaggcgcggcggtcggaagagggcggggttagggtagttttgagttggtcgcggttgttttcgcgttttcggttttcggggaaggtttttcgcgaagtcggtttcgtcgaggagtagtcgcgtaaacggtgtcgttgttttcgttcgtagttttaaacgtttggttcggatttcgtttaataaagagtgcgtggtaattttggcgtttgcgaattttgtcggaggcgtttgggcgcggagtcggg

SEQ ID NO: 18608 - DNA, 588 bp, Artificial Sequence
  chemically treated genomic DNA (Homo sapiens) CpG-island No: 18608
cccgactccgcgcccaaacgcctccgacaaaattcgcaaacgccaaaattaccacgcactctttattaaacgaaatccgaaccaaacgtttaaaactacgaacgaaaacaacgacaccgtttacgcgactactcctcgacgaaaccgacttcgcgaaaaaccttccccgaaaaccgaaaacgcgaaaacaaccgcgaccaactcaaaactaccctaaccccgccctcttccgaccgccgcgcctcttaccgccgcaacaacaacaataccgacatcctcgactcgcgctcgctaccttcgcccgctccgcgcaatctaaataccgccgaaaaacccaacccaacgccgaacgcgtaatcaatccgttacccaacgttaaccaacgactaccgcttatccaaaaaaaaaatcaacacgatcctaatctaaaaataaaacaaaaacgtaaaacgaaaaaacgcgctaaaaccgaacccacgacccgaaaccgctccgcgcttctcctaaaaccctcgtccacccgaatcctatcgtccacccgaatcctatcatcctctcgtacacaaaactaaaaaaaacccctatcca

SEQ ID NO: 18609 - DNA, 744 bp, Artificial Sequence
  chemically treated genomic DNA (Homo sapiens) CpG-island No: 18609
tacggcgggtttttggtattatattgtggtcgtatgtgtatattgtagttttcgttcgtatttgggggtcgtagtcgttagcgttcggggatttagttgcggcgaaagttgtcgggcgcgcgtttcgtcgtagtttcgcgttttcgttaaaatttagtgagaaattatttgtatttttggagtttgtaggagcgagaaatgagttgtaggagtcggtgggtagtaacggcggtaggcggatggaagagagtaaggggtcgtcgttcgtgttttattcgttcgagttaaggggcggttttttaaaattttaacgttattgttttttcggggtcggtaggtgtgaaaattcggcggtagaatggaagttcggtagtttgcgagggttcgcggtttttttaggcgcgtagttgagtttttttaatttcgtttcgggttcgtttgttttcgggtttcggcgcggcgttatttggcggtcgtttgtggaggttgtagttgtcgttaagttacggggatgttgtcggttttaggtgttttcggtcgagttttcgcggagaggaggattggtagattataggaaacgggaggacggcgttgggtttttagtaggcgttttagttttttggtttgtcgtaagagtagtcggaggcggcggcggtagggagggagcgggtggggagtgggagaggtcgttcgttttttcgtttagttcggaggattttttagttggtttttttatcgttaaaa

SEQ ID NO: 18610 - DNA, 744 bp, Artificial Sequence
  chemically treated genomic DNA (Homo sapiens) CpG-island No: 18610
ttttaacgataaaaaaaccaactaaaaaatcctccgaactaaacgaaaaaacgaacgacctctcccactccccacccgctccctccctaccgccgccgcctccgactactcttacgacaaaccaaaaaactaaaacgcctactaaaaacccaacgccgtcctcccgtttcctataatctaccaatcctcctctccgcgaaaactcgaccgaaaacacctaaaaccgacaacatccccgtaacttaacgacaactacaacctccacaaacgaccgccaaataacgccgcgccgaaacccgaaaacaaacgaacccgaaacgaaattaaaaaaactcaactacgcgcctaaaaaaaccgcgaaccctcgcaaactaccgaacttccattctaccgccgaattttcacacctaccgaccccgaaaaaacaataacgttaaaattttaaaaaaccgccccttaactcgaacgaataaaacacgaacgacgaccccttactctcttccatccgcctaccgccgttactacccaccgactcctacaactcatttctcgctcctacaaactccaaaaatacaaataatttctcactaaattttaacgaaaacgcgaaactacgacgaaacgcgcgcccgacaactttcgccgcaactaaatccccgaacgctaacgactacgacccccaaatacgaacgaaaactacaatatacacatacgaccacaatataataccaaaaacccgccgta

SEQ ID NO: 18611 - DNA, 744 bp, Artificial Sequence
  chemically treated genomic DNA (Homo sapiens) CpG-island No: 18611
ttttgacggtgagggaattagttgggaggtttttcgagttggacggggaggcgggcggttttttttattttttattcgttttttttttgtcgtcgtcgttttcggttgtttttgcgataagttaagaagttggggcgtttgttgggagtttagcgtcgttttttcgttttttgtgatttattagttttttttttcgcggaggttcggtcgggggtatttgaggtcggtagtattttcgtggtttggcggtagttgtaatttttatagacggtcgttaggtggcgtcgcgtcggggttcgggagtaggcgggttcggggcggggttggagggatttagttacgcgtttggggaggtcgcgggttttcgtagattatcgaatttttattttgtcgtcgggtttttatatttgtcggtttcgaggaaataatgacgttgggattttggggggtcgttttttgattcgggcgaatgggatacgaacggcgattttttgtttttttttattcgtttgtcgtcgttgttgtttatcgatttttatagtttatttttcgtttttgtaggttttaggaatgtaaataattttttattgggttttggcgggggcgcggagttgcggcgaagcgcgcgttcgatagttttcgtcgtagttgggttttcgggcgttggcggttgcggtttttagatacgggcggaggttgtaatatgtatatgcggttatagtgtggtgttaggggttcgtcgtg

SEQ ID NO: 18612 - DNA, 744 bp, Artificial Sequence
  chemically treated genomic DNA (Homo sapiens) CpG-island No: 18612
cacgacgaacccctaacaccacactataaccgcatatacatattacaacctccgcccgtatctaaaaaccgcaaccgccaacgcccgaaaacccaactacgacgaaaactatcgaacgcgcgcttcgccgcaactccgcgcccccgccaaaacccaataaaaaattatttacattcctaaaacctacaaaaacgaaaaataaactataaaaatcgataaacaacaacgacgacaaacgaataaaaaaaaacaaaaaatcgccgttcgtatcccattcgcccgaatcaaaaaacgaccccccaaaatcccaacgtcattatttcctcgaaaccgacaaatataaaaacccgacgacaaaataaaaattcgataatctacgaaaacccgcgacctccccaaacgcgtaactaaatccctccaaccccgccccgaacccgcctactcccgaaccccgacgcgacgccacctaacgaccgtctataaaaattacaactaccgccaaaccacgaaaatactaccgacctcaaatacccccgaccgaacctccgcgaaaaaaaaaactaataaatcacaaaaaacgaaaaaacgacgctaaactcccaacaaacgccccaacttcttaacttatcgcaaaaacaaccgaaaacgacgacgacaaaaaaaaaacgaataaaaaataaaaaaaaccgcccgcctccccgtccaactcgaaaaacctcccaactaattccctcaccgtcaaaa

SEQ ID NO: 18613 - DNA, 655 bp, Artificial Sequence
  chemically treated genomic DNA (Homo sapiens) CpG-island No: 18613
tttcgaaatttagcggttcggtcgtttttaaaggttaggcggaatatacgtttatatcgcggtttttttttcgaagtaagatcgtcgggttacggtcgtttttaggaagtttcgcgtttcgtattttatattcggggatataaataggcgtcgggtagtcgcgagggtcggcgcggcgtttttaagaggcggcgggcggcgttgttttttggcggtcgtttcgtcgttttttcgtcgtcgcgggtttaagcggggcggtcgggttagcgcggggcggcggcgggtaggggcggcgagtgcgcgggcgttcgtcgtcgtttttttcggcgggtagcgcgcgaggattaggtcgaggaggaagtggcggcggcggcggcgggtgaggatttttggtcgggtcgagtggtcgcgtgcgtttcgtcggggtttaagcgcgtttaggggttacggttcggttgggaatattagagggcgaggattcgggcgggaggaggagggaggaagggttcggaggtcgcgtttttgtcgtcgtttgagggcgtgtggttcgggttcgcgcggcgggagggcgggtagggcgggggcggtgtttgcggaggttcggtttttttttttgcgggttttggttttagtttcgatttagatttaggtttag

SEQ ID NO: 18614 - DNA, 655 bp, Artificial Sequence
  chemically treated genomic DNA (Homo sapiens) CpG-island No: 18614
ctaaacctaaatctaaatcgaaactaaaaccaaaacccgcaaaaaaaaaaaccgaacctccgcaaacaccgcccccgccctacccgccctcccgccgcgcgaacccgaaccacacgccctcaaacgacgacaaaaacgcgacctccgaacccttcctccctcctcctcccgcccgaatcctcgccctctaatattcccaaccgaaccgtaacccctaaacgcgcttaaaccccgacgaaacgcacgcgaccactcgacccgaccaaaaatcctcacccgccgccgccgccgccacttcctcctcgacctaatcctcgcgcgctacccgccgaaaaaaacgacgacgaacgcccgcgcactcgccgcccctacccgccgccgccccgcgctaacccgaccgccccgcttaaacccgcgacgacgaaaaaacgacgaaacgaccgccaaaaaacaacgccgcccgccgcctcttaaaaacgccgcgccgaccctcgcgactacccgacgcctatttatatccccgaatataaaatacgaaacgcgaaacttcctaaaaacgaccgtaacccgacgatcttacttcgaaaaaaaaaccgcgatataaacgtatattccgcctaacctttaaaaacgaccgaaccgctaaatttcgaaa

SEQ ID NO: 18615 - DNA, 655 bp, Artificial Sequence
  chemically treated genomic DNA (Homo sapiens) CpG-island No: 18615
ttgagtttgagtttgagtcggagttggggttagggttcgtaggaggggaagtcgggttttcgtagatatcgttttcgttttgttcgttttttcgtcgcgcgggttcgagttatacgtttttaggcggcggtagaagcgcggttttcgagttttttttttttttttttttcgttcgggttttcgttttttgatgtttttagtcgggtcgtaatttttgggcgcgtttggatttcggcggggcgtacgcggttattcggttcggttagagatttttattcgtcgtcgtcgtcgttatttttttttcggtttggttttcgcgcgttgttcgtcgagaagggcggcggcgagcgttcgcgtattcgtcgtttttgttcgtcgtcgtttcgcgttggttcggtcgtttcgtttgagttcgcggcggcgaggaagcggcggggcggtcgttagggggtagcgtcgttcgtcgttttttaaaggcgtcgcgtcggttttcgcggttattcggcgtttgtttgtgttttcgggtgtggggtgcggggcgcggggttttttgggggcggtcgtggttcggcggttttatttcgggaagggagtcgcggtgtgggcgtgtgtttcgtttggtttttgggggcgatcgagtcgttgagtttcggaa

SEQ ID NO: 18616 - DNA, 655 bp, Artificial Sequence
  chemically treated genomic DNA (Homo sapiens) CpG-island No: 18616
ttccgaaactcaacgactcgatcgcccccaaaaaccaaacgaaacacacgcccacaccgcgactcccttcccgaaataaaaccgccgaaccacgaccgcccccaaaaaaccccgcgccccgcaccccacacccgaaaacacaaacaaacgccgaataaccgcgaaaaccgacgcgacgcctttaaaaaacgacgaacgacgctaccccctaacgaccgccccgccgcttcctcgccgccgcgaactcaaacgaaacgaccgaaccaacgcgaaacgacgacgaacaaaaacgacgaatacgcgaacgctcgccgccgcccttctcgacgaacaacgcgcgaaaaccaaaccgaaaaaaaaataacgacgacgacgacgaataaaaatctctaaccgaaccgaataaccgcgtacgccccgccgaaatccaaacgcgcccaaaaattacgacccgactaaaaacatcaaaaaacgaaaacccgaacgaaaaaaaaaaaaaaaaaaaactcgaaaaccgcgcttctaccgccgcctaaaaacgtataactcgaacccgcgcgacgaaaaaacgaacaaaacgaaaacgatatctacgaaaacccgacttcccctcctacgaaccctaaccccaactccgactcaaactcaaactcaa

SEQ ID NO: 18617 - DNA, 838 bp, Artificial Sequence
  chemically treated genomic DNA (Homo sapiens) CpG-island No: 18617
tgcggtaaggcgggaatagggatagtcgggtcgggaaggggaggttcggcgggagcgggggagaggaggttcgggtcgcgcgtttatttgagagtaggagtatttttcggagtcgttgtcgtttaggatagcgtacgttttattttttagtttttcgttttttttaaggacgtcgattaacgatattacgggttttagtttcgattgtcgtttagcggcgttttcggtttcggttatttttaattgttagtcgaatagcggttcggtttcggcggaggcgggaaaagcggtcgtgaggggcgtagtcggaggaggtggggttcgagtgttaggaattaatgataaggaaaaaaagcgaaggaagggggaggagcgattttcgataaacggatgttattttttttttttttttcgtttgcgtcggacgcgggttgattttcgttttcgggtggcgtttttcggtgtcgtgttttggaagtttagcggttattatggagttgttgggagagtacgtcgggtaggaagggaagtcgtagaagttgcgggtgttttgtgaggcgtcgggtgacggcgattttttttagggtttgttgtttggcgtggtttagatgaaggatatggtaacggaattattcgattttttggtatagggggaagtgtagtatcgggtggcggcggttttagacgaggatttggacggtgagttttgagacggtgttgtagtgatcggaggacggggcgggcgtttaggggaaattggtttggggagttcgtgtagagtggtagatttggataaagtgagtttcgaggaaagaagaattgtatttaaaaatttttg

SEQ ID NO: 18618 - DNA, 838 bp, Artificial Sequence
  chemically treated genomic DNA (Homo sapiens) CpG-island No: 18618
caaaaatttttaaatacaattcttctttcctcgaaactcactttatccaaatctaccactctacacgaactccccaaaccaatttcccctaaacgcccgccccgtcctccgatcactacaacaccgtctcaaaactcaccgtccaaatcctcgtctaaaaccgccgccacccgatactacacttccccctataccaaaaaatcgaataattccgttaccatatccttcatctaaaccacgccaaacaacaaaccctaaaaaaaatcgccgtcacccgacgcctcacaaaacacccgcaacttctacgacttcccttcctacccgacgtactctcccaacaactccataataaccgctaaacttccaaaacacgacaccgaaaaacgccacccgaaaacgaaaatcaacccgcgtccgacgcaaacgaaaaaaaaaaaaaaaataacatccgtttatcgaaaatcgctcctcccccttccttcgctttttttccttatcattaattcctaacactcgaaccccacctcctccgactacgcccctcacgaccgcttttcccgcctccgccgaaaccgaaccgctattcgactaacaattaaaaataaccgaaaccgaaaacgccgctaaacgacaatcgaaactaaaacccgtaatatcgttaatcgacgtccttaaaaaaaacgaaaaactaaaaaataaaacgtacgctatcctaaacgacaacgactccgaaaaatactcctactctcaaataaacgcgcgacccgaacctcctctcccccgctcccgccgaacctccccttcccgacccgactatccctattcccgccttaccgca

SEQ ID NO: 18619 - DNA, 838 bp, Artificial Sequence
  chemically treated genomic DNA (Homo sapiens) CpG-island No: 18619
taaaaatttttagatgtaattttttttttttcgaggtttattttgtttaagtttgttattttatacgggttttttaagttaattttttttgggcgttcgtttcgtttttcggttattgtagtatcgttttagagtttatcgtttaagttttcgtttggagtcgtcgttattcggtgttgtatttttttttgtattagagggtcgaataatttcgttattatgttttttatttgggttacgttagataataggttttggaaagggtcgtcgttattcggcgttttataggatattcgtagtttttgcggtttttttttttgttcgacgtatttttttagtagttttatggtgatcgttaagtttttagaatacgatatcgggaagcgttattcggaggcggaaattagttcgcgttcggcgtaggcgggagaagggagaggagtgatattcgtttgtcggaagtcgttttttttttttttttcgttttttttttttgttattggtttttggtattcgggttttatttttttcggttacgttttttacggtcgtttttttcgttttcgtcggggtcgagtcgttgttcggttgatagttgaggatggtcggagtcgagggcgtcgttgggcggtagtcggagttggagttcgtggtatcgttggtcgacgtttttgaggaggacgaggagttggagaatgaggcgtgcgttgttttgggcggtagcgatttcgagaagtgtttttatttttaggtgggcgcgcggttcgggttttttttttttcgttttcgtcgaatttttttttttcggttcggttgtttttattttcgttttgtcgta

SEQ ID NO: 18620 - DNA, 838 bp, Artificial Sequence
  chemically treated genomic DNA (Homo sapiens) CpG-island No: 18620
tacgacaaaacgaaaataaaaacaaccgaaccgaaaaaaaaaaattcgacgaaaacgaaaaaaaaaaaacccgaaccgcgcgcccacctaaaaataaaaacacttctcgaaatcgctaccgcccaaaacaacgcacgcctcattctccaactcctcgtcctcctcaaaaacgtcgaccaacgataccacgaactccaactccgactaccgcccaacgacgccctcgactccgaccatcctcaactatcaaccgaacaacgactcgaccccgacgaaaacgaaaaaaacgaccgtaaaaaacgtaaccgaaaaaaataaaacccgaataccaaaaaccaataacaaaaaaaaaaaacgaaaaaaaaaaaaaaaacgacttccgacaaacgaatatcactcctctcccttctcccgcctacgccgaacgcgaactaatttccgcctccgaataacgcttcccgatatcgtattctaaaaacttaacgatcaccataaaactactaaaaaaatacgtcgaacaaaaaaaaaaaccgcaaaaactacgaatatcctataaaacgccgaataacgacgaccctttccaaaacctattatctaacgtaacccaaataaaaaacataataacgaaattattcgaccctctaatacaaaaaaaaatacaacaccgaataacgacgactccaaacgaaaacttaaacgataaactctaaaacgatactacaataaccgaaaaacgaaacgaacgcccaaaaaaaattaacttaaaaaacccgtataaaataacaaacttaaacaaaataaacctcgaaaaaaaaaaaattacatctaaaaattttta

SEQ ID NO: 18621 - DNA, 684 bp, Artificial Sequence
  chemically treated genomic DNA (Homo sapiens) CpG-island No: 18621
tcggattttatttttttgtttcgtggtggttagttcgttcgtcgtttcggatgtcgtcgtagtcggagttttcggttcgggtcggaagcgcgcgcgtttcgttttcgaggttcgttttttatgacgttagatcgttttcgttcgtcgcgtagttttttcgagcgagattaaaataggtggaattcgggttggagtcggagtttcggcggcgcgggtggcggtacgtttttttaggtgggtggttttttgggtttggcgatttagcgttttttagttttgttttttggtgttcgttcgcgattgttatcgttttattatttttcgttgtagatagtattataggtatttggagtatcggtatcggtcgttgtggttttcgagtgttcgttagagtttaggggagtttgttttttcgcgtttcgtcggggttcggttaggtattttggtcgtcggcgtacggacgcgggtacgagtattagattacggtgagtggaagcgggttcgacgcggttttgtaggttcgatattcgttaggtattagggttgggaggggtgaggggcgcgcgtcgtagtgcggttgttttggcgtcgtcgttgggggtagggcgcgcggggtttggggtttgtacgtttgttttggacgttggtatttttagttaatttgtttgttttgttttgtaggtt

SEQ ID NO: 18622 - DNA, 684 bp, Artificial Sequence
  chemically treated genomic DNA (Homo sapiens) CpG-island No: 18622
aacctacaaaacaaaacaaacaaattaactaaaaataccaacgtccaaaacaaacgtacaaaccccaaaccccgcgcgccctacccccaacgacgacgccaaaacaaccgcactacgacgcgcgcccctcacccctcccaaccctaatacctaacgaatatcgaacctacaaaaccgcgtcgaacccgcttccactcaccgtaatctaatactcgtacccgcgtccgtacgccgacgaccaaaatacctaaccgaaccccgacgaaacgcgaaaaaacaaactcccctaaactctaacgaacactcgaaaaccacaacgaccgataccgatactccaaatacctataatactatctacaacgaaaaataataaaacgataacaatcgcgaacgaacaccaaaaaacaaaactaaaaaacgctaaatcgccaaacccaaaaaaccacccacctaaaaaaacgtaccgccacccgcgccgccgaaactccgactccaacccgaattccacctattttaatctcgctcgaaaaaactacgcgacgaacgaaaacgatctaacgtcataaaaaacgaacctcgaaaacgaaacgcgcgcgcttccgacccgaaccgaaaactccgactacgacgacatccgaaacgacgaacgaactaaccaccacgaaacaaaaaaataaaatccga

SEQ ID NO: 18623 - DNA, 684 bp, Artificial Sequence
  chemically treated genomic DNA (Homo sapiens) CpG-island No: 18623
agtttgtaagatagagtagataggttagttaaaggtgttaacgtttagggtaagcgtgtaggttttaagtttcgcgcgttttgtttttagcggcgacgttagggtagtcgtattgcggcgcgcgttttttattttttttagttttggtgtttggcggatgtcgggtttgtagggtcgcgtcgggttcgtttttatttatcgtgatttagtgttcgtgttcgcgttcgtgcgtcggcggttaaggtgtttggtcgggtttcgacgaggcgcgggagggtaggtttttttaggttttgacggatattcgggggttatagcgatcgatgtcggtattttaggtgtttgtggtattgtttgtaacgagaagtgatggggcgatgatagtcgcgagcgggtattagggggtaaggttgaggagcgttgagtcgttagatttagagagttatttatttggagggacgtgtcgttattcgcgtcgtcggagtttcggttttagttcggattttatttgttttggtttcgttcggggaagttgcgcggcgggcgggggcgatttgacgttatgaggggcgggtttcgggggcggggcgcgcgcgttttcggttcgagtcggaagtttcgattgcggcggtattcgggacggcgggcgggttggttattacgggataggaaggtgagattcgg

SEQ ID NO: 18624 - DNA, 684 bp, Artificial Sequence
  chemically treated genomic DNA (Homo sapiens) CpG-island No: 18624
ccgaatctcaccttcctatcccgtaataaccaacccgcccgccgtcccgaataccgccgcaatcgaaacttccgactcgaaccgaaaacgcgcgcgccccgcccccgaaacccgcccctcataacgtcaaatcgcccccgcccgccgcgcaacttccccgaacgaaaccaaaacaaataaaatccgaactaaaaccgaaactccgacgacgcgaataacgacacgtccctccaaataaataactctctaaatctaacgactcaacgctcctcaaccttaccccctaatacccgctcgcgactatcatcgccccatcacttctcgttacaaacaataccacaaacacctaaaataccgacatcgatcgctataacccccgaatatccgtcaaaacctaaaaaaacctaccctcccgcgcctcgtcgaaacccgaccaaacaccttaaccgccgacgcacgaacgcgaacacgaacactaaatcacgataaataaaaacgaacccgacgcgaccctacaaacccgacatccgccaaacaccaaaactaaaaaaaataaaaaacgcgcgccgcaatacgactaccctaacgtcgccgctaaaaacaaaacgcgcgaaacttaaaacctacacgcttaccctaaacgttaacacctttaactaacctatctactctatcttacaaact

SEQ ID NO: 18625 - DNA, 559 bp, Artificial Sequence
  chemically treated genomic DNA (Homo sapiens) CpG-island No: 18625
cggtagcggttttttatatataataaatttcggtatgttttcgagcggtttgaggtggagggttttagaaggcgtgacgtggggtcgagagcgggattcgaggttggcgggttttggtagtagttgtggttgcggttgtcgggtttggggacgcgggcggtcgaggtcgtcgtcgtagttttttcgtttcgtcggttatggttgcgttcggtcggttttttagcggtttttttttgagcggcggttcggattttttgtagtcgtcgtagtcggtttttttcggtcgggttttttcgtcgggggttgacggcgtcgagttggtttcgcggtcgggatttcgcgtagtttttagtagtttcgttgggagtgcggcgcgcggacggtgaggagttcgtcgggcgtagggcgtagggcgggcgggcgggcgggtaggttgggcgtttttcgcggcgggcgcgggtaggggcgcgggtttcgcgtcggggttttttgattttttttttacggtttttcgcgggagtttcgtagtttagtttatagatgaagaaattgattttcg

SEQ ID NO: 18626 - DNA, 559 bp, Artificial Sequence
  chemically treated genomic DNA (Homo sapiens) CpG-island No: 18626
cgaaaatcaatttcttcatctataaactaaactacgaaactcccgcgaaaaaccgtaaaaaaaaaatcaaaaaaccccgacgcgaaacccgcgcccctacccgcgcccgccgcgaaaaacgcccaacctacccgcccgcccgcccgccctacgccctacgcccgacgaactcctcaccgtccgcgcgccgcactcccaacgaaactactaaaaactacgcgaaatcccgaccgcgaaaccaactcgacgccgtcaacccccgacgaaaaaacccgaccgaaaaaaaccgactacgacgactacaaaaaatccgaaccgccgctcaaaaaaaaaccgctaaaaaaccgaccgaacgcaaccataaccgacgaaacgaaaaaactacgacgacgacctcgaccgcccgcgtccccaaacccgacaaccgcaaccacaactactaccaaaacccgccaacctcgaatcccgctctcgaccccacgtcacgccttctaaaaccctccacctcaaaccgctcgaaaacataccgaaatttattatatataaaaaaccgctaccg

SEQ ID NO: 18627 - DNA, 559 bp, Artificial Sequence
  chemically treated genomic DNA (Homo sapiens) CpG-island No: 18627
cggggattagtttttttatttgtaaattgggttgcgaagttttcgcggagggtcgtggggagggagttaaaaagtttcggcgcggagttcgcgtttttgttcgcgttcgtcgcgaggggcgtttagtttgttcgttcgttcgttcgttttgcgttttgcgttcgacgggttttttatcgttcgcgcgtcgtatttttagcgggattgttagggattgcgcgaggtttcggtcgcggggttaattcggcgtcgttagttttcggcgggaaggttcggtcggggaaggtcggttgcggcggttgtaggaagttcgagtcgtcgtttagagggaggtcgttgaagggtcggtcgagcgtagttatagtcggcgagacgaggaggttgcgacggcggtttcggtcgttcgcgtttttaggttcggtagtcgtagttatagttattgttaaaattcgttagtttcggatttcgttttcgattttacgttacgttttttagaattttttattttaggtcgttcgggggtatgtcgggatttgttgtgtgtagagggtcgttgtcg

SEQ ID NO: 18628 - DNA, 559 bp, Artificial Sequence
  chemically treated genomic DNA (Homo sapiens) CpG-island No: 18628
cgacaacgaccctctacacacaacaaatcccgacatacccccgaacgacctaaaataaaaaattctaaaaaacgtaacgtaaaatcgaaaacgaaatccgaaactaacgaattttaacaataactataactacgactaccgaacctaaaaacgcgaacgaccgaaaccgccgtcgcaacctcctcgtctcgccgactataactacgctcgaccgacccttcaacgacctccctctaaacgacgactcgaacttcctacaaccgccgcaaccgaccttccccgaccgaaccttcccgccgaaaactaacgacgccgaattaaccccgcgaccgaaacctcgcgcaatccctaacaatcccgctaaaaatacgacgcgcgaacgataaaaaacccgtcgaacgcaaaacgcaaaacgaacgaacgaacgaacaaactaaacgcccctcgcgacgaacgcgaacaaaaacgcgaactccgcgccgaaactttttaactccctccccacgaccctccgcgaaaacttcgcaacccaatttacaaataaaaaaactaatccccg

SEQ ID NO: 18629 - DNA, 1235 bp, Artificial Sequence
  chemically treated genomic DNA (Homo sapiens) CpG-island No: 18629
cgtttttagagaggacgtttatcgttcggagtaggttgcggtttcggttttcgtcgaattttagtaatcgcgaggagaaatgtttgtcgtagggggcggagcgtagcgggggcggagcgcggacgaaggggcggagcgaggacgaaggggcggagtagaaacgacgggcggggggcggagcgagaataatggggtggagtaagacggcgggcgggggcggagcgaggacgacggggcggagcgtagatcgcgggcggggggcggagttgggatgatggggaggagcgaggataaaggggcggagtatagatagaaataggggcggggaggggaggggcgttttcggtttttgggattcgtttttcgtcgtaggcgcgtttgtttcgtttttttattttttacggcggcggttgcggaggtcgagggcggggagggaggggagagcgggttacgacgttgtcggggcggggataattttttacgtggagtagatgaaagggtcgcggcgcgacggtcgggggagtcgagttgagtttgcgatttataaagtcgtcgtcgtcgtcgtcgtgatggggttgtgaggcgttcgttcgcgttcggtttttagtcggttcgcgattatgttcggtcgcgttcgtttttcgcgttttttcgtcgtaggattatgaggtcgcgttcgggcgggcgtttaggggttacgggtcgtcgtcgtcgtcgtttgcgtcgtcgttttcgcggttttcggtgtagtcgtttgtcgtcgtcgtcgtcgttgtcgttgttgttcgggttgttgttggcggtcgcggggttcggcgcggcgcgggttaaggagacggcgttcgtggaggtggtgttgttcgagtcgagtttaagcggcgattatattatttatattatcggttttacgggtcgtttttcgcgggtcggggttacgtttagcgtcgagggcgagatcgtgtaggtagttgttcgtcgttcgggtttcgcgtcgttttcgttataagatggtttcgggggttgcgttcgtcgatttcgtcgcgggttgtttgattggcgggcgggcgggaggggtggtcgagaggtcggcggtattttttttttgcgggcgggtaggcgggcgggacgcggttttcggggcgtattcgcggggggcgagcgtacgtgggggttagagtttttgtgaatttcggggcgggaggggtattttgggttcggtatttatgttggggtag

SEQ ID NO: 18630 - DNA, 1235 bp, Artificial Sequence
  chemically treated genomic DNA (Homo sapiens) CpG-island No: 18630
ctaccccaacataaataccgaacccaaaatacccctcccgccccgaaattcacaaaaactctaacccccacgtacgctcgccccccgcgaatacgccccgaaaaccgcgtcccgcccgcctacccgcccgcaaaaaaaaaataccgccgacctctcgaccacccctcccgcccgcccgccaatcaaacaacccgcgacgaaatcgacgaacgcaacccccgaaaccatcttataacgaaaacgacgcgaaacccgaacgacgaacaactacctacacgatctcgccctcgacgctaaacgtaaccccgacccgcgaaaaacgacccgtaaaaccgataatataaataatataatcgccgcttaaactcgactcgaacaacaccacctccacgaacgccgtctccttaacccgcgccgcgccgaaccccgcgaccgccaacaacaacccgaacaacaacgacaacgacgacgacgacgacaaacgactacaccgaaaaccgcgaaaacgacgacgcaaacgacgacgacgacgacccgtaacccctaaacgcccgcccgaacgcgacctcataatcctacgacgaaaaaacgcgaaaaacgaacgcgaccgaacataatcgcgaaccgactaaaaaccgaacgcgaacgaacgcctcacaaccccatcacgacgacgacgacgacgactttataaatcgcaaactcaactcgactcccccgaccgtcgcgccgcgaccctttcatctactccacgtaaaaaattatccccgccccgacaacgtcgtaacccgctctcccctccctccccgccctcgacctccgcaaccgccgccgtaaaaaataaaaaaacgaaacaaacgcgcctacgacgaaaaacgaatcccaaaaaccgaaaacgcccctcccctccccgcccctatttctatctatactccgcccctttatcctcgctcctccccatcatcccaactccgccccccgcccgcgatctacgctccgccccgtcgtcctcgctccgcccccgcccgccgtcttactccaccccattattctcgctccgccccccgcccgtcgtttctactccgccccttcgtcctcgctccgccccttcgtccgcgctccgcccccgctacgctccgccccctacgacaaacatttctcctcgcgattactaaaattcgacgaaaaccgaaaccgcaacctactccgaacgataaacgtcctctctaaaaacg

SEQ ID NO: 18631 - DNA, 1235 bp, Artificial Sequence
  chemically treated genomic DNA (Homo sapiens) CpG-island No: 18631
ttgttttagtatgggtgtcgggtttaggatgtttttttcgtttcggggtttataggagttttagtttttacgtgcgttcgtttttcgcggatgcgtttcggaggtcgcgtttcgttcgtttgttcgttcgtaggggagggatgtcgtcggtttttcggttatttttttcgttcgttcgttagttaggtagttcgcggcggggtcggcgggcgtagttttcggagttattttgtggcggaggcggcgcggggttcgggcggcgggtagttatttgtacgatttcgttttcggcgttgagcgtggtttcggttcgcgagaagcggttcgtgaggtcggtggtgtaggtggtgtaatcgtcgtttgggttcgattcgaatagtattatttttacgaacgtcgtttttttggttcgcgtcgcgtcgggtttcgcggtcgttagtagtagttcgagtagtagcggtagcggcggcggcggcggtaggcggttgtatcggaggtcgcgggggcggcggcgtaggcggcggcggcggcggttcgtggtttttgggcgttcgttcgagcgcggttttatggttttgcggcgggagggcgcggagggcgggcgcggtcgggtatagtcgcgggtcggttgaggatcgaacgcgggcggacgttttatagttttattacggcggcggcggcggcggttttgtgggtcgtaggtttagttcggttttttcggtcgtcgcgtcgcggtttttttatttgttttacgtgaggggttattttcgtttcggtagcgtcgtgattcgttttttttttttttttcgttttcggttttcgtagtcgtcgtcgtggggagtgagaaggcggggtaggcgcgtttgcggcgagaggcgggttttaaaggtcgagaacgtttttttttttttcgtttttgtttttatttgtgtttcgtttttttattttcgtttttttttattattttagtttcgtttttcgttcgcggtttgcgtttcgtttcgtcgttttcgtttcgttttcgttcgtcgttttgttttattttattattttcgtttcgtttttcgttcgtcgtttttatttcgttttttcgttttcgtttcgttttttcgttcgcgtttcgttttcgttgcgtttcgttttttacggtagatattttttttcgcggttgttagagttcggcgggaatcgggatcgtaatttgtttcgggcgatgggcgttttttttggaggcg

SEQ ID NO: 18632 - DNA, 1235 bp, Artificial Sequence
  chemically treated genomic DNA (Homo sapiens) CpG-island No: 18632
cgcctccaaaaaaaacgcccatcgcccgaaacaaattacgatcccgattcccgccgaactctaacaaccgcgaaaaaaaatatctaccgtaaaaaacgaaacgcaacgaaaacgaaacgcgaacgaaaaaacgaaacgaaaacgaaaaaacgaaataaaaacgacgaacgaaaaacgaaacgaaaataataaaataaaacaaaacgacgaacgaaaacgaaacgaaaacgacgaaacgaaacgcaaaccgcgaacgaaaaacgaaactaaaataataaaaaaaaacgaaaataaaaaaacgaaacacaaataaaaacaaaaacgaaaaaaaaaaaaacgttctcgacctttaaaacccgcctctcgccgcaaacgcgcctaccccgccttctcactccccacgacgacgactacgaaaaccgaaaacgaaaaaaaaaaaaaaaacgaatcacgacgctaccgaaacgaaaataacccctcacgtaaaacaaataaaaaaaccgcgacgcgacgaccgaaaaaaccgaactaaacctacgacccacaaaaccgccgccgccgccgccgtaataaaactataaaacgtccgcccgcgttcgatcctcaaccgacccgcgactatacccgaccgcgcccgccctccgcgccctcccgccgcaaaaccataaaaccgcgctcgaacgaacgcccaaaaaccacgaaccgccgccgccgccgcctacgccgccgcccccgcgacctccgatacaaccgcctaccgccgccgccgccgctaccgctactactcgaactactactaacgaccgcgaaacccgacgcgacgcgaaccaaaaaaacgacgttcgtaaaaataatactattcgaatcgaacccaaacgacgattacaccacctacaccaccgacctcacgaaccgcttctcgcgaaccgaaaccacgctcaacgccgaaaacgaaatcgtacaaataactacccgccgcccgaaccccgcgccgcctccgccacaaaataactccgaaaactacgcccgccgaccccgccgcgaactacctaactaacgaacgaacgaaaaaaataaccgaaaaaccgacgacatccctcccctacgaacgaacaaacgaacgaaacgcgacctccgaaacgcatccgcgaaaaacgaacgcacgtaaaaactaaaactcctataaaccccgaaacgaaaaaaacatcctaaacccgacacccatactaaaacaa

SEQ ID NO: 18633 - DNA, 1542 bp, Artificial Sequence
  chemically treated genomic DNA (Homo sapiens) CpG-island No: 18633
gtcggtcgagtcgggtttcgagattttcgttcgtagttcggtttcgaagttaggtcggtttagggtcgttttattttattttggtattcggtatttttagtttatttttcgggtattattagagttttcgggcgacgcgattacgcgtttagttggggaggaggaagaagggaggcgtaggtcggggagggttattttcgcgtcgcggttttttaggtttcggggagtcgttaggagtggtttgtcggtggtcgtgggaatgagcgtgtttcgaggcggtagttgttgcgcgggataaattcggaagaagtcgcgagacggattgaagtcggttaggagcgtattgcgcggcggggtcgcgggcgttcgattttatttttatttgggcgatgttatagggagtttcgcgttttttatattttagggcgttcgttcgagggggttggggttggaatttcgttgcgtcggtgttttggtttcgcgggcgaggaggaggaggagtaggaggaggagtcgcgggtgaggcgcgaggttatcgtttattcggttcggaggaggcggatttattcggagcgtcgcgcgcgcgtcgggttgagttttgtaaataagtgtttgtgttgtgttttcgcggtttttttcgcgtcggggtcgtttttttcgggtaggagggagtaagggagttttcgtcgcgcggttcgcgagtcgtcgtcgttttcggttcgcgtattttcgcgcgggggtcgcggattcgattaggttgttaggcgtagcgatatcgggtcgcggtgcgagcggcgtttcggttttcgtcgagaggtttttgatagaaaaacgtgcgtggttgtttttatttttgggaggggttgtcggtgtcgcgcgcggtcgtttagtcgttagcgtttttttttgggaggattcgttgtcggaggaaggagtggatttaatttggtcgcgtcgtagaagtggttttcgaggaagtcggcgtcggggtcgtcgtttcgtgttttttcggggcgtagtgttcgggggtcggcgggttagagtcgaggcgcggtcggggagtcgggggttgcggggtcgagcgggtagtcgcgcgagggggcgggcgttcggcgattcgggggtcggtcgggttgagtttcgcgtttcgggacgcgggttggaagcgacggaggagtgttgtcgcgggttgcggattagcgtcgtttttttacggagcggggattttgttatgatagttgggtttttcggagggttaatttgggtgttttcggtaaagttgtcgtcgagtcgggagttcgtgtaggggtcgcggcgtcgcggttcggggggcggtcgggcggtcggcggcggtcgtggttcggcggggttcgcgcggtcggggggtttttgggggtgtgcgtttttagtcggttgttttcgtggatgtttttcggcggcggcgggtttatgaaagattgcgagtatagttagattagtatttatagttttttttttatggagtcgttttataagaagaagaaaatcgcggttcggaggaaa

SEQ ID NO: 18634 - DNA, 1542 bp, Artificial Sequence
  chemically treated genomic DNA (Homo sapiens) CpG-island No: 18634
tttcctccgaaccgcgattttcttcttcttataaaacgactccataaaaaaaaaactataaatactaatctaactatactcgcaatctttcataaacccgccgccgccgaaaaacatccacgaaaacaaccgactaaaaacgcacacccccaaaaaccccccgaccgcgcgaaccccgccgaaccacgaccgccgccgaccgcccgaccgccccccgaaccgcgacgccgcgacccctacacgaactcccgactcgacgacaactttaccgaaaacacccaaattaaccctccgaaaaacccaactatcataacaaaatccccgctccgtaaaaaaacgacgctaatccgcaacccgcgacaacactcctccgtcgcttccaacccgcgtcccgaaacgcgaaactcaacccgaccgacccccgaatcgccgaacgcccgccccctcgcgcgactacccgctcgaccccgcaacccccgactccccgaccgcgcctcgactctaacccgccgacccccgaacactacgccccgaaaaaacacgaaacgacgaccccgacgccgacttcctcgaaaaccacttctacgacgcgaccaaattaaatccactccttcctccgacaacgaatcctcccaaaaaaaaacgctaacgactaaacgaccgcgcgcgacaccgacaacccctcccaaaaataaaaacaaccacgcacgtttttctatcaaaaacctctcgacgaaaaccgaaacgccgctcgcaccgcgacccgatatcgctacgcctaacaacctaatcgaatccgcgacccccgcgcgaaaatacgcgaaccgaaaacgacgacgactcgcgaaccgcgcgacgaaaactcccttactccctcctacccgaaaaaaacgaccccgacgcgaaaaaaaccgcgaaaacacaacacaaacacttatttacaaaactcaacccgacgcgcgcgcgacgctccgaataaatccgcctcctccgaaccgaataaacgataacctcgcgcctcacccgcgactcctcctcctactcctcctcctcctcgcccgcgaaaccaaaacaccgacgcaacgaaattccaaccccaaccccctcgaacgaacgccctaaaatataaaaaacgcgaaactccctataacatcgcccaaataaaaataaaatcgaacgcccgcgaccccgccgcgcaatacgctcctaaccgacttcaatccgtctcgcgacttcttccgaatttatcccgcgcaacaactaccgcctcgaaacacgctcattcccacgaccaccgacaaaccactcctaacgactccccgaaacctaaaaaaccgcgacgcgaaaataaccctccccgacctacgcctcccttcttcctcctccccaactaaacgcgtaatcgcgtcgcccgaaaactctaataatacccgaaaaataaactaaaaataccgaataccaaaataaaataaaacgaccctaaaccgacctaacttcgaaaccgaactacgaacgaaaatctcgaaacccgactcgaccgac

SEQ ID NO: 18635 - DNA, 1542 bp, Artificial Sequence
  chemically treated genomic DNA (Homo sapiens) CpG-island No: 18635
tttttttcgggtcgcgatttttttttttttgtggggcgattttatgggggaggagttgtgggtgttgatttggttgtattcgtagttttttatgggttcgtcgtcgtcgggaggtatttacgagggtagtcggttgggggcgtatatttttaggagtttttcggtcgcgcgggtttcgtcgagttacgatcgtcgtcggtcgttcggtcgtttttcgagtcgcggcgtcgcggtttttatacgggttttcggttcggcgataattttgtcgaggatatttaggttaatttttcggggagtttaattgttatagtagaattttcgtttcgtgaggggacggcgttggttcgtagttcgcggtagtattttttcgtcgtttttagttcgcgtttcggggcgcggggtttagttcggtcggttttcgggtcgtcgagcgttcgttttttcgcgcggttgttcgttcggtttcgtagttttcggtttttcggtcgcgtttcggttttggttcgtcgattttcgagtattgcgtttcgaggggatacgaggcggcggtttcggcgtcggttttttcgggagttatttttgcggcgcggttaggttgggtttattttttttttcggtagcggatttttttaggagagagcgttggcgattgggcggtcgcgcgcggtatcggtaattttttttaggggtggggataattacgtacgtttttttgttaggagtttttcggcgagagtcggggcgtcgttcgtatcgcgattcggtgtcgttgcgtttggtagtttagtcgaattcgcggttttcgcgcggggatgcgcgggtcgagggcggcggcggttcgcgggtcgcgcggcgagggtttttttgtttttttttattcggaggaagcggtttcggcgcgaggagggtcgcggggatatagtatagatatttgtttgtaaggtttagttcggcgcgcgcgcggcgtttcgagtgggttcgtttttttcgggtcgggtgggcggtggtttcgcgttttattcgcggtttttttttttgttttttttttttttcgttcgcgaagttagggtatcggcgtagcgagattttagttttagttttttcgggcgggcgttttggggtgtggaaggcgcggggttttttgtggtatcgtttaagtagggatggggtcgggcgttcgcggtttcgtcgcgtagtgcgtttttggtcgattttagttcgtttcgcggtttttttcgggtttatttcgcgtagtagttgtcgtttcgggatacgtttatttttacggttatcggtaagttatttttggcgatttttcgggatttgaggagtcgcggcgcggaggtgatttttttcggtttgcgtttttttttttttttttttttagttgggcgcgtggtcgcgtcgttcggggattttggtgatgttcgagaaatgggttgggggtgtcgggtgttaggatggggtggggcggttttaggtcggtttgatttcgggatcgggttgcgggcgagggtttcggggttcggttcggtcggt

SEQ ID NO: 18636 - DNA, 1542 bp, Artificial Sequence
  chemically treated genomic DNA (Homo sapiens) CpG-island No: 18636
accgaccgaaccgaaccccgaaaccctcgcccgcaacccgatcccgaaatcaaaccgacctaaaaccgccccaccccatcctaacacccgacacccccaacccatttctcgaacatcaccaaaatccccgaacgacgcgaccacgcgcccaactaaaaaaaaaaaaaaaaaaaaacgcaaaccgaaaaaaatcacctccgcgccgcgactcctcaaatcccgaaaaatcgccaaaaataacttaccgataaccgtaaaaataaacgtatcccgaaacgacaactactacgcgaaataaacccgaaaaaaaccgcgaaacgaactaaaatcgaccaaaaacgcactacgcgacgaaaccgcgaacgcccgaccccatccctacttaaacgataccacaaaaaaccccgcgccttccacaccccaaaacgcccgcccgaaaaaactaaaactaaaatctcgctacgccgataccctaacttcgcgaacgaaaaaaaaaaaaaacaaaaaaaaaaaccgcgaataaaacgcgaaaccaccgcccacccgacccgaaaaaaacgaacccactcgaaacgccgcgcgcgcgccgaactaaaccttacaaacaaatatctatactatatccccgcgaccctcctcgcgccgaaaccgcttcctccgaataaaaaaaaacaaaaaaaccctcgccgcgcgacccgcgaaccgccgccgccctcgacccgcgcatccccgcgcgaaaaccgcgaattcgactaaactaccaaacgcaacgacaccgaatcgcgatacgaacgacgccccgactctcgccgaaaaactcctaacaaaaaaacgtacgtaattatccccacccctaaaaaaaattaccgataccgcgcgcgaccgcccaatcgccaacgctctctcctaaaaaaatccgctaccgaaaaaaaaaataaacccaacctaaccgcgccgcaaaaataactcccgaaaaaaccgacgccgaaaccgccgcctcgtatcccctcgaaacgcaatactcgaaaatcgacgaaccaaaaccgaaacgcgaccgaaaaaccgaaaactacgaaaccgaacgaacaaccgcgcgaaaaaacgaacgctcgacgacccgaaaaccgaccgaactaaaccccgcgccccgaaacgcgaactaaaaacgacgaaaaaatactaccgcgaactacgaaccaacgccgtcccctcacgaaacgaaaattctactataacaattaaactccccgaaaaattaacctaaatatcctcgacaaaattatcgccgaaccgaaaacccgtataaaaaccgcgacgccgcgactcgaaaaacgaccgaacgaccgacgacgatcgtaactcgacgaaacccgcgcgaccgaaaaactcctaaaaatatacgcccccaaccgactaccctcgtaaatacctcccgacgacgacgaacccataaaaaactacgaatacaaccaaatcaacacccacaactcctcccccataaaatcgccccacaaaaaaaaaaaaatcgcgacccgaaaaaaa

SEQ ID NO: 18637 - DNA, 535 bp, Artificial Sequence
  chemically treated genomic DNA (Homo sapiens) CpG-island No: 18637
aaaattcgtcgcgttcgaaggagagtgtggaggggtgcggggcgtcgcgcggtgttcggattttaaggtgggtaggggcgttcggaattttttttcgcgagtttttcgcgttcgtttattttgttcggcgtagagtagaagagttaggatagcggcggacggtatggcggattcgggcgtcgagtagttggcggtgtggggtcgggtatttaggtatcgggcgaggggcggttggattggcggtcggggtcgggttgcggtggtatcggcgcggggttgggggcgtagtgtttcggcgtgcgttcgtttgtcggtcgattttttcgtaagtttttttgtacggggttcgagtattgtagtggtaggagcggtggtagtagtagcgttttcgcgtttcgtttatatatttcgatttcggaaatgacgttagcggtgtcgttttttttttttttttttattttttaggtgtttagttttcgttcgtttttatttttaattttatttttcgttatttttggttttcgtcgtttggagt

SEQ ID NO: 18638 - DNA, 535 bp, Artificial Sequence
  chemically treated genomic DNA (Homo sapiens) CpG-island No: 18638
actccaaacgacgaaaaccaaaaataacgaaaaataaaattaaaaataaaaacgaacgaaaactaaacacctaaaaaataaaaaaaaaaaaaaaaaacgacaccgctaacgtcatttccgaaatcgaaatatataaacgaaacgcgaaaacgctactactaccaccgctcctaccactacaatactcgaaccccgtacaaaaaaacttacgaaaaaatcgaccgacaaacgaacgcacgccgaaacactacgcccccaaccccgcgccgataccaccgcaacccgaccccgaccgccaatccaaccgcccctcgcccgatacctaaatacccgaccccacaccgccaactactcgacgcccgaatccgccataccgtccgccgctatcctaactcttctactctacgccgaacaaaataaacgaacgcgaaaaactcgcgaaaaaaaattccgaacgcccctacccaccttaaaatccgaacaccgcgcgacgccccgcacccctccacactctccttcgaacgcgacgaatttt

SEQ ID NO: 18639 - DNA, 535 bp, Artificial Sequence
  chemically treated genomic DNA (Homo sapiens) CpG-island No: 18639
gttttaagcggcggaggttagaggtagcgaggggtgaggttagaggtgggggcgagcggggattggatatttggggagtggggaaaggggaagggggcggtatcgttgacgttattttcggggtcggggtatataagcggggcgcgagggcgttgttgttgttatcgtttttgttattgtagtgttcgagtttcgtgtaggggagtttgcgggaggatcgatcgatagacgaacgtacgtcgaggtattgcgtttttagtttcgcgtcggtgttatcgtagttcgatttcggtcgttagtttagtcgtttttcgttcggtgtttaggtgttcggttttatatcgttagttgttcggcgttcgggttcgttatgtcgttcgtcgttgttttggtttttttgttttgcgtcgggtaaggtgagcgagcgcggggagttcgcgggagagggtttcgggcgtttttgtttattttgaggttcgggtatcgcgcggcgtttcgtatttttttatattttttttcgggcgcggcgagtttt

SEQ ID NO: 18640 - DNA, 535 bp, Artificial Sequence
  chemically treated genomic DNA (Homo sapiens) CpG-island No: 18640
aaaactcgccgcgcccgaaaaaaaatataaaaaaatacgaaacgccgcgcgatacccgaacctcaaaataaacaaaaacgcccgaaaccctctcccgcgaactccccgcgctcgctcaccttacccgacgcaaaacaaaaaaaccaaaacaacgacgaacgacataacgaacccgaacgccgaacaactaacgatataaaaccgaacacctaaacaccgaacgaaaaacgactaaactaacgaccgaaatcgaactacgataacaccgacgcgaaactaaaaacgcaatacctcgacgtacgttcgtctatcgatcgatcctcccgcaaactcccctacacgaaactcgaacactacaataacaaaaacgataacaacaacaacgccctcgcgccccgcttatataccccgaccccgaaaataacgtcaacgataccgcccccttcccctttccccactccccaaatatccaatccccgctcgcccccacctctaacctcacccctcgctacctctaacctccgccgcttaaaac

SEQ ID NO: 18641 - DNA, 1584 bp, Artificial Sequence
  chemically treated genomic DNA (Homo sapiens) CpG-island No: 18641
tcggtcgtcgcgcgcgttttttcgttcggcgtgtgtttggttcggggaatcgggagggttcggcgatcgcgcggcggtcgtcgcgagggtgtgagcgcgcgtgggcgttcgtcgagtcgaggttatggtgtagtaaattaataatgtcgagaatacggaagcgttgttggtcggcgagagttcggattcgggcgtcggtttcgagttgggaatcgtttttttttttacgttcggttttatcgtttttacgggcggtaaggtcgacgattcgagttggtgtaagatttcgagtgggtatattaagcgatttatgaacgtttttatggtgtggtcgtagatcgagcggcgtaagattatggagtagtcgttcgatatgtataacgtcgagatttttaagcggttgggtaaacgttggaagttgtttaaagatagcgataagattttttttattcgagaggcggagcggttgcgttttaagtatatggttgattatttcgattataagtatcggtttaggaagaaggtgaagttcggtaacgttaattttagtttttcggtcgtcgttttttttaagtcgggggagaagggagataaggtcggtggtagtggcgggggcggttatgggggcggcggcggcggcgggagtagtaacgcggggggaggaggcggcggtgcgagtggcggcggcgttaattttaaatcggcgtagaaaaagagttgcggttttaaagtggcgggcggcgcgggcggtggggttagtaaatcgtacgttaagtttattttggtaggcggcggcggtggcggtaaagtagcggttgttttcgtcgttttttttttcgtcgaataggcgggggtcgtcgttttgttgattttgggcgtcgtcgtcgattattattcgttgtataaggcgcggatttttagcgtttcggttttcgttttttcggtagtttcggttttcgtagcgttcgcggtttcgggtaagtatttggcggagaagaaggtgaagcgcgtttatttgttcggcggtttgggtacgtcgtcgtcgttcgtgggcggcgtgggcgcgggagtcgattttagcgattttttgggtttgtacgaggaggagggcgcgggttgttcgttcgacgcgtttagtttgagcggtcgtagtagcgtcgtttcgtttttcgtcgtcggtcgttcgttcgtcgattatcgcggttacgttagtttgcgcgtcgtttcgttcgtttcgtttagcgcgttttcgtacgcgtttttttcggtttcgttttattttttttttttttttttttcgggtttttcgtttttcgacgacgagttcgaagacgatttgttcgatttgaattttagtttaaattttgagagtatgtttttgggtagttttagttcgtcgtcggcgttcgatcgggatttggattttaatttcgagttcggtttcggttcgtatttcgagttttcggattattgtacgttcgaggtgagcgagatgatttcgggagattggttcgagtttagtatttttaatttggtttttatttattgaagggcgcgtaggtagggagaagggtcggggggggt

SEQ ID NO: 18642 - DNA, 1584 bp, Artificial Sequence
  chemically treated genomic DNA (Homo sapiens) CpG-island No: 18642
accccccccgacccttctccctacctacgcgcccttcaataaataaaaaccaaattaaaaatactaaactcgaaccaatctcccgaaatcatctcgctcacctcgaacgtacaataatccgaaaactcgaaatacgaaccgaaaccgaactcgaaattaaaatccaaatcccgatcgaacgccgacgacgaactaaaactacccaaaaacatactctcaaaatttaaactaaaattcaaatcgaacaaatcgtcttcgaactcgtcgtcgaaaaacgaaaaacccgaaaaaaaaaaaaaaaaaaaataaaacgaaaccgaaaaaaacgcgtacgaaaacgcgctaaacgaaacgaacgaaacgacgcgcaaactaacgtaaccgcgataatcgacgaacgaacgaccgacgacgaaaaacgaaacgacgctactacgaccgctcaaactaaacgcgtcgaacgaacaacccgcgccctcctcctcgtacaaacccaaaaaatcgctaaaatcgactcccgcgcccacgccgcccacgaacgacgacgacgtacccaaaccgccgaacaaataaacgcgcttcaccttcttctccgccaaatacttacccgaaaccgcgaacgctacgaaaaccgaaactaccgaaaaaacgaaaaccgaaacgctaaaaatccgcgccttatacaacgaataataatcgacgacgacgcccaaaatcaacaaaacgacgacccccgcctattcgacgaaaaaaaaaacgacgaaaacaaccgctactttaccgccaccgccgccgcctaccaaaataaacttaacgtacgatttactaaccccaccgcccgcgccgcccgccactttaaaaccgcaactctttttctacgccgatttaaaattaacgccgccgccactcgcaccgccgcctcctccccccgcgttactactcccgccgccgccgccgcccccataaccgcccccgccactaccaccgaccttatctcccttctcccccgacttaaaaaaaacgacgaccgaaaaactaaaattaacgttaccgaacttcaccttcttcctaaaccgatacttataatcgaaataatcaaccatatacttaaaacgcaaccgctccgcctctcgaataaaaaaaatcttatcgctatctttaaacaacttccaacgtttacccaaccgcttaaaaatctcgacgttatacatatcgaacgactactccataatcttacgccgctcgatctacgaccacaccataaaaacgttcataaatcgcttaatatacccactcgaaatcttacaccaactcgaatcgtcgaccttaccgcccgtaaaaacgataaaaccgaacgtaaaaaaaaaaacgattcccaactcgaaaccgacgcccgaatccgaactctcgccgaccaacaacgcttccgtattctcgacattattaatttactacaccataacctcgactcgacgaacgcccacgcgcgctcacaccctcgcgacgaccgccgcgcgatcgccgaaccctcccgattccccgaaccaaacacacgccgaacgaaaaaacgcgcgcgacgaccga

SEQ ID NO: 18643 - DNA, 1584 bp, Artificial Sequence
  chemically treated genomic DNA (Homo sapiens) CpG-island No: 18643
atttttttcggtttttttttttgtttgcgcgttttttagtaggtgaaaattaggttggagatgttggattcgagttagtttttcgagattatttcgtttatttcgggcgtgtagtagttcgggaattcgaagtgcgagtcggagtcgggttcgaagttaaaatttaggtttcggtcgagcgtcgacgacgaattgaagttgtttagggatatgtttttaaagtttgagttggggtttaggtcgagtaggtcgttttcgaattcgtcgtcggaggacgaggagttcgaggaggaggaagaggaggagtgggacgaggtcgaggaggacgcgtgcgagggcgcgttggacggggcgggcgaggcggcgcgtaggttggcgtagtcgcggtggtcggcgggcgagcggtcggcggcgggggacgaggcggcgttgttgcggtcgtttaggttgggcgcgtcgggcgagtagttcgcgttttttttttcgtataggtttagggggtcgttggggtcggttttcgcgtttacgtcgtttacgggcgacgacgacgtgtttaggtcgtcgaataggtagacgcgttttattttttttttcgttaggtgtttgttcggggtcgcgagcgttgcggaggtcgaggttgtcgaggaggcggaggtcgaggcgttgggagttcgcgttttgtatagcgagtggtggtcgacgacggcgtttagggttaataggacggcggttttcgtttgttcggcgaagaaggagacgacggaggtagtcgttgttttatcgttatcgtcgtcgtttgttaggatgagtttggcgtgcggtttgttaattttatcgttcgcgtcgttcgttattttggagtcgtagttttttttttgcgtcggtttggagttggcgtcgtcgttattcgtatcgtcgtttttttttttcgcgttgttgttttcgtcgtcgtcgtcgtttttatggtcgttttcgttattgttatcgattttgttttttttttttttcggtttggaggaggcggcggtcgaggagttggagttggcgttgtcggattttattttttttttgggtcggtatttgtagtcggggtagttagttatgtgtttgaggcgtagtcgtttcgtttttcgaatgaaagggattttgtcgttgtttttgagtagtttttagcgtttgtttagtcgtttggagatttcggcgttgtgtatgtcgggcgattgttttatgattttgcgtcgttcgatttgcgattatattatgaaggcgtttatgggtcgtttgatgtgtttattcggggttttgtattagttcgggtcgtcggttttgtcgttcgtggaggcggtggagtcgggcgtgggggaggaggcgatttttagttcgaggtcggcgttcgagttcgagttttcgtcggttagtagcgttttcgtgttttcggtattgttggtttgttgtattatggtttcggttcggcgggcgtttacgcgcgtttatattttcgcggcggtcgtcgcgcgatcgtcgggttttttcggtttttcgggttaagtatacgtcgaacgggaagacgcgcgcggcggtcga

SEQ ID NO: 18644 - DNA, 1584 bp, Artificial Sequence
  chemically treated genomic DNA (Homo sapiens) CpG-island No: 18644
tcgaccgccgcgcgcgtcttcccgttcgacgtatacttaacccgaaaaaccgaaaaaacccgacgatcgcgcgacgaccgccgcgaaaatataaacgcgcgtaaacgcccgccgaaccgaaaccataatacaacaaaccaacaataccgaaaacacgaaaacgctactaaccgacgaaaactcgaactcgaacgccgacctcgaactaaaaatcgcctcctcccccacgcccgactccaccgcctccacgaacgacaaaaccgacgacccgaactaatacaaaaccccgaataaacacatcaaacgacccataaacgccttcataatataatcgcaaatcgaacgacgcaaaatcataaaacaatcgcccgacatacacaacgccgaaatctccaaacgactaaacaaacgctaaaaactactcaaaaacaacgacaaaatccctttcattcgaaaaacgaaacgactacgcctcaaacacataactaactaccccgactacaaataccgacccaaaaaaaaaataaaatccgacaacgccaactccaactcctcgaccgccgcctcctccaaaccgaaaaaaaaaaaaaacaaaatcgataacaataacgaaaacgaccataaaaacgacgacgacgacgaaaacaacaacgcgaaaaaaaaaaacgacgatacgaataacgacgacgccaactccaaaccgacgcaaaaaaaaaactacgactccaaaataacgaacgacgcgaacgataaaattaacaaaccgcacgccaaactcatcctaacaaacgacgacgataacgataaaacaacgactacctccgtcgtctccttcttcgccgaacaaacgaaaaccgccgtcctattaaccctaaacgccgtcgtcgaccaccactcgctatacaaaacgcgaactcccaacgcctcgacctccgcctcctcgacaacctcgacctccgcaacgctcgcgaccccgaacaaacacctaacgaaaaaaaaaataaaacgcgtctacctattcgacgacctaaacacgtcgtcgtcgcccgtaaacgacgtaaacgcgaaaaccgaccccaacgaccccctaaacctatacgaaaaaaaaaacgcgaactactcgcccgacgcgcccaacctaaacgaccgcaacaacgccgcctcgtcccccgccgccgaccgctcgcccgccgaccaccgcgactacgccaacctacgcgccgcctcgcccgccccgtccaacgcgccctcgcacgcgtcctcctcgacctcgtcccactcctcctcttcctcctcctcgaactcctcgtcctccgacgacgaattcgaaaacgacctactcgacctaaaccccaactcaaactttaaaaacatatccctaaacaacttcaattcgtcgtcgacgctcgaccgaaacctaaattttaacttcgaacccgactccgactcgcacttcgaattcccgaactactacacgcccgaaataaacgaaataatctcgaaaaactaactcgaatccaacatctccaacctaattttcacctactaaaaaacgcgcaaacaaaaaaaaaaaccgaaaaaaat

SEQ ID NO: 18645 - DNA, 673 bp, Artificial Sequence
  chemically treated genomic DNA (Homo sapiens) CpG-island No: 18645
gtgggcgcggagtaggttcggattttcgcgtggcgtcgttttagttcgtgttttttgtagtttttgtcgttggatggggaattcgttttggttttaggagtcggattcggcgttttagacgtgggttcgtatttggattgtggcgcgggtgaggcggtcgggtaggggcggggttttggaaaggtatgtttaggggcggggattggagggaaggcgcgtcgaggggggcgaggatcggagggagggcgttttcgggggcgtggtttagggagtggcggaagtgtttcgaagcggggtttgggaggtcgtgtttagacgcgtggcgtggcgtggcgtggcgtggtgtggcgcggcgtttgtttcgtggagtttagggatgtgtttcggtttaggcgaatttgtcgtttttcgcgattttgatcgttttttttggtatgattcgtatttgtggcgttttggggacgaggtatttggtttttttttcgtggacgtcgagcgcgtgttttgtcgttacgacgacgtttttttttcgtttagtgttttttttcgcgtggggttcggttttggcgttagtttcgtgcgtgttcgtagtatttcggttttgggtcgggtgagtattgaggggagggaggttcgggttttttttttttatttcggttcgatttcgtttttt

SEQ ID NO: 18646 - DNA, 673 bp, Artificial Sequence
  chemically treated genomic DNA (Homo sapiens) CpG-island No: 18646
aaaaaacgaaatcgaaccgaaataaaaaaaaaaaacccgaacctccctcccctcaatactcacccgacccaaaaccgaaatactacgaacacgcacgaaactaacgccaaaaccgaaccccacgcgaaaaaaaacactaaacgaaaaaaaaacgtcgtcgtaacgacaaaacacgcgctcgacgtccacgaaaaaaaaaccaaatacctcgtccccaaaacgccacaaatacgaatcataccaaaaaaaacgatcaaaatcgcgaaaaacgacaaattcgcctaaaccgaaacacatccctaaactccacgaaacaaacgccgcgccacaccacgccacgccacgccacgccacgcgtctaaacacgacctcccaaaccccgcttcgaaacacttccgccactccctaaaccacgcccccgaaaacgccctccctccgatcctcgcccccctcgacgcgccttccctccaatccccgcccctaaacatacctttccaaaaccccgcccctacccgaccgcctcacccgcgccacaatccaaatacgaacccacgtctaaaacgccgaatccgactcctaaaaccaaaacgaattccccatccaacgacaaaaactacaaaaaacacgaactaaaacgacgccacgcgaaaatccgaacctactccgcgcccac

SEQ ID NO: 18647 - DNA, 673 bp, Artificial Sequence
  chemically treated genomic DNA (Homo sapiens) CpG-island No: 18647
gaggggcggggtcgggtcgaggtggggagaggggattcgagtttttttttttttagtgtttattcggtttagagtcgagatgttgcggatacgtacggggttagcgttagggtcgagttttacgcggaaggaggtattaggcggaaagaagacgtcgtcgtggcggtagggtacgcgttcggcgtttacgaagaagaggttaggtgtttcgtttttagagcgttataggtgcgggttatgttaggagaagcggttagagtcgcggaagacggtaggttcgtttgagtcggagtatatttttgagttttacggaataagcgtcgcgttatattacgttacgttacgttacgttacgcgtttgagtacgattttttaagtttcgtttcgggatattttcgttattttttaaattacgttttcggaggcgtttttttttcggttttcgtttttttcgacgcgttttttttttagttttcgtttttgaatatgtttttttagagtttcgtttttgttcgatcgttttattcgcgttatagtttaggtgcgagtttacgtttgagacgtcgaattcggtttttgaagttaggacgagttttttatttagcggtaggagttgtaagagatacgggttgaggcggcgttacgcgggggttcgggtttgtttcgcgtttat

SEQ ID NO: 18648 - DNA, 673 bp, Artificial Sequence
  chemically treated genomic DNA (Homo sapiens) CpG-island No: 18648
ataaacgcgaaacaaacccgaacccccgcgtaacgccgcctcaacccgtatctcttacaactcctaccgctaaataaaaaactcgtcctaacttcaaaaaccgaattcgacgtctcaaacgtaaactcgcacctaaactataacgcgaataaaacgatcgaacaaaaacgaaactctaaaaaaacatattcaaaaacgaaaactaaaaaaaaaacgcgtcgaaaaaaacgaaaaccgaaaaaaaaacgcctccgaaaacgtaatttaaaaaataacgaaaatatcccgaaacgaaacttaaaaaatcgtactcaaacgcgtaacgtaacgtaacgtaacgtaatataacgcgacgcttattccgtaaaactcaaaaatatactccgactcaaacgaacctaccgtcttccgcgactctaaccgcttctcctaacataacccgcacctataacgctctaaaaacgaaacacctaacctcttcttcgtaaacgccgaacgcgtaccctaccgccacgacgacgtcttctttccgcctaatacctccttccgcgtaaaactcgaccctaacgctaaccccgtacgtatccgcaacatctcgactctaaaccgaataaacactaaaaaaaaaaaaactcgaatcccctctccccacctcgacccgaccccgcccctc

SEQ ID NO: 18649 - DNA, 798 bp, Artificial Sequence
  chemically treated genomic DNA (Homo sapiens) CpG-island No: 18649
tcgtgaggtcgatacggagatttaggtggtgttggtggagaatgggttcgagataggcggagcggggcggttggttcgggtttttttggcggacgtcgtcgagaacggtaatcgcgttcgttttatttcgtttcgtcgcgtttcgtttcgtcgcggggaagattgagtcggttttttcgtcgtaggcgaggttttcggcgttttggaggcgattatgcgggagtcgggcgtatacgtttggggtagtttcgcggttgggttggcgggcggcgtggcggttgtcgtgttgttggcgttgttggttttgttggtggcgtcgtcgttgttgcgtcgcgcggggaggtttaggtacgcggggcgggggcgcggaggtggggttgggggttgtttcgaggggtttacgttgcgttttcgttacgtttttaggtggaggaggtacgaggcggcggtttcggttggagcgtttttcggttttcgtaattcggtgttcgacgtgacggttttcgaggagttggtgagggggttggaggggggatcggggttttttcggggtcgggattcggcgtcgatcgtcgtttgattttgttatttcgtagtttttgtcgcggcggtttagtttggtttcgaaggcggtcgtagatagtattagttatagttatttcgttaattttttgttcgtcggggtcgaggtcgaggtttgagcggtcgtttgatcgtcgattttggggttttttattcgttttggttttagtcgaattgggggttagttattttttcgtttagtttttaaattttttt

SEQ ID NO: 18650 - DNA, 798 bp, Artificial Sequence
  chemically treated genomic DNA (Homo sapiens) CpG-island No: 18650
aaaaaaatttaaaaactaaacgaaaaaataactaacccccaattcgactaaaaccaaaacgaataaaaaaccccaaaatcgacgatcaaacgaccgctcaaacctcgacctcgaccccgacgaacaaaaaattaacgaaataactataactaatactatctacgaccgccttcgaaaccaaactaaaccgccgcgacaaaaactacgaaataacaaaatcaaacgacgatcgacgccgaatcccgaccccgaaaaaaccccgatcccccctccaaccccctcaccaactcctcgaaaaccgtcacgtcgaacaccgaattacgaaaaccgaaaaacgctccaaccgaaaccgccgcctcgtacctcctccacctaaaaacgtaacgaaaacgcaacgtaaacccctcgaaacaacccccaaccccacctccgcgcccccgccccgcgtacctaaacctccccgcgcgacgcaacaacgacgacgccaccaacaaaaccaacaacgccaacaacacgacaaccgccacgccgcccgccaacccaaccgcgaaactaccccaaacgtatacgcccgactcccgcataatcgcctccaaaacgccgaaaacctcgcctacgacgaaaaaaccgactcaatcttccccgcgacgaaacgaaacgcgacgaaacgaaataaaacgaacgcgattaccgttctcgacgacgtccgccaaaaaaacccgaaccaaccgccccgctccgcctatctcgaacccattctccaccaacaccacctaaatctccgtatcgacctcacga

SEQ ID NO: 18651 - DNA, 798 bp, Artificial Sequence
  chemically treated genomic DNA (Homo sapiens) CpG-island No: 18651
ggggaggtttgggggttggacgaggaggtggttagtttttagttcgattggggttagagcgggtggagagttttaaggtcgacggttaggcggtcgtttaggtttcggtttcggtttcggcgaatagagggttgacgaagtaattgtggttggtgttgtttgcggtcgttttcggaattaggttgagtcgtcgcggtaggggttgcggggtgatagggttaggcggcggtcggcgtcgagtttcggtttcgaggaggtttcggttttttttttagtttttttattagtttttcggaggtcgttacgtcgaatatcgggttgcggaagtcgaggggcgttttagtcggggtcgtcgtttcgtgttttttttatttgagggcgtagcggggacgtagcgtgagtttttcggagtaatttttagttttattttcgcgttttcgtttcgcgtatttgagttttttcgcgcggcgtagtagcggcggcgttattagtaggattagtagcgttagtagtacggtagtcgttacgtcgttcgttagtttagtcgcggagttgttttagacgtgtgcgttcgattttcgtatggtcgtttttaggacgtcgagggtttcgtttgcgacggaggggtcggtttagtttttttcgcggcggggcgaggcgcggcggggcgggatggggcgggcgcggttatcgttttcggcgacgttcgttaggagggttcgggttagtcgtttcgtttcgtttgtttcgggtttattttttattagtattatttggattttcgtatcggttttacgg

SEQ ID NO: 18652 - DNA, 798 bp, Artificial Sequence
  chemically treated genomic DNA (Homo sapiens) CpG-island No: 18652
ccgtaaaaccgatacgaaaatccaaataatactaataaaaaataaacccgaaacaaacgaaacgaaacgactaacccgaaccctcctaacgaacgtcgccgaaaacgataaccgcgcccgccccatcccgccccgccgcgcctcgccccgccgcgaaaaaaactaaaccgacccctccgtcgcaaacgaaaccctcgacgtcctaaaaacgaccatacgaaaatcgaacgcacacgtctaaaacaactccgcgactaaactaacgaacgacgtaacgactaccgtactactaacgctactaatcctactaataacgccgccgctactacgccgcgcgaaaaaactcaaatacgcgaaacgaaaacgcgaaaataaaactaaaaattactccgaaaaactcacgctacgtccccgctacgccctcaaataaaaaaaacacgaaacgacgaccccgactaaaacgcccctcgacttccgcaacccgatattcgacgtaacgacctccgaaaaactaataaaaaaactaaaaaaaaaaccgaaacctcctcgaaaccgaaactcgacgccgaccgccgcctaaccctatcaccccgcaacccctaccgcgacgactcaacctaattccgaaaacgaccgcaaacaacaccaaccacaattacttcgtcaaccctctattcgccgaaaccgaaaccgaaacctaaacgaccgcctaaccgtcgaccttaaaactctccacccgctctaaccccaatcgaactaaaaactaaccacctcctcgtccaacccccaaacctcccc

SEQ ID NO: 18653 - DNA, 1106 bp, Artificial Sequence
  chemically treated genomic DNA (Homo sapiens) CpG-island No: 18653
tttcgtgtaggagcggttacggcgtttagaggaattcgcgggtgtaaatttcgggagcggtttgtagggtgacggcggcggttttcgtttttcggtatttgatgatgtcgtcgttgtggtttcggtagaatttttgtttgtgttttcgcgggttgtatattacgtcgattttcgttacgaagtatacgatttttttggtcgtagtgtagtagaggttgttgcggtattggtggtttcggtagtcgtatatttattcgagtcgtaggtggtagttcggggcgtttcgggtcgttatgtcggggcgtttattcgtcgttttcgttcgggttcgcggcggcgacgggaggcggcggcggttcggtaacgaaagttttttcgttggttgtcgggatttttcgttagtcgcgttttttaagtcgcgttcgttaggtgtatttcgtttcgggggtcgtcgtcgttttagtttataggcgggaggaaaattttcgtttcgcggaatatgttgagggtcgcgagcgtcgtcggttgttaagtggatgtttagagtttttcgttcgtttcggttcgtttagtttttttagttcgtagcgtttgggtcgagagcgagggttcgtttttagttttttagtcgtcgttcgcgtacgtagtttttagtttcggttatttgcggcgttcgcgtttcgtcgcggttttgtagttatagtttggcggattcgcgtcgcgtatttcgaaatcgagcgagtcgagtcgagtcgagtcgagcggcgggcgcgcggttttgcgtggtttcgttttttttcgcgtttatttcgtttttttcggagtcgagaagaggttggagttcgcggggttacggtttagttgcggagtcgttgggatcgcgtttttgtaagtgcgcgggtcggtgagttttttttcgttgagttgtttaagtttaggcggattttcggcgatttcgggttttcgttgttttgcgtttttaatcgggaagtatttgtcggtttcgtacggtttttgtatttagcgtaggttacgtttttgtttgggaaaatttatatcgggatgttaaatttttttttttacgtttgatattttgtgtgttttgt

SEQ ID NO: 18654 - DNA, 1106 bp, Artificial Sequence
  chemically treated genomic DNA (Homo sapiens) CpG-island No: 18654
acaaaacacacaaaatatcaaacgtaaaaaaaaaaatttaacatcccgatataaattttcccaaacaaaaacgtaacctacgctaaatacaaaaaccgtacgaaaccgacaaatacttcccgattaaaaacgcaaaacaacgaaaacccgaaatcgccgaaaatccgcctaaacttaaacaactcaacgaaaaaaaactcaccgacccgcgcacttacaaaaacgcgatcccaacgactccgcaactaaaccgtaaccccgcgaactccaacctcttctcgactccgaaaaaaacgaaataaacgcgaaaaaaaacgaaaccacgcaaaaccgcgcgcccgccgctcgactcgactcgactcgactcgctcgatttcgaaatacgcgacgcgaatccgccaaactataactacaaaaccgcgacgaaacgcgaacgccgcaaataaccgaaactaaaaactacgtacgcgaacgacgactaaaaaactaaaaacgaaccctcgctctcgacccaaacgctacgaactaaaaaaactaaacgaaccgaaacgaacgaaaaactctaaacatccacttaacaaccgacgacgctcgcgaccctcaacatattccgcgaaacgaaaattttcctcccgcctataaactaaaacgacgacgacccccgaaacgaaatacacctaacgaacgcgacttaaaaaacgcgactaacgaaaaatcccgacaaccaacgaaaaaactttcgttaccgaaccgccgccgcctcccgtcgccgccgcgaacccgaacgaaaacgacgaataaacgccccgacataacgacccgaaacgccccgaactaccacctacgactcgaataaatatacgactaccgaaaccaccaataccgcaacaacctctactacactacgaccaaaaaaatcgtatacttcgtaacgaaaatcgacgtaatatacaacccgcgaaaacacaaacaaaaattctaccgaaaccacaacgacgacatcatcaaataccgaaaaacgaaaaccgccgccgtcaccctacaaaccgctcccgaaatttacacccgcgaattcctctaaacgccgtaaccgctcctacacgaaa

SEQ ID NO: 18655 - DNA, 1106 bp, Artificial Sequence
  chemically treated genomic DNA (Homo sapiens) CpG-island No: 18655
gtaagatatataaggtattaagcgtaaaaaagagaatttagtatttcggtgtggatttttttaggtaaaaacgtggtttacgttgggtgtagggatcgtgcggaatcggtaggtgtttttcggttgaggacgtaaagtagcgggagttcggggtcgtcgagggttcgtttgggtttaagtagtttaacgagggagggtttatcggttcgcgtatttgtagagacgcggttttagcgatttcgtaattagatcgtggtttcgcgaattttagttttttttcggtttcgggaggggcggagtgagcgcgggagggggcggggttacgtaaggtcgcgcgttcgtcgttcggttcggttcggttcggttcgttcggtttcggggtgcgcggcgcgggttcgttaggttgtggttataaagtcgcggcggggcgcgagcgtcgtaggtgatcggggttgggagttgcgtgcgcgggcggcggttgaggagttggaggcgggttttcgttttcggtttaggcgttacgggttgaggagattaggcgagtcgaggcgggcgaagggttttgggtatttatttgatagtcggcggcgttcgcggtttttagtatgtttcgcgaggcgagggtttttttttcgtttgtgggttgaggcggcggcggttttcgaaacgagatgtatttgacgggcgcggtttagaggacgcggttggcgggaagtttcggtagttagcgggagggttttcgttgtcgggtcgtcgtcgtttttcgtcgtcgtcgcgggttcgagcgggagcggcgggtgggcgtttcgatatggcggttcggagcgtttcgagttgttatttgcggttcgagtgggtgtacggttatcggggttattagtgtcgtaataatttttattatattgcggttaaggagatcgtatatttcgtggcgggggtcggcgtggtgtatagttcgcgggagtataggtagaagttttatcggggttatagcgacgatattattaggtatcggggagcgggggtcgtcgtcgttattttgtaagtcgttttcggagtttgtattcgcgggtttttttggacgtcgtgatcgtttttgtacggag

SEQ ID NO: 18656 - DNA, 1106 bp, Artificial Sequence
  chemically treated genomic DNA (Homo sapiens) CpG-island No: 18656
ctccgtacaaaaacgatcacgacgtccaaaaaaacccgcgaatacaaactccgaaaacgacttacaaaataacgacgacgacccccgctccccgatacctaataatatcgtcgctataaccccgataaaacttctacctatactcccgcgaactatacaccacgccgacccccgccacgaaatatacgatctccttaaccgcaatataataaaaattattacgacactaataaccccgataaccgtacacccactcgaaccgcaaataacaactcgaaacgctccgaaccgccatatcgaaacgcccacccgccgctcccgctcgaacccgcgacgacgacgaaaaacgacgacgacccgacaacgaaaaccctcccgctaactaccgaaacttcccgccaaccgcgtcctctaaaccgcgcccgtcaaatacatctcgtttcgaaaaccgccgccgcctcaacccacaaacgaaaaaaaaaccctcgcctcgcgaaacatactaaaaaccgcgaacgccgccgactatcaaataaatacccaaaacccttcgcccgcctcgactcgcctaatctcctcaacccgtaacgcctaaaccgaaaacgaaaacccgcctccaactcctcaaccgccgcccgcgcacgcaactcccaaccccgatcacctacgacgctcgcgccccgccgcgactttataaccacaacctaacgaacccgcgccgcgcaccccgaaaccgaacgaaccgaaccgaaccgaaccgaacgacgaacgcgcgaccttacgtaaccccgccccctcccgcgctcactccgcccctcccgaaaccgaaaaaaaactaaaattcgcgaaaccacgatctaattacgaaatcgctaaaaccgcgtctctacaaatacgcgaaccgataaaccctccctcgttaaactacttaaacccaaacgaaccctcgacgaccccgaactcccgctactttacgtcctcaaccgaaaaacacctaccgattccgcacgatccctacacccaacgtaaaccacgtttttacctaaaaaaatccacaccgaaatactaaattctcttttttacgcttaataccttatatatcttac

SEQ ID NO: 18657 - DNA, 711 bp, Artificial Sequence
  chemically treated genomic DNA (Homo sapiens) CpG-island No: 18657
gttatttttatgtcgttcgaatcgatgtttttcgtgttgtttcgtgtttggacggtcggttttattaggcgtagaggggaagaattttagtttcggggtttggttggggtttcgggagtcgcgggaaagcgagtttgcggcgcgggaagtttggttagtagatttcggcggcgttcggttagttttttcgtttcggtttttcggttgtttaattatggcgcggttcgggagcgcgtcgcggttaattaggagcggcgggagcggcgtcgggagtcggcgggcgtagagcgagttcgagtttggagtcggcgtcggcgttgcggtcgggagggatcgtggcgagagtagtgcggtcgggtgggtatttcgcggttagagaagtcggttttgtcgcggcgatttttcggcggacgtcggggattttgcggatcgcggcgtaggtaattgtatttacgtttcgtagtaggaggcgagcgcgttttttaagaggggtttcgtaggtggagcgggcggggggcgggggcgggggcgggggcgggtcggtcgcgaggttttagcgtcgttgtgttttttggcgttttcgagtttgtttggtcgagttacgcggaggcgcggcgtttttattagtcgcgggcgtttcggggtgggggaggacgaggggattttgtttaaggtaggtaggggtggaggaggatttttgcgatatttggt

SEQ ID NO: 18658 - DNA, 711 bp, Artificial Sequence
  chemically treated genomic DNA (Homo sapiens) CpG-island No: 18658
accaaatatcgcaaaaatcctcctccacccctacctaccttaaacaaaatcccctcgtcctcccccaccccgaaacgcccgcgactaataaaaacgccgcgcctccgcgtaactcgaccaaacaaactcgaaaacgccaaaaaacacaacgacgctaaaacctcgcgaccgacccgcccccgcccccgcccccgccccccgcccgctccacctacgaaacccctcttaaaaaacgcgctcgcctcctactacgaaacgtaaatacaattacctacgccgcgatccgcaaaatccccgacgtccgccgaaaaatcgccgcgacaaaaccgacttctctaaccgcgaaatacccacccgaccgcactactctcgccacgatccctcccgaccgcaacgccgacgccgactccaaactcgaactcgctctacgcccgccgactcccgacgccgctcccgccgctcctaattaaccgcgacgcgctcccgaaccgcgccataattaaacaaccgaaaaaccgaaacgaaaaaactaaccgaacgccgccgaaatctactaaccaaacttcccgcgccgcaaactcgctttcccgcgactcccgaaaccccaaccaaaccccgaaactaaaattcttcccctctacgcctaataaaaccgaccgtccaaacacgaaacaacacgaaaaacatcgattcgaacgacataaaaataac

SEQ ID NO: 18659 - DNA, 711 bp, Artificial Sequence
  chemically treated genomic DNA (Homo sapiens) CpG-island No: 18659
gttaggtgtcgtaggagtttttttttatttttatttgttttaagtagagttttttcgtttttttttatttcgggacgttcgcggttggtggaaacgtcgcgttttcgcgtggttcgattaggtaggttcgggggcgttagggggtatagcggcgttaggatttcgcggtcggttcgttttcgttttcgttttcgtttttcgttcgttttatttgcggggttttttttggggggcgcgttcgttttttgttgcggggcgtgggtgtagttatttgcgtcgcggttcgtagggttttcggcgttcgtcgaaaggtcgtcgcggtaaagtcggtttttttggtcgcgggatatttattcggtcgtattgttttcgttacgatttttttcggtcgtagcgtcgacgtcggttttagattcgagttcgttttgcgttcgtcggttttcggcgtcgttttcgtcgtttttgattggtcgcggcgcgttttcgagtcgcgttatgattgggtagtcggggagtcggggcggggggattggtcgggcgtcgtcgggatttgttggttaagtttttcgcgtcgtagattcgttttttcgcggttttcggggttttaattagatttcgaagttgggattttttttttttgcgtttagtggggtcggtcgtttaggtacgaggtaatacggaaagtatcgattcgagcgatatggaaatggt

SEQ ID NO: 18660 - DNA, 711 bp, Artificial Sequence
  chemically treated genomic DNA (Homo sapiens) CpG-island No: 18660
accatttccatatcgctcgaatcgatactttccgtattacctcgtacctaaacgaccgaccccactaaacgcaaaaaaaaaaaatcccaacttcgaaatctaattaaaaccccgaaaaccgcgaaaaaacgaatctacgacgcgaaaaacttaaccaacaaatcccgacgacgcccgaccaatccccccgccccgactccccgactacccaatcataacgcgactcgaaaacgcgccgcgaccaatcaaaaacgacgaaaacgacgccgaaaaccgacgaacgcaaaacgaactcgaatctaaaaccgacgtcgacgctacgaccgaaaaaaatcgtaacgaaaacaatacgaccgaataaatatcccgcgaccaaaaaaaccgactttaccgcgacgacctttcgacgaacgccgaaaaccctacgaaccgcgacgcaaataactacacccacgccccgcaacaaaaaacgaacgcgccccccaaaaaaaaccccgcaaataaaacgaacgaaaaacgaaaacgaaaacgaaaacgaaccgaccgcgaaatcctaacgccgctataccccctaacgcccccgaacctacctaatcgaaccacgcgaaaacgcgacgtttccaccaaccgcgaacgtcccgaaataaaaaaaaacgaaaaaactctacttaaaacaaataaaaataaaaaaaaactcctacgacacctaac

SEQ ID NO: 18661 - DNA, 1199 bp, Artificial Sequence
  chemically treated genomic DNA (Homo sapiens) CpG-island No: 18661
aagagttcgtgtgagtggcgtgtacgttaagagttcgtgtgagtggcgtgtacgttacgagttcgtgtgagtggcgtgtacgttacgagtttgtgagcggcgtgtacgttacgagtttgtgagcggcgtgtacgttacgagtttgtgagtggcgtgtacgttaagagttcgtgtgagtggcgtgtacgttacgagttcgtgtgagtggcgtgtacgttacgagtttgtgagtggcgtgtacgttacgagtttgtgagtggcgtgtacgttacgagtttgtgagtggcgtgtacgttacgaatttgtgggtggcgtgtacgttacgagttcgtgtgagtggcgtgtacgttacgagtttgtgagtggcgtgtacgttacgagttcgtgtgagtggtgtgtacgttataagtttgtgaatggcgtgtacgttacgagtttgtgagtggcgtgtatattacgagtttgtgagtggcgtgtacgttacgagtttgtgagtggcgtgtacgttacgagttcgtgtgagtggtgtgtacgttataagtttgtgaatggcgtgtacgttacgagtttgtgagtggcgtgtatattacgagtttgtgagtggcgtgtacgttattagttcgtgtgagtggtgtgtacgttacgagttcgtgtgagtggtgtgtacgttataagtttgtgagtggcgtgtacgttacgagtttgtgagtggcgtgtacgttgagttcgtgtgagtggtgtgtacgttacgagtttgtgagtggcgtgtacgttacgagtttgtgagtggcgtgtacgttgagttcgtgtgagtggtgtgtacgttacgagttcgtgtgagtggcgtgtacgttacgagtttgtgagtggcgtgtacgttacgagtttgtgggtggtgtgtacgttacgagttcgtgtgagtggcgtgtacgttataagtttgtgagtggtgtgtacgttacgagtttgtgattggtgtgtacgttacgagtgcgtgtgagtggcgtgtacgttacgagttcgtgtgagtggcgtgtacgttacgagttcgtgtgagtggtgtgtatgttacgagtttgtgattggtgtgtacgttacgagtgcgtgtgagtggcgtgtacgttaagagttcgtgtgagttgttgttgaggtaggaatgtgggtgggatgatagcgagatatttatgtttagttacgtt

SEQ ID NO: 18662 - DNA, 1199 bp, Artificial Sequence
  chemically treated genomic DNA (Homo sapiens) CpG-island No: 18662
aacgtaactaaacataaatatctcgctatcatcccacccacattcctacctcaacaacaactcacacgaactcttaacgtacacgccactcacacgcactcgtaacgtacacaccaatcacaaactcgtaacatacacaccactcacacgaactcgtaacgtacacgccactcacacgaactcgtaacgtacacgccactcacacgcactcgtaacgtacacaccaatcacaaactcgtaacgtacacaccactcacaaacttataacgtacacgccactcacacgaactcgtaacgtacacaccacccacaaactcgtaacgtacacgccactcacaaactcgtaacgtacacgccactcacacgaactcgtaacgtacacaccactcacacgaactcaacgtacacgccactcacaaactcgtaacgtacacgccactcacaaactcgtaacgtacacaccactcacacgaactcaacgtacacgccactcacaaactcgtaacgtacacgccactcacaaacttataacgtacacaccactcacacgaactcgtaacgtacacaccactcacacgaactaataacgtacacgccactcacaaactcgtaatatacacgccactcacaaactcgtaacgtacacgccattcacaaacttataacgtacacaccactcacacgaactcgtaacgtacacgccactcacaaactcgtaacgtacacgccactcacaaactcgtaatatacacgccactcacaaactcgtaacgtacacgccattcacaaacttataacgtacacaccactcacacgaactcgtaacgtacacgccactcacaaactcgtaacgtacacgccactcacacgaactcgtaacgtacacgccacccacaaattcgtaacgtacacgccactcacaaactcgtaacgtacacgccactcacaaactcgtaacgtacacgccactcacaaactcgtaacgtacacgccactcacacgaactcgtaacgtacacgccactcacacgaactcttaacgtacacgccactcacaaactcgtaacgtacacgccgctcacaaactcgtaacgtacacgccgctcacaaactcgtaacgtacacgccactcacacgaactcgtaacgtacacgccactcacacgaactcttaacgtacacgccactcacacgaactctt

SEQ ID NO: 18663 - DNA, 1199 bp, Artificial Sequence
  chemically treated genomic DNA (Homo sapiens) CpG-island No: 18663
aacgtaattagatatagatatttcgttgttattttatttatatttttgttttagtagtaatttatacggatttttaacgtatacgttatttatacgtattcgtaacgtgtatattagttatagattcgtaatatgtatattatttatacggattcgtaacgtgtacgttatttatacggattcgtaacgtgtacgttatttatacgtattcgtaacgtgtatattagttatagattcgtaacgtgtatattatttatagatttgtaacgtgtacgttatttatacggattcgtaacgtgtatattatttatagattcgtaacgtgtacgttatttatagattcgtaacgtgtacgttatttatacggattcgtaacgtgtatattatttatacggatttaacgtgtacgttatttatagattcgtaacgtgtacgttatttatagattcgtaacgtgtatattatttatacggatttaacgtgtacgttatttatagattcgtaacgtgtacgttatttatagatttgtaacgtatatattatttatacggattcgtaacgtgtatattatttatacggattggtaacgtgtacgttatttatagattcgtaatgtgtacgttatttatagattcgtaacgtgtacgttatttatagatttgtaacgtatatattatttatacggattcgtaacgtgtacgttatttatagattcgtaacgtgtacgttatttatagattcgtaatgtgtacgttatttatagattcgtaacgtgtacgttatttatagatttgtaacgtatatattatttatacggattcgtaacgtgtacgttatttatagattcgtaacgtgtacgttatttatacggattcgtaacgtgtacgttatttatagattcgtaacgtgtacgttatttatagattcgtaacgtgtacgttatttatagattcgtaacgtgtacgttatttatagattcgtaacgtgtacgttatttatacggattcgtaacgtgtacgttatttatacggatttttaacgtgtacgttatttatagattcgtaacgtgtacgtcgtttatagattcgtaacgtgtacgtcgtttatagattcgtaacgtgtacgttatttatacggattcgtaacgtgtacgttatttatacggatttttaacgtgtacgttatttatacggattttt

SEQ ID NO: 18664 - DNA, 1199 bp, Artificial Sequence
  chemically treated genomic DNA (Homo sapiens) CpG-island No: 18664
aaaaatccgtataaataacgtacacgttaaaaatccgtataaataacgtacacgttacgaatccgtataaataacgtacacgttacgaatctataaacgacgtacacgttacgaatctataaacgacgtacacgttacgaatctataaataacgtacacgttaaaaatccgtataaataacgtacacgttacgaatccgtataaataacgtacacgttacgaatctataaataacgtacacgttacgaatctataaataacgtacacgttacgaatctataaataacgtacacgttacgaatctataaataacgtacacgttacgaatccgtataaataacgtacacgttacgaatctataaataacgtacacgttacgaatccgtataaataatatatacgttacaaatctataaataacgtacacgttacgaatctataaataacgtacacattacgaatctataaataacgtacacgttacgaatctataaataacgtacacgttacgaatccgtataaataatatatacgttacaaatctataaataacgtacacgttacgaatctataaataacgtacacattacgaatctataaataacgtacacgttaccaatccgtataaataatatacacgttacgaatccgtataaataatatatacgttacaaatctataaataacgtacacgttacgaatctataaataacgtacacgttaaatccgtataaataatatacacgttacgaatctataaataacgtacacgttacgaatctataaataacgtacacgttaaatccgtataaataatatacacgttacgaatccgtataaataacgtacacgttacgaatctataaataacgtacacgttacgaatctataaataatatacacgttacgaatccgtataaataacgtacacgttacaaatctataaataatatacacgttacgaatctataactaatatacacgttacgaatacgtataaataacgtacacgttacgaatccgtataaataacgtacacgttacgaatccgtataaataatatacatattacgaatctataactaatatacacgttacgaatacgtataaataacgtatacgttaaaaatccgtataaattactactaaaacaaaaatataaataaaataacaacgaaatatctatatctaattacgtt

SEQ ID NO: 18665 - DNA, 568 bp, Artificial Sequence
  chemically treated genomic DNA (Homo sapiens) CpG-island No: 18665
gacgagttcgtgtgagcggcgggtattttacgagttagtgcgagcggtagatattttacgagttagtgtgagcggcgggtattttacgagttattgtgagcggcgggtattttacgagttcgtgtgagcggcgggtattttacgagttcgtgtgagcggcgggtacgttacgagttagtgtgagtggcgtgtacgttacgagtttgtgagtggcgtgtacgttaagagttcgtgtgagtggcgtgtacgttacgagttcgtgtgagtggcgtgtacgttacgagtttgtgagtggcgtgtacgttacgagtttgtgagtggcgtgtacgttacgagttcgtatgagcggcgggtattttacgagttcgtgtgagcggcgggtacgttacgagttagtgtgagtggcgtgtacgttacgagtttgtgagcggcgtgtacgttacgagtttgtgagtggcgtgtacgttaagagttcgtgtgagtggcgtgtacgttacgagtttttgtgagtggcgtgtacgttacgagtttgtgagtggcgtgtacgttacgagtttgtgagtggcgt

SEQ ID NO: 18666 - DNA, 568 bp, Artificial Sequence
  chemically treated genomic DNA (Homo sapiens) CpG-island No: 18666
acgccactcacaaactcgtaacgtacacgccactcacaaactcgtaacgtacacgccactcacaaaaactcgtaacgtacacgccactcacacgaactcttaacgtacacgccactcacaaactcgtaacgtacacgccgctcacaaactcgtaacgtacacgccactcacactaactcgtaacgtacccgccgctcacacgaactcgtaaaatacccgccgctcatacgaactcgtaacgtacacgccactcacaaactcgtaacgtacacgccactcacaaactcgtaacgtacacgccactcacacgaactcgtaacgtacacgccactcacacgaactcttaacgtacacgccactcacaaactcgtaacgtacacgccactcacactaactcgtaacgtacccgccgctcacacgaactcgtaaaatacccgccgctcacacgaactcgtaaaatacccgccgctcacaataactcgtaaaatacccgccgctcacactaactcgtaaaatatctaccgctcgcactaactcgtaaaatacccgccgctcacacgaactcgtc

SEQ ID NO: 18667 - DNA, 568 bp, Artificial Sequence
  chemically treated genomic DNA (Homo sapiens) CpG-island No: 18667
acgttatttatagattcgtaacgtgtacgttatttatagattcgtaacgtgtacgttatttatagggattcgtaacgtgtacgttatttatacggatttttaacgtgtacgttatttatagattcgtaacgtgtacgtcgtttatagattcgtaacgtatacgttatttatattggttcgtaacgtgttcgtcgtttatacggattcgtaaggtgttcgtcgtttatacggattcgtaacgtgtacgttatttatagattcgtaacgtgtacgttatttatagattcgtaacgtgtacgttatttatacggattcgtaacgtgtacgttatttatacggatttttaacgtgtacgttatttatagattcgtaacgtatacgttatttatattggttcgtaacgtgttcgtcgtttatacggattcgtaaggtgttcgtcgtttatacggattcgtaaggtgttcgtcgtttatagtggttcgtaaggtgttcgtcgtttatattggttcgtaaggtgtttgtcgttcgtattggttcgtaaggtgttcgtcgtttatacggattcgtt

SEQ ID NO: 18668 - DNA, 568 bp, Artificial Sequence
  chemically treated genomic DNA (Homo sapiens) CpG-island No: 18668
aacgaatccgtataaacgacgaacaccttacgaaccaatacgaacgacaaacaccttacgaaccaatataaacgacgaacaccttacgaaccactataaacgacgaacaccttacgaatccgtataaacgacgaacaccttacgaatccgtataaacgacgaacacgttacgaaccaatataaataacgtatacgttacgaatctataaataacgtacacgttaaaaatccgtataaataacgtacacgttacgaatccgtataaataacgtacacgttacgaatctataaataacgtacacgttacgaatctataaataacgtacacgttacgaatccgtataaacgacgaacaccttacgaatccgtataaacgacgaacacgttacgaaccaatataaataacgtatacgttacgaatctataaacgacgtacacgttacgaatctataaataacgtacacgttaaaaatccgtataaataacgtacacgttacgaatccctataaataacgtacacgttacgaatctataaataacgtacacgttacgaatctataaataacgt

SEQ ID NO: 18669 - DNA, 650 bp, Artificial Sequence
  chemically treated genomic DNA (Homo sapiens) CpG-island No: 18669
gtttcgatgttgttgacgttggtcgggggcgcgttttttttttcggggtttttcgcgttttgtatttgggcgttgcgtcgtttttagttcggatggagtcgtatcgattgcgtgatgattagtattaggtatcggcgtcgtcgagacgtttttcgaggttcggggcgttgtttatcgtattttattcggtcgcggggtttagggcggaaaaggggggcggtaggaagttcgggggttgtttttttcgcgtttcggcggttcgagttttcgaagttttttcgcgtttttttttggcgggagcggggtcggggcgggcgggaatggtcgatgagttttcggagttcgttttttatatttgtttgcggttggggagagttaggtcgaagggtcgggtcgggttttttgcggttttcggatcggattgagcgcgcgcgttgtttttttcgttcgcgttaggttggttttttcggtgtacgtcgtgttggttatcggttcggggatcgttattattcgtttttgcgacgacgtgattatcggtaggtaagagttcgggtcggggttttgttgtaaatgttatattttagtagttcgtaggttttggttttcgtagtatacgcgtttagaaagttgattaatgggaaaagttggta

SEQ ID NO: 18670 - DNA, 650 bp, Artificial Sequence
  chemically treated genomic DNA (Homo sapiens) CpG-island No: 18670
taccaacttttcccattaatcaactttctaaacgcgtatactacgaaaaccaaaacctacgaactactaaaatataacatttacaacaaaaccccgacccgaactcttacctaccgataatcacgtcgtcgcaaaaacgaataataacgatccccgaaccgataaccaacacgacgtacaccgaaaaaaccaacctaacgcgaacgaaaaaaacaacgcgcgcgctcaatccgatccgaaaaccgcaaaaaacccgacccgacccttcgacctaactctccccaaccgcaaacaaatataaaaaacgaactccgaaaactcatcgaccattcccgcccgccccgaccccgctcccgccaaaaaaaaacgcgaaaaaacttcgaaaactcgaaccgccgaaacgcgaaaaaaacaacccccgaacttcctaccgccccccttttccgccctaaaccccgcgaccgaataaaatacgataaacaacgccccgaacctcgaaaaacgtctcgacgacgccgatacctaatactaatcatcacgcaatcgatacgactccatccgaactaaaaacgacgcaacgcccaaatacaaaacgcgaaaaaccccgaaaaaaaaaacgcgcccccgaccaacgtcaacaacatcgaaac

SEQ ID NO: 18671 - DNA, 650 bp, Artificial Sequence
  chemically treated genomic DNA (Homo sapiens) CpG-island No: 18671
tgttagttttttttattagttagttttttgagcgcgtgtgttgcgagagttagagtttgcgagttattgaaatgtgatatttgtaataaggtttcggttcgggtttttatttgtcggtgattacgtcgtcgtaggagcgaatgatgacgattttcgagtcggtggttagtacggcgtgtatcgaggaaattagtttagcgcgggcggagagaatagcgcgcgcgtttagttcggttcgaggatcgtagggagttcggttcggtttttcggtttgattttttttagtcgtaggtagatgtggggagcgggtttcggaggtttatcggttattttcgttcgtttcggtttcgttttcgttaggggaggacgcggaggggtttcgaaaattcgggtcgtcgggacgcggagggagtagttttcgggttttttgtcgtttttttttttcgttttgggtttcgcggtcgggtggggtgcggtgggtagcgtttcgggtttcggggggcgtttcggcggcgtcggtatttggtgttgattattacgtagtcggtgcggttttattcgggttgggagcggcgtagcgtttaggtgtagagcgcgaagagtttcgggaagaagagcgcgttttcggttagcgttagtagtatcggggt

SEQ ID NO: 18672 - DNA, 650 bp, Artificial Sequence
  chemically treated genomic DNA (Homo sapiens) CpG-island No: 18672
accccgatactactaacgctaaccgaaaacgcgctcttcttcccgaaactcttcgcgctctacacctaaacgctacgccgctcccaacccgaataaaaccgcaccgactacgtaataatcaacaccaaataccgacgccgccgaaacgccccccgaaacccgaaacgctacccaccgcaccccacccgaccgcgaaacccaaaacgaaaaaaaaaaacgacaaaaaacccgaaaactactccctccgcgtcccgacgacccgaattttcgaaacccctccgcgtcctcccctaacgaaaacgaaaccgaaacgaacgaaaataaccgataaacctccgaaacccgctccccacatctacctacgactaaaaaaaatcaaaccgaaaaaccgaaccgaactccctacgatcctcgaaccgaactaaacgcgcgcgctattctctccgcccgcgctaaactaatttcctcgatacacgccgtactaaccaccgactcgaaaatcgtcatcattcgctcctacgacgacgtaatcaccgacaaataaaaacccgaaccgaaaccttattacaaatatcacatttcaataactcgcaaactctaactctcgcaacacacgcgctcaaaaaactaactaataaaaaaaactaaca

SEQ ID NO: 18673 - DNA, 994 bp, Artificial Sequence
  chemically treated genomic DNA (Homo sapiens) CpG-island No: 18673
  misc_feature (430)..(430): n is either a, c, g or t
tgcgcgagtttcgggcgtttttaagggttttaattttacgtttgtttcgtgtttttaagcgtagggggtcggaggcggtaagacgcggtttaacgcgcggcgggattcggattatttttcgttaaggttatttcgggatttttagattcgtttcgacgcgggggacgtttcggttcgggttcgcgcgagcgtgcgcgataggaggagacgcgacggggtagtatcgttttggtggcgtattgttggacgtagttcggggtcggggagtcgcggtatttatttaggtttatggcggcgacgtcggcggttgcgcggggttaacgttttttttttttcgagaattcgaacgcggcgcgggacgtacggtacgatgggagacgtatgagttacggcggtcgcgtttaagtttgtttataattttcgttcggtntcgtttatagttttcgtcgcgtacgcgtagtttttacgaacgagcgcgttaagcgtatagcgtcgtttttcggtagagtttttttattagtttttaggtattcggacgtcgtttattagattttttcgtatcgttttttgttcggtttttttttcggggttttagcgggtcgggtttatgatttttcggtttcgtatttatttttattcggtaatttcgggcgtgtttcgtatatagtttatttttatcgagcgtttttttcgggacgtttattatttagcgcggtcgtattacgcgaggtttttatttttattcgtttagttcgcgttatatatagttttttaacgcgtttttgtcgcgtcgttttttttagatagtagcgtttcggattttagacgttttttgacggttggttttttttagaaaatgcgtcgtgtgagtttaaatatggtggggtttacgttggatttcgagtttgtaatttgtgtttgataaaatataaatatcgcgtgtttgttttttttttttgagatcgagtagtaatagttattttaattttttatt

SEQ ID NO: 18674 - DNA, 994 bp, Artificial Sequence
  chemically treated genomic DNA (Homo sapiens) CpG-island No: 18674
  misc_feature (565)..(565): n is either a, c, g or t
aataaaaaattaaaataactattactactcgatctcaaaaaaaaaaaacaaacacgcgatatttatattttatcaaacacaaattacaaactcgaaatccaacgtaaaccccaccatatttaaactcacacgacgcattttctaaaaaaaaccaaccgtcaaaaaacgtctaaaatccgaaacgctactatctaaaaaaaacgacgcgacaaaaacgcgttaaaaaactatatataacgcgaactaaacgaataaaaataaaaacctcgcgtaatacgaccgcgctaaataataaacgtcccgaaaaaaacgctcgataaaaataaactatatacgaaacacgcccgaaattaccgaataaaaataaatacgaaaccgaaaaatcataaacccgacccgctaaaaccccgaaaaaaaaaccgaacaaaaaacgatacgaaaaaatctaataaacgacgtccgaatacctaaaaactaataaaaaaactctaccgaaaaacgacgctatacgcttaacgcgctcgttcgtaaaaactacgcgtacgcgacgaaaactataaacganaccgaacgaaaattataaacaaacttaaacgcgaccgccgtaactcatacgtctcccatcgtaccgtacgtcccgcgccgcgttcgaattctcgaaaaaaaaaaaacgttaaccccgcgcaaccgccgacgtcgccgccataaacctaaataaataccgcgactccccgaccccgaactacgtccaacaatacgccaccaaaacgatactaccccgtcgcgtctcctcctatcgcgcacgctcgcgcgaacccgaaccgaaacgtcccccgcgtcgaaacgaatctaaaaatcccgaaataaccttaacgaaaaataatccgaatcccgccgcgcgttaaaccgcgtcttaccgcctccgaccccctacgcttaaaaacacgaaacaaacgtaaaattaaaacccttaaaaacgcccgaaactcgcgca

SEQ ID NO: 18675 - DNA, 994 bp, Artificial Sequence
  chemically treated genomic DNA (Homo sapiens) CpG-island No: 18675
  misc_feature (565)..(565): n is either a, c, g or t
ggtggagagttggagtggttgttattattcgattttagggggaggagataggtacgcgatgtttgtgttttgttaagtatagattgtaagttcggggtttagcgtaaattttattatgtttgggtttatacggcgtattttttggggaggattagtcgttaaaaagcgtttaggattcggaacgttgttgtttggagggggcggcgcggtaggagcgcgttgagggattgtatgtggcgcgagttgggcgggtgggagtggaagtttcgcgtggtgcggtcgcgttgggtggtgggcgtttcgggggaggcgttcggtgggggtgaattgtgtgcggggtacgttcggggttatcgggtgagggtgaatgcggggtcggggaattatgagttcgattcgttgggatttcggaagaggggtcgggtaggggacggtgcggaggggtttagtgagcgacgttcgggtatttgagggttggtgggagggttttgtcggaaggcggcgttgtgcgtttggcgcgttcgttcgtgaggattgcgcgtgcgcggcggaggttgtgggcggngtcgggcggaggttgtgagtaggtttaagcgcggtcgtcgtggtttatgcgttttttatcgtgtcgtgcgtttcgcgtcgcgttcgagttttcggaggggagggggcgttagtttcgcgtagtcgtcggcgtcgtcgttatggatttaggtgggtgtcgcggtttttcggtttcgggttgcgtttagtaatgcgttattagagcggtgttgtttcgtcgcgtttttttttgtcgcgtacgttcgcgcgggttcggatcgaaacgtttttcgcgtcggggcgggtttaggggtttcggggtggttttggcggggggtggttcgggtttcgtcgcgcgttgggtcgcgttttgtcgttttcggttttttgcgtttgaaaatacggagtagacgtgaagttagagtttttggaagcgttcggggttcgcgta

SEQ ID NO: 18676 - DNA, 994 bp, Artificial Sequence
  chemically treated genomic DNA (Homo sapiens) CpG-island No: 18676
  misc_feature (430)..(430): n is either a, c, g or t
tacgcgaaccccgaacgcttccaaaaactctaacttcacgtctactccgtattttcaaacgcaaaaaaccgaaaacgacaaaacgcgacccaacgcgcgacgaaacccgaaccaccccccgccaaaaccaccccgaaacccctaaacccgccccgacgcgaaaaacgtttcgatccgaacccgcgcgaacgtacgcgacaaaaaaaaacgcgacgaaacaacaccgctctaataacgcattactaaacgcaacccgaaaccgaaaaaccgcgacacccacctaaatccataacgacgacgccgacgactacgcgaaactaacgccccctcccctccgaaaactcgaacgcgacgcgaaacgcacgacacgataaaaaacgcataaaccacgacgaccgcgcttaaacctactcacaacctccgcccgacnccgcccacaacctccgccgcgcacgcgcaatcctcacgaacgaacgcgccaaacgcacaacgccgccttccgacaaaaccctcccaccaaccctcaaatacccgaacgtcgctcactaaacccctccgcaccgtcccctacccgacccctcttccgaaatcccaacgaatcgaactcataattccccgaccccgcattcaccctcacccgataaccccgaacgtaccccgcacacaattcacccccaccgaacgcctcccccgaaacgcccaccacccaacgcgaccgcaccacgcgaaacttccactcccacccgcccaactcgcgccacatacaatccctcaacgcgctcctaccgcgccgccccctccaaacaacaacgttccgaatcctaaacgctttttaacgactaatcctccccaaaaaatacgccgtataaacccaaacataataaaatttacgctaaaccccgaacttacaatctatacttaacaaaacacaaacatcgcgtacctatctcctccccctaaaatcgaataataacaaccactccaactctccacc

SEQ ID NO: 18677 - DNA, 588 bp, Artificial Sequence
  chemically treated genomic DNA (Homo sapiens) CpG-island No: 18677
aaggtttatgatttttaacggtaattcgttacgtttttgaagttgaatatcgcgtagggtttaaggtcggatatttttcggtttaggtttacgatatatttattttttttttttttcgttagggtcggttcgggcgtcggttttagtttcgcgcgttagtttttgtcggtttcggtttgtatttttatttttaggacgtttcgatagaaacgcgtcgtttggaagcggttttttattttgaatacgaagtgtagagttttgcgagtagttatgattttcgtcgtacgtagtcgttacgcgtatcgtatagtttagtttacgaagggcgttacgggtcgtgacgttattagtcgtcgacggcgcgttttcgtgacgtagttcgggttttagggaatatggcggcgttggtgagattcgcgaggtttgtcgtgcgatcgttgttgtaggtggtttaggtttgggattttgacgcgaggcgttgggttcgggcgttgcggcggagtttagtgaaagtggtgttttttttcggagaggtggtggaatagaagcgcgtttttgggaagtagtttcgtaaggtattatttgagg

SEQ ID NO: 18678 - DNA, 588 bp, Artificial Sequence
  chemically treated genomic DNA (Homo sapiens) CpG-island No: 18678
cctcaaataataccttacgaaactacttcccaaaaacgcgcttctattccaccacctctccgaaaaaaaacaccactttcactaaactccgccgcaacgcccgaacccaacgcctcgcgtcaaaatcccaaacctaaaccacctacaacaacgatcgcacgacaaacctcgcgaatctcaccaacgccgccatattccctaaaacccgaactacgtcacgaaaacgcgccgtcgacgactaataacgtcacgacccgtaacgcccttcgtaaactaaactatacgatacgcgtaacgactacgtacgacgaaaatcataactactcgcaaaactctacacttcgtattcaaaataaaaaaccgcttccaaacgacgcgtttctatcgaaacgtcctaaaaataaaaatacaaaccgaaaccgacaaaaactaacgcgcgaaactaaaaccgacgcccgaaccgaccctaacgaaaaaaaaaaaaaataaatatatcgtaaacctaaaccgaaaaatatccgaccttaaaccctacgcgatattcaacttcaaaaacgtaacgaattaccgttaaaaatcataaacctt

SEQ ID NO: 18679 - DNA, 588 bp, Artificial Sequence
  chemically treated genomic DNA (Homo sapiens) CpG-island No: 18679
ttttagatggtgttttgcggggttgttttttaggagcgcgtttttgttttattattttttcggaaggaaatattatttttattgggtttcgtcgtagcgttcggatttagcgtttcgcgttaaggttttaagtttggattatttgtagtaacggtcgtacgataaatttcgcgggttttattagcgtcgttatgttttttgagattcgggttgcgttacgaaagcgcgtcgtcggcggttagtgacgttacggttcgtggcgtttttcgtggattgggttgtacggtgcgcgtgacggttgcgtgcggcgggaattatggttgttcgtagagttttgtatttcgtatttaaagtgggaaatcgtttttagacggcgcgtttttatcgggacgttttggggatgaaggtgtaggtcggggtcgataggggttggcgcgcgaggttggaatcggcgttcgagtcggttttggcggagggaggggaaaatgggtgtgtcgtgaatttaagtcggagggtgttcgattttaggttttgcgcggtgtttagttttaggagcgtggcgagttgtcgttggggattataggtttt

SEQ ID NO: 18680 - DNA, 588 bp, Artificial Sequence
  chemically treated genomic DNA (Homo sapiens) CpG-island No: 18680
aaaacctataatccccaacgacaactcgccacgctcctaaaactaaacaccgcgcaaaacctaaaatcgaacaccctccgacttaaattcacgacacacccattttcccctccctccgccaaaaccgactcgaacgccgattccaacctcgcgcgccaacccctatcgaccccgacctacaccttcatccccaaaacgtcccgataaaaacgcgccgtctaaaaacgatttcccactttaaatacgaaatacaaaactctacgaacaaccataattcccgccgcacgcaaccgtcacgcgcaccgtacaacccaatccacgaaaaacgccacgaaccgtaacgtcactaaccgccgacgacgcgctttcgtaacgcaacccgaatctcaaaaaacataacgacgctaataaaacccgcgaaatttatcgtacgaccgttactacaaataatccaaacttaaaaccttaacgcgaaacgctaaatccgaacgctacgacgaaacccaataaaaataatatttccttccgaaaaaataataaaacaaaaacgcgctcctaaaaaacaaccccgcaaaacaccatctaaaa

SEQ ID NO: 18681 - DNA, 739 bp, Artificial Sequence
  chemically treated genomic DNA (Homo sapiens) CpG-island No: 18681
aatttattttatttcgtttttttcgttttttttgggtttttttagggatacggattttatttttacgtcgcgagtaaattgcgtttggggtttggagttaatcgtagttaaaggcgagtttttagaacggtttcgtttacgttttttttcgttttagttgggtttttaggggcggggagcgtgattagggatttttgtatttgtaatttcgtttttcgtttcggggttttcggtatatttcgattttcgttattcgcgtatttagagatatcgtgtgcgtaagtcgagcgcgtatcgatttacgttcgttatttatttgtcgtagaaatatttgtgaacgtagtatatattcgcgaatacgtattttcgcggatacgtagggatatacgcgggtacgtttggttcggttttgggtcgtcggttcggggttttttgttgtttgtcgtcgtttttttattttttttgagtgtttcggtgtttcggcgaattcgcgtttagtttcggttttataaggaattgatttcggtagttgtttatattttagttggcgtagtttagcgcggttttgatatataatcgtttcgttcgggttcgttttaaggaggcgggattcgcgttcggtttatcgcgtcgttcgggatcgtttttttcggggtttaggtttttggttgtttagcgtcgagttagttgagtttggtcgagttttagtaggttagtcggtttcggaatttcgcgtatt

SEQ ID NO: 18682 - DNA, 739 bp, Artificial Sequence
  chemically treated genomic DNA (Homo sapiens) CpG-island No: 18682
aatacgcgaaattccgaaaccgactaacctactaaaactcgaccaaactcaactaactcgacgctaaacaaccaaaaacctaaaccccgaaaaaaacgatcccgaacgacgcgataaaccgaacgcgaatcccgcctccttaaaacgaacccgaacgaaacgattatatatcaaaaccgcgctaaactacgccaactaaaatataaacaactaccgaaatcaattccttataaaaccgaaactaaacgcgaattcgccgaaacaccgaaacactcaaaaaaaataaaaaaacgacgacaaacaacaaaaaaccccgaaccgacgacccaaaaccgaaccaaacgtacccgcgtatatccctacgtatccgcgaaaatacgtattcgcgaatatatactacgttcacaaatatttctacgacaaataaataacgaacgtaaatcgatacgcgctcgacttacgcacacgatatctctaaatacgcgaataacgaaaatcgaaatataccgaaaaccccgaaacgaaaaacgaaattacaaatacaaaaatccctaatcacgctccccgcccctaaaaacccaactaaaacgaaaaaaaacgtaaacgaaaccgttctaaaaactcgcctttaactacgattaactccaaaccccaaacgcaatttactcgcgacgtaaaaataaaatccgtatccctaaaaaaacccaaaaaaaacgaaaaaaacgaaataaaataaatt

SEQ ID NO: 18683 - DNA, 739 bp, Artificial Sequence
  chemically treated genomic DNA (Homo sapiens) CpG-island No: 18683
agtacgcgaggtttcgggatcggttggtttgttggaattcggttaggtttagttggttcggcgttgggtagttaggagtttgggtttcggggagggcggtttcgggcggcgcggtgggtcgagcgcgggtttcgtttttttgaggcgggttcgggcggggcggttgtatattagggtcgcgttgagttgcgttagttgaggtgtgagtagttgtcgaagttagttttttgtggagtcggagttgggcgcggattcgtcgaggtatcgaggtatttagaggaggtgagagagcggcggtagataataggggatttcgggtcggcggtttagagtcgagttaagcgtgttcgcgtgtgtttttgcgtgttcgcgaggatgcgtgttcgcgggtgtgtgttgcgtttataggtgtttttgcggtaggtgaatgacgggcgtgggtcggtgcgcgttcggtttgcgtatacggtgtttttaagtgcgcgggtgacgagagtcgggatgtgtcggagatttcggggcggagagcgggattataagtataggaatttttggttacgtttttcgtttttggaaatttagttggggcgagggagggcgtggacgggatcgttttgggagttcgtttttggttgcggttggttttaggttttaggcgtagtttgttcgcggcgtggggatgaagttcgtgtttttggaggggtttaggaagggcgaggaaagcggagtggagtaagtt

SEQ ID NO: 18684 - DNA, 739 bp, Artificial Sequence
  chemically treated genomic DNA (Homo sapiens) CpG-island No: 18684
aacttactccactccgctttcctcgcccttcctaaacccctccaaaaacacgaacttcatccccacgccgcgaacaaactacgcctaaaacctaaaaccaaccgcaaccaaaaacgaactcccaaaacgatcccgtccacgccctccctcgccccaactaaatttccaaaaacgaaaaacgtaaccaaaaattcctatacttataatcccgctctccgccccgaaatctccgacacatcccgactctcgtcacccgcgcacttaaaaacaccgtatacgcaaaccgaacgcgcaccgacccacgcccgtcattcacctaccgcaaaaacacctataaacgcaacacacacccgcgaacacgcatcctcgcgaacacgcaaaaacacacgcgaacacgcttaactcgactctaaaccgccgacccgaaatcccctattatctaccgccgctctctcacctcctctaaatacctcgatacctcgacgaatccgcgcccaactccgactccacaaaaaactaacttcgacaactactcacacctcaactaacgcaactcaacgcgaccctaatatacaaccgccccgcccgaacccgcctcaaaaaaacgaaacccgcgctcgacccaccgcgccgcccgaaaccgccctccccgaaacccaaactcctaactacccaacgccgaaccaactaaacctaaccgaattccaacaaaccaaccgatcccgaaacctcgcgtact

SEQ ID NO: 18685 - DNA, 567 bp, Artificial Sequence
  chemically treated genomic DNA (Homo sapiens) CpG-island No: 18685
cgtgtttcgagacgttttcggtttcgtttatattttttttcggtttttagggcgggggtcgcgggggaagtaggggcgtaggtgatgttttttttttcgagtcgaggaggcgggaggttgcggcgtcgtttttcgtcgggcgagatcggtatgggggcgattcgggttttatttagtttttcgagaggcggtgatgtcgcgttttacgttcgttatcgcgcggtagatagttttttatcgaacgcggatatttattttttcgtggaagatggattttatgtttatttgtttggagttaacggtttttacgtcgaattattttttttagtttcgttttttgtttttttttttcgtttatttcgttttttttcggttcgtttcggtatttcgtttacgtgtcgtacgtagattaattattcgtgaggatgcgagtgtcgtgaagcgaagagcgagtgaacgtcggggatacgtgattttggtagcgcgtttttttagtttttgttagcgggttttttgggggatgttatatcgttatttgttgtttggaggatttttttcgttttttat

SEQ ID NO: 18686 - DNA, 567 bp, Artificial Sequence
  chemically treated genomic DNA (Homo sapiens) CpG-island No: 18686
ataaaaaacgaaaaaaatcctccaaacaacaaataacgatataacatcccccaaaaaacccgctaacaaaaactaaaaaaacgcgctaccaaaatcacgtatccccgacgttcactcgctcttcgcttcacgacactcgcatcctcacgaataattaatctacgtacgacacgtaaacgaaataccgaaacgaaccgaaaaaaaacgaaataaacgaaaaaaaaaaacaaaaaacgaaactaaaaaaaataattcgacgtaaaaaccgttaactccaaacaaataaacataaaatccatcttccacgaaaaaataaatatccgcgttcgataaaaaactatctaccgcgcgataacgaacgtaaaacgcgacatcaccgcctctcgaaaaactaaataaaacccgaatcgcccccataccgatctcgcccgacgaaaaacgacgccgcaacctcccgcctcctcgactcgaaaaaaaaaacatcacctacgcccctacttcccccgcgacccccgccctaaaaaccgaaaaaaaatataaacgaaaccgaaaacgtctcgaaacacg

SEQ ID NO: 18687 - DNA, 567 bp, Artificial Sequence
  chemically treated genomic DNA (Homo sapiens) CpG-island No: 18687
gtgggaagcggagaagattttttagatagtaggtggcgatgtagtattttttagaaggttcgttaatagaagttaggaggacgcgttattaaggttacgtgttttcggcgtttattcgtttttcgttttacgatattcgtatttttacgggtgattggtttgcgtgcggtacgtgggcggggtatcggggcgggtcggggaggggcggggtgggcggaggagaggggtagggggcggagttggagggggtggttcggcgtgggggtcgttggttttagataaataaatatggagtttattttttacgagaaagtgagtgttcgcgttcggtggggagttgtttgtcgcgcggtggcgggcgtggagcgcggtattatcgtttttcggagggttgggtggggttcgagtcgtttttatgtcgatttcgttcggcgaggggcgacgtcgtagtttttcgttttttcggttcgaggaggggagtattatttacgtttttatttttttcgcggttttcgttttgggagtcgggagggagtatgggcggggtcgggggcgtttcgggatacg

SEQ ID NO: 18688 - DNA, 567 bp, Artificial Sequence
  chemically treated genomic DNA (Homo sapiens) CpG-island No: 18688
cgtatcccgaaacgcccccgaccccgcccatactccctcccgactcccaaaacgaaaaccgcgaaaaaaataaaaacgtaaataatactcccctcctcgaaccgaaaaaacgaaaaactacgacgtcgcccctcgccgaacgaaatcgacataaaaacgactcgaaccccacccaaccctccgaaaaacgataataccgcgctccacgcccgccaccgcgcgacaaacaactccccaccgaacgcgaacactcactttctcgtaaaaaataaactccatatttatttatctaaaaccaacgacccccacgccgaaccaccccctccaactccgccccctacccctctcctccgcccaccccgcccctccccgacccgccccgataccccgcccacgtaccgcacgcaaaccaatcacccgtaaaaatacgaatatcgtaaaacgaaaaacgaataaacgccgaaaacacgtaaccttaataacgcgtcctcctaacttctattaacgaaccttctaaaaaatactacatcgccacctactatctaaaaaatcttctccgcttcccac

SEQ ID NO: 18689 - DNA, 547 bp, Artificial Sequence
  chemically treated genomic DNA (Homo sapiens) CpG-island No: 18689
tttggacgaatgtaagttgttcgcggaggggaggtagcgttttttttgttttaggttaggcgtgggattcgggtcggttttttttttagttcggttagcgggcggttattgggttatatttttacggacgtttttttgttatgatagttttagaaaattttttttaaaagtttcggttcggaaattttattttttattcgaagaaaattttatttttttttttcgttattttcgttcggaagtttcggggaagtttagattatttttttatatatgtatagtatcgagggtttgtttagaatttttttcgttatcgtcgtcgtgattttcgtcgcggcggtttttcgggttttttaaatttatttgtagttttagcgtttatagcgatttcgagattaagggtaatagggaatttaattcgcgttagtggaagttgcgatttcgggatttgttattcgtcgcgttcgtacggagtagaggggtgacgttagtaaattatattatttttttttttttagggttgattttttttatttttttttttttt

SEQ ID NO: 18690 - DNA, 547 bp, Artificial Sequence
  chemically treated genomic DNA (Homo sapiens) CpG-island No: 18690
aaaaaaaaaaaaaataaaaaaaatcaaccctaaaaaaaaaaaaataatataatttactaacgtcacccctctactccgtacgaacgcgacgaataacaaatcccgaaatcgcaacttccactaacgcgaattaaattccctattacccttaatctcgaaatcgctataaacgctaaaactacaaataaatttaaaaaacccgaaaaaccgccgcgacgaaaatcacgacgacgataacgaaaaaaattctaaacaaaccctcgatactatacatatataaaaaaataatctaaacttccccgaaacttccgaacgaaaataacgaaaaaaaaaaataaaattttcttcgaataaaaaataaaatttccgaaccgaaacttttaaaaaaaattttctaaaactatcataacaaaaaaacgtccgtaaaaatataacccaataaccgcccgctaaccgaactaaaaaaaaaaccgacccgaatcccacgcctaacctaaaacaaaaaaaacgctacctcccctccgcgaacaacttacattcgtccaaa

SEQ ID NO: 18691 - DNA, 547 bp, Artificial Sequence
  chemically treated genomic DNA (Homo sapiens) CpG-island No: 18691
aaaaaaaaaaaaaatgagaggagttaattttgaggaggaaaaagtagtatgatttgttggcgttatttttttgtttcgtgcgggcgcggcgaatggtaggtttcgaggtcgtagtttttattggcgcgggttgagttttttgttgtttttggtttcggggtcgttgtaggcgttgaggttgtaggtgggtttggggagttcggggggtcgtcgcgacgaggattacggcgacggtggcggggagggttttaggtaagttttcggtgttgtgtatgtgtggaggggtggtttgggttttttcggggttttcgaacgaaggtgacgggaaaggaaaatggggtttttttcgggtggaggatgggattttcgggtcggagtttttggaaagggttttttgaggttgttataataggaaaacgttcgtagagatgtgatttagtgatcgttcgttaatcggattggagagaagatcggttcggattttacgtttggtttgaagtagggaagacgttgtttttttttcgcgagtagtttatattcgtttaag

SEQ ID NO: 18692 - DNA, 547 bp, Artificial Sequence
  chemically treated genomic DNA (Homo sapiens) CpG-island No: 18692
cttaaacgaatataaactactcgcgaaaaaaaaacaacgtcttccctacttcaaaccaaacgtaaaatccgaaccgatcttctctccaatccgattaacgaacgatcactaaatcacatctctacgaacgttttcctattataacaacctcaaaaaaccctttccaaaaactccgacccgaaaatcccatcctccacccgaaaaaaaccccattttcctttcccgtcaccttcgttcgaaaaccccgaaaaaacccaaaccacccctccacacatacacaacaccgaaaacttacctaaaaccctccccgccaccgtcgccgtaatcctcgtcgcgacgaccccccgaactccccaaacccacctacaacctcaacgcctacaacgaccccgaaaccaaaaacaacaaaaaactcaacccgcgccaataaaaactacgacctcgaaacctaccattcgccgcgcccgcacgaaacaaaaaaataacgccaacaaatcatactactttttcctcctcaaaattaactcctctcatttttttttttttt

SEQ ID NO: 18693 - DNA, 693 bp, Artificial Sequence
  chemically treated genomic DNA (Homo sapiens) CpG-island No: 18693
  misc_feature (427)..(427): n is either a, c, g or t
aagagcggaggagagaggggagaagaggggggaggagagggtggaagggaggaggagtagagggaaaagggaggaggaggggggaagagaggaggagacgggggagagatggggggaagagaggaggagagggaggagaagaggaggagacgggggagggggagaaaaggagggaagagaggagtcggggaggagaggagaaggggggaagagaggaggggagcgggaagatgggggagggagaggtgggggaagagaggaggatagggaggagaagaggaggagacgggggagggggagaaaaggagggaagagacgggggaggagaggagaaggggggaagataggggagggggaagatcggggacggagaggtgggggaagataggaggagagggaggaaaatacgagacgggggagggggtangagacgacgagagtcgggaggagacgaggagacggagggagatacgaggaggataggggatatacgaggaggaggagatacgagaggaaaatacgagaggaggaggagatggcggacgcggagaagggggaggagataagtaggcgatacggaagacgagggggaaatttcggggatacgagggatagataagaagtagttttcggtcgcggtatacgtagacgaaaattcgaggtatacgagggtcggaggcgaagatttcggat

SEQ ID NO: 18694 - DNA, 693 bp, Artificial Sequence
  chemically treated genomic DNA (Homo sapiens) CpG-island No: 18694
  misc_feature (267)..(267): n is either a, c, g or t
atccgaaatcttcgcctccgaccctcgtatacctcgaattttcgtctacgtataccgcgaccgaaaactacttcttatctatccctcgtatccccgaaatttccccctcgtcttccgtatcgcctacttatctcctcccccttctccgcgtccgccatctcctcctcctctcgtattttcctctcgtatctcctcctcctcgtatatcccctatcctcctcgtatctccctccgtctcctcgtctcctcccgactctcgtcgtctcntaccccctcccccgtctcgtattttcctccctctcctcctatcttcccccacctctccgtccccgatcttccccctcccctatcttccccccttctcctctcctcccccgtctcttccctccttttctccccctcccccgtctcctcctcttctcctccctatcctcctctcttcccccacctctccctcccccatcttcccgctcccctcctctcttccccccttctcctctcctccccgactcctctcttccctccttttctccccctcccccgtctcctcctcttctcctccctctcctcctctcttccccccatctctcccccgtctcctcctctcttcccccctcctcctcccttttccctctactcctcctcccttccaccctctcctcccccctcttctcccctctctcctccgctctt

SEQ ID NO: 18695 - DNA, 693 bp, Artificial Sequence
  chemically treated genomic DNA (Homo sapiens) CpG-island No: 18695
  misc_feature (267)..(267): n is either a, c, g or t
gttcggggttttcgttttcgattttcgtgtgtttcgggttttcgtttgcgtgtgtcgcggtcggggattgttttttgtttatttttcgtgttttcggagtttttttttcgtttttcgtgtcgtttgtttgttttttttttttttttcgcgttcgttattttttttttttttcgtgtttttttttcgtgttttttttttttcgtgtattttttgtttttttcgtgttttttttcgttttttcgttttttttcggttttcgtcgttttntgttttttttttcgtttcgtgtttttttttttttttttttgtttttttttattttttcgttttcgatttttttttttttttgttttttttttttttttttttttttttcgttttttttttttttttttttttttttttcgtttttttttttttttttttttgtttttttttttttttttattttttttttttttattttttcgttttttttttttttttttttttttttttttttttttcgattttttttttttttttttttttttttttttttcgttttttttttttttttttttttttttttttttttttttttatttttttttcgttttttttttttttttttttttttttttttttttttttttgtttttttttttttttattttttttttttttttttttttttttttttttttcgttttt

SEQ ID NO: 18696 - DNA, 693 bp, Artificial Sequence
  chemically treated genomic DNA (Homo sapiens) CpG-island No: 18696
  misc_feature (427)..(427): n is either a, c, g or t
aaaaacgaaaaaaaaaaaaaaaaaaaaaaaaaaaaaaaaaataaaaaaaaaaaaaaacaaaaaaaaaaaaaaaaaaaaaaaaaaaaaaaaaaaaaaaacgaaaaaaaaataaaaaaaaaaaaaaaaaaaaaaaaaaaaaaaaaaaaaaaacgaaaaaaaaaaaaaaaaaaaaaaaaaaaaaaaatcgaaaaaaaaaaaaaaaaaaaaaaaaaaaaaaaaaaaacgaaaaaataaaaaaaaaaaaaataaaaaaaaaaaaaaaaacaaaaaaaaaaaaaaaaaaaaacgaaaaaaaaaaaaaaaaaaaaaaaaaaaacgaaaaaaaaaaaaaaaaaaaaaaaaaacaaaaaaaaaaaaaaatcgaaaacgaaaaaataaaaaaaaacaaaaaaaaaaaaaaaaaaacacgaaacgaaaaaaaaaacanaaaacgacgaaaaccgaaaaaaaacgaaaaaacgaaaaaaaacacgaaaaaaacaaaaaatacacgaaaaaaaaaaaacacgaaaaaaaaacacgaaaaaaaaaaaaaataacgaacgcgaaaaaaaaaaaaaaaacaaacaaacgacacgaaaaacgaaaaaaaaactccgaaaacacgaaaaataaacaaaaaacaatccccgaccgcgacacacgcaaacgaaaacccgaaacacacgaaaatcgaaaacgaaaaccccgaac

SEQ ID NO: 18697 - DNA, 668 bp, Artificial Sequence
  chemically treated genomic DNA (Homo sapiens) CpG-island No: 18697
ttcgacggttcgggtttcggcgtttttcgtttaaggttgggagggaggtttggtgttttattcggttttcgcggtaattaaaataaaaggtgtatcgggatgtgcgtgcgtttttcgtagatatgcggagaggtttagagaaggcgttttggttacgtcgagttatttgttttgcgtttattagaggtcgcggatttcgcgttcggaaattaacggaattcgtaggtcggggtagagggtggtaagggggtatcgcgagtaggttagttgtttcgtcgttttcgttcgcgagtcgggtacgttttttgggatttttttacgttttattgttggttttttcgtttttttcgttttaatttataagttttatatttatttcgtcgtcggtttagttgtttggtttaggttttttttcggatttattttttattcgtattttcggtgagttattttcgtagacggcgacggcggtttagttttagtttgtaaattaaagcgttttttgcgtttttggtttcgtagtttaaagttcgggtaatttttttttttcggtatgaaagcgaatcgatcgcggggtattgcggggatgtcggattttttgttgggttaagttttgttgcgtttttaaaacgtttttgttttgttttcgtttgtttttttttttagtt

SEQ ID NO: 18698 - DNA, 668 bp, Artificial Sequence
  chemically treated genomic DNA (Homo sapiens) CpG-island No: 18698
aactaaaaaaaaaaacaaacgaaaacaaaacaaaaacgttttaaaaacgcaacaaaacttaacccaacaaaaaatccgacatccccgcaataccccgcgatcgattcgctttcataccgaaaaaaaaaaattacccgaactttaaactacgaaaccaaaaacgcaaaaaacgctttaatttacaaactaaaactaaaccgccgtcgccgtctacgaaaataactcaccgaaaatacgaataaaaaataaatccgaaaaaaaacctaaaccaaacaactaaaccgacgacgaaataaatataaaacttataaattaaaacgaaaaaaacgaaaaaaccaacaataaaacgtaaaaaaatcccaaaaaacgtacccgactcgcgaacgaaaacgacgaaacaactaacctactcgcgatacccccttaccaccctctaccccgacctacgaattccgttaatttccgaacgcgaaatccgcgacctctaataaacgcaaaacaaataactcgacgtaaccaaaacgccttctctaaacctctccgcatatctacgaaaaacgcacgcacatcccgatacaccttttattttaattaccgcgaaaaccgaataaaacaccaaacctccctcccaaccttaaacgaaaaacgccgaaacccgaaccgtcgaa

SEQ ID NO: 18699 - DNA, 668 bp, Artificial Sequence
  chemically treated genomic DNA (Homo sapiens) CpG-island No: 18699
ggttgggagggagagtaaacgagagtagaatagaggcgttttggaagcgtagtaggatttggtttagtagaggattcgatattttcgtagtgtttcgcggtcggttcgtttttatgtcgaggggaggggattattcgggttttgggttgcggggttaggagcgtagaaagcgttttgatttataagttgaggttgagtcgtcgtcgtcgtttgcgagggtgatttatcgggggtgcgggtgggaggtagattcggagaggggtttaaattaggtaattgggtcggcggcggggtgggtgtggggtttatgggttggggcgggggggacgaagaagttagtagtggagcgtgggggagttttagggagcgtgttcggttcgcgagcggaggcggcggagtagttggtttgttcgcggtgtttttttgttattttttgtttcggtttgcggatttcgttggttttcgagcgcgggattcgcggtttttagtgggcgtagggtaggtggttcggcgtaattaaagcgttttttttggattttttcgtatatttgcggaaggcgtacgtatatttcggtgtattttttgttttggttatcgcgagggtcggatagggtattaagttttttttttagttttgggcgaggaacgtcggagttcgagtcgtcgga

SEQ ID NO: 18700 - DNA, 668 bp, Artificial Sequence
  chemically treated genomic DNA (Homo sapiens) CpG-island No: 18700
tccgacgactcgaactccgacgttcctcgcccaaaactaaaaaaaaaacttaataccctatccgaccctcgcgataaccaaaacaaaaaatacaccgaaatatacgtacgccttccgcaaatatacgaaaaaatccaaaaaaaacgctttaattacgccgaaccacctaccctacgcccactaaaaaccgcgaatcccgcgctcgaaaaccaacgaaatccgcaaaccgaaacaaaaaataacaaaaaaacaccgcgaacaaaccaactactccgccgcctccgctcgcgaaccgaacacgctccctaaaactcccccacgctccactactaacttcttcgtcccccccgccccaacccataaaccccacacccaccccgccgccgacccaattacctaatttaaacccctctccgaatctacctcccacccgcacccccgataaatcaccctcgcaaacgacgacgacgactcaacctcaacttataaatcaaaacgctttctacgctcctaaccccgcaacccaaaacccgaataatcccctcccctcgacataaaaacgaaccgaccgcgaaacactacgaaaatatcgaatcctctactaaaccaaatcctactacgcttccaaaacgcctctattctactctcgtttactctccctcccaacc

SEQ ID NO: 18701 - DNA, 518 bp, Artificial Sequence
  chemically treated genomic DNA (Homo sapiens) CpG-island No: 18701
agtcgtttagcggtttcgcggggtcgggggcgtcgtcggtttcgttgtcggagtttagggagttgagggagtcgtaagaggagtcgcggttttcgtagtcgtatatttgtatcgagtcgtacgggggtacgtcggggttttcgttcgtttcgcggagtcgtagcgttaggagttgcgttacgtcggcggggtcggggggtttgggttggcgcgatattcgggttcggggtaatacgtttcggcgcgcgggagggtcgggcgtcgggggggtcgtttcgttcgggttttgtaaggtcgtgatgtcgaaggtttcggtgtttttttcgtcgtcgttttcgtcgtcgtaggtgatgatgttttttcggacgttttttttttttagtattattagtgttttttgtttttgtcgtcgtagggttacgaagagtattattagggttgcgcgagaggcgcgtatataggttttgagttagtagggtcgggagcgggcggtttgtttttatgtgaaaggttgattt

SEQ ID NO: 18702 - DNA, 518 bp, Artificial Sequence
  chemically treated genomic DNA (Homo sapiens) CpG-island No: 18702
aaatcaacctttcacataaaaacaaaccgcccgctcccgaccctactaactcaaaacctatatacgcgcctctcgcgcaaccctaataatactcttcgtaaccctacgacgacaaaaacaaaaaacactaataatactaaaaaaaaaaaacgtccgaaaaaacatcatcacctacgacgacgaaaacgacgacgaaaaaaacaccgaaaccttcgacatcacgaccttacaaaacccgaacgaaacgacccccccgacgcccgaccctcccgcgcgccgaaacgtattaccccgaacccgaatatcgcgccaacccaaaccccccgaccccgccgacgtaacgcaactcctaacgctacgactccgcgaaacgaacgaaaaccccgacgtacccccgtacgactcgatacaaatatacgactacgaaaaccgcgactcctcttacgactccctcaactccctaaactccgacaacgaaaccgacgacgcccccgaccccgcgaaaccgctaaacgact

SEQ ID NO: 18703 - DNA, 518 bp, Artificial Sequence
  chemically treated genomic DNA (Homo sapiens) CpG-island No: 18703
gggttagttttttatatggagataggtcgttcgttttcggttttgttggtttagggtttgtgtgcgcgtttttcgcgtagttttggtggtgtttttcgtggttttgcggcggtagaagtaagaagtattgatggtattggaggaggaggacgttcgagagaatattattatttacgacgacgagggcggcggcgaggaggatatcgaggttttcgatattacggttttgtagaattcggacggggcggttttttcggcgttcggttttttcgcgcgtcgagacgtgttgtttcgggttcgggtgtcgcgttagtttagatttttcggtttcgtcgacgtggcgtagtttttggcgttgcggtttcgcgaggcggacgaggatttcggcgtattttcgtacgattcggtgtaggtgtacggttacgagggtcgcggttttttttgcggtttttttagttttttgggtttcggtagcgaagtcggcggcgttttcggtttcgcggagtcgttggacgatt

SEQ ID NO: 18704 - DNA, 518 bp, Artificial Sequence
  chemically treated genomic DNA (Homo sapiens) CpG-island No: 18704
aatcgtccaacgactccgcgaaaccgaaaacgccgccgacttcgctaccgaaacccaaaaaactaaaaaaaccgcaaaaaaaaccgcgaccctcgtaaccgtacacctacaccgaatcgtacgaaaatacgccgaaatcctcgtccgcctcgcgaaaccgcaacgccaaaaactacgccacgtcgacgaaaccgaaaaatctaaactaacgcgacacccgaacccgaaacaacacgtctcgacgcgcgaaaaaaccgaacgccgaaaaaaccgccccgtccgaattctacaaaaccgtaatatcgaaaacctcgatatcctcctcgccgccgccctcgtcgtcgtaaataataatattctctcgaacgtcctcctcctccaataccatcaatacttcttacttctaccgccgcaaaaccacgaaaaacaccaccaaaactacgcgaaaaacgcgcacacaaaccctaaaccaacaaaaccgaaaacgaacgacctatctccatataaaaaactaaccc

SEQ ID NO: 18705 - DNA, 601 bp, Artificial Sequence
  chemically treated genomic DNA (Homo sapiens) CpG-island No: 18705
gtcgagtttgtcgtcgggtttcggggtatagtttcgagtcgattggagcgggcgtcgcgtttcgttgtaggtttgagcggtttcggcgagaataagggagcgagacggagggggcgggggaagaagatttcgtttgcggaggagcgaggcggtttcgcgtcgcgcgggagaggagagtttagttttcgatttttttcggttagtcgggttcgcgcggcgggggcgggggcggaggcggcgtcgcgcgttcgttttttcggcgtttttgggttgcggggcgtatatagatgcggcgtttttttcggatcgggttcgtagcgttcggtagggtattcgggcgggaggacgtttaggttacggcgttaggttattttcgaagagttggcggggcgggtgtattcgggagcgcgaagttgttagttttcgttcgtagcggaaaacgggcgagcgcgcggtgaggtggggaattcggagtttattgcggagagattcggtttcgggttttcggttttcggttggtttttgggattggtgtggatggaattttagttgtaaggcggcggcgttttgagagtttatgtaaagtacggtagtaggttag

SEQ ID NO: 18706 - DNA, 601 bp, Artificial Sequence
  chemically treated genomic DNA (Homo sapiens) CpG-island No: 18706
ctaacctactaccgtactttacataaactctcaaaacgccgccgccttacaactaaaattccatccacaccaatcccaaaaaccaaccgaaaaccgaaaacccgaaaccgaatctctccgcaataaactccgaattccccacctcaccgcgcgctcgcccgttttccgctacgaacgaaaactaacaacttcgcgctcccgaatacacccgccccgccaactcttcgaaaataacctaacgccgtaacctaaacgtcctcccgcccgaataccctaccgaacgctacgaacccgatccgaaaaaaacgccgcatctatatacgccccgcaacccaaaaacgccgaaaaaacgaacgcgcgacgccgcctccgcccccgcccccgccgcgcgaacccgactaaccgaaaaaaatcgaaaactaaactctcctctcccgcgcgacgcgaaaccgcctcgctcctccgcaaacgaaatcttcttcccccgccccctccgtctcgctcccttattctcgccgaaaccgctcaaacctacaacgaaacgcgacgcccgctccaatcgactcgaaactataccccgaaacccgacgacaaactcgac

SEQ ID NO: 18707 - DNA, 601 bp, Artificial Sequence
  chemically treated genomic DNA (Homo sapiens) CpG-island No: 18707
ttgatttgttatcgtgttttgtatgggtttttaaaacgtcgtcgttttgtagttgggattttatttatattagttttaaaagttagtcgggaatcgggagttcggagtcgggttttttcgtagtgggtttcgaattttttattttatcgcgcgttcgttcgtttttcgttgcgggcggggattggtagtttcgcgttttcgggtgtattcgtttcgttagtttttcggaaatggtttggcgtcgtggtttggacgttttttcgttcgagtgttttgtcgggcgttgcgggttcggttcgggaggggcgtcgtatttgtatgcgtttcgtagtttaggagcgtcgagggggcggacgcgcggcgtcgttttcgttttcgttttcgtcgcgcgggttcggttggtcggggagggtcggaggttgggtttttttttttcgcgcggcgcggagtcgtttcgttttttcgtaggcggagtttttttttttcgtttttttcgtttcgtttttttgttttcgtcggggtcgtttagatttgtagcggagcgcggcgttcgttttaatcggttcggggttgtgtttcgggattcggcgataagttcgat

SEQ ID NO: 18708 - DNA, 601 bp, Artificial Sequence
  chemically treated genomic DNA (Homo sapiens) CpG-island No: 18708
atcgaacttatcgccgaatcccgaaacacaaccccgaaccgattaaaacgaacgccgcgctccgctacaaatctaaacgaccccgacgaaaacaaaaaaacgaaacgaaaaaaacgaaaaaaaaaaactccgcctacgaaaaaacgaaacgactccgcgccgcgcgaaaaaaaaaaacccaacctccgaccctccccgaccaaccgaacccgcgcgacgaaaacgaaaacgaaaacgacgccgcgcgtccgccccctcgacgctcctaaactacgaaacgcatacaaatacgacgcccctcccgaaccgaacccgcaacgcccgacaaaacactcgaacgaaaaaacgtccaaaccacgacgccaaaccatttccgaaaaactaacgaaacgaatacacccgaaaacgcgaaactaccaatccccgcccgcaacgaaaaacgaacgaacgcgcgataaaataaaaaattcgaaacccactacgaaaaaacccgactccgaactcccgattcccgactaacttttaaaactaatataaataaaatcccaactacaaaacgacgacgttttaaaaacccatacaaaacacgataacaaatcaa

SEQ ID NO: 18709 - DNA, 665 bp, Artificial Sequence
  chemically treated genomic DNA (Homo sapiens) CpG-island No: 18709
tgggtcgtcggggtagtggagaatcgaatatcgtgacgggttttttttcgtttttaattattttttttatttatcgaagtagttttttttggtttttggttttcgtattcgggttcgggcggttttcggaacgaaaggatttggtggtttttttagattcgacggtttaattttcgagggtttttcgcgggtttcggtttttcgtttatcggtgtttatcgttaggcgaagtaaagttgttagttcgttttggtatcgggcgtttacggcgtagttttcgtagtcggttatagagtgtcgttcgggttgcgtttttcgtttttttaagggtttcgtcgtttttatttcggtttcggttagagttttagggttgtttagggtcgggggatacgagtggcggtttttttggtagtcgaatttcgcgggtcgttgagcgtataatcggtttagggcggcgtggagtttcgggtaggcggacgggattttttcgggagaatagtttgtcggtgtttcggttaggggtgggttaaataggtacggtttcgttggtaaggggttttcgtggcgttggtcgtagtttatgttgatgtcgttggtgcgattgttgtagggtcggttatttttagtttcgttagttttcgtttcgtttagtagtaggttgtttt

SEQ ID NO: 18710 - DNA, 665 bp, Artificial Sequence
  chemically treated genomic DNA (Homo sapiens) CpG-island No: 18710
aaaacaacctactactaaacgaaacgaaaactaacgaaactaaaaataaccgaccctacaacaatcgcaccaacgacatcaacataaactacgaccaacgccacgaaaaccccttaccaacgaaaccgtacctatttaacccacccctaaccgaaacaccgacaaactattctcccgaaaaaatcccgtccgcctacccgaaactccacgccgccctaaaccgattatacgctcaacgacccgcgaaattcgactaccaaaaaaaccgccactcgtatcccccgaccctaaacaaccctaaaactctaaccgaaaccgaaataaaaacgacgaaacccttaaaaaaacgaaaaacgcaacccgaacgacactctataaccgactacgaaaactacgccgtaaacgcccgataccaaaacgaactaacaactttacttcgcctaacgataaacaccgataaacgaaaaaccgaaacccgcgaaaaaccctcgaaaattaaaccgtcgaatctaaaaaaaccaccaaatcctttcgttccgaaaaccgcccgaacccgaatacgaaaaccaaaaaccaaaaaaaactacttcgataaataaaaaaaataattaaaaacgaaaaaaaacccgtcacgatattcgattctccactaccccgacgaccca

SEQ ID NO: 18711 - DNA, 665 bp, Artificial Sequence
  chemically treated genomic DNA (Homo sapiens) CpG-island No: 18711
ggggtagtttgttgttggacggggcgggggttggcggagttggaggtagtcggttttgtagtaatcgtattagcggtattagtatgggttacgattagcgttacgggagttttttgttagcggggtcgtgtttgtttggtttatttttggtcggagtatcggtaggttattttttcggaggggtttcgttcgtttattcggagttttacgtcgttttggatcgattgtacgtttagcggttcgcggggttcggttgttaggaaagtcgttattcgtatttttcggttttgggtagttttggagttttagtcggggtcggagtgggagcggcggggtttttggagagacggggggcgtaattcggacgatattttgtgatcggttacggggattgcgtcgtgggcgttcggtattaggacgagttaatagttttgtttcgtttgacggtgggtatcggtgggcgagaagtcggagttcgcggagaattttcggggattgagtcgtcgggtttggaggagttattaggttttttcgtttcggaggtcgttcgggttcggatgcgggagttagaggttagggaggattatttcggtgagtgagagaagtggttagggacgggaagggattcgttacggtattcggttttttattgtttcgacggttta

SEQ ID NO: 18712 - DNA, 665 bp, Artificial Sequence
  chemically treated genomic DNA (Homo sapiens) CpG-island No: 18712
taaaccgtcgaaacaataaaaaaccgaataccgtaacgaatcccttcccgtccctaaccacttctctcactcaccgaaataatcctccctaacctctaactcccgcatccgaacccgaacgacctccgaaacgaaaaaacctaataactcctccaaacccgacgactcaatccccgaaaattctccgcgaactccgacttctcgcccaccgatacccaccgtcaaacgaaacaaaactattaactcgtcctaataccgaacgcccacgacgcaatccccgtaaccgatcacaaaatatcgtccgaattacgccccccgtctctccaaaaaccccgccgctcccactccgaccccgactaaaactccaaaactacccaaaaccgaaaaatacgaataacgactttcctaacaaccgaaccccgcgaaccgctaaacgtacaatcgatccaaaacgacgtaaaactccgaataaacgaacgaaacccctccgaaaaaataacctaccgatactccgaccaaaaataaaccaaacaaacacgaccccgctaacaaaaaactcccgtaacgctaatcgtaacccatactaataccgctaatacgattactacaaaaccgactacctccaactccgccaacccccgccccgtccaacaacaaactacccc

SEQ ID NO: 18713 - DNA, 646 bp, Artificial Sequence
  chemically treated genomic DNA (Homo sapiens) CpG-island No: 18713
gtcggtttcgcgtttttcgtttcgcgttttcgttttttcgcgtcgcgtataaaacggtttcgtagcgagtagcgggcgcggggttgcggcggttcgcgttcgggagataaaagcggggcgcgcgatttacgtttcgcggtttcggcggtttcgcgtttcgttcgggtttgggggaaggggagggttagtcgttcggggaggaataatacgggcggtttcgtttttcggcggttttgggcgatcggcgcgtcgtttcgcggtgttagttcgggagttcgggagttcgggcgcgggattaggttacgcggggcgttgggaggggattggtggttcgaggcgggtgggtcgcggggttcggtttttcgttcgtgggatcgcgcgttttcgtcgagcgtagttttttcgcgtgtggggttttagtacgtggcgtatttttgcgcgcgtgcgcgtgtagtcggggttcgagcgttacgtgcgagttggggtgcgcgggtattggtgcgtgtcgggagcggggacgttttgtttttcgaggttgttttgtttttcgaggtcgttcgtagttgtcgttcgttttgggtttggggatttcggttttgcgttttttcgtatttttggtaggtgtagttttaggtatagttaagag

SEQ ID NO: 18714 - DNA, 646 bp, Artificial Sequence
  chemically treated genomic DNA (Homo sapiens) CpG-island No: 18714
ctcttaactatacctaaaactacacctaccaaaaatacgaaaaaacgcaaaaccgaaatccccaaacccaaaacgaacgacaactacgaacgacctcgaaaaacaaaacaacctcgaaaaacaaaacgtccccgctcccgacacgcaccaatacccgcgcaccccaactcgcacgtaacgctcgaaccccgactacacgcgcacgcgcgcaaaaatacgccacgtactaaaaccccacacgcgaaaaaactacgctcgacgaaaacgcgcgatcccacgaacgaaaaaccgaaccccgcgacccacccgcctcgaaccaccaatcccctcccaacgccccgcgtaacctaatcccgcgcccgaactcccgaactcccgaactaacaccgcgaaacgacgcgccgatcgcccaaaaccgccgaaaaacgaaaccgcccgtattattcctccccgaacgactaaccctccccttcccccaaacccgaacgaaacgcgaaaccgccgaaaccgcgaaacgtaaatcgcgcgccccgcttttatctcccgaacgcgaaccgccgcaaccccgcgcccgctactcgctacgaaaccgttttatacgcgacgcgaaaaaacgaaaacgcgaaacgaaaaacgcgaaaccgac

SEQ ID NO: 18715 - DNA, 646 bp, Artificial Sequence
  chemically treated genomic DNA (Homo sapiens) CpG-island No: 18715
tttttgattgtatttggggttgtatttgttaggagtgcggaaaggcgtagggtcgaggtttttaagtttagagcgggcggtagttgcgggcgatttcggagggtagagtaatttcggagggtagggcgttttcgttttcggtacgtattagtgttcgcgtattttagttcgtacgtggcgttcgggtttcggttgtacgcgtacgcgcgtagggatgcgttacgtgttggggttttatacgcggggaggttgcgttcggcgagggcgcgcggttttacgggcggggagtcgggtttcgcgatttattcgtttcgggttattagtttttttttagcgtttcgcgtagtttggtttcgcgttcgggttttcgggttttcgggttggtatcgcgaggcggcgcgtcggtcgtttagggtcgtcgaggggcggggtcgttcgtattgttttttttcgagcggttggtttttttttttttttagattcgggcggggcgcggggtcgtcgaagtcgcggaacgtgggtcgcgcgtttcgtttttgtttttcgggcgcgagtcgtcgtagtttcgcgttcgttgttcgttgcggagtcgttttgtgcgcggcgcgggggaacggggacgcggggcggggggcgcggagtcggt

SEQ ID NO: 18716 - DNA, 646 bp, Artificial Sequence
  chemically treated genomic DNA (Homo sapiens) CpG-island No: 18716
accgactccgcgccccccgccccgcgtccccgttcccccgcgccgcgcacaaaacgactccgcaacgaacaacgaacgcgaaactacgacgactcgcgcccgaaaaacaaaaacgaaacgcgcgacccacgttccgcgacttcgacgaccccgcgccccgcccgaatctaaaaaaaaaaaaaaaccaaccgctcgaaaaaaaacaatacgaacgaccccgcccctcgacgaccctaaacgaccgacgcgccgcctcgcgataccaacccgaaaacccgaaaacccgaacgcgaaaccaaactacgcgaaacgctaaaaaaaaactaataacccgaaacgaataaatcgcgaaacccgactccccgcccgtaaaaccgcgcgccctcgccgaacgcaacctccccgcgtataaaaccccaacacgtaacgcatccctacgcgcgtacgcgtacaaccgaaacccgaacgccacgtacgaactaaaatacgcgaacactaatacgtaccgaaaacgaaaacgccctaccctccgaaattactctaccctccgaaatcgcccgcaactaccgcccgctctaaacttaaaaacctcgaccctacgcctttccgcactcctaacaaatacaaccccaaatacaatcaaaaa

SEQ ID NO: 18717 - DNA, 787 bp, Artificial Sequence
  chemically treated genomic DNA (Homo sapiens) CpG-island No: 18717
tcgtttttttgttttcgtggagcgagcgttatgtttcgtaagaattagggaggcggtttagggtcgtgggggttgcgagggtttcgtcgcgcggggttttatttatcgtcgtttttagttttgataagtagggatatgttttttagtcgttttacgtagttagacgatatatgttcggtgtttcggtcgttttattgtcggttttcgttgagcgtgtatatttttattcgtcgtcgggtgtcggttatcgtgtcgttcgggaatcggggcgggggtttcgttagtagacgtttaggaaaggggttttggagaggcgaggggcgaggcgtgagggcgttcgcgagcggagggtttttcggttttattgtcgtcgttgggcgtcgcggggtcgcgtcgtcgtttgtatggttcgttttagggatcgagttttgggtcgtcgttttttttcgttttcggtttttcggcgttattgtttaggtttggcgagttcggcgttcggtagtttcgagggggtcgcgtagcgtttcgtagtttttcgtttcgtagcgttaggaattcggggttttcgttattgttttgttttcgttttcgttatgattttcgcgaagtagtttttcgcgtcgtcgtcgtttttttaggtcgtcgtcgtcgtcgttatattttttttttttatatttggttttgttatcgcggttagtggttttttttcgttttttttgttttaaacgttagaagtcgataggcgtttgattttgttgtaattgttattattgttcgggagattttg

SEQ ID NO: 18718 - DNA, 787 bp, Artificial Sequence
  chemically treated genomic DNA (Homo sapiens) CpG-island No: 18718
caaaatctcccgaacaataataacaattacaacaaaatcaaacgcctatcgacttctaacgtttaaaacaaaaaaaacgaaaaaaaaccactaaccgcgataacaaaaccaaatataaaaaaaaaaaatataacgacgacgacgacgacctaaaaaaacgacgacgacgcgaaaaactacttcgcgaaaatcataacgaaaacgaaaacaaaacaataacgaaaaccccgaattcctaacgctacgaaacgaaaaactacgaaacgctacgcgaccccctcgaaactaccgaacgccgaactcgccaaacctaaacaataacgccgaaaaaccgaaaacgaaaaaaaacgacgacccaaaactcgatccctaaaacgaaccatacaaacgacgacgcgaccccgcgacgcccaacgacgacaataaaaccgaaaaaccctccgctcgcgaacgccctcacgcctcgcccctcgcctctccaaaacccctttcctaaacgtctactaacgaaacccccgccccgattcccgaacgacacgataaccgacacccgacgacgaataaaaatatacacgctcaacgaaaaccgacaataaaacgaccgaaacaccgaacatatatcgtctaactacgtaaaacgactaaaaaacatatccctacttatcaaaactaaaaacgacgataaataaaaccccgcgcgacgaaaccctcgcaacccccacgaccctaaaccgcctccctaattcttacgaaacataacgctcgctccacgaaaacaaaaaaacga

SEQ ID NO: 18719 - DNA, 787 bp, Artificial Sequence
  chemically treated genomic DNA (Homo sapiens) CpG-island No: 18719
tagagtttttcgggtagtggtagtagttgtagtaggattaggcgtttgtcggtttttgacgtttaaaatagggggagcggaagggagttattggtcgcggtggtagggttaggtataaggaaggaaaatatggcggcggcggcggcggtttgaggaggcggcggcggcgcgggaagttgtttcgcggagattatggcggaggcgggagtagggtagtgacgggagtttcgagtttttagcgttgcggggcgggaggttacgaagcgttgcgcggttttttcggggttgtcgggcgtcgggttcgttaggtttggataatagcgtcggggagtcggaggcgaggaaaggcggcggtttagagttcggtttttggagcgggttatgtaggcggcggcgcggtttcgcggcgtttagcggcggtagtgaggtcggggagtttttcgttcgcgggcgtttttacgtttcgtttttcgtttttttagggttttttttttgggcgtttattggcggggttttcgtttcggttttcgggcggtacgatgatcgatattcggcggcgggtgaaggtgtatacgtttaacgaggatcggtagtgggacgatcggggtatcgggtatgtgtcgtttggttacgtggagcggttgaagggtatgtttttgtttgttagggttgagagcgacggtaagtgaagtttcgcgcggcgggattttcgtagtttttacggttttgggtcgtttttttggtttttgcggggtatggcgttcgttttacgagaatagagggacgg

SEQ ID NO: 18720 - DNA, 787 bp, Artificial Sequence
  chemically treated genomic DNA (Homo sapiens) CpG-island No: 18720
ccgtccctctattctcgtaaaacgaacgccataccccgcaaaaaccaaaaaaacgacccaaaaccgtaaaaactacgaaaatcccgccgcgcgaaacttcacttaccgtcgctctcaaccctaacaaacaaaaacatacccttcaaccgctccacgtaaccaaacgacacatacccgataccccgatcgtcccactaccgatcctcgttaaacgtatacaccttcacccgccgccgaatatcgatcatcgtaccgcccgaaaaccgaaacgaaaaccccgccaataaacgcccaaaaaaaaaaccctaaaaaaacgaaaaacgaaacgtaaaaacgcccgcgaacgaaaaactccccgacctcactaccgccgctaaacgccgcgaaaccgcgccgccgcctacataacccgctccaaaaaccgaactctaaaccgccgcctttcctcgcctccgactccccgacgctattatccaaacctaacgaacccgacgcccgacaaccccgaaaaaaccgcgcaacgcttcgtaacctcccgccccgcaacgctaaaaactcgaaactcccgtcactaccctactcccgcctccgccataatctccgcgaaacaacttcccgcgccgccgccgcctcctcaaaccgccgccgccgccgccatattttccttccttatacctaaccctaccaccgcgaccaataactcccttccgctccccctattttaaacgtcaaaaaccgacaaacgcctaatcctactacaactactaccactacccgaaaaactcta

SEQ ID NO: 18721 - DNA, 831 bp, Artificial Sequence
  chemically treated genomic DNA (Homo sapiens) CpG-island No: 18721
ttcggtcgtttaagcgattcggattagtggaagtcggttttttttcgtcgtcgtttttttcgttttttttatatagttaaaatcgtcgttattttggttcgttttttaaaagcggcgcgcggggttatttagggagtagttgtaggggcggttcgtagttttattatttaaagagatagtagcgagatcgggagttttattgcggcggaggttttcgacggaggcgggaggcgggcgcggagttgtcgaggtggcgggagcgtagggagcggaggaggcgggacgtagattgcgtcggtgatagttcgaggttttttttcgtttttttgtacgtatcgtcgtgcgagcgttgggcggtgtgtgcgttcgtcgcgttttgtgttcgttattagtttcgttttaggatgtacgaggggcgtggatacgtttgcggtttttgttcgcgggtttcggcgtttcggtttcgttttcgttcgtcgttatttttttttgtttttgtttcgtttttgtttttgtttttgtttttggtttgcggacgtcgggtagcgtgggtttgggtttttattcgttttcgagagcgttttttcggggtcgtttttatggttgagtcgggcgttcgggatttattcggcgttttgcggatttgagggaatgaaatggaaacgttttcggggaaggtcgcgggtgtgggcgtttaggtcggcgtagttttgggagtcgtcgtgggtcgcggattggcgtggttagtgtggaaatttgggattgtttgcgatttttgggcgtgggatcgagttttaagtgataattttaaaattttattttatagtttag

SEQ ID NO: 18722 - DNA, 831 bp, Artificial Sequence
  chemically treated genomic DNA (Homo sapiens) CpG-island No: 18722
ctaaactataaaataaaattttaaaattatcacttaaaactcgatcccacgcccaaaaatcgcaaacaatcccaaatttccacactaaccacgccaatccgcgacccacgacgactcccaaaactacgccgacctaaacgcccacacccgcgaccttccccgaaaacgtttccatttcattccctcaaatccgcaaaacgccgaataaatcccgaacgcccgactcaaccataaaaacgaccccgaaaaaacgctctcgaaaacgaataaaaacccaaacccacgctacccgacgtccgcaaaccaaaaacaaaaacaaaaacaaaaacgaaacaaaaacaaaaaaaaataacgacgaacgaaaacgaaaccgaaacgccgaaacccgcgaacaaaaaccgcaaacgtatccacgcccctcgtacatcctaaaacgaaactaataacgaacacaaaacgcgacgaacgcacacaccgcccaacgctcgcacgacgatacgtacaaaaaaacgaaaaaaaacctcgaactatcaccgacgcaatctacgtcccgcctcctccgctccctacgctcccgccacctcgacaactccgcgcccgcctcccgcctccgtcgaaaacctccgccgcaataaaactcccgatctcgctactatctctttaaataataaaactacgaaccgcccctacaactactccctaaataaccccgcgcgccgcttttaaaaaacgaaccaaaataacgacgattttaactatataaaaaaaacgaaaaaaacgacgacgaaaaaaaaccgacttccactaatccgaatcgcttaaacgaccgaa

SEQ ID NO: 18723 - DNA, 831 bp, Artificial Sequence
  chemically treated genomic DNA (Homo sapiens) CpG-island No: 18723
ttaggttgtaaggtgaagttttagaattgttatttggaattcggttttacgtttagaaatcgtaaatagttttaagtttttatattggttacgttagttcgcgatttacggcggtttttaaggttgcgtcgatttaggcgtttatattcgcgatttttttcggaagcgtttttattttatttttttaagttcgtaaggcgtcgggtgggtttcgagcgttcgatttagttataaaggcggtttcgggaaaacgttttcggaagcgggtaggggtttaggtttacgttgttcggcgttcgtaggttaggggtaggggtagaggtagggacggggtaggaataagggaaggtggcggcgggcggaggcgaggtcgaagcgtcggggttcgcgggtagaggtcgtaaacgtatttacgtttttcgtgtattttggagcggggttgatgacgaatatagggcgcgacggacgtatatatcgtttagcgttcgtacgacggtgcgtgtaaggaggcgggagggagtttcgggttgttatcggcgtaatttgcgtttcgtttttttcgttttttgcgttttcgttatttcggtaatttcgcgttcgtttttcgttttcgtcggaagttttcgtcgtagtaaggttttcggtttcgttgttgtttttttaaatggtggggttacgagtcgtttttgtagttgttttttgggtggtttcgcgcgtcgtttttgaggggcgaattaagatggcggcggttttggttgtgtgaggaagacggaagagacggcggcggagggaaatcgatttttattagttcgggtcgtttgggcggtcggg

SEQ ID NO: 18724 - DNA, 831 bp, Artificial Sequence
  chemically treated genomic DNA (Homo sapiens) CpG-island No: 18724
cccgaccgcccaaacgacccgaactaataaaaatcgatttccctccgccgccgtctcttccgtcttcctcacacaaccaaaaccgccgccatcttaattcgcccctcaaaaacgacgcgcgaaaccacccaaaaaacaactacaaaaacgactcgtaaccccaccatttaaaaaaacaacaacgaaaccgaaaaccttactacgacgaaaacttccgacgaaaacgaaaaacgaacgcgaaattaccgaaataacgaaaacgcaaaaaacgaaaaaaacgaaacgcaaattacgccgataacaacccgaaactccctcccgcctccttacacgcaccgtcgtacgaacgctaaacgatatatacgtccgtcgcgccctatattcgtcatcaaccccgctccaaaatacacgaaaaacgtaaatacgtttacgacctctacccgcgaaccccgacgcttcgacctcgcctccgcccgccgccaccttcccttattcctaccccgtccctacctctacccctacccctaacctacgaacgccgaacaacgtaaacctaaacccctacccgcttccgaaaacgttttcccgaaaccgcctttataactaaatcgaacgctcgaaacccacccgacgccttacgaacttaaaaaaataaaataaaaacgcttccgaaaaaaatcgcgaatataaacgcctaaatcgacgcaaccttaaaaaccgccgtaaatcgcgaactaacgtaaccaatataaaaacttaaaactatttacgatttctaaacgtaaaaccgaattccaaataacaattctaaaacttcaccttacaacctaa

SEQ ID NO: 18725 - DNA, 884 bp, Artificial Sequence
  chemically treated genomic DNA (Homo sapiens) CpG-island No: 18725
agcgttttcgagtttacggtagtttcgaaaaggcgtcgtggggagggcggtttttttttttttacggtcgtttagatttcgggtttggttcgggtcgtttttcggcgggtttcggggtttattttttttttgtttcggcggtcgaggcgaggagatcgggagggcggtagtggcggagtcgagtttgcgggcggcgggttgcgtttcggttcgtcggcgtttttttgttttagggcgtttcgcgattttgggtttttttatttttttttttattttttttcgtcgtatcgcgaattttagttcgcgggtttttatatagcgtcgtcggcggcgtttgaaaacgaggaggcggaggaggatgtgaaggaagtggagcgtaagataggtcgtcgcgggttgtgggcgtcgattatggagcgggttgcggaggaggcgtttgcgttcgattgtttttttttttttagcgagtttgttgttttagttttcgttttgttggtcgtcgttgtcgtcgtcgtatttcggtattttagagttttacggagttaagatggtcgtttttcggttttttttgttgttttcggttgtcggaagtgacgataggtcgttattcggagtttcgttaattagtatggtttgagaaagtcggttcggttgttgttgttaggggcgatttggtttagatttcgtcgcgggggcggtgtagagggttggatagtgttggtcgggttttcgttgattttcgcgggttgcgggttttttttgtttcgagcgcgtcggtaatcgcgaaagagtcgagaaacggttttgggcgatagttagagttttttcgttgagttggtatttatatattataggtttgggttggttggattatagatcgagag

SEQ ID NO: 18726 - DNA, 884 bp, Artificial Sequence
  chemically treated genomic DNA (Homo sapiens) CpG-island No: 18726
ctctcgatctataatccaaccaacccaaacctataatatataaataccaactcaacgaaaaaactctaactatcgcccaaaaccgtttctcgactctttcgcgattaccgacgcgctcgaaacaaaaaaaacccgcaacccgcgaaaatcaacgaaaacccgaccaacactatccaaccctctacaccgcccccgcgacgaaatctaaaccaaatcgcccctaacaacaacaaccgaaccgactttctcaaaccatactaattaacgaaactccgaataacgacctatcgtcacttccgacaaccgaaaacaacaaaaaaaaccgaaaaacgaccatcttaactccgtaaaactctaaaataccgaaatacgacgacgacaacgacgaccaacaaaacgaaaactaaaacaacaaactcgctaaaaaaaaaaaaacaatcgaacgcaaacgcctcctccgcaacccgctccataatcgacgcccacaacccgcgacgacctatcttacgctccacttccttcacatcctcctccgcctcctcgttttcaaacgccgccgacgacgctatataaaaacccgcgaactaaaattcgcgatacgacgaaaaaaaataaaaaaaaaaataaaaaaacccaaaatcgcgaaacgccctaaaacaaaaaaacgccgacgaaccgaaacgcaacccgccgcccgcaaactcgactccgccactaccgccctcccgatctcctcgcctcgaccgccgaaacaaaaaaaaaataaaccccgaaacccgccgaaaaacgacccgaaccaaacccgaaatctaaacgaccgtaaaaaaaaaaaaaccgccctccccacgacgccttttcgaaactaccgtaaactcgaaaacgct

SEQ ID NO: 18727 - DNA, 884 bp, Artificial Sequence
  chemically treated genomic DNA (Homo sapiens) CpG-island No: 18727
ttttcgatttgtaatttagttaatttaggtttgtagtgtgtaaatgttaatttagcgggagggttttggttgtcgtttagagtcgtttttcggttttttcgcggttgtcggcgcgttcgggataggaggaattcgtagttcgcgggagttagcggagattcgattagtattatttagttttttgtatcgttttcgcggcgaggtttggattaagtcgtttttagtaataatagtcgggtcggtttttttaggttatgttgattggcgggatttcgggtggcggtttgtcgttattttcggtagtcggaggtagtagaggaagtcgaggggcggttattttggtttcgtgaggttttgaggtgtcggggtgcggcggcggtagcggcggttagtagggcggaggttgaggtagtaagttcgttagagagggagaagtagtcgggcgtaggcgtttttttcgtagttcgttttatggtcggcgtttatagttcgcggcggtttgttttgcgttttattttttttatattttttttcgttttttcgtttttaggcgtcgtcggcggcgttgtgtggaggttcgcgagttgaaattcgcggtgcgacgggagggagtggagaaggaggtgagggggtttaggatcgcggggcgttttgaggtaaggggacgtcggcgggtcgaagcgtagttcgtcgttcgtaggttcggtttcgttattgtcgttttttcggttttttcgtttcggtcgtcgaggtagggagagaatgagtttcgggattcgtcgggggacggttcgggttaggttcgggatttagacggtcgtagggggaagggagtcgttttttttacggcgttttttcggaattgtcgtggattcgaggacgtt

SEQ ID NO: 18728 - DNA, 884 bp, Artificial Sequence
  chemically treated genomic DNA (Homo sapiens) CpG-island No: 18728
aacgtcctcgaatccacgacaattccgaaaaaacgccgtaaaaaaaacgactcccttccccctacgaccgtctaaatcccgaacctaacccgaaccgtcccccgacgaatcccgaaactcattctctccctacctcgacgaccgaaacgaaaaaaccgaaaaaacgacaataacgaaaccgaacctacgaacgacgaactacgcttcgacccgccgacgtccccttacctcaaaacgccccgcgatcctaaaccccctcacctccttctccactccctcccgtcgcaccgcgaatttcaactcgcgaacctccacacaacgccgccgacgacgcctaaaaacgaaaaaacgaaaaaaaatataaaaaaaataaaacgcaaaacaaaccgccgcgaactataaacgccgaccataaaacgaactacgaaaaaaacgcctacgcccgactacttctccctctctaacgaacttactacctcaacctccgccctactaaccgccgctaccgccgccgcaccccgacacctcaaaacctcacgaaaccaaaataaccgcccctcgacttcctctactacctccgactaccgaaaataacgacaaaccgccacccgaaatcccgccaatcaacataacctaaaaaaaccgacccgactattattactaaaaacgacttaatccaaacctcgccgcgaaaacgatacaaaaaactaaataatactaatcgaatctccgctaactcccgcgaactacgaattcctcctatcccgaacgcgccgacaaccgcgaaaaaaccgaaaaacgactctaaacgacaaccaaaaccctcccgctaaattaacatttacacactacaaacctaaattaactaaattacaaatcgaaaa

SEQ ID NO: 18729 - DNA, 2397 bp, Artificial Sequence
  chemically treated genomic DNA (Homo sapiens) CpG-island No: 18729
cgcgggtgttttcgggttgggtcgtagttagattgcgtttttcgcgcgttttcgttttgtattaggatcgtttaggaaacgtttgcgggtattttgaggaaggtcggcggtttcgggttagttcgtattggtcgggggtggggcgggggtcgtatttgttgcggaagtttcgaaagttttcgttcggtttttcgtcgtcgtcgcgggggttggttggattaggcgggtaggttcgaggatgcggatgaatttaagcgttttcgagtgttcggaggtttttcgttttagtttttcgtttagaggtaagggcgtgcgaggggatttagatatttaaggatttgaggtttcggtttcgaggttttgggcgggggattgggtaggttgcgcggggttttagcgaggggatagttcgggtgggcggttagggtgttgggggttgcgggcggcggataaagcggcggtattatttcgcggcgcgggttaatggaatgaatgggttataaatagtcgttaatgggcggttcgcgttgtgttttttaagagtcgcgggagcgcggagcggtcgttgttcgtttgcgtcgtttcgggagttgtcgacggacggagcgttttcgttttcgttcggtcgttcggtgagtgggttcgggggtcgggggcgttcgcgttcgggttaggggcgttgcgtgtaaagggggcgcgtcgtttggagcgcgcgtcggatcggtcgggggttttcggcgatgatggcgtttttcgcgcgcgttgcggatttcgttgattttggtcgcgtttcggggggcgtcggggggttcggcggcgggggtttgagtggtacgcgggagttcgggaatttcggcgtgtcggttttttttgatttcgcgttttttcgtagttcgtcgtcgttatgtttttttttaatagttataacgtattgaagttgcgtttttcggtcgaggacgagtttttcgatttgagcgtttataataattatatggttaaggtgttgattttcgagttgtacgcggattgcgcgttaagagtacgtcgagcggttttacgttggacgacgttatttagataggcgtggataattcgggtacgcgatttttcggggtcggggtttcggtttttttttttttcgcgtagtcgtagggtttttagtagcgcgttcgggttcggtagtgacgttattgttttcgtttcgcgtttttttttttaggttattcgtatattatgatcgtgggttgcgtggcgggcgacgaggagttttacgaagtgtttaaggattttttcgattttattatcgaggatcggtacggcggttataagtttagcgatgagtataagatcgattttaatttcgataatttgtaggtgcggggttgcgggcgggtcgggcgggcggggtcggggttttcgggcgtttattttcgtttcgttttttagggcggcgacgatttggattttaattacgtgttgagttcgcgggtgcgtacgggtcgtagtattcgtggtttttgttttttttcgtattgtagtcgcggggagcgtcgcgttatcgagaagttcgcggtggaaggtaggggtcgggcgggtcgaggggcggcggcggtcgcgtttttttttcggcgcggttttcgttcgtttttgtttacgtcgttcgggagcggtagtcgtcgtcgcgtttttatttgcgcgcgttcgggtttagtttttcggagggatcgagggacggaggtttagtttcgcgtttatagcggtttggggtttagggagggcgggttttggcgcggggttatcgtttgggatcgtcgttcgggtcgtgaggattggacgttcgtagattcgggcgggtggggttttttgacgtttttcgaggtggggtacgggggcgggcgggttcgcgttgcgggttggaggggcgggcgcgggagtcgagcgttttgagcgtatttttcgtagttttgtttagtttggacggcgatttggcgggtcgatattacgcgtttaagagtatgacggaggcggagtagtagtagtttatcgacgattatttttttttcgataagttcgtgtcgtttttgttgttggtttcgggtatggttcgcgattggttcgacgttcgcggtatttggtgcgtgtttttttgcgttttttcgcggcgtttttttttttcgttattttcgttttttttttcgtttttttcgcgggggtggggtttttcgcggcgaggaggaggaggaggaggagggaggggtcggtcgcgtttcgggtttgggtttcgtgtcgcgtttttttttgcgtcggtgattttggtcgagtaggtgcgttaagggattgggtttcggttcgtgggggtttaggatttagtaatatttttttatttcgagacgtgag

SEQ ID NO: 18730 - DNA, 2397 bp, Artificial Sequence
  chemically treated genomic DNA (Homo sapiens) CpG-island No: 18730
ctcacgtctcgaaataaaaaaatattactaaatcctaaacccccacgaaccgaaacccaatcccttaacgcacctactcgaccaaaatcaccgacgcaaaaaaaaacgcgacacgaaacccaaacccgaaacgcgaccgacccctccctcctcctcctcctcctcctcgccgcgaaaaaccccacccccgcgaaaaaaacgaaaaaaaaaacgaaaataacgaaaaaaaaaaacgccgcgaaaaaacgcaaaaaaacacgcaccaaataccgcgaacgtcgaaccaatcgcgaaccatacccgaaaccaacaacaaaaacgacacgaacttatcgaaaaaaaaataatcgtcgataaactactactactccgcctccgtcatactcttaaacgcgtaatatcgacccgccaaatcgccgtccaaactaaacaaaactacgaaaaatacgctcaaaacgctcgactcccgcgcccgcccctccaacccgcaacgcgaacccgcccgcccccgtaccccacctcgaaaaacgtcaaaaaaccccacccgcccgaatctacgaacgtccaatcctcacgacccgaacgacgatcccaaacgataaccccgcgccaaaacccgccctccctaaaccccaaaccgctataaacgcgaaactaaacctccgtccctcgatccctccgaaaaactaaacccgaacgcgcgcaaataaaaacgcgacgacgactaccgctcccgaacgacgtaaacaaaaacgaacgaaaaccgcgccgaaaaaaaaacgcgaccgccgccgcccctcgacccgcccgacccctaccttccaccgcgaacttctcgataacgcgacgctccccgcgactacaatacgaaaaaaaacaaaaaccacgaatactacgacccgtacgcacccgcgaactcaacacgtaattaaaatccaaatcgtcgccgccctaaaaaacgaaacgaaaataaacgcccgaaaaccccgaccccgcccgcccgacccgcccgcaaccccgcacctacaaattatcgaaattaaaatcgatcttatactcatcgctaaacttataaccgccgtaccgatcctcgataataaaatcgaaaaaatccttaaacacttcgtaaaactcctcgtcgcccgccacgcaacccacgatcataatatacgaataacctaaaaaaaaaaacgcgaaacgaaaacaataacgtcactaccgaacccgaacgcgctactaaaaaccctacgactacgcgaaaaaaaaaaaaaccgaaaccccgaccccgaaaaatcgcgtacccgaattatccacgcctatctaaataacgtcgtccaacgtaaaaccgctcgacgtactcttaacgcgcaatccgcgtacaactcgaaaatcaacaccttaaccatataattattataaacgctcaaatcgaaaaactcgtcctcgaccgaaaaacgcaacttcaatacgttataactattaaaaaaaaacataacgacgacgaactacgaaaaaacgcgaaatcaaaaaaaaccgacacgccgaaattcccgaactcccgcgtaccactcaaacccccgccgccgaaccccccgacgccccccgaaacgcgaccaaaatcaacgaaatccgcaacgcgcgcgaaaaacgccatcatcgccgaaaacccccgaccgatccgacgcgcgctccaaacgacgcgccccctttacacgcaacgcccctaacccgaacgcgaacgcccccgacccccgaacccactcaccgaacgaccgaacgaaaacgaaaacgctccgtccgtcgacaactcccgaaacgacgcaaacgaacaacgaccgctccgcgctcccgcgactcttaaaaaacacaacgcgaaccgcccattaacgactatttataacccattcattccattaacccgcgccgcgaaataataccgccgctttatccgccgcccgcaacccccaacaccctaaccgcccacccgaactatcccctcgctaaaaccccgcgcaacctacccaatcccccgcccaaaacctcgaaaccgaaacctcaaatccttaaatatctaaatcccctcgcacgcccttacctctaaacgaaaaactaaaacgaaaaacctccgaacactcgaaaacgcttaaattcatccgcatcctcgaacctacccgcctaatccaaccaacccccgcgacgacgacgaaaaaccgaacgaaaactttcgaaacttccgcaacaaatacgacccccgccccacccccgaccaatacgaactaacccgaaaccgccgaccttcctcaaaatacccgcaaacgtttcctaaacgatcctaatacaaaacgaaaacgcgcgaaaaacgcaatctaactacgacccaacccgaaaacacccgcg

SEQ ID NO: 18731 - DNA, 2397 bp, Artificial Sequence
  chemically treated genomic DNA (Homo sapiens) CpG-island No: 18731
tttacgtttcggggtggggaggtgttgttgagttttgagtttttacgggtcggggtttagttttttaacgtatttgttcggttaaggttatcggcgtaggaggaggcgcggtacggaatttagattcggagcgcggtcggtttttttttttttttttttttttttttcgtcgcgaggggttttattttcgcgaggggggcgagagggaaagcggaggtagcggggagggaggacgtcgcgagagggcgtagagggatacgtattagatatcgcgggcgtcgggttagtcgcgggttatgttcgaggttagtagtaggggcgatacgggtttgtcgaagaggaagtggtcgtcgatgagttgttgttgtttcgttttcgttatgtttttgagcgcgtagtatcggttcgttaggtcgtcgtttaggttggatagggttgcgaggggtgcgtttaggacgttcggttttcgcgttcgtttttttagttcgtagcgcggattcgttcgttttcgtgttttatttcgggggacgttagagggttttattcgttcggatttgcgggcgtttagtttttacggttcgggcgacggttttaggcggtgatttcgcgttaggattcgttttttttgggttttaggtcgttgtgggcgcggggttgggttttcgtttttcggttttttcgggaaattgaattcgggcgcgcgtagataagagcgcgacggcggttgtcgttttcgggcgacgtaaataaaagcgggcggggatcgcgtcgggagggggacgcggtcgtcgtcgtttttcggttcgttcggtttttattttttatcgcgagtttttcgatggcgcggcgtttttcgcggttgtagtgcggggggaggtagaagttacggatgttgcggttcgtgcgtattcgcgagtttagtacgtagttggggtttaggtcgtcgtcgttttgggaggcgagacgggagtgagcgttcgaagatttcggtttcgttcgttcggttcgttcgtagtttcgtatttgtaggttgtcggggttgaggtcggttttgtgtttatcgttgggtttgtagtcgtcgtgtcggttttcgatgatggggtcgaagagatttttgaatatttcgtaggatttttcgtcgttcgttacgtagtttacggttatgatgtacgggtggtttgggggagggggcgcgggacggggatagtgacgttattgtcgggttcgagcgcgttgttgaggattttgcggttgcgcggggggagggggggtcgggatttcggtttcgaggggtcgcgtattcgggttgtttacgtttgtttggatgacgtcgtttagcgtgaagtcgttcggcgtgtttttggcgcgtagttcgcgtatagttcgggggttagtattttggttatgtggttgttgtgggcgtttaggtcggggaattcgttttcggtcgggaagcgtagttttagtgcgttgtggttgttggagaagggtatggcggcggcgggttgcggggagacgcggggttagaggggatcggtacgtcggggttttcgggttttcgcgtattatttaggttttcgtcgtcgggtttttcggcgtttttcgggacgcggttaaggttagcggggttcgtagcgcgcgcggggagcgttattatcgtcggggattttcggtcggttcggcgcgcgttttaggcgacgcgttttttttgtacgtagcgtttttagttcgggcgcggacgttttcggttttcgggtttatttatcgggcggtcgggcgggggcgggggcgtttcgttcgtcggtagttttcggagcgacgtaggcgaatagcggtcgtttcgcgttttcgcggtttttaaggggtataacgcgggtcgtttattggcggttatttatagtttatttattttattggttcgcgtcgcggggtggtgtcgtcgttttgttcgtcgttcgtagtttttaatattttggtcgtttattcgagttgttttttcgttgggatttcgcgtagtttgtttagtttttcgtttaagatttcgaggtcgaaattttaggtttttggatatttggattttttcgtacgtttttgtttttgggcgggaaattgaggcggagagttttcgggtattcgaggacgtttgggtttattcgtattttcgagtttgttcgtttagtttagttagttttcgcggcggcggcgaggggtcgggcgaaagttttcggggttttcgtagtaggtacggttttcgttttattttcggttagtgcgagttggttcggagtcgtcgattttttttaaggtgttcgtaggcgttttttgggcgattttggtgtaaagcgaaggcgcgcgggaagcgtagtttggttgcggtttagttcgggggtattcgcg

SEQ ID NO: 18732 - DNA, 2397 bp, Artificial Sequence
  chemically treated genomic DNA (Homo sapiens) CpG-island No: 18732
cgcgaatacccccgaactaaaccgcaaccaaactacgcttcccgcgcgccttcgctttacaccaaaatcgcccaaaaaacgcctacgaacaccttaaaaaaaatcgacgactccgaaccaactcgcactaaccgaaaataaaacgaaaaccgtacctactacgaaaaccccgaaaactttcgcccgacccctcgccgccgccgcgaaaactaactaaactaaacgaacaaactcgaaaatacgaataaacccaaacgtcctcgaatacccgaaaactctccgcctcaatttcccgcccaaaaacaaaaacgtacgaaaaaatccaaatatccaaaaacctaaaatttcgacctcgaaatcttaaacgaaaaactaaacaaactacgcgaaatcccaacgaaaaaacaactcgaataaacgaccaaaatattaaaaactacgaacgacgaacaaaacgacgacaccaccccgcgacgcgaaccaataaaataaataaactataaataaccgccaataaacgacccgcgttataccccttaaaaaccgcgaaaacgcgaaacgaccgctattcgcctacgtcgctccgaaaactaccgacgaacgaaacgcccccgcccccgcccgaccgcccgataaataaacccgaaaaccgaaaacgtccgcgcccgaactaaaaacgctacgtacaaaaaaaacgcgtcgcctaaaacgcgcgccgaaccgaccgaaaatccccgacgataataacgctccccgcgcgcgctacgaaccccgctaaccttaaccgcgtcccgaaaaacgccgaaaaacccgacgacgaaaacctaaataatacgcgaaaacccgaaaaccccgacgtaccgatcccctctaaccccgcgtctccccgcaacccgccgccgccatacccttctccaacaaccacaacgcactaaaactacgcttcccgaccgaaaacgaattccccgacctaaacgcccacaacaaccacataaccaaaatactaacccccgaactatacgcgaactacgcgccaaaaacacgccgaacgacttcacgctaaacgacgtcatccaaacaaacgtaaacaacccgaatacgcgacccctcgaaaccgaaatcccgaccccccctccccccgcgcaaccgcaaaatcctcaacaacgcgctcgaacccgacaataacgtcactatccccgtcccgcgccccctcccccaaaccacccgtacatcataaccgtaaactacgtaacgaacgacgaaaaatcctacgaaatattcaaaaatctcttcgaccccatcatcgaaaaccgacacgacgactacaaacccaacgataaacacaaaaccgacctcaaccccgacaacctacaaatacgaaactacgaacgaaccgaacgaacgaaaccgaaatcttcgaacgctcactcccgtctcgcctcccaaaacgacgacgacctaaaccccaactacgtactaaactcgcgaatacgcacgaaccgcaacatccgtaacttctacctccccccgcactacaaccgcgaaaaacgccgcgccatcgaaaaactcgcgataaaaaataaaaaccgaacgaaccgaaaaacgacgacgaccgcgtccccctcccgacgcgatccccgcccgcttttatttacgtcgcccgaaaacgacaaccgccgtcgcgctcttatctacgcgcgcccgaattcaatttcccgaaaaaaccgaaaaacgaaaacccaaccccgcgcccacaacgacctaaaacccaaaaaaaacgaatcctaacgcgaaatcaccgcctaaaaccgtcgcccgaaccgtaaaaactaaacgcccgcaaatccgaacgaataaaaccctctaacgtcccccgaaataaaacacgaaaacgaacgaatccgcgctacgaactaaaaaaacgaacgcgaaaaccgaacgtcctaaacgcacccctcgcaaccctatccaacctaaacgacgacctaacgaaccgatactacgcgctcaaaaacataacgaaaacgaaacaacaacaactcatcgacgaccacttcctcttcgacaaacccgtatcgcccctactactaacctcgaacataacccgcgactaacccgacgcccgcgatatctaatacgtatccctctacgccctctcgcgacgtcctccctccccgctacctccgctttccctctcgcccccctcgcgaaaataaaacccctcgcgacgaaaaaaaaaaaaaaaaaaaaaaaaaaaccgaccgcgctccgaatctaaattccgtaccgcgcctcctcctacgccgataaccttaaccgaacaaatacgttaaaaaactaaaccccgacccgtaaaaactcaaaactcaacaacacctccccaccccgaaacgtaaa

SEQ ID NO: 18733 - DNA, 547 bp, Artificial Sequence
  chemically treated genomic DNA (Homo sapiens) CpG-island No: 18733
atggtaggtttcgaggtcgtagtttttattggcgcgggttgagttttttgttgtttttggtttcggggtcgttgtaggcgttgaggttgtaggtgggtttggggagttcggggggtcgtcgcgacgaggattacggcgacggtggcggggagggttttaggtaagttttcggtgttgtgtatgtgtggaggggtggtttgggttttttcggggttttcgaacgaaggtgacgggaaaggaaaatggggtttttttcgggtggaggatgggattttcgggtcggagtttttggaaagggttttttgaggttgttataataggaaaacgttcgtagagatgtgatttagtgatcgttcgttaatcggattggagagaagatcggttcggattttacgtttggtttgaagtagggaagacgttgtttttttttcgcgagtagtttatattcgtttaagttttagttttttgttttttcgttaatttcgtttttttttaaatcgtaaatttttttgagtcgatatcgttgcgtttaaatgatgtgtttatt

SEQ ID NO: 18734 - DNA, 547 bp, Artificial Sequence
  chemically treated genomic DNA (Homo sapiens) CpG-island No: 18734
aataaacacatcatttaaacgcaacgatatcgactcaaaaaaatttacgatttaaaaaaaaacgaaattaacgaaaaaacaaaaaactaaaacttaaacgaatataaactactcgcgaaaaaaaaacaacgtcttccctacttcaaaccaaacgtaaaatccgaaccgatcttctctccaatccgattaacgaacgatcactaaatcacatctctacgaacgttttcctattataacaacctcaaaaaaccctttccaaaaactccgacccgaaaatcccatcctccacccgaaaaaaaccccattttcctttcccgtcaccttcgttcgaaaaccccgaaaaaacccaaaccacccctccacacatacacaacaccgaaaacttacctaaaaccctccccgccaccgtcgccgtaatcctcgtcgcgacgaccccccgaactccccaaacccacctacaacctcaacgcctacaacgaccccgaaaccaaaaacaacaaaaaactcaacccgcgccaataaaaactacgacctcgaaacctaccat

SEQ ID NO: 18735 - DNA, 547 bp, Artificial Sequence
  chemically treated genomic DNA (Homo sapiens) CpG-island No: 18735
ggtaagtatattatttaggcgtaacggtgtcggtttaagaggatttgcgatttggaagagagcgaggttagcgagaagatagaaggttggaatttggacgaatgtaagttgttcgcggaggggaggtagcgttttttttgttttaggttaggcgtgggattcgggtcggttttttttttagttcggttagcgggcggttattgggttatatttttacggacgtttttttgttatgatagttttagaaaattttttttaaaagtttcggttcggaaattttattttttattcgaagaaaattttatttttttttttcgttattttcgttcggaagtttcggggaagtttagattatttttttatatatgtatagtatcgagggtttgtttagaatttttttcgttatcgtcgtcgtgattttcgtcgcggcggtttttcgggttttttaaatttatttgtagttttagcgtttatagcgatttcgagattaagggtaatagggaatttaattcgcgttagtggaagttgcgatttcgggatttgttat

SEQ ID NO: 18736 - DNA, 547 bp, Artificial Sequence
  chemically treated genomic DNA (Homo sapiens) CpG-island No: 18736
ataacaaatcccgaaatcgcaacttccactaacgcgaattaaattccctattacccttaatctcgaaatcgctataaacgctaaaactacaaataaatttaaaaaacccgaaaaaccgccgcgacgaaaatcacgacgacgataacgaaaaaaattctaaacaaaccctcgatactatacatatataaaaaaataatctaaacttccccgaaacttccgaacgaaaataacgaaaaaaaaaaataaaattttcttcgaataaaaaataaaatttccgaaccgaaacttttaaaaaaaattttctaaaactatcataacaaaaaaacgtccgtaaaaatataacccaataaccgcccgctaaccgaactaaaaaaaaaaccgacccgaatcccacgcctaacctaaaacaaaaaaaacgctacctcccctccgcgaacaacttacattcgtccaaattccaaccttctatcttctcgctaacctcgctctcttccaaatcgcaaatcctcttaaaccgacaccgttacgcctaaataatatacttacc

SEQ ID NO: 18737 - DNA, 502 bp, Artificial Sequence
  chemically treated genomic DNA (Homo sapiens) CpG-island No: 18737
ttcgcgaagttattttcgcgttttgaatgttttcgaatttttgtagagttttcgcggttttttggaagttttcgcgttcgtggagtttttttttcgttttcgggggtatcgcgggtttttagtttagttttttcgacgttggtcgttgttattttttacgaggcgtcggtttcgatttattttattgtcgttgtcggggacgggcgcgtcgggttaggggcgattcggcggcggcggcggcggcggcggggcgcgggacgcggcgttagcgggggagtcggtttcgggcgcggcggtttcgcgtttgattgggttgcggggggtagcgggggtttatttttttcgggtgggcgtcggggtcgttagttgcggggaagggtcgttgcggcgtcgattgatagttgggtttcggtttttgttattttggcgggcgcgtgttcgggtcggcgtgtgcgcgggtcgtttttgttggtcgtcgtcggggattgatgggtcggggtta

SEQ ID NO: 18738 - DNA, 502 bp, Artificial Sequence
  chemically treated genomic DNA (Homo sapiens) CpG-island No: 18738
taaccccgacccatcaatccccgacgacgaccaacaaaaacgacccgcgcacacgccgacccgaacacgcgcccgccaaaataacaaaaaccgaaacccaactatcaatcgacgccgcaacgacccttccccgcaactaacgaccccgacgcccacccgaaaaaaataaacccccgctaccccccgcaacccaatcaaacgcgaaaccgccgcgcccgaaaccgactcccccgctaacgccgcgtcccgcgccccgccgccgccgccgccgccgccgaatcgcccctaacccgacgcgcccgtccccgacaacgacaataaaataaatcgaaaccgacgcctcgtaaaaaataacaacgaccaacgtcgaaaaaactaaactaaaaacccgcgatacccccgaaaacgaaaaaaaaactccacgaacgcgaaaacttccaaaaaaccgcgaaaactctacaaaaattcgaaaacattcaaaacgcgaaaataacttcgcgaa

SEQ ID NO: 18739 - DNA, 502 bp, Artificial Sequence
  chemically treated genomic DNA (Homo sapiens) CpG-island No: 18739
tggtttcggtttattaattttcggcggcggttaataggaacggttcgcgtatacgtcggttcgggtacgcgttcgttaagatggtaggggtcggggtttagttgttagtcggcgtcgtagcggttttttttcgtagttagcggtttcgacgtttattcggagaagatgagttttcgttgtttttcgtagtttagttagacgcggagtcgtcgcgttcggggtcggttttttcgttagcgtcgcgtttcgcgtttcgtcgtcgtcgtcgtcgtcgtcgggtcgtttttggttcggcgcgttcgttttcggtagcgataatgaggtgagtcggggtcggcgtttcgtgggaggtggtagcggttagcgtcggaggggttgggttgggggttcgcggtgttttcgagggcgggaggggggttttacgggcgcgggggtttttagagaatcgcgggggttttgtagagattcgggggtatttagagcgcgggaatggtttcgcgag

SEQ ID NO: 18740 - DNA, 502 bp, Artificial Sequence
  chemically treated genomic DNA (Homo sapiens) CpG-island No: 18740
ctcgcgaaaccattcccgcgctctaaatacccccgaatctctacaaaacccccgcgattctctaaaaacccccgcgcccgtaaaacccccctcccgccctcgaaaacaccgcgaacccccaacccaacccctccgacgctaaccgctaccacctcccacgaaacgccgaccccgactcacctcattatcgctaccgaaaacgaacgcgccgaaccaaaaacgacccgacgacgacgacgacgacgacgaaacgcgaaacgcgacgctaacgaaaaaaccgaccccgaacgcgacgactccgcgtctaactaaactacgaaaaacaacgaaaactcatcttctccgaataaacgtcgaaaccgctaactacgaaaaaaaaccgctacgacgccgactaacaactaaaccccgacccctaccatcttaacgaacgcgtacccgaaccgacgtatacgcgaaccgttcctattaaccgccgccgaaaattaataaaccgaaacca

SEQ ID NO: 18741 - DNA, 500 bp, Artificial Sequence
  chemically treated genomic DNA (Homo sapiens) CpG-island No: 18741
  misc_feature (14)..(14): n is either a, c, g or t
ttcgtttgagattncggggcggcggtttttggcgagtgcgcgggcggtttcgagttttcgagggagaggcgcgcgggcgcgcgggttagttttagtatagtagttaagagttagggtacgcgcgttgttgttcgttttatcgtttttcgaggggattgcgcgcgcgtgcgttttttcgttcgcggtcgttgaggtgaatgagcgcgcgcggcggttaaagttcgatataaaaggcgcggggttttatcgttcgcgttttcgggagcgttgagtttgaggttgcgaggggcggggcggacgagagttgcggggttgaggggcggggttttgagggaagcgcgaggggcgtggtcggggtgggggcggggcgtcgggcgggtacgtggcgcggtgcgttttttttcggcgcggacgtttttttagttttcgtttgattttagagtttatagaggttatcgggggagttagggttcgtgttcgatggttttatgatttttatt

SEQ ID NO: 18742 - DNA, 500 bp, Artificial Sequence
  chemically treated genomic DNA (Homo sapiens) CpG-island No: 18742
  misc_feature (487)..(487): n is either a, c, g or t
aataaaaatcataaaaccatcgaacacgaaccctaactcccccgataacctctataaactctaaaatcaaacgaaaactaaaaaaacgtccgcgccgaaaaaaaacgcaccgcgccacgtacccgcccgacgccccgcccccaccccgaccacgcccctcgcgcttccctcaaaaccccgcccctcaaccccgcaactctcgtccgccccgcccctcgcaacctcaaactcaacgctcccgaaaacgcgaacgataaaaccccgcgccttttatatcgaactttaaccgccgcgcgcgctcattcacctcaacgaccgcgaacgaaaaaacgcacgcgcgcgcaatcccctcgaaaaacgataaaacgaacaacaacgcgcgtaccctaactcttaactactatactaaaactaacccgcgcgcccgcgcgcctctccctcgaaaactcgaaaccgcccgcgcactcgccaaaaaccgccgccccgnaatctcaaacgaa

SEQ ID NO: 18743 - DNA, 500 bp, Artificial Sequence
  chemically treated genomic DNA (Homo sapiens) CpG-island No: 18743
  misc_feature (487)..(487): n is either a, c, g or t
gatgggaattatggggttatcgagtacggattttggttttttcggtggtttttgtgagttttggggttaggcggggattggaggagcgttcgcgtcgggagggagcgtatcgcgttacgtgttcgttcggcgtttcgtttttatttcggttacgtttttcgcgttttttttaaagtttcgttttttagtttcgtaattttcgttcgtttcgtttttcgtagttttaagtttagcgttttcggaggcgcggacggtggggtttcgcgttttttgtgtcgggttttgatcgtcgcgcgcgtttatttattttagcggtcgcgggcggaggggcgtacgcgcgcgtagttttttcggagggcggtggggcgaatagtaacgcgcgtattttagtttttggttgttgtgttgagattagttcgcgcgttcgcgcgtttttttttcgaggattcggagtcgttcgcgtattcgttaggggtcgtcgtttcgnagttttaggcgga

SEQ ID NO: 18744 - DNA, 500 bp, Artificial Sequence
  chemically treated genomic DNA (Homo sapiens) CpG-island No: 18744
  misc_feature (14)..(14): n is either a, c, g or t
tccgcctaaaactncgaaacgacgacccctaacgaatacgcgaacgactccgaatcctcgaaaaaaaaacgcgcgaacgcgcgaactaatctcaacacaacaaccaaaaactaaaatacgcgcgttactattcgccccaccgccctccgaaaaaactacgcgcgcgtacgcccctccgcccgcgaccgctaaaataaataaacgcgcgcgacgatcaaaacccgacacaaaaaacgcgaaaccccaccgtccgcgcctccgaaaacgctaaacttaaaactacgaaaaacgaaacgaacgaaaattacgaaactaaaaaacgaaactttaaaaaaaacgcgaaaaacgtaaccgaaataaaaacgaaacgccgaacgaacacgtaacgcgatacgctccctcccgacgcgaacgctcctccaatccccgcctaaccccaaaactcacaaaaaccaccgaaaaaaccaaaatccgtactcgataaccccataattcccatc

SEQ ID NO: 18745 - DNA, 1066 bp, Artificial Sequence
  chemically treated genomic DNA (Homo sapiens) CpG-island No: 18745
cgggatacgggatcggggcgtggggattttcgtttcggcgatttacgggggtaattttagtggatgtggagggtggcggcgcgttttcgggtttttcgtacgttttttttaattaggatttgtcgtttgacgttacgtttgtcggagattggttgtttaggtttgatattcggggttacgggagagaaatttttaaaagatttcgtcgtcggggttgtttcggagtgtttcgcgcgttttcgttcgttttcggttattttcgtcgggtttcgttgcggcgcgcgttgtaattttcggtcggacgcgcggatttttattttgcgcggttcgtttttttcgttttttttcgtttttcgggtttcgcgttttttatttttacgttttttttttgtttttagttataatcggtcggggtttggggtcgtttagttgttcgtagagttttttttttcgttatcgatttggttttttttcgtttttttcgggttttcggtagttttcgggggagttcgaacgcgcggggaaaggcgagtcgtacggtcgggggagggggtcggatcgcgcgcgatcggtcgcgttcgttggggttcgcgatggcgggggtttggtttaggtgggggtttttgttttgggtagggtttttcgcgttttcggcgtacggtcggttgcggaggattatttacgtggtgtattcgggtttcggtttggtagtcggcgttttgtttttgagcgggttttcgcgttcgcggatatttaacgtcgcgtttaacgttaggtatagtcgtagttcggcggttgtcggcgtttttagtcgtgtttttttcggggttttttcggagaggattcggcgtacgagtaagtcgggcggcgcggttttgtaggggtttagatcgtcgtcgtcgtcgtcgtcggagtttgcgcgtttcgcggttttcggcgggtagttttattttaatttcggcggttattcggtagtcgtttcgtttattaaataaggtaggtaagttgtgcgttttaaggtgtcgtaggagatttagagcggcggaggttttaggttgtaggttta

SEQ ID NO: 18746 - DNA, 1066 bp, Artificial Sequence
  chemically treated genomic DNA (Homo sapiens) CpG-island No: 18746
taaacctacaacctaaaacctccgccgctctaaatctcctacgacaccttaaaacgcacaacttacctaccttatttaataaacgaaacgactaccgaataaccgccgaaattaaaataaaactacccgccgaaaaccgcgaaacgcgcaaactccgacgacgacgacgacgacgatctaaacccctacaaaaccgcgccgcccgacttactcgtacgccgaatcctctccgaaaaaaccccgaaaaaaacacgactaaaaacgccgacaaccgccgaactacgactatacctaacgttaaacgcgacgttaaatatccgcgaacgcgaaaacccgctcaaaaacaaaacgccgactaccaaaccgaaacccgaatacaccacgtaaataatcctccgcaaccgaccgtacgccgaaaacgcgaaaaaccctacccaaaacaaaaacccccacctaaaccaaacccccgccatcgcgaaccccaacgaacgcgaccgatcgcgcgcgatccgaccccctcccccgaccgtacgactcgcctttccccgcgcgttcgaactcccccgaaaactaccgaaaacccgaaaaaaacgaaaaaaaaccaaatcgataacgaaaaaaaaaactctacgaacaactaaacgaccccaaaccccgaccgattataactaaaaacaaaaaaaaaacgtaaaaataaaaaacgcgaaacccgaaaaacgaaaaaaaacgaaaaaaacgaaccgcgcaaaataaaaatccgcgcgtccgaccgaaaattacaacgcgcgccgcaacgaaacccgacgaaaataaccgaaaacgaacgaaaacgcgcgaaacactccgaaacaaccccgacgacgaaatcttttaaaaatttctctcccgtaaccccgaatatcaaacctaaacaaccaatctccgacaaacgtaacgtcaaacgacaaatcctaattaaaaaaaacgtacgaaaaacccgaaaacgcgccgccaccctccacatccactaaaattacccccgtaaatcgccgaaacgaaaatccccacgccccgatcccgtatcccg

SEQ ID NO: 18747 - DNA, 1066 bp, Artificial Sequence
  chemically treated genomic DNA (Homo sapiens) CpG-island No: 18747
tgaatttgtagtttagagttttcgtcgttttgggttttttgcggtattttggagcgtataatttgtttgttttgtttggtgaacggggcggttgtcgggtggtcgtcgggattggggtggagttgttcgtcggggatcgcgggacgcgtaggtttcggcggcggcggcggcggcggtttgagtttttgtagggtcgcgtcgttcggtttgttcgtgcgtcgggtttttttcgaggggatttcgggggaggtacggttgggggcgtcggtagtcgtcgagttgcggttgtatttggcgttgagcgcgacgttgaatgttcgcgaacgcgggggttcgtttaggggtaaggcgtcggttgttaggtcggggttcgggtgtattacgtaggtgatttttcgtagtcggtcgtgcgtcgaggacgcgaggagttttgtttagagtaggagtttttatttgagttaggttttcgttatcgcgggttttagcgggcgcgatcggtcgcgcgcggttcggttttttttttcggtcgtgcggttcgttttttttcgcgcgttcgggttttttcgagagttgtcgagagttcgggaaaggcgggaggagattaagtcggtggcgagggaggaggttttgcgggtagttgagcggttttagatttcggtcgattgtggttgggagtaggaggagggcgtgggggtggggagcgcggagttcggggagcggggaggggcgaggggagcgggtcgcgtaaggtgagggttcgcgcgttcggtcgggggttgtagcgcgcgtcgtagcggggttcggcgagggtggtcgagagcgagcgagagcgcgcgggatatttcgaggtagtttcggcggcgaagttttttaaaagtttttttttcgtggtttcgagtgttagatttgagtagttaattttcggtagacgtgacgttaggcggtagattttaattggggaaggcgtgcgaggagttcgaaggcgcgtcgttattttttatatttattggggttgttttcgtgggtcgtcgaggcggaggtttttacgtttcggtttcgtgtttcg

SEQ ID NO: 18748 - DNA, 1066 bp, Artificial Sequence
  chemically treated genomic DNA (Homo sapiens) CpG-island No: 18748
cgaaacacgaaaccgaaacgtaaaaacctccgcctcgacgacccacgaaaacaaccccaataaatataaaaaataacgacgcgccttcgaactcctcgcacgccttccccaattaaaatctaccgcctaacgtcacgtctaccgaaaattaactactcaaatctaacactcgaaaccacgaaaaaaaaacttttaaaaaacttcgccgccgaaactacctcgaaatatcccgcgcgctctcgctcgctctcgaccaccctcgccgaaccccgctacgacgcgcgctacaacccccgaccgaacgcgcgaaccctcaccttacgcgacccgctcccctcgcccctccccgctccccgaactccgcgctccccacccccacgccctcctcctactcccaaccacaatcgaccgaaatctaaaaccgctcaactacccgcaaaacctcctccctcgccaccgacttaatctcctcccgcctttcccgaactctcgacaactctcgaaaaaacccgaacgcgcgaaaaaaaacgaaccgcacgaccgaaaaaaaaaaccgaaccgcgcgcgaccgatcgcgcccgctaaaacccgcgataacgaaaacctaactcaaataaaaactcctactctaaacaaaactcctcgcgtcctcgacgcacgaccgactacgaaaaatcacctacgtaatacacccgaaccccgacctaacaaccgacgccttacccctaaacgaacccccgcgttcgcgaacattcaacgtcgcgctcaacgccaaatacaaccgcaactcgacgactaccgacgcccccaaccgtacctcccccgaaatcccctcgaaaaaaacccgacgcacgaacaaaccgaacgacgcgaccctacaaaaactcaaaccgccgccgccgccgccgccgaaacctacgcgtcccgcgatccccgacgaacaactccaccccaatcccgacgaccacccgacaaccgccccgttcaccaaacaaaacaaacaaattatacgctccaaaataccgcaaaaaacccaaaacgacgaaaactctaaactacaaattca

SEQ ID NO: 18749 - DNA, 545 bp, Artificial Sequence
  chemically treated genomic DNA (Homo sapiens) CpG-island No: 18749
ttgtcgggcgaggattttcgcgggtatcgcgaaggaaggtagtttttgtaggaattaggcggcgcgggttggtaggcgggtagtcgtcggttttaggtttttcgtgtgtttttcgtagtcggaggtttcgcgacgtataaggttagtgttttaagggcgattaaagtggcgttgtttgttagtattgggttttgttggtattgaatttgtatcgcgtcgtgtttttcgtcggtggtcgttgtttttttagaagagagcgcggttttcgtaatttttttatggagcgttagacgttattcgtgttcgttttttcggttttggttttcgtttttttattttgttttttatttcgtcgcgtttagttttggcgcggttcgtagtaatattttttttttaaggatgtagtcgcggtggtcggaggagaacgaaggtttttttagttcgttcgttttttttacggttttatatttatttttcgtttaggttgtttttttatgatttgttttttaattattagcgtttgatgcgtatatttttggaattaa

SEQ ID NO: 18750 - DNA, 545 bp, Artificial Sequence
  chemically treated genomic DNA (Homo sapiens) CpG-island No: 18750
ttaattccaaaaatatacgcatcaaacgctaataattaaaaaacaaatcataaaaaaacaacctaaacgaaaaataaatataaaaccgtaaaaaaaacgaacgaactaaaaaaaccttcgttctcctccgaccaccgcgactacatccttaaaaaaaaaatattactacgaaccgcgccaaaactaaacgcgacgaaataaaaaacaaaataaaaaaacgaaaaccaaaaccgaaaaaacgaacacgaataacgtctaacgctccataaaaaaattacgaaaaccgcgctctcttctaaaaaaacaacgaccaccgacgaaaaacacgacgcgatacaaattcaataccaacaaaacccaatactaacaaacaacgccactttaatcgcccttaaaacactaaccttatacgtcgcgaaacctccgactacgaaaaacacacgaaaaacctaaaaccgacgactacccgcctaccaacccgcgccgcctaattcctacaaaaactaccttccttcgcgatacccgcgaaaatcctcgcccgacaa

SEQ ID NO: 18751 - DNA, 545 bp, Artificial Sequence
  chemically treated genomic DNA (Homo sapiens) CpG-island No: 18751
ttagttttagaagtatgcgtattagacgttaatagttgaggaataagttatggaaggatagtttaagcgggaggtgaatgtaaagtcgtggagagggcgggcgaattaagaaggttttcgttttttttcggttatcgcggttgtatttttgagaaaggggtattgttgcgaatcgcgttagggttggacgcggcgaggtgggaggtaggatggaggggcgggagttaaggtcgagggggcggatacgggtggcgtttggcgttttataaaggggttgcgggggtcgcgtttttttttgggagggtagcggttatcggcgaggaatacggcgcgatgtaggtttagtgttagtagagtttagtgttggtaggtagcgttattttggtcgtttttggggtattggttttgtacgtcgcgaagttttcggttacgggaagtatacggagagtttgaagtcggcggttattcgtttgttagttcgcgtcgtttggtttttgtaggagttgttttttttcgcggtgttcgcggggattttcgttcggtag

SEQ ID NO: 18752 - DNA, 545 bp, Artificial Sequence
  chemically treated genomic DNA (Homo sapiens) CpG-island No: 18752
ctaccgaacgaaaatccccgcgaacaccgcgaaaaaaaacaactcctacaaaaaccaaacgacgcgaactaacaaacgaataaccgccgacttcaaactctccgtatacttcccgtaaccgaaaacttcgcgacgtacaaaaccaataccccaaaaacgaccaaaataacgctacctaccaacactaaactctactaacactaaacctacatcgcgccgtattcctcgccgataaccgctaccctcccaaaaaaaaacgcgacccccgcaacccctttataaaacgccaaacgccacccgtatccgccccctcgaccttaactcccgcccctccatcctacctcccacctcgccgcgtccaaccctaacgcgattcgcaacaatacccctttctcaaaaatacaaccgcgataaccgaaaaaaaacgaaaaccttcttaattcgcccgccctctccacgactttacattcacctcccgcttaaactatccttccataacttattcctcaactattaacgtctaatacgcatacttctaaaactaa

SEQ ID NO: 18753 - DNA, 590 bp, Artificial Sequence
  chemically treated genomic DNA (Homo sapiens) CpG-island No: 18753
agcggcggtagtagcgagtggagtaggaggaggagcgtaggtagcggtcgcggcggggtcggaggaagaggaggggggagaaggaggagttgaagcgggaagagcggtaggtagcggttcggcggagttgtagtagaggcggcggcgacgttgagatatcgtagtttttttgagcgtcgagttttttcggggatagtagtagggagcgttcgcgtagttatcgagtttttgtttagttaagtcgtcgtcgtcgcgtcgggggatcgttagttatggtcgcgtcgggggattcgtaggacgagttgttgtcgttggtcggtttcgggttttagtggtttaggtatcggggggagggggagaacgaagcggtgacgtcgaaaggggttacgtcggcgtcgtaggttggggagtttagttcggggttgggcgttagggttcgggaagcggcgtcgcgggaagtcggttcgggtttcgttcggtagtcgttcgttgttatggaaattgtatttataggtaaggcgggcgtcgttgttttttaaatggcgtcggggattagggttttttagttagtttttttttgcgcggttttt

SEQ ID NO: 18754 - DNA, 590 bp, Artificial Sequence
  chemically treated genomic DNA (Homo sapiens) CpG-island No: 18754
aaaaaccgcgcaaaaaaaaactaactaaaaaaccctaatccccgacgccatttaaaaaacaacgacgcccgccttacctataaatacaatttccataacaacgaacgactaccgaacgaaacccgaaccgacttcccgcgacgccgcttcccgaaccctaacgcccaaccccgaactaaactccccaacctacgacgccgacgtaacccctttcgacgtcaccgcttcgttctccccctccccccgatacctaaaccactaaaacccgaaaccgaccaacgacaacaactcgtcctacgaatcccccgacgcgaccataactaacgatcccccgacgcgacgacgacgacttaactaaacaaaaactcgataactacgcgaacgctccctactactatccccgaaaaaactcgacgctcaaaaaaactacgatatctcaacgtcgccgccgcctctactacaactccgccgaaccgctacctaccgctcttcccgcttcaactcctccttctcccccctcctcttcctccgaccccgccgcgaccgctacctacgctcctcctcctactccactcgctactaccgccgct

SEQ ID NO: 18755 - DNA, 590 bp, Artificial Sequence
  chemically treated genomic DNA (Homo sapiens) CpG-island No: 18755
gagagtcgcgtagaaggggattgattggggggttttggttttcgacgttatttgaggggtagcggcgttcgttttatttgtggatgtagtttttatggtaacgggcgattgtcgggcggggttcgagtcggtttttcgcgacgtcgtttttcgggttttggcgtttaatttcgggttgggttttttagtttgcggcgtcggcgtggtttttttcggcgttatcgtttcgtttttttttttttttcggtgtttgagttattgggattcggggtcggttagcggtagtagttcgttttgcggatttttcggcgcggttatggttggcggtttttcggcgcggcgacggcggtttggttgggtagaggttcggtggttgcgcgggcgttttttgttgttgttttcggagggattcggcgtttagggaagttgcggtgttttagcgtcgtcgtcgtttttgttgtaatttcgtcgagtcgttgtttgtcgtttttttcgttttagttttttttttttttttttttttttttttcggtttcgtcgcggtcgttgtttgcgtttttttttttattttattcgttgttgtcgtcgtt

SEQ ID NO: 18756 - DNA, 590 bp, Artificial Sequence
  chemically treated genomic DNA (Homo sapiens) CpG-island No: 18756
aacgacgacaacaacgaataaaataaaaaaaaaaacgcaaacaacgaccgcgacgaaaccgaaaaaaaaaaaaaaaaaaaaaaaaaaaactaaaacgaaaaaaacgacaaacaacgactcgacgaaattacaacaaaaacgacgacgacgctaaaacaccgcaacttccctaaacgccgaatccctccgaaaacaacaacaaaaaacgcccgcgcaaccaccgaacctctacccaaccaaaccgccgtcgccgcgccgaaaaaccgccaaccataaccgcgccgaaaaatccgcaaaacgaactactaccgctaaccgaccccgaatcccaataactcaaacaccgaaaaaaaaaaaaaaacgaaacgataacgccgaaaaaaaccacgccgacgccgcaaactaaaaaacccaacccgaaattaaacgccaaaacccgaaaaacgacgtcgcgaaaaaccgactcgaaccccgcccgacaatcgcccgttaccataaaaactacatccacaaataaaacgaacgccgctacccctcaaataacgtcgaaaaccaaaaccccccaatcaatccccttctacgcgactctc

SEQ ID NO: 18757 - DNA, 528 bp, Artificial Sequence
  chemically treated genomic DNA (Homo sapiens) CpG-island No: 18757
taagtcgtcggttacgcgttttgcgtttttttggtgtcgcgtttagtgtttagcgcgttttgatgttgtagtttcgggtcgggtcgttttgtttttttgttcgttgggacgtttttcgacggtttcgttttcgtttttcgtttcgagtttttgttgatttcggggaggtggggttcgggtcgggtatagtttcgttgaggtaggatgtttacgtttaagtttaattcggtgtcgttttcgtcgtttttggagtaggttgattcggacgttttggatattagtattaaagtgtagttttacggcgtgttgtggaagaggtttttcggtaggtcgtcggttaagtggtttcggcggtgagtgcgttttcgcgttttaaggagatcgtcggggagagagtttgggcgtcgttattttttttattttttttagtcgtcgtcgtgtttttgtttttttgtgtgattttggcgttatttttttttattttatattggttttcgtaggaaaatgtggattatagtttgggtcggg

SEQ ID NO: 18758 - DNA, 528 bp, Artificial Sequence
  chemically treated genomic DNA (Homo sapiens) CpG-island No: 18758
cccgacccaaactataatccacattttcctacgaaaaccaatataaaataaaaaaaaataacgccaaaatcacacaaaaaaacaaaaacacgacgacgactaaaaaaaataaaaaaaataacgacgcccaaactctctccccgacgatctccttaaaacgcgaaaacgcactcaccgccgaaaccacttaaccgacgacctaccgaaaaacctcttccacaacacgccgtaaaactacactttaatactaatatccaaaacgtccgaatcaacctactccaaaaacgacgaaaacgacaccgaattaaacttaaacgtaaacatcctacctcaacgaaactatacccgacccgaaccccacctccccgaaatcaacaaaaactcgaaacgaaaaacgaaaacgaaaccgtcgaaaaacgtcccaacgaacaaaaaaacaaaacgacccgacccgaaactacaacatcaaaacgcgctaaacactaaacgcgacaccaaaaaaacgcaaaacgcgtaaccgacgactta

SEQ ID NO: 18759 - DNA, 528 bp, Artificial Sequence
  chemically treated genomic DNA (Homo sapiens) CpG-island No: 18759
ttcggtttagattatggtttatatttttttgcgggagttagtgtagagtgaaaaggggtgacgttaaggttatataggaaagtagaggtacgacggcgattggagggggtgggaggggtaacgacgtttaggtttttttttcggcggtttttttggggcgcgggggcgtatttatcgtcgggattatttggtcgacggtttgtcgaaaggttttttttatagtacgtcgtagagttgtattttggtgttgatatttagggcgttcgagttagtttgttttagggacggcgagggcgatatcgagttggatttggacgtgaatattttgttttagcggggttgtgttcggttcggattttattttttcggggttagtagggattcggggcgagaggcgagggcggagtcgtcggagagcgttttagcgagtagagaagtagagcggttcggttcggagttgtagtattaaagcgcgttgggtattggacgcggtattaagggggcgtagggcgcgtagtcggcggtttg

SEQ ID NO: 18760 - DNA, 528 bp, Artificial Sequence
  chemically treated genomic DNA (Homo sapiens) CpG-island No: 18760
caaaccgccgactacgcgccctacgcccccttaataccgcgtccaatacccaacgcgctttaatactacaactccgaaccgaaccgctctacttctctactcgctaaaacgctctccgacgactccgccctcgcctctcgccccgaatccctactaaccccgaaaaaataaaatccgaaccgaacacaaccccgctaaaacaaaatattcacgtccaaatccaactcgatatcgccctcgccgtccctaaaacaaactaactcgaacgccctaaatatcaacaccaaaatacaactctacgacgtactataaaaaaaacctttcgacaaaccgtcgaccaaataatcccgacgataaatacgcccccgcgccccaaaaaaaccgccgaaaaaaaaacctaaacgtcgttacccctcccaccccctccaatcgccgtcgtacctctactttcctatataaccttaacgtcaccccttttcactctacactaactcccgcaaaaaaatataaaccataatctaaaccgaa

SEQ ID NO: 18761 - DNA, 2102 bp, Artificial Sequence
  chemically treated genomic DNA (Homo sapiens) CpG-island No: 18761
ggtcgaaggatcgcgtgttggttttttcgcgtatttttttacgtacgtggaaggaagttcgggttgtggagcgggcgttttttagcgtattgcgtcgttttcgcgttagttgttcgttgcgttttagtttgcgttcgatggtttggagtagttttcgtcggcggtagttttcgtttttttttattttttttttgttggcgcgttgggttcgttttttttttagtcggttttggtttacgcgtcgcgttttttgttgtattgttttttcggttatttgcgtcgcgtgttgtagtcgtcgttttttcgttcgggttagcgtttttaggtgcgtttgatgttttcgttttttgcgttttgtcgtttttttggttcgtcgattttgtagtttttttcgtcgggttcgttttcgtagttttcgggtgcgttgttttattaaatgttcgtagtttttttgcgtacggtttaaattggtttttagcgagtttcgtaggttttttcgtttttggcgttgttgtcgggttcgattttgtagtagcgtttcgtggcgcgttcgttcggttcggtttagttttcgtttttttcgttgtagttggtttttttgtcgttgtttggcgcgggtcgtcgttgggcgcgttttttgcggatttgtttagttcgttttcgttttttttgtagattttttttacgttgttttaggttttgtttttgttgaagtttgcgtagtcgattttttcgggtcgcgcgtttcgttcgttttcgtcgtaggaggttttggcgttcggttagttttcgtcgtcgtttttcgttgcgttcgtattgtcgttgtcgtcgtcgcgtcgtttcgcgtttttcgcggttacggcggtttcgtcgtttttttatttgcgcggtttaggttcggcggttttgttttagggcgcgttgtttttttcgtttttcgcgttttcgtcgttgtttggcgtgtacgcgttgtagtttttattggtcgtgggtagtcgcgcgttgttttagtagtaggagttttttttggtgtcgcgttagtatgagcgtcgcgatttttcggttacgtttcggtatttcgcgtaggtcgcgttttgtacgtatttgacgtacgatgcgttttacgtgttgagcggtttgcggcgaatggtttaggtcgtcgaggttgaagttgcggtcggtgatcggaattagggttagggtagacgggcggttcggagcgttggtggtggaggacgtcgatttcgttgggtagttgtttttggtcgaggttcgaggcggttagcgtagtttttttaagttttttttattgtaggatgacgacgatgcgttcgattcggagttgagggcgtttttacgtcggcgggatagtgagtttagcgaatggttttttttgtttgttcgagaattcgttggcggaggttgggttcgggcggaggagggattaggggaagttttgcgggtcgtacgcggcgcgggcgaggtcgggaggttggcgttgttgtagttgttgttgttgttcgcgttcggggtcgaggtcgcggcggcggcggcggcggcggcggtcgcggggtttaaaggcgtgaaaagacgtcgttttttttcgcgtatgatgcgttcgcgttcggttcggtattgttgtagtttggcgcgtcgtttcgtttcgtaggttttatataggtcggtggttattcgtatggagcggttcggagtttttcgtattaggtcggttagggttcgtggtagtagttttatcggtttgatcgtatagcgggcgtaggtttttagcgagcgggggttggttagtacgtagcggttgtttttcgtttttgggtagtcgaagttgaagaggtcgaggtgtagtagcggggattgttttcgtcgttcgttttttgcggttgtatatgggatttttgttttgcggggtatcgtcgcggaggtcgaggtcgaggtcgaggaagttgcgggtttttgtgcgttttgggaattagggggtacggacgttacggtttcgttttttttagagtcgtcgggtttcgtttttgtttttttttttttaggtattgggtttattatggttgagtttcgttttttgttggaat

SEQ ID NO: 18762 - DNA, 2102 bp, Artificial Sequence
  chemically treated genomic DNA (Homo sapiens) CpG-island No: 18762
attccaacaaaaaacgaaactcaaccataataaacccaatacctaaaaaaaaaaaaacaaaaacgaaacccgacgactctaaaaaaaacgaaaccgtaacgtccgtaccccctaattcccaaaacgcacaaaaacccgcaacttcctcgacctcgacctcgacctccgcgacgataccccgcaaaacaaaaatcccatatacaaccgcaaaaaacgaacgacgaaaacaatccccgctactacacctcgacctcttcaacttcgactacccaaaaacgaaaaacaaccgctacgtactaaccaacccccgctcgctaaaaacctacgcccgctatacgatcaaaccgataaaactactaccacgaaccctaaccgacctaatacgaaaaactccgaaccgctccatacgaataaccaccgacctatataaaacctacgaaacgaaacgacgcgccaaactacaacaataccgaaccgaacgcgaacgcatcatacgcgaaaaaaaacgacgtcttttcacgcctttaaaccccgcgaccgccgccgccgccgccgccgccgcgacctcgaccccgaacgcgaacaacaacaacaactacaacaacgccaacctcccgacctcgcccgcgccgcgtacgacccgcaaaacttcccctaatccctcctccgcccgaacccaacctccgccaacgaattctcgaacaaacaaaaaaaaccattcgctaaactcactatcccgccgacgtaaaaacgccctcaactccgaatcgaacgcatcgtcgtcatcctacaataaaaaaaacttaaaaaaactacgctaaccgcctcgaacctcgaccaaaaacaactacccaacgaaatcgacgtcctccaccaccaacgctccgaaccgcccgtctaccctaaccctaattccgatcaccgaccgcaacttcaacctcgacgacctaaaccattcgccgcaaaccgctcaacacgtaaaacgcatcgtacgtcaaatacgtacaaaacgcgacctacgcgaaataccgaaacgtaaccgaaaaatcgcgacgctcatactaacgcgacaccaaaaaaaactcctactactaaaacaacgcgcgactacccacgaccaataaaaactacaacgcgtacacgccaaacaacgacgaaaacgcgaaaaacgaaaaaaacaacgcgccctaaaacaaaaccgccgaacctaaaccgcgcaaataaaaaaacgacgaaaccgccgtaaccgcgaaaaacgcgaaacgacgcgacgacgacaacgacaatacgaacgcaacgaaaaacgacgacgaaaactaaccgaacgccaaaacctcctacgacgaaaacgaacgaaacgcgcgacccgaaaaaatcgactacgcaaacttcaacaaaaacaaaacctaaaacaacgtaaaaaaaatctacaaaaaaaacgaaaacgaactaaacaaatccgcaaaaaacgcgcccaacgacgacccgcgccaaacaacgacaaaaaaaccaactacaacgaaaaaaacgaaaactaaaccgaaccgaacgaacgcgccacgaaacgctactacaaaatcgaacccgacaacaacgccaaaaacgaaaaaacctacgaaactcgctaaaaaccaatttaaaccgtacgcaaaaaaactacgaacatttaataaaacaacgcacccgaaaactacgaaaacgaacccgacgaaaaaaactacaaaatcgacgaaccaaaaaaacgacaaaacgcaaaaaacgaaaacatcaaacgcacctaaaaacgctaacccgaacgaaaaaacgacgactacaacacgcgacgcaaataaccgaaaaaacaatacaacaaaaaacgcgacgcgtaaaccaaaaccgactaaaaaaaaaacgaacccaacgcgccaacaaaaaaaaaataaaaaaaaacgaaaactaccgccgacgaaaactactccaaaccatcgaacgcaaactaaaacgcaacgaacaactaacgcgaaaacgacgcaatacgctaaaaaacgcccgctccacaacccgaacttccttccacgtacgtaaaaaaatacgcgaaaaaaccaacacgcgatccttcgacc

SEQ ID NO: 18763 - DNA, 2102 bp, Artificial Sequence
  chemically treated genomic DNA (Homo sapiens) CpG-island No: 18763
attttaataaaggacggggtttagttatggtggatttagtgtttgaagaagagaaggtaggagcggaattcggcgattttggaggggacgaggtcgtggcgttcgtgttttttgatttttagggcgtataggagttcgtagttttttcggtttcggtttcggttttcgcggcggtgtttcgtaaggtagaagttttatgtgtagtcgtagaaggcgggcggcgggagtagttttcgttgttgtatttcgatttttttaatttcgattgtttagaggcggagggtagtcgttacgtgttgattagttttcgttcgttagaggtttgcgttcgttgtgcggttaagtcggtggagttgttgttacgggttttggtcgatttggtgcgagaggtttcgggtcgttttatgcgggtggttatcggtttgtatgaggtttacgaggcggagcggcgcgttaagttgtagtaatgtcgggtcgagcgcgagcgtattatgcgcgaggagaagcggcgtttttttacgtttttgagtttcgcggtcgtcgtcgtcgtcgtcgtcgtcgcggtttcggtttcgagcgcgggtagtagtagtagttgtagtagcgttagtttttcggtttcgttcgcgtcgcgtgcggttcgtaaggttttttttagtttttttttcgttcggatttaattttcgttagcgggttttcgaataggtaggaagagttattcgttggatttattgtttcgtcggcgtgagggcgtttttagtttcgagtcgggcgtatcgtcgttattttatagtggggaaagtttgagggagttgcgttggtcgtttcgggtttcggttaggaatagttgtttagcggggtcggcgttttttattattaacgtttcgggtcgttcgtttgttttgattttggtttcgattatcggtcgtagttttagtttcggcgatttgagttattcgtcgtagatcgtttagtacgtggagcgtatcgtgcgttaagtgcgtgtagagcgcggtttgcgcggggtgtcggagcgtgatcggaagatcgcggcgtttatgttggcgcggtattaggaggagtttttgttgttggagtaacgcgcggttgtttacggttagtgggagttgtagcgcgtgtacgttaagtagcggcgggagcgcgaggagcgggagaagtagcgcgttttagagtagggtcgtcgagtttgggtcgcgtaggtggaggagcggcgaggtcgtcgtggtcgcgaagagcgcgaggcggcgcggcggcggtagcggtagtacgagcgtagcgaggagcggcggcgggagttggtcgaacgttagggttttttgcggcgggagcgggcggagcgcgcggttcgggaggatcggttgcgtaagttttagtaggagtagaatttgaagtaacgtgaggaaggtttataggaagggcgggagcgggttgagtagattcgtagggagcgcgtttagcggcggttcgcgttaagtagcggtaggagggttagttgtagcgggagaagcgggagttgagtcgggtcgagcgggcgcgttacgaggcgttgttatagggtcggattcggtagtagcgttaggagcgagagggtttgcggagttcgttggaagttagtttgggtcgtgcgtaggagaattacgagtatttggtggagtagcgtattcgggagttgcgggagcgggttcggcgagaggagttgtagggtcggcgggttaaggaggcggtagagcgtaaagagcgggaatattaggcgtatttggaggcgttggttcgggcgggggagcgacggttgtagtacgcgacgtaggtggtcgaggaagtagtgtagtagaaggcgcggcgcgtgggttagagtcggttggagaaggaacgagtttagcgcgttaataaggagaaggtggagagggacgaagattgtcgtcggcgagagttattttaggttatcgggcgtaagttggagcgtagcgagtagttgacgcgggaacggcgtagtgcgttggagagcgttcgttttatagttcgggtttttttttacgtgcgtgagaaggtgcgcgaggagattaatacgcgatttttcgatt

SEQ ID NO: 18764 - DNA, 2102 bp, Artificial Sequence
  chemically treated genomic DNA (Homo sapiens) CpG-island No: 18764
aatcgaaaaatcgcgtattaatctcctcgcgcaccttctcacgcacgtaaaaaaaaacccgaactataaaacgaacgctctccaacgcactacgccgttcccgcgtcaactactcgctacgctccaacttacgcccgataacctaaaataactctcgccgacgacaatcttcgtccctctccaccttctccttattaacgcgctaaactcgttccttctccaaccgactctaacccacgcgccgcgccttctactacactacttcctcgaccacctacgtcgcgtactacaaccgtcgctcccccgcccgaaccaacgcctccaaatacgcctaatattcccgctctttacgctctaccgcctccttaacccgccgaccctacaactcctctcgccgaacccgctcccgcaactcccgaatacgctactccaccaaatactcgtaattctcctacgcacgacccaaactaacttccaacgaactccgcaaaccctctcgctcctaacgctactaccgaatccgaccctataacaacgcctcgtaacgcgcccgctcgacccgactcaactcccgcttctcccgctacaactaaccctcctaccgctacttaacgcgaaccgccgctaaacgcgctccctacgaatctactcaacccgctcccgcccttcctataaaccttcctcacgttacttcaaattctactcctactaaaacttacgcaaccgatcctcccgaaccgcgcgctccgcccgctcccgccgcaaaaaaccctaacgttcgaccaactcccgccgccgctcctcgctacgctcgtactaccgctaccgccgccgcgccgcctcgcgctcttcgcgaccacgacgacctcgccgctcctccacctacgcgacccaaactcgacgaccctactctaaaacgcgctacttctcccgctcctcgcgctcccgccgctacttaacgtacacgcgctacaactcccactaaccgtaaacaaccgcgcgttactccaacaacaaaaactcctcctaataccgcgccaacataaacgccgcgatcttccgatcacgctccgacaccccgcgcaaaccgcgctctacacgcacttaacgcacgatacgctccacgtactaaacgatctacgacgaataactcaaatcgccgaaactaaaactacgaccgataatcgaaaccaaaatcaaaacaaacgaacgacccgaaacgttaataataaaaaacgccgaccccgctaaacaactattcctaaccgaaacccgaaacgaccaacgcaactccctcaaactttccccactataaaataacgacgatacgcccgactcgaaactaaaaacgccctcacgccgacgaaacaataaatccaacgaataactcttcctacctattcgaaaacccgctaacgaaaattaaatccgaacgaaaaaaaaactaaaaaaaaccttacgaaccgcacgcgacgcgaacgaaaccgaaaaactaacgctactacaactactactactacccgcgctcgaaaccgaaaccgcgacgacgacgacgacgacgacgaccgcgaaactcaaaaacgtaaaaaaacgccgcttctcctcgcgcataatacgctcgcgctcgacccgacattactacaacttaacgcgccgctccgcctcgtaaacctcatacaaaccgataaccacccgcataaaacgacccgaaacctctcgcaccaaatcgaccaaaacccgtaacaacaactccaccgacttaaccgcacaacgaacgcaaacctctaacgaacgaaaactaatcaacacgtaacgactaccctccgcctctaaacaatcgaaattaaaaaaatcgaaatacaacaacgaaaactactcccgccgcccgccttctacgactacacataaaacttctaccttacgaaacaccgccgcgaaaaccgaaaccgaaaccgaaaaaactacgaactcctatacgccctaaaaatcaaaaaacacgaacgccacgacctcgtcccctccaaaatcgccgaattccgctcctaccttctcttcttcaaacactaaatccaccataactaaaccccgtcctttattaaaat

SEQ ID NO: 18765 - DNA, 875 bp, Artificial Sequence
  chemically treated genomic DNA (Homo sapiens) CpG-island No: 18765
ttagcgtagagggattgtttttttaaggtttttttatttttttaatcgcgtcgttttttttttgggtatttggttcggtcggcggcgcgtgcgtgtagggtttttcggcggggcggtcgcggcggcgcgacgtcggcgtcgttgcgtgcgcgtttggttttgtttttttttcgtttttttttcgttttttttttttcgcggggtttttttcgttcgcgcggtatagttgggttagtgacgcgggcgttgtagtcgtcgttatcgtcgcgttttatttttcgaagtcggcgatcgttttattttttttttttttttcgttcgttttttttgtttatagcgtcggttagagcgagttagataagggtacgcggggtttcgtttagattcgagaagattgcgggcgcgcgtaagcggcggcgtggaagttgtgagcgtttttatttcggaggttttcgtcggttttcgggtgagttgttatcgcggttcgggggcggcggggtcggtattgtgttatcgacgcgttcggtcggttgttaggggcgcgggattagcgcgtatcgtttaggagtgacgttggtcggagttcgggtcggtttcggcggtttttcgcgtttttttgcgtcggttcgttgttattcggtcgcgagtcgcgtcgttgggagtttcgcgttggcgtggcgcggttagtcggttagtagtgggggtgcgcggtcggggggatcggcggttggtttgcggtcgggaatttggtgattcgcggttcggggcgcgtcgtttcgcgtcgttgttcgggtagtatcggaagagttagacgtcgtgtcgatgggtgtagaggaggtaggtagaggttttttgtgttattgttattattgttt

SEQ ID NO: 18766 - DNA, 875 bp, Artificial Sequence
  chemically treated genomic DNA (Homo sapiens) CpG-island No: 18766
aaacaataataacaataacacaaaaaacctctacctacctcctctacacccatcgacacgacgtctaactcttccgatactacccgaacaacgacgcgaaacgacgcgccccgaaccgcgaatcaccaaattcccgaccgcaaaccaaccgccgatccccccgaccgcgcacccccactactaaccgactaaccgcgccacgccaacgcgaaactcccaacgacgcgactcgcgaccgaataacaacgaaccgacgcaaaaaaacgcgaaaaaccgccgaaaccgacccgaactccgaccaacgtcactcctaaacgatacgcgctaatcccgcgcccctaacaaccgaccgaacgcgtcgataacacaataccgaccccgccgcccccgaaccgcgataacaactcacccgaaaaccgacgaaaacctccgaaataaaaacgctcacaacttccacgccgccgcttacgcgcgcccgcaatcttctcgaatctaaacgaaaccccgcgtacccttatctaactcgctctaaccgacgctataaacaaaaaaaacgaacgaaaaaaaaaaaaaaaataaaacgatcgccgacttcgaaaaataaaacgcgacgataacgacgactacaacgcccgcgtcactaacccaactataccgcgcgaacgaaaaaaaccccgcgaaaaaaaaaaaacgaaaaaaaaacgaaaaaaaaacaaaaccaaacgcgcacgcaacgacgccgacgtcgcgccgccgcgaccgccccgccgaaaaaccctacacgcacgcgccgccgaccgaaccaaatacccaaaaaaaaaacgacgcgattaaaaaaataaaaaaaccttaaaaaaacaatccctctacgctaa

SEQ ID NO: 18767 - DNA, 875 bp, Artificial Sequence
  chemically treated genomic DNA (Homo sapiens) CpG-island No: 18767
gggtagtaatgatagtggtatagagggtttttgtttattttttttgtatttatcggtacggcgtttggttttttcggtgttgttcgggtagcgacgcgggacggcgcgtttcggatcgcgggttattaagttttcggtcgtaaattagtcgtcggttttttcggtcgcgtatttttattgttggtcggttggtcgcgttacgttagcgcggggtttttagcggcgcggttcgcggtcgggtgatagcgggtcggcgtagagaagcgcggggagtcgtcgaagtcggttcgggtttcggttagcgttatttttgggcggtgcgcgttggtttcgcgtttttgatagtcggtcgagcgcgtcgatggtataatgtcggtttcgtcgttttcgggtcgcggtgataatttattcgggagtcggcggagattttcgggatgggggcgtttatagtttttacgtcgtcgtttgcgcgcgttcgtagttttttcgggtttaggcgaggtttcgcgtgtttttgtttagttcgttttggtcggcgttgtgggtagaggaagcgggcgggagggagggaggaggtggggcggtcgtcggtttcggagaatagaacgcggcggtagcgacggttgtagcgttcgcgttattgatttagttgtatcgcgcgggcgggggaggtttcgcggaggggagggggcggggaaggggcgggaaaggggtagggttaggcgcgtacgtaacggcgtcggcgtcgcgtcgtcgcgatcgtttcgtcgggaggttttgtacgtacgcgtcgtcggtcgggttaggtatttaagggagaagcgacgcggttggggaggtgggggggttttaaagagatagtttttttgcgttgg

SEQ ID NO: 18768 - DNA, 875 bp, Artificial Sequence
  chemically treated genomic DNA (Homo sapiens) CpG-island No: 18768
ccaacgcaaaaaaactatctctttaaaacccccccacctccccaaccgcgtcgcttctcccttaaatacctaacccgaccgacgacgcgtacgtacaaaacctcccgacgaaacgatcgcgacgacgcgacgccgacgccgttacgtacgcgcctaaccctacccctttcccgccccttccccgccccctcccctccgcgaaacctcccccgcccgcgcgatacaactaaatcaataacgcgaacgctacaaccgtcgctaccgccgcgttctattctccgaaaccgacgaccgccccacctcctccctccctcccgcccgcttcctctacccacaacgccgaccaaaacgaactaaacaaaaacacgcgaaacctcgcctaaacccgaaaaaactacgaacgcgcgcaaacgacgacgtaaaaactataaacgcccccatcccgaaaatctccgccgactcccgaataaattatcaccgcgacccgaaaacgacgaaaccgacattataccatcgacgcgctcgaccgactatcaaaaacgcgaaaccaacgcgcaccgcccaaaaataacgctaaccgaaacccgaaccgacttcgacgactccccgcgcttctctacgccgacccgctatcacccgaccgcgaaccgcgccgctaaaaaccccgcgctaacgtaacgcgaccaaccgaccaacaataaaaatacgcgaccgaaaaaaccgacgactaatttacgaccgaaaacttaataacccgcgatccgaaacgcgccgtcccgcgtcgctacccgaacaacaccgaaaaaaccaaacgccgtaccgataaatacaaaaaaaataaacaaaaaccctctataccactatcattactaccc

SEQ ID NO: 18769 - DNA, 573 bp, Artificial Sequence
  chemically treated genomic DNA (Homo sapiens) CpG-island No: 18769
ttcgagggttttcgggggagagcggtcgcgggaggacgggaacgaagtcgtagcgagaatttcgttttacgtcgtagttttttgtagtagcgtcggttcgtcggttttttgcgtttcgagtcgtttagggagtttagtcgtcgtagtttcggtttttgtgttttttttcgcgggtcgggtttggtgtgtacgtttggatggtttcgggtttggaaggtttgcgaggtttcgggagtcgtagatcgcgtcggggaggagatttcggtaggtcggtcggggtagagcgttaaggagggcggcggaattttggttgtttttcgggaggttaagggtagttttttcgcgtgattcgcgcgttgtcgagcgcgtcggttattttggcggtttcgttcgggtttcgcgttcggttcggtttggttttcgttcgcggttgagtagacgtcggggtggcgacgggagagttcgatcgcgaagttcggtcgtaggagtgcgtgggcgtcgtagaagtttaggagagttttggattttggtagtttttcgggggtgttgggaaacgttattttagtagtcgtt

SEQ ID NO: 18770 - DNA, 573 bp, Artificial Sequence
  chemically treated genomic DNA (Homo sapiens) CpG-island No: 18770
aacgactactaaaataacgtttcccaacacccccgaaaaactaccaaaatccaaaactctcctaaacttctacgacgcccacgcactcctacgaccgaacttcgcgatcgaactctcccgtcgccaccccgacgtctactcaaccgcgaacgaaaaccaaaccgaaccgaacgcgaaacccgaacgaaaccgccaaaataaccgacgcgctcgacaacgcgcgaatcacgcgaaaaaactacccttaacctcccgaaaaacaaccaaaattccgccgccctccttaacgctctaccccgaccgacctaccgaaatctcctccccgacgcgatctacgactcccgaaacctcgcaaaccttccaaacccgaaaccatccaaacgtacacaccaaacccgacccgcgaaaaaaaacacaaaaaccgaaactacgacgactaaactccctaaacgactcgaaacgcaaaaaaccgacgaaccgacgctactacaaaaaactacgacgtaaaacgaaattctcgctacgacttcgttcccgtcctcccgcgaccgctctcccccgaaaaccctcgaa

SEQ ID NO: 18771 - DNA, 573 bp, Artificial Sequence
  chemically treated genomic DNA (Homo sapiens) CpG-island No: 18771
ggcggttattggggtggcgttttttagtattttcgggaagttattaaggtttagggtttttttgggtttttgcgacgtttacgtatttttgcggtcgagtttcgcggtcgggttttttcgtcgttatttcggcgtttgtttagtcgcgagcgagaattaagtcgggtcgggcgcggggttcgggcgaggtcgttaagatggtcgacgcgttcggtagcgcgcggattacgcgggaaggttgtttttggtttttcgggaaatagttaaggtttcgtcgttttttttggcgttttgtttcggtcggtttgtcgggatttttttttcggcgcggtttgcggttttcggggtttcgtaaattttttaggttcgaggttatttagacgtgtatattaggttcggttcgcgaggggagatataggggtcggggttgcggcggttgagttttttgggcggttcggaacgtaaggggtcggcgagtcgacgttgttgtaggaggttgcggcgtggggcgaggttttcgttacggtttcgttttcgttttttcgcggtcgttttttttcggaagttttcgga

SEQ ID NO: 18772 - DNA, 573 bp, Artificial Sequence
  chemically treated genomic DNA (Homo sapiens) CpG-island No: 18772
tccgaaaacttccgaaaaaaaacgaccgcgaaaaaacgaaaacgaaaccgtaacgaaaacctcgccccacgccgcaacctcctacaacaacgtcgactcgccgaccccttacgttccgaaccgcccaaaaaactcaaccgccgcaaccccgacccctatatctcccctcgcgaaccgaacctaatatacacgtctaaataacctcgaacctaaaaaatttacgaaaccccgaaaaccgcaaaccgcgccgaaaaaaaaatcccgacaaaccgaccgaaacaaaacgccaaaaaaaacgacgaaaccttaactatttcccgaaaaaccaaaaacaaccttcccgcgtaatccgcgcgctaccgaacgcgtcgaccatcttaacgacctcgcccgaaccccgcgcccgacccgacttaattctcgctcgcgactaaacaaacgccgaaataacgacgaaaaaacccgaccgcgaaactcgaccgcaaaaatacgtaaacgtcgcaaaaacccaaaaaaaccctaaaccttaataacttcccgaaaatactaaaaaacgccaccccaataaccgcc

SEQ ID NO: 18773 - DNA, 614 bp, Artificial Sequence
  chemically treated genomic DNA (Homo sapiens) CpG-island No: 18773
gtcgcggtttattgtagtttcggtagtttgtcgttttacgtttgggaggttagttcgtacgttcggtcgcgggtcgtgcgtttttagatgaagttcgtgcgggtcggttttagcggcgttttattttcgggtcgttttttaggttcgtttcggtttttttgttttttagcgatcgttatttcgcgatttagtttgtggacgtgtcgcggcgttcgcgtcggtagttcggggtttcggatcggttttttttcgtcgcgtgaggttgacgtatcgattagtttttcggttcggtttcgttcggtcgcgttgcgttcgcgttcgttttcgttttcggttttttgacgttttcggtttggagacgtaattcgacgcgtataattttagattttgcgcgggagtcgggggtttttttagtttttagagcgagagcgaaagtcggaggggtttgtgtttttttgcggggttggggggcggggggtgttcgtttcgcgtcgtttcgtttagttttagttcgtttattttcggttaattttttcgtattttaatgcgagataattaaatcgtacgaattacgtgtttatcgtgttttcggcggagttttaaagttgaaaggg

SEQ ID NO: 18774 - DNA, 614 bp, Artificial Sequence
  chemically treated genomic DNA (Homo sapiens) CpG-island No: 18774
ccctttcaactttaaaactccgccgaaaacacgataaacacgtaattcgtacgatttaattatctcgcattaaaatacgaaaaaattaaccgaaaataaacgaactaaaactaaacgaaacgacgcgaaacgaacaccccccgccccccaaccccgcaaaaaaacacaaacccctccgactttcgctctcgctctaaaaactaaaaaaacccccgactcccgcgcaaaatctaaaattatacgcgtcgaattacgtctccaaaccgaaaacgtcaaaaaaccgaaaacgaaaacgaacgcgaacgcaacgcgaccgaacgaaaccgaaccgaaaaactaatcgatacgtcaacctcacgcgacgaaaaaaaaccgatccgaaaccccgaactaccgacgcgaacgccgcgacacgtccacaaactaaatcgcgaaataacgatcgctaaaaaacaaaaaaaccgaaacgaacctaaaaaacgacccgaaaataaaacgccgctaaaaccgacccgcacgaacttcatctaaaaacgcacgacccgcgaccgaacgtacgaactaacctcccaaacgtaaaacgacaaactaccgaaactacaataaaccgcgac

SEQ ID NO: 18775 - DNA, 614 bp, Artificial Sequence
  chemically treated genomic DNA (Homo sapiens) CpG-island No: 18775
tttttttagttttaagatttcgtcgggaatacggtggatacgtaattcgtacgatttgattgtttcgtattgagatacggaaggattggtcgggagtgagcgggttggggttgggcggggcggcgcggggcgggtatttttcgttttttaatttcgtaggaaaatataggttttttcggttttcgttttcgttttgggaattggaaggattttcgattttcgcgtagggtttggggttgtgcgcgtcgggttgcgtttttaggtcgggggcgttagggagtcgggggcggggacgggcgcgggcgtagcgcgatcgggcggggtcgagtcgggaagttggtcggtgcgttagttttacgcggcgggaaggaatcggttcgaggtttcgggttgtcggcgcgggcgtcgcggtacgtttataggttgggtcgcgaggtggcgatcgttgagaggtaggagggtcgaggcgggtttgggaggcggttcggaggtggggcgtcgttggggtcggttcgtacgggttttatttgagggcgtacggttcgcgatcgagcgtgcggattggttttttaagcgtggggcgataagttgtcggagttgtaatgggtcgcggt

SEQ ID NO: 18776 - DNA, 614 bp, Artificial Sequence
  chemically treated genomic DNA (Homo sapiens) CpG-island No: 18776
accgcgacccattacaactccgacaacttatcgccccacgcttaaaaaaccaatccgcacgctcgatcgcgaaccgtacgccctcaaataaaacccgtacgaaccgaccccaacgacgccccacctccgaaccgcctcccaaacccgcctcgaccctcctacctctcaacgatcgccacctcgcgacccaacctataaacgtaccgcgacgcccgcgccgacaacccgaaacctcgaaccgattccttcccgccgcgtaaaactaacgcaccgaccaacttcccgactcgaccccgcccgatcgcgctacgcccgcgcccgtccccgcccccgactccctaacgcccccgacctaaaaacgcaacccgacgcgcacaaccccaaaccctacgcgaaaatcgaaaatccttccaattcccaaaacgaaaacgaaaaccgaaaaaacctatattttcctacgaaattaaaaaacgaaaaatacccgccccgcgccgccccgcccaaccccaacccgctcactcccgaccaatccttccgtatctcaatacgaaacaatcaaatcgtacgaattacgtatccaccgtattcccgacgaaatcttaaaactaaaaaaa

SEQ ID NO: 18777 - DNA, 561 bp, Artificial Sequence
  chemically treated genomic DNA (Homo sapiens) CpG-island No: 18777
tcgttttgttttatcgtagtttcgttttttttacgtcgggtgagttgtggtttagtagtattcgaggtttcgttttttttatttttaagcgtttgcgttttagcgaaggggcggagtagggcggtggcgcgttgatatttggcggcggcggagggcgggtagaaggcgagcgtgggttgggattggttgaggcgacgcgggtggagggggcgggaaggaggcggggagacggttgtcgggttggtttttgtgttggattttgggcggtttgaggggtacggagattttgggggagggagacggtagcggtatggcggtcgggtgtaagacgttcgattttttttttttttgttttcgtcgtcgtcgttgttggagttattgggattttgtagtttgcgtgtgttagttgtaatttcgtcgtttttttgttagtttttcgtttcgtcggtttttttttttttcgtcgtcgtagttagttcgagggtcggtcggttgtgtaatatttttttattttatttattagttcgcgggttagtattatggaggacgtgaagttggagt

SEQ ID NO: 18778 - DNA, 561 bp, Artificial Sequence
  chemically treated genomic DNA (Homo sapiens) CpG-island No: 18778
actccaacttcacgtcctccataatactaacccgcgaactaataaataaaataaaaaaatattacacaaccgaccgaccctcgaactaactacgacgacgaaaaaaaaaaaaaccgacgaaacgaaaaactaacaaaaaaacgacgaaattacaactaacacacgcaaactacaaaatcccaataactccaacaacgacgacgacgaaaacaaaaaaaaaaaaaatcgaacgtcttacacccgaccgccataccgctaccgtctccctcccccaaaatctccgtacccctcaaaccgcccaaaatccaacacaaaaaccaacccgacaaccgtctccccgcctccttcccgccccctccacccgcgtcgcctcaaccaatcccaacccacgctcgccttctacccgccctccgccgccgccaaatatcaacgcgccaccgccctactccgccccttcgctaaaacgcaaacgcttaaaaataaaaaaaacgaaacctcgaatactactaaaccacaactcacccgacgtaaaaaaaacgaaactacgataaaacaaaacga

SEQ ID NO: 18779 - DNA, 561 bp, Artificial Sequence
  chemically treated genomic DNA (Homo sapiens) CpG-island No: 18779
attttagttttacgttttttatggtgttggttcgcgggttggtgggtggggtgggagagtgttatatagtcggtcgattttcgggttggttgcggcggcggaaggaaggagggtcggcggagcggagggttgataggagggcggcgggattataattaatatacgtagattatagggttttagtgattttagtagcggcggcggcgaagatagggaagaggagggtcgggcgttttatattcggtcgttatgtcgttgtcgttttttttttttagagttttcgtattttttaggtcgtttaggatttagtataggaattagttcgataatcgttttttcgtttttttttcgttttttttattcgcgtcgttttagttaattttagtttacgttcgttttttgttcgtttttcgtcgtcgttaggtgttagcgcgttatcgttttgtttcgttttttcgttagagcgtagacgtttgggggtggggggggcggagtttcggatgttgttaggttatagtttattcggcgtggaggaggcggggttgcggtgggataggacga

SEQ ID NO: 18780 - DNA, 561 bp, Artificial Sequence
  chemically treated genomic DNA (Homo sapiens) CpG-island No: 18780
tcgtcctatcccaccgcaaccccgcctcctccacgccgaataaactataacctaacaacatccgaaactccgccccccccacccccaaacgtctacgctctaacgaaaaaacgaaacaaaacgataacgcgctaacacctaacgacgacgaaaaacgaacaaaaaacgaacgtaaactaaaattaactaaaacgacgcgaataaaaaaaacgaaaaaaaaacgaaaaaacgattatcgaactaattcctatactaaatcctaaacgacctaaaaaatacgaaaactctaaaaaaaaaaaacgacaacgacataacgaccgaatataaaacgcccgaccctcctcttccctatcttcgccgccgccgctactaaaatcactaaaaccctataatctacgtatattaattataatcccgccgccctcctatcaaccctccgctccgccgaccctccttccttccgccgccgcaaccaacccgaaaatcgaccgactatataacactctcccaccccacccaccaacccgcgaaccaacaccataaaaaacgtaaaactaaaat

SEQ ID NO: 18781 - DNA, 612 bp, Artificial Sequence
  chemically treated genomic DNA (Homo sapiens) CpG-island No: 18781
gttatcgattcggcggagtcggttttttgggaaaaaataatttgcgaagttttttttttttttcgtgttttttacgcgaggtattttttaattaatgggaaacgtggtgggcggagcgagagtgatagacgattatagagttttttcgtcggcgcgaacgggcggtgtagtagtagggttaattagtagcgtgggtgggaagtataggggcgggagaaagtagggaaattacgcgtttaattagatttcggggttttcgagcgacgggttttgcggttcgtggtttttcgagcgcggcgtttagggggcgtgtttgtttgggttaatcggcgcgagtttatagtgcggagcgagcgttttaaatgttcgggttttttagttgattgtttttagtcgagagttgttttttgtagttacggagtcgagtcgtagtaggaggagtcgagattttcggggggtggggggaaagaggaggcggggttcgggggagtcgcggttgttttgcgttggatttcgggtttcgttacggcgttttttggggttagaggttggggtgggtggggggtaagggggtagtttttttttttttcgacggcggtttcgagtttagtt

SEQ ID NO: 18782 - DNA, 612 bp, Artificial Sequence
  chemically treated genomic DNA (Homo sapiens) CpG-island No: 18782
aactaaactcgaaaccgccgtcgaaaaaaaaaaaaactacccccttaccccccacccaccccaacctctaaccccaaaaaacgccgtaacgaaacccgaaatccaacgcaaaacaaccgcgactcccccgaaccccgcctcctctttccccccaccccccgaaaatctcgactcctcctactacgactcgactccgtaactacaaaaaacaactctcgactaaaaacaatcaactaaaaaacccgaacatttaaaacgctcgctccgcactataaactcgcgccgattaacccaaacaaacacgccccctaaacgccgcgctcgaaaaaccacgaaccgcaaaacccgtcgctcgaaaaccccgaaatctaattaaacgcgtaatttccctactttctcccgcccctatacttcccacccacgctactaattaaccctactactacaccgcccgttcgcgccgacgaaaaaactctataatcgtctatcactctcgctccgcccaccacgtttcccattaattaaaaaatacctcgcgtaaaaaacacgaaaaaaaaaaaaaacttcgcaaattattttttcccaaaaaaccgactccgccgaatcgataac

SEQ ID NO: 18783 - DNA, 612 bp, Artificial Sequence
  chemically treated genomic DNA (Homo sapiens) CpG-island No: 18783
ggttggattcggagtcgtcgtcgaaggggagaaggattgtttttttattttttatttattttagtttttaattttaggaagcgtcgtgacgggattcggagtttagcgtaaagtagtcgcggttttttcggatttcgttttttttttttttttatttttcgggggtttcggttttttttgttgcggttcggtttcgtagttgtaaaaaataattttcggttggagataattagttgagaaattcgagtatttgaggcgttcgtttcgtattgtgggttcgcgtcgattggtttaggtaggtacgttttttgagcgtcgcgttcggaaggttacgggtcgtaggattcgtcgttcgagggtttcgagatttgattgggcgcgtaatttttttattttttttcgtttttgtattttttatttacgttgttgattggttttgttattgtatcgttcgttcgcgtcggcgggaggattttgtaatcgtttgttattttcgtttcgtttattacgttttttattggttagagagtgtttcgcgtagggagtacgaggagaaggaggagtttcgtaggttgtttttttttaggaggtcgatttcgtcgagtcggtggt

SEQ ID NO: 18784 - DNA, 612 bp, Artificial Sequence
  chemically treated genomic DNA (Homo sapiens) CpG-island No: 18784
accaccgactcgacgaaatcgacctcctaaaaaaaaacaacctacgaaactcctccttctcctcgtactccctacgcgaaacactctctaaccaataaaaaacgtaataaacgaaacgaaaataacaaacgattacaaaatcctcccgccgacgcgaacgaacgatacaataacaaaaccaatcaacaacgtaaataaaaaatacaaaaacgaaaaaaaataaaaaaattacgcgcccaatcaaatctcgaaaccctcgaacgacgaatcctacgacccgtaaccttccgaacgcgacgctcaaaaaacgtacctacctaaaccaatcgacgcgaacccacaatacgaaacgaacgcctcaaatactcgaatttctcaactaattatctccaaccgaaaattattttttacaactacgaaaccgaaccgcaacaaaaaaaaccgaaacccccgaaaaataaaaaaaaaaaaaaaacgaaatccgaaaaaaccgcgactactttacgctaaactccgaatcccgtcacgacgcttcctaaaattaaaaactaaaataaataaaaaataaaaaaacaatccttctccccttcgacgacgactccgaatccaacc

SEQ ID NO: 18785 - DNA, 749 bp, Artificial Sequence
  chemically treated genomic DNA (Homo sapiens) CpG-island No: 18785
  misc_feature (534)..(534): n is either a, c, g or t
gtgggaacgtaggatgtggttttaaggggtaggatgagggggcgggacgatcgaacgcggatgtcgagtttagggagggtaaggagggatgaaaagttagcggagggacgagggtgtaaggagcggttggagagagatgggttgcgggtttgggggcgttgttagagcgagaggaggcgaagtttacgagttgggtgggtaggagggcggtagggtttgttcgggcggggatgggcgggcgtggggatgcgcgggttggggcgcgggggtcgtagagtcgtaggttcggttttgtcggcgcgtatttattttattcgaggaattcggttacgtatttgtcgcggcgtagggtcgagtggttgtattcggtgtataggtagacgagtacgtcgagtagcgtttttacgtttagggcgttttcgttgcgttagggttcgtttaggagtagttgttttagttttttgagtcgtattttggtcgatatggtgtcgcgcggtcgttttcgacgcgtcgtttttgatagcggttgcgtantgcgttaggcgcgtttcggggtttagcgttgcgattcgtagtacgtttgttcgcgttcgttttatgtgggttcggttatgcgaatttgggttttttcgacgcgtaatttgggcggagtttcggttttggttttttttttggtgcgttttgtattcgttgttttcgcgttttatatttagttattttcgtcgtttaataatcgtaattttttgtat

SEQ ID NO: 18786 - DNA, 749 bp, Artificial Sequence
  chemically treated genomic DNA (Homo sapiens) CpG-island No: 18786
  misc_feature (216)..(216): n is either a, c, g or t
atacaaaaaattacgattattaaacgacgaaaataactaaatataaaacgcgaaaacaacgaatacaaaacgcaccaaaaaaaaaaccaaaaccgaaactccgcccaaattacgcgtcgaaaaaacccaaattcgcataaccgaacccacataaaacgaacgcgaacaaacgtactacgaatcgcaacgctaaaccccgaaacgcgcctaacgcantacgcaaccgctatcaaaaacgacgcgtcgaaaacgaccgcgcgacaccatatcgaccaaaatacgactcaaaaaactaaaacaactactcctaaacgaaccctaacgcaacgaaaacgccctaaacgtaaaaacgctactcgacgtactcgtctacctatacaccgaatacaaccactcgaccctacgccgcgacaaatacgtaaccgaattcctcgaataaaataaatacgcgccgacaaaaccgaacctacgactctacgacccccgcgccccaacccgcgcatccccacgcccgcccatccccgcccgaacaaaccctaccgccctcctacccacccaactcgtaaacttcgcctcctctcgctctaacaacgcccccaaacccgcaacccatctctctccaaccgctccttacaccctcgtccctccgctaacttttcatccctccttaccctccctaaactcgacatccgcgttcgatcgtcccgccccctcatcctaccccttaaaaccacatcctacgttcccac

SEQ ID NO: 18787 - DNA, 749 bp, Artificial Sequence
  chemically treated genomic DNA (Homo sapiens) CpG-island No: 18787
  misc_feature (216)..(216): n is either a, c, g or t
gtgtagaaagttgcgattattgggcggcgggagtagttgggtgtaggacgcgagagtaacgagtgtagggcgtattaggagaggggttaggatcggggtttcgtttagattgcgcgtcgaaggagtttagattcgtatagtcgggtttatatgggacgggcgcgagtaggcgtgttgcgggtcgtagcgttgagtttcgaggcgcgtttgacgtantgcgtagtcgttgttagaggcggcgcgtcgggagcggtcgcgcggtattatgtcggttaaggtgcggtttaagaagttggagtagttgtttttggacgggttttggcgtaacgagagcgttttgagcgtggaaacgttgttcgacgtgttcgtttgtttgtatatcgagtgtagttattcggttttgcgtcgcgataagtacgtggtcgagtttttcgagtggggtaagtgcgcgtcggtagggtcggatttgcggttttgcgattttcgcgttttagttcgcgtatttttacgttcgtttattttcgttcggatagattttgtcgtttttttgtttatttagttcgtgggtttcgttttttttcgttttggtagcgtttttaggttcgtagtttatttttttttagtcgttttttgtattttcgttttttcgttagttttttatttttttttgttttttttaggttcgatattcgcgttcgatcgtttcgtttttttattttgttttttggagttatattttacgtttttat

SEQ ID NO: 18788 - DNA, 749 bp, Artificial Sequence
  chemically treated genomic DNA (Homo sapiens) CpG-island No: 18788
  misc_feature (534)..(534): n is either a, c, g or t
ataaaaacgtaaaatataactccaaaaaacaaaataaaaaaacgaaacgatcgaacgcgaatatcgaacctaaaaaaaacaaaaaaaaataaaaaactaacgaaaaaacgaaaatacaaaaaacgactaaaaaaaaataaactacgaacctaaaaacgctaccaaaacgaaaaaaaacgaaacccacgaactaaataaacaaaaaaacgacaaaatctatccgaacgaaaataaacgaacgtaaaaatacgcgaactaaaacgcgaaaatcgcaaaaccgcaaatccgaccctaccgacgcgcacttaccccactcgaaaaactcgaccacgtacttatcgcgacgcaaaaccgaataactacactcgatatacaaacaaacgaacacgtcgaacaacgtttccacgctcaaaacgctctcgttacgccaaaacccgtccaaaaacaactactccaacttcttaaaccgcaccttaaccgacataataccgcgcgaccgctcccgacgcgccgcctctaacaacgactacgcantacgtcaaacgcgcctcgaaactcaacgctacgacccgcaacacgcctactcgcgcccgtcccatataaacccgactatacgaatctaaactccttcgacgcgcaatctaaacgaaaccccgatcctaacccctctcctaatacgccctacactcgttactctcgcgtcctacacccaactactcccgccgcccaataatcgcaactttctacac

SEQ ID NO: 18789 - DNA, 521 bp, Artificial Sequence
  chemically treated genomic DNA (Homo sapiens) CpG-island No: 18789
  misc_feature (61)..(62): n is either a, c, g or t
  misc_feature (64)..(64): n is either a, c, g or t
  misc_feature (66)..(66): n is either a, c, g or t
  misc_feature (69)..(69): n is either a, c, g or t
  misc_feature (93)..(93): n is either a, c, g or t
  misc_feature (107)..(107): n is either a, c, g or t
gttttttgttttcggcgggttcgggtttcgtcgtttgtcgtagggagtcgggatgttgggnngntnggntcgggtttggggtgcggcgcgggntttttgtttcgcgnttgttttcgtggcgagtgggtcgttgagattgcggagttcgcgtatggtagagcgcgtttggtgggcgtgtgcgttttcgtttgcggattcggtgtttttagtattcggggttcgatcgcgcgcgtcgcggatttcggggtcgaagacgattttaagtatcggagaggtagagtcgcgattttaggtcgtcgagtttcgtttcgtagttcgcgggtttatgttgtttgcggggtttcggatttgttcggtcgaggtgggggtcgagggcggttcggtaggcgtagttttgatggtttcggcgggttgtgggttatttaaaacggtttgttttagttcgaagcggttttggaagattcgggttttatttttgattttatcgatgagagattgaggtttagacggtgtggggttag

SEQ ID NO: 18790 - DNA, 521 bp, Artificial Sequence
  chemically treated genomic DNA (Homo sapiens) CpG-island No: 18790
  misc_feature (415)..(415): n is either a, c, g or t
  misc_feature (429)..(429): n is either a, c, g or t
  misc_feature (453)..(453): n is either a, c, g or t
  misc_feature (456)..(456): n is either a, c, g or t
  misc_feature (458)..(458): n is either a, c, g or t
  misc_feature (460)..(461): n is either a, c, g or t
ctaaccccacaccgtctaaacctcaatctctcatcgataaaatcaaaaataaaacccgaatcttccaaaaccgcttcgaactaaaacaaaccgttttaaataacccacaacccgccgaaaccatcaaaactacgcctaccgaaccgccctcgacccccacctcgaccgaacaaatccgaaaccccgcaaacaacataaacccgcgaactacgaaacgaaactcgacgacctaaaatcgcgactctacctctccgatacttaaaatcgtcttcgaccccgaaatccgcgacgcgcgcgatcgaaccccgaatactaaaaacaccgaatccgcaaacgaaaacgcacacgcccaccaaacgcgctctaccatacgcgaactccgcaatctcaacgacccactcgccacgaaaacaancgcgaaacaaaaancccgcgccgcaccccaaacccganccnancnncccaacatcccgactccctacgacaaacgacgaaacccgaacccgccgaaaacaaaaaac

SEQ ID NO: 18791 - DNA, 521 bp, Artificial Sequence
  chemically treated genomic DNA (Homo sapiens) CpG-island No: 18791
  misc_feature (415)..(415): n is either a, c, g or t
  misc_feature (429)..(429): n is either a, c, g or t
  misc_feature (453)..(453): n is either a, c, g or t
  misc_feature (456)..(456): n is either a, c, g or t
  misc_feature (458)..(458): n is either a, c, g or t
  misc_feature (460)..(461): n is either a, c, g or t
ttgattttatatcgtttgggttttagttttttatcggtaaagttaggggtagggttcgagttttttaggatcgtttcgagttgggataagtcgttttaaatagtttataattcgtcgaggttattagagttgcgtttgtcgggtcgttttcgatttttatttcggtcgggtaggttcgaggtttcgtaggtaatatgggttcgcggattgcgggacggggttcgacggtttgagatcgcgattttgttttttcgatatttggggtcgttttcggtttcgggattcgcgacgcgcgcggtcggatttcgaatattgaaggtatcgggttcgtaggcgaaggcgtatacgtttattaggcgcgttttgttatgcgcgggtttcgtaattttagcggtttattcgttacgaaaatagncgcggggtaaaaanttcgcgtcgtattttaggttcggnttngntnntttagtatttcggttttttacggtaagcggcgaggttcgagttcgtcgggagtagggagt

SEQ ID NO: 18792 - DNA, 521 bp, Artificial Sequence
  chemically treated genomic DNA (Homo sapiens) CpG-island No: 18792
  misc_feature (61)..(62): n is either a, c, g or t
  misc_feature (64)..(64): n is either a, c, g or t
  misc_feature (66)..(66): n is either a, c, g or t
  misc_feature (69)..(69): n is either a, c, g or t
  misc_feature (93)..(93): n is either a, c, g or t
  misc_feature (107)..(107): n is either a, c, g or t
actccctactcccgacgaactcgaacctcgccgcttaccgtaaaaaaccgaaatactaaannancnaanccgaacctaaaatacgacgcgaantttttaccccgcgnctattttcgtaacgaataaaccgctaaaattacgaaacccgcgcataacaaaacgcgcctaataaacgtatacgccttcgcctacgaacccgataccttcaatattcgaaatccgaccgcgcgcgtcgcgaatcccgaaaccgaaaacgaccccaaatatcgaaaaaacaaaatcgcgatctcaaaccgtcgaaccccgtcccgcaatccgcgaacccatattacctacgaaacctcgaacctacccgaccgaaataaaaatcgaaaacgacccgacaaacgcaactctaataacctcgacgaattataaactatttaaaacgacttatcccaactcgaaacgatcctaaaaaactcgaaccctacccctaactttaccgataaaaaactaaaacccaaacgatataaaatcaa

SEQ ID NO: 18793 - DNA, 695 bp, Artificial Sequence
  chemically treated genomic DNA (Homo sapiens) CpG-island No: 18793
ttatttgtcgggcgggacgagtaatatgattggtggaatcgagtaattattgattagtattgtttaattacggagggtagtttagagtcggtttaatgagggtttttagggggcgggtcggattgtcgcgggtcggggagcgttttgggtggttagttgtgggttcgggtcgtcgtgggtttcggtttgcgtgcggagatgagcgggtttttcggtcgagttgcggcggttttgtttcgttgggggcgcggcgcgggcggcggtggtttttggggttcgggcgtgcgggcggcgggttcgggcgcgggcggcggcggttcggcggagtagttggacgcgttggtgaagaaggataaggtggtggttttttttaaggggacgtcggagtagttttagtgcggttttagtaacgtcgtggtgtagattttgcggttgtacggcgttcgcgattacgcggtttataacgtgttggacgattcggagtttcgataaggttaggttagtgtgtcgggtaggcgtttttcgtttcgggtttaggagtatcgttgtacgaggtcgaggggtttcgtcgcgtcgggttgggggagcggggttttattcgtcggggtttgtttgaaggttcgagtcgggttagggcgaggagtattgttttggagtagagtttgggttgagggtgtagttgattttattgggtt

SEQ ID NO: 18794 - DNA, 695 bp, Artificial Sequence
  chemically treated genomic DNA (Homo sapiens) CpG-island No: 18794
aacccaataaaatcaactacaccctcaacccaaactctactccaaaacaatactcctcgccctaacccgactcgaaccttcaaacaaaccccgacgaataaaaccccgctcccccaacccgacgcgacgaaacccctcgacctcgtacaacgatactcctaaacccgaaacgaaaaacgcctacccgacacactaacctaaccttatcgaaactccgaatcgtccaacacgttataaaccgcgtaatcgcgaacgccgtacaaccgcaaaatctacaccacgacgttactaaaaccgcactaaaactactccgacgtccccttaaaaaaaaccaccaccttatccttcttcaccaacgcgtccaactactccgccgaaccgccgccgcccgcgcccgaacccgccgcccgcacgcccgaaccccaaaaaccaccgccgcccgcgccgcgcccccaacgaaacaaaaccgccgcaactcgaccgaaaaacccgctcatctccgcacgcaaaccgaaacccacgacgacccgaacccacaactaaccacccaaaacgctccccgacccgcgacaatccgacccgccccctaaaaaccctcattaaaccgactctaaactaccctccgtaattaaacaatactaatcaataattactcgattccaccaatcatattactcgtcccgcccgacaaataa

SEQ ID NO: 18795 - DNA, 695 bp, Artificial Sequence
  chemically treated genomic DNA (Homo sapiens) CpG-island No: 18795
gatttagtgaaattaattatatttttagtttagattttattttagggtagtatttttcgttttaattcggttcgaatttttagatagatttcggcggatggagtttcgtttttttagttcggcgcggcggaatttttcggtttcgtgtagcgatgtttttgggttcggggcggagggcgtttgttcggtatattggtttgattttgtcggagtttcgggtcgtttagtacgttgtaggtcgcgtaatcgcggacgtcgtgtagtcgtaggatttgtattacggcgttgttgaagtcgtattggggttgtttcggcgtttttttgaggaagattattattttgtttttttttattagcgcgtttaattgtttcgtcgagtcgtcgtcgttcgcgttcgagttcgtcgttcgtacgttcggattttaaaggttatcgtcgttcgcgtcgcgtttttagcggagtagagtcgtcgtagttcggtcgagggattcgtttattttcgtacgtaagtcggagtttacgacggttcgggtttatagttggttatttagagcgtttttcggttcgcggtagttcgattcgttttttggaggtttttattgggtcggttttaaattgtttttcgtgattggataatattgattagtaattattcgattttattaattatgttgttcgtttcgttcggtaggtag

SEQ ID NO: 18796 - DNA, 695 bp, Artificial Sequence
  chemically treated genomic DNA (Homo sapiens) CpG-island No: 18796
ctacctaccgaacgaaacgaacaacataattaataaaatcgaataattactaatcaatattatccaatcacgaaaaacaatttaaaaccgacccaataaaaacctccaaaaaacgaatcgaactaccgcgaaccgaaaaacgctctaaataaccaactataaacccgaaccgtcgtaaactccgacttacgtacgaaaataaacgaatccctcgaccgaactacgacgactctactccgctaaaaacgcgacgcgaacgacgataacctttaaaatccgaacgtacgaacgacgaactcgaacgcgaacgacgacgactcgacgaaacaattaaacgcgctaataaaaaaaaacaaaataataatcttcctcaaaaaaacgccgaaacaaccccaatacgacttcaacaacgccgtaatacaaatcctacgactacacgacgtccgcgattacgcgacctacaacgtactaaacgacccgaaactccgacaaaatcaaaccaatataccgaacaaacgccctccgccccgaacccaaaaacatcgctacacgaaaccgaaaaattccgccgcgccgaactaaaaaaacgaaactccatccgccgaaatctatctaaaaattcgaaccgaattaaaacgaaaaatactaccctaaaataaaatctaaactaaaaatataattaatttcactaaatc

SEQ ID NO: 18797 - DNA, 1379 bp, Artificial Sequence
  chemically treated genomic DNA (Homo sapiens) CpG-island No: 18797
tgttttcggttaaagtatagaagcggtttttagtttcgggtaggcggtcggggcgtcgggggtattggaagtgtttaaatttagcggtgttgtcgcgcggggaagcggaggtgcggtcgtaggataagcgcgttttttaagtttttggttatttgcgatgcgtttttaattcgtttgtttatcgttattattagaaattttagatagtttattgtgtgggtaggtagcgcgttttttcggtttcgtcgttttcgtttattttttgtcggttttttcggagcgttcgtatagtcggtagttcgtttttagcgttttgtaaagcgaaggaggacgttttgttagggttggagaaacgggataatatttcgtagtcggcgtagcggtttcgggcgggcgttttttaaaaggacgcgaatggggattcgcgtgagcgttatttttatatgtaaggggttagtttttataaaagcgcggttttcgggggtcgcgggttgtagcgcgtattttttttttttttgtgggagtgagttagtgtgcgtagtcgcgttttcgggatcggttttttttttcgttttcgaagtagtttcgttttcgtttcgttttttcgttcggtcgttgttttttttcggttcgtagggattgcgtttcgttggtttcggattttaaatgggaagttttcgagtgattcggtgtttagttcgtttcgggtttttagggtttcgtcgacggcgcgggggtagcgcgaggttttcgtgtatttttaggtcgtgggttcgggttttcggggttgcgttatttattgcgtttcggggtttaggcgttcggcgtcgtcgcgggaattatggtcgttggcgtatttcgggtttggcggcggtagcgggacggtcgcgtttagcgcgttcggttttcggttcggtcgcggttattcggagttttggacgtcggggaggaagggtcgggttcgcgcggggaggaggagttagggcgacgtcggtttcggcgcggttttttttttgcggttcgcgcggtttaggtagcggagggaggagcgggcggcgtcgtttgagttttcgtagacgcgttttttcgtttcgagcgttcgttttcgagatttgaagttagaaacgtcggggtttcgggtgcgggtgtaggagttggcgtttcgaggtcgttatcgagttggggttggcgttgttattttcgttttttgtttgttcgttttttttttttttttaatacgtttatatttattcgtatcgcggatattcgggtcgtagcgttttcgcgtagaggaagggttttcgtttttagtaagcgggattttaagggggtgattttttagttttcgggtgtcgattggttattaatattggaaaggg

SEQ ID NO: 18798 - DNA, 1379 bp, Artificial Sequence
  chemically treated genomic DNA (Homo sapiens) CpG-island No: 18798
ccctttccaatattaataaccaatcgacacccgaaaactaaaaaatcacccccttaaaatcccgcttactaaaaacgaaaacccttcctctacgcgaaaacgctacgacccgaatatccgcgatacgaataaatataaacgtattaaaaaaaaaaaaaaaacgaacaaacaaaaaacgaaaataacaacgccaaccccaactcgataacgacctcgaaacgccaactcctacacccgcacccgaaaccccgacgtttctaacttcaaatctcgaaaacgaacgctcgaaacgaaaaaacgcgtctacgaaaactcaaacgacgccgcccgctcctccctccgctacctaaaccgcgcgaaccgcaaaaaaaaaaccgcgccgaaaccgacgtcgccctaactcctcctccccgcgcgaacccgacccttcctccccgacgtccaaaactccgaataaccgcgaccgaaccgaaaaccgaacgcgctaaacgcgaccgtcccgctaccgccgccaaacccgaaatacgccaacgaccataattcccgcgacgacgccgaacgcctaaaccccgaaacgcaataaataacgcaaccccgaaaacccgaacccacgacctaaaaatacacgaaaacctcgcgctacccccgcgccgtcgacgaaaccctaaaaacccgaaacgaactaaacaccgaatcactcgaaaacttcccatttaaaatccgaaaccaacgaaacgcaatccctacgaaccgaaaaaaaacaacgaccgaacgaaaaaacgaaacgaaaacgaaactacttcgaaaacgaaaaaaaaaaccgatcccgaaaacgcgactacgcacactaactcactcccacaaaaaaaaaaaaaatacgcgctacaacccgcgacccccgaaaaccgcgcttttataaaaactaaccccttacatataaaaataacgctcacgcgaatccccattcgcgtccttttaaaaaacgcccgcccgaaaccgctacgccgactacgaaatattatcccgtttctccaaccctaacaaaacgtcctccttcgctttacaaaacgctaaaaacgaactaccgactatacgaacgctccgaaaaaaccgacaaaaaataaacgaaaacgacgaaaccgaaaaaacgcgctacctacccacacaataaactatctaaaatttctaataataacgataaacaaacgaattaaaaacgcatcgcaaataaccaaaaacttaaaaaacgcgcttatcctacgaccgcacctccgcttccccgcgcgacaacaccgctaaatttaaacacttccaatacccccgacgccccgaccgcctacccgaaactaaaaaccgcttctatactttaaccgaaaaca

SEQ ID NO: 18799 - DNA, 1379 bp, Artificial Sequence
  chemically treated genomic DNA (Homo sapiens) CpG-island No: 18799
ttttttttaatgttgatggttaatcgatattcgagggttgggaaattatttttttaaagtttcgtttgttgaaggcgggggttttttttttgcgcgaagacgttgcggttcgagtgttcgcggtgcgggtgagtgtaggcgtgttgggaaagaaagggaggcggataggtaaggggcgagggtggtagcgttagttttagttcggtggcgatttcggggcgttagtttttatattcgtattcggagtttcggcgtttttaattttagatttcggaggcgggcgttcggagcgggagggcgcgtttgcgagggtttaggcggcgtcgttcgttttttttttcgttgtttgagtcgcgcgggtcgtagaggaggagtcgcgtcggggtcggcgtcgttttgatttttttttttcgcgcgggttcggtttttttttttcggcgtttagagtttcgggtggtcgcggtcgagtcgggagtcgagcgcgttgggcgcggtcgtttcgttgtcgtcgttaagttcggagtgcgttagcggttatggttttcgcggcggcgtcgggcgtttgagtttcgggacgtagtaagtggcgtaatttcggggattcggatttacggtttgggggtgtacggaggtttcgcgttgttttcgcgtcgtcggcgaggttttgagagttcggagcgaattgggtatcggattattcgggggttttttatttggggttcggggttagcggggcgtaatttttgcgggtcgggaggaagtagcggtcgggcgggaggacgaggcggggacggggttgtttcggaggcgggaggaggggtcggtttcggaggcgcggttgcgtatattgatttatttttataaaaaaaaaaaggatgcgcgttgtagttcgcggttttcgagagtcgcgtttttgtaagagttggttttttatatatggaaatgacgtttacgcgggtttttattcgcgtttttttgaaggacgttcgttcggaatcgttgcgtcggttgcgaagtattgtttcgtttttttagttttaataaagcgttttttttcgttttgtagagcgttggaggcgggttgtcggttgtgcgggcgtttcggagagatcgatagaaggtaggcgagggcggcggggtcgggggagcgcgttgtttgtttatataatgggttgtttgaggtttttggtagtggcgatgggtaggcgagttgaggacgtatcgtaggtggttagggatttgggaggcgcgtttgttttgcggtcgtattttcgttttttcgcgcggtagtatcgttgggtttgggtatttttagtattttcgacgtttcggtcgtttgttcggagttgaaagtcgtttttgtgttttgatcgagagta

SEQ ID NO: 18800 - DNA, 1379 bp, Artificial Sequence
  chemically treated genomic DNA (Homo sapiens) CpG-island No: 18800
tactctcgatcaaaacacaaaaacgactttcaactccgaacaaacgaccgaaacgtcgaaaatactaaaaatacccaaacccaacgatactaccgcgcgaaaaaacgaaaatacgaccgcaaaacaaacgcgcctcccaaatccctaaccacctacgatacgtcctcaactcgcctacccatcgccactaccaaaaacctcaaacaacccattatataaacaaacaacgcgctcccccgaccccgccgccctcgcctaccttctatcgatctctccgaaacgcccgcacaaccgacaacccgcctccaacgctctacaaaacgaaaaaaaacgctttattaaaactaaaaaaacgaaacaatacttcgcaaccgacgcaacgattccgaacgaacgtccttcaaaaaaacgcgaataaaaacccgcgtaaacgtcatttccatatataaaaaaccaactcttacaaaaacgcgactctcgaaaaccgcgaactacaacgcgcatcctttttttttttataaaaataaatcaatatacgcaaccgcgcctccgaaaccgacccctcctcccgcctccgaaacaaccccgtccccgcctcgtcctcccgcccgaccgctacttcctcccgacccgcaaaaattacgccccgctaaccccgaaccccaaataaaaaacccccgaataatccgatacccaattcgctccgaactctcaaaacctcgccgacgacgcgaaaacaacgcgaaacctccgtacacccccaaaccgtaaatccgaatccccgaaattacgccacttactacgtcccgaaactcaaacgcccgacgccgccgcgaaaaccataaccgctaacgcactccgaacttaacgacgacaacgaaacgaccgcgcccaacgcgctcgactcccgactcgaccgcgaccacccgaaactctaaacgccgaaaaaaaaaaaccgaacccgcgcgaaaaaaaaaaatcaaaacgacgccgaccccgacgcgactcctcctctacgacccgcgcgactcaaacaacgaaaaaaaaaacgaacgacgccgcctaaaccctcgcaaacgcgccctcccgctccgaacgcccgcctccgaaatctaaaattaaaaacgccgaaactccgaatacgaatataaaaactaacgccccgaaatcgccaccgaactaaaactaacgctaccaccctcgccccttacctatccgcctccctttctttcccaacacgcctacactcacccgcaccgcgaacactcgaaccgcaacgtcttcgcgcaaaaaaaaaacccccgccttcaacaaacgaaactttaaaaaaataatttcccaaccctcgaatatcgattaaccatcaacattaaaaaaaa

SEQ ID NO: 18801 - DNA, 774 bp, Artificial Sequence
  chemically treated genomic DNA (Homo sapiens) CpG-island No: 18801
cgtttgggttcgattttacgacgcgattttagacgggttaacggggcggtttttatcggggtgggtttcgcgcggcgtttatttagtatttttttgcgtcgttgcgtgtgcggttggtcggtgtagatttattcgaagtcgttgcggttcgcgttgttgtttatggtggggcgggaggcgtcgttcggagcgcggtcggttcggttttgttgtatttgtcgcggcggtcgcggcgcggaattagttttgattagggcgggggcggggtttcggcggggcggggttaggtgcgttaggtttggggcggggtattttggttgggcggggcggtcgggtttcggcgttttttagatttcggcgggtagttggcgttttgggaattttagttgtttcggttggaaatggggtttttcggtaggatcgaggtggtcgcgtgttatttgcgcgagtttttgggtttttcgatgcgcgggggcgattgttgttatcgcggttttttatcggttttgcgcgtttcgtttattcgcgggtagtcgtcgggtttttatttcggttcgtttttttcgtagtttcgattcgttcgcgggtacgtttttgtggttcgcgtcgtttttgttttaaggaggagcggttggtaggatagggggattgcggaggatcggcgtggaatggatgcgacggtgttagtaaataggcgtcgaggaaaggttggtgtagtaattttttttttttttattcggtttttttattaataatgtaaaggggagataatgt

SEQ ID NO: 18802 - DNA, 774 bp, Artificial Sequence
  chemically treated genomic DNA (Homo sapiens) CpG-island No: 18802
acattatctcccctttacattattaataaaaaaaccgaataaaaaaaaaaaaaattactacaccaacctttcctcgacgcctatttactaacaccgtcgcatccattccacgccgatcctccgcaatccccctatcctaccaaccgctcctccttaaaacaaaaacgacgcgaaccacaaaaacgtacccgcgaacgaatcgaaactacgaaaaaaacgaaccgaaataaaaacccgacgactacccgcgaataaacgaaacgcgcaaaaccgataaaaaaccgcgataacaacaatcgcccccgcgcatcgaaaaacccaaaaactcgcgcaaataacacgcgaccacctcgatcctaccgaaaaaccccatttccaaccgaaacaactaaaattcccaaaacgccaactacccgccgaaatctaaaaaacgccgaaacccgaccgccccgcccaaccaaaataccccgccccaaacctaacgcacctaaccccgccccgccgaaaccccgcccccgccctaatcaaaactaattccgcgccgcgaccgccgcgacaaatacaacaaaaccgaaccgaccgcgctccgaacgacgcctcccgccccaccataaacaacaacgcgaaccgcaacgacttcgaataaatctacaccgaccaaccgcacacgcaacgacgcaaaaaaatactaaataaacgccgcgcgaaacccaccccgataaaaaccgccccgttaacccgtctaaaatcgcgtcgtaaaatcgaacccaaacg

SEQ ID NO: 18803 - DNA, 774 bp, Artificial Sequence
  chemically treated genomic DNA (Homo sapiens) CpG-island No: 18803
gtattattttttttttgtattattggtgaaagggtcgggtggaggaagggaggattgttgtattaattttttttcggcgtttgtttattggtatcgtcgtatttattttacgtcgatttttcgtagtttttttattttgttagtcgtttttttttggggtaggggcggcgcgagttataggggcgtgttcgcgagcgggtcggggttgcggagagaacgggtcggggtaaaaattcgacggttgttcgcgggtgggcggggcgcgtagagtcggtgggaggtcgcggtggtagtagtcgttttcgcgtatcgagggatttagggattcgcgtagatggtacgcggttatttcggttttgtcggggagttttatttttaatcgaggtaattgaggtttttaaagcgttagttattcgtcggggtttggagagcgtcggggttcggtcgtttcgtttagttagagtgtttcgttttaagtttggcgtatttggtttcgtttcgtcgggatttcgttttcgttttaattagagttggtttcgcgtcgcggtcgtcgcgataggtgtagtagagtcgagtcggtcgcgtttcgaacggcgtttttcgttttattatgggtaatagcgcgagtcgtagcgatttcgagtgggtttatatcgattagtcgtatacgtagcggcgtaaggagatattgggtgagcgtcgcgcggggtttatttcggtggggatcgtttcgttggttcgtttggagtcgcgtcgtggggtcgagtttagacg

SEQ ID NO: 18804 - DNA, 774 bp, Artificial Sequence
  chemically treated genomic DNA (Homo sapiens) CpG-island No: 18804
cgtctaaactcgaccccacgacgcgactccaaacgaaccaacgaaacgatccccaccgaaataaaccccgcgcgacgctcacccaatatctccttacgccgctacgtatacgactaatcgatataaacccactcgaaatcgctacgactcgcgctattacccataataaaacgaaaaacgccgttcgaaacgcgaccgactcgactctactacacctatcgcgacgaccgcgacgcgaaaccaactctaattaaaacgaaaacgaaatcccgacgaaacgaaaccaaatacgccaaacttaaaacgaaacactctaactaaacgaaacgaccgaaccccgacgctctccaaaccccgacgaataactaacgctttaaaaacctcaattacctcgattaaaaataaaactccccgacaaaaccgaaataaccgcgtaccatctacgcgaatccctaaatccctcgatacgcgaaaacgactactaccaccgcgacctcccaccgactctacgcgccccgcccacccgcgaacaaccgtcgaatttttaccccgacccgttctctccgcaaccccgacccgctcgcgaacacgcccctataactcgcgccgcccctaccccaaaaaaaaacgactaacaaaataaaaaaactacgaaaaatcgacgtaaaataaatacgacgataccaataaacaaacgccgaaaaaaaattaatacaacaatcctcccttcctccacccgaccctttcaccaataatacaaaaaaaaaataatac

SEQ ID NO: 18805 - DNA, 748 bp, Artificial Sequence
  chemically treated genomic DNA (Homo sapiens) CpG-island No: 18805
tagtatcgtcgtgttagtttattgacgtagcgtatcggtgtttgttagtatcgtcgtgttagtttattgacgtagcgtattcggtgttgttagtatcgtcgtgttagtttattgacgtagcgtatacggtggtgttagtatcgtcgtgttagtttattgacgtagcgtatacggtggtgttagtatcgtcgtgttagtttattgacgtagcgtatacggtggtgttagtatcgtcgtgttagtttattgacgtagcgtatacggtggtgttagtatcgtcgtgttagtttattgacgtagcgtatacggtggtgttagtatcgtcgtgttagtttattgacgtagcgtatacggtggtgttagtatcgtcgtgttagtttattgacgtagcgttatatggtggtgttagtatcgtcgtgttagtttattgacgtagcgtatacggtgttgtgttagtatcgtcgtgttagtttattgacgtagcgtatacggtgttgtgttagtatcgtcgtgttagtttattgacgtagcgtatacggtgttgtgttagtatcgtcgtgttagtttattgacgtagcgtatacggtgttgtgttagtatcgtcgtgttagtttattgacgtagcgtatacggtgttgtgttagtatcgtcgtgttagtttattgacgtagcgtatacggtgttgttagtatcgttgtgttagtttattgacgtagcgtatacggtgttgttagtatcgttgtgttag

SEQ ID NO: 18806 - DNA, 748 bp, Artificial Sequence
  chemically treated genomic DNA (Homo sapiens) CpG-island No: 18806
ctaacacaacgatactaacaacaccgtatacgctacgtcaataaactaacacaacgatactaacaacaccgtatacgctacgtcaataaactaacacgacgatactaacacaacaccgtatacgctacgtcaataaactaacacgacgatactaacacaacaccgtatacgctacgtcaataaactaacacgacgatactaacacaacaccgtatacgctacgtcaataaactaacacgacgatactaacacaacaccgtatacgctacgtcaataaactaacacgacgatactaacacaacaccgtatacgctacgtcaataaactaacacgacgatactaacaccaccatataacgctacgtcaataaactaacacgacgatactaacaccaccgtatacgctacgtcaataaactaacacgacgatactaacaccaccgtatacgctacgtcaataaactaacacgacgatactaacaccaccgtatacgctacgtcaataaactaacacgacgatactaacaccaccgtatacgctacgtcaataaactaacacgacgatactaacaccaccgtatacgctacgtcaataaactaacacgacgatactaacaccaccgtatacgctacgtcaataaactaacacgacgatactaacaacaccgaatacgctacgtcaataaactaacacgacgatactaacaaacaccgatacgctacgtcaataaactaacacgacgatacta

SEQ ID NO: 18807 - DNA, 748 bp, Artificial Sequence
  chemically treated genomic DNA (Homo sapiens) CpG-island No: 18807
ttgatatagcgatgttgataatatcgtgtgcgttacgttaatggattgatatagcgatgttgataatatcgtgtgcgttacgttaatggattgatacggcgatgttgatataatatcgtgtgcgttacgttagtggattgatacggcgatgttgatataatatcgtgtgcgttacgttagtggattgatacggcgatgttgatataatatcgtgtgcgttacgttagtggattgatacggcgatgttgatataatatcgtgtgcgttacgttagtggattgatacggcgatgttgatataatatcgtgtgcgttacgttagtggattgatacggcgatgttgatattattatgtggcgttacgttagtggattgatacggcgatgttgatattatcgtgtgcgttacgttaatggattgatacggcgatgttgatattatcgtgtgcgttacgttaatggattgatacggcgatgttgatattatcgtgtgcgttacgttaatggattgatacggcgatgttgatattatcgtgtgcgttacgttaatggattgatacggcgatgttgatattatcgtgtgcgttacgttaatggattgatacggcgatgttgatattatcgtgtgcgttacgttaatggattgatacggcgatgttgataatatcgggtgcgttacgttaatggattgatacggcgatgttgataaatatcggtgcgttacgttaatggattgatacggcgatgttg

SEQ ID NO: 18808 - DNA, 748 bp, Artificial Sequence
  chemically treated genomic DNA (Homo sapiens) CpG-island No: 18808
caacatcgccgtatcaatccattaacgtaacgcaccgatatttatcaacatcgccgtatcaatccattaacgtaacgcacccgatattatcaacatcgccgtatcaatccattaacgtaacgcacacgataatatcaacatcgccgtatcaatccattaacgtaacgcacacgataatatcaacatcgccgtatcaatccattaacgtaacgcacacgataatatcaacatcgccgtatcaatccattaacgtaacgcacacgataatatcaacatcgccgtatcaatccattaacgtaacgcacacgataatatcaacatcgccgtatcaatccattaacgtaacgcacacgataatatcaacatcgccgtatcaatccactaacgtaacgccacataataatatcaacatcgccgtatcaatccactaacgtaacgcacacgatattatatcaacatcgccgtatcaatccactaacgtaacgcacacgatattatatcaacatcgccgtatcaatccactaacgtaacgcacacgatattatatcaacatcgccgtatcaatccactaacgtaacgcacacgatattatatcaacatcgccgtatcaatccactaacgtaacgcacacgatattatatcaacatcgccgtatcaatccattaacgtaacgcacacgatattatcaacatcgctatatcaatccattaacgtaacgcacacgatattatcaacatcgctatatcaa

SEQ ID NO: 18809 - DNA, 607 bp, Artificial Sequence
  chemically treated genomic DNA (Homo sapiens) CpG-island No: 18809
aatttcggttcgcgtttcgtatttattttagggtttcgagatatttcgtagttttcgatacgcggtttcgtggtttcgttttttatcggtatttgcgattcggcggggcggttgttttggggttttcggattcggtttcgcgtacgcggatttcgggattatagcgtttataaggcggcgcggcgggcgcgcggttgcggggtgggcgggttcgtttcgtcgaacgcgttttgagggcggggtttcgcgcgtggtcgggcgttgcggtaggagcgtttttacggggtatttttttatttacggtcgttttttagtttcggcgtcggtttttttttattcggttatcgtcggggttacgcggtttttcgtgttgcggttttatttttggggtcgttttttgatttcgatcgtttttcgggtttttattttcgtcggcgttagtattttggggtgttattcgcggaggtgtcggtttttcgggcgggtattttgttatttttttttttcgcgttttttttattttcggtttttttttgatttttttttttcgacgaggttttgtgcgttttttttttggtattttggaatatttgtatttttggtcgta

SEQ ID NO: 18810 - DNA, 607 bp, Artificial Sequence
  chemically treated genomic DNA (Homo sapiens) CpG-island No: 18810
tacgaccaaaaatacaaatattccaaaataccaaaaaaaaaacgcacaaaacctcgtcgaaaaaaaaaaatcaaaaaaaaaccgaaaataaaaaaaacgcgaaaaaaaaaaataacaaaatacccgcccgaaaaaccgacacctccgcgaataacaccccaaaatactaacgccgacgaaaataaaaacccgaaaaacgatcgaaatcaaaaaacgaccccaaaaataaaaccgcaacacgaaaaaccgcgtaaccccgacgataaccgaataaaaaaaaaccgacgccgaaactaaaaaacgaccgtaaataaaaaaataccccgtaaaaacgctcctaccgcaacgcccgaccacgcgcgaaaccccgccctcaaaacgcgttcgacgaaacgaacccgcccaccccgcaaccgcgcgcccgccgcgccgccttataaacgctataatcccgaaatccgcgtacgcgaaaccgaatccgaaaaccccaaaacaaccgccccgccgaatcgcaaataccgataaaaaacgaaaccacgaaaccgcgtatcgaaaactacgaaatatctcgaaaccctaaaataaatacgaaacgcgaaccgaaatt

SEQ ID NO: 18811 - DNA, 607 bp, Artificial Sequence
  chemically treated genomic DNA (Homo sapiens) CpG-island No: 18811
tgcggttaggaatgtaggtgttttagggtgttaaaaggaaaacgtataaggtttcgtcgaggagggggggttaggaggggatcgggggtgggaagaacgcgggggagagggatggtagggtgttcgttcgagggatcgatattttcgcgagtggtattttaggatgttgacgtcggcgggggtgggggttcgaggggcggtcggggttagggggcggttttaggggtagggtcgtagtacgaggggtcgcgtgatttcggcggtgatcgggtggggagaggtcggcgtcggggttgggagacggtcgtgggtgggagggtgtttcgtggggacgtttttgtcgtagcgttcggttacgcgcgaggtttcgtttttaggacgcgttcggcgggacggattcgtttatttcgtagtcgcgcgttcgtcgcgtcgttttgtgggcgttgtagtttcggagttcgcgtgcgcggggtcgggttcgggagttttagggtagtcgtttcgtcgagtcgtaggtatcggtggggaacggggttacggggtcgcgtgtcgggggttgcggggtgtttcggggttttggggtgagtgcggggcgcgggtcgaggtt

SEQ ID NO: 18812 - DNA, 607 bp, Artificial Sequence
  chemically treated genomic DNA (Homo sapiens) CpG-island No: 18812
aacctcgacccgcgccccgcactcaccccaaaaccccgaaacaccccgcaacccccgacacgcgaccccgtaaccccgttccccaccgatacctacgactcgacgaaacgactaccctaaaactcccgaacccgaccccgcgcacgcgaactccgaaactacaacgcccacaaaacgacgcgacgaacgcgcgactacgaaataaacgaatccgtcccgccgaacgcgtcctaaaaacgaaacctcgcgcgtaaccgaacgctacgacaaaaacgtccccacgaaacaccctcccacccacgaccgtctcccaaccccgacgccgacctctccccacccgatcaccgccgaaatcacgcgacccctcgtactacgaccctacccctaaaaccgccccctaaccccgaccgcccctcgaacccccacccccgccgacgtcaacatcctaaaataccactcgcgaaaatatcgatccctcgaacgaacaccctaccatccctctcccccgcgttcttcccacccccgatcccctcctaaccccccctcctcgacgaaaccttatacgttttccttttaacaccctaaaacacctacattcctaaccgca

SEQ ID NO: 18813 - DNA, 613 bp, Artificial Sequence
  chemically treated genomic DNA (Homo sapiens) CpG-island No: 18813
atggtcggtgcggtcgggttttgggaaatgaagggttcgcggtgtttcgtattttttgtgggggcgggagtaattattaggtggtcgcggagttagtcgagggggcggttgttaattcgggcggcgatcgtaggcggagacgtttcgttcgggatagggatcgggtcgcgtcggcgttcgcggatagatattcgcggtttcggtcgttgtcgcgtttttcgttttcgttacgtttcggcggtttcgtttggggcgcgttttcgtttcgtacgcgtacgcgtttgtattcgtattggttcgttcggttttttcgcgttcgcggggtcgtttcgggggaggtgtcgagattcggttttggttcgcgcgcggttttcggggttcggcgcgtcggggatttataggcgaggcgagagaaaggggttggttcgcggggatatttatttgcgcggcgcggggttgtggcgtcggttattattatttcgcgtttttttttttgttagcgcgtacgtagatggcggggtggtttggggaggttttcgggtttttttttgggaacgtagggttaagttgtgtttcgattttacgttttttttatttacgtcgggtatacgta

SEQ ID NO: 18814 - DNA, 613 bp, Artificial Sequence
  chemically treated genomic DNA (Homo sapiens) CpG-island No: 18814
tacgtatacccgacgtaaataaaaaaaacgtaaaatcgaaacacaacttaaccctacgttcccaaaaaaaaacccgaaaacctccccaaaccaccccgccatctacgtacgcgctaacaaaaaaaaaaacgcgaaataataataaccgacgccacaaccccgcgccgcgcaaataaatatccccgcgaaccaacccctttctctcgcctcgcctataaatccccgacgcgccgaaccccgaaaaccgcgcgcgaaccaaaaccgaatctcgacacctcccccgaaacgaccccgcgaacgcgaaaaaaccgaacgaaccaatacgaatacaaacgcgtacgcgtacgaaacgaaaacgcgccccaaacgaaaccgccgaaacgtaacgaaaacgaaaaacgcgacaacgaccgaaaccgcgaatatctatccgcgaacgccgacgcgacccgatccctatcccgaacgaaacgtctccgcctacgatcgccgcccgaattaacaaccgccccctcgactaactccgcgaccacctaataattactcccgcccccacaaaaaatacgaaacaccgcgaacccttcatttcccaaaacccgaccgcaccgaccat

SEQ ID NO: 18815 - DNA, 613 bp, Artificial Sequence
  chemically treated genomic DNA (Homo sapiens) CpG-island No: 18815
tgcgtgtgttcgacgtgggtggggggggcgtggaatcggagtataatttggttttgcgtttttaggaagggattcgaagatttttttaggttatttcgttatttgcgtgcgcgttggtaagaggaggggcgcggggtaatggtggtcggcgttatagtttcgcgtcgcgtaggtaggtgttttcgcgagttaatttttttttttcgtttcgtttgtgggttttcggcgcgtcggatttcggaaatcgcgcgcgggttaaggtcgggtttcggtatttttttcggagcggtttcgcgagcgcgggggaatcgggcgggttagtgcgggtgtaggcgcgtgcgcgtgcgaggcgggggcgcgttttaagcgaggtcgtcggggcgtggcgggggcgggagacgcggtagcggtcgggatcgcgggtgtttgttcgcgagcgtcggcgcggttcggtttttgtttcgggcggggcgttttcgtttgcggtcgtcgttcgggttagtagtcgttttttcggttggtttcgcggttatttggtaattattttcgtttttataaaaagtgcgagatatcgcgagttttttattttttagagttcggtcgtatcggttat

SEQ ID NO: 18816 - DNA, 613 bp, Artificial Sequence
  chemically treated genomic DNA (Homo sapiens) CpG-island No: 18816
ataaccgatacgaccgaactctaaaaaataaaaaactcgcgatatctcgcactttttataaaaacgaaaataattaccaaataaccgcgaaaccaaccgaaaaaacgactactaacccgaacgacgaccgcaaacgaaaacgccccgcccgaaacaaaaaccgaaccgcgccgacgctcgcgaacaaacacccgcgatcccgaccgctaccgcgtctcccgcccccgccacgccccgacgacctcgcttaaaacgcgcccccgcctcgcacgcgcacgcgcctacacccgcactaacccgcccgattcccccgcgctcgcgaaaccgctccgaaaaaaataccgaaacccgaccttaacccgcgcgcgatttccgaaatccgacgcgccgaaaacccacaaacgaaacgaaaaaaaaaaattaactcgcgaaaacacctacctacgcgacgcgaaactataacgccgaccaccattaccccgcgcccctcctcttaccaacgcgcacgcaaataacgaaataacctaaaaaaatcttcgaatcccttcctaaaaacgcaaaaccaaattatactccgattccacgccccccccacccacgtcgaacacacgca

SEQ ID NO: 18817 - DNA, 691 bp, Artificial Sequence
  chemically treated genomic DNA (Homo sapiens) CpG-island No: 18817
gtttttaggtttgcgttttcgttttttaggcgttttgaggtttaaagttttagagaacgcgttggggcgggtgtggaggtgtcgtcgagcggtttcgggtcgttttcggcggttatatcggggtattttgggagtttttggttttttagacggtttttattaaggaagtcggacgggggcggggcggggcgagggggggcgagcggagggcgcggtgattatggcgatcgtagtggttatggcgatcgcggtttagagtatcgagaggtcgtgatacgatttggagcgttgtttgaagaatttggcgttgcgcggtattaggttggcgaggaattttttggtttttttggtgaggttttcgcggcgtgtaggtggcgtagggttttcggggttgttcggatcgggtttttggttttcggcgtggtttcggtttcgtcgtagtcggatttggcgtatcgcgttttcgaagagttttttcgtgttgtggtgtagtgcggtcgacgtttcgatgtgtttgtagtttagcgtttcggttaggtggcggttttttgtaggaaggtatcggtttaggcgttcgttgggttgtacgggattcggggcgagggtgggtttagggagggtttgggcgtgcggtggtaagggattggtattagtgaattttgtaatcgagagaatatggttgagtttatat

SEQ ID NO: 18818 - DNA, 691 bp, Artificial Sequence
  chemically treated genomic DNA (Homo sapiens) CpG-island No: 18818
atataaactcaaccatattctctcgattacaaaattcactaataccaatcccttaccaccgcacgcccaaaccctccctaaacccaccctcgccccgaatcccgtacaacccaacgaacgcctaaaccgataccttcctacaaaaaaccgccacctaaccgaaacgctaaactacaaacacatcgaaacgtcgaccgcactacaccacaacacgaaaaaactcttcgaaaacgcgatacgccaaatccgactacgacgaaaccgaaaccacgccgaaaaccaaaaacccgatccgaacaaccccgaaaaccctacgccacctacacgccgcgaaaacctcaccaaaaaaaccaaaaaattcctcgccaacctaataccgcgcaacgccaaattcttcaaacaacgctccaaatcgtatcacgacctctcgatactctaaaccgcgatcgccataaccactacgatcgccataatcaccgcgccctccgctcgccccccctcgccccgccccgcccccgtccgacttccttaataaaaaccgtctaaaaaaccaaaaactcccaaaataccccgatataaccgccgaaaacgacccgaaaccgctcgacgacacctccacacccgccccaacgcgttctctaaaactttaaacctcaaaacgcctaaaaaacgaaaacgcaaacctaaaaac

SEQ ID NO: 18819 - DNA, 691 bp, Artificial Sequence
  chemically treated genomic DNA (Homo sapiens) CpG-island No: 18819
atatgagtttagttatgttttttcggttgtaagatttattagtattaattttttgttatcgtacgtttaggttttttttagatttattttcgtttcgggtttcgtatagtttagcgggcgtttgagtcggtgtttttttgtagagggtcgttatttggtcgggacgttgagttgtaagtatatcgagacgtcggtcgtattgtattataatacgagggagtttttcgagggcgcggtgcgttagattcggttgcggcggggtcgaaattacgtcggaggttagaggttcgattcgggtagtttcgagggttttgcgttatttgtacgtcgcgagagttttattaagaaagttaagaggtttttcgttaatttggtgtcgcgtaacgttaagttttttaagtagcgttttaggtcgtgttacgatttttcggtgttttgagtcgcggtcgttatggttattgcggtcgttatggttatcgcgtttttcgttcgttttttttcgtttcgtttcgttttcgttcggtttttttggtggaggtcgtttaggaaattaaaaatttttaggatgtttcggtgtgatcgtcgggggcggttcggggtcgttcggcggtatttttatattcgttttaacgcgttttttggagttttgggttttagggcgtttagaaggcgaggacgtagatttgaaggt

SEQ ID NO: 18820 - DNA, 691 bp, Artificial Sequence
  chemically treated genomic DNA (Homo sapiens) CpG-island No: 18820
accttcaaatctacgtcctcgccttctaaacgccctaaaacccaaaactccaaaaaacgcgttaaaacgaatataaaaataccgccgaacgaccccgaaccgcccccgacgatcacaccgaaacatcctaaaaatttttaatttcctaaacgacctccaccaaaaaaaccgaacgaaaacgaaacgaaacgaaaaaaaacgaacgaaaaacgcgataaccataacgaccgcaataaccataacgaccgcgactcaaaacaccgaaaaatcgtaacacgacctaaaacgctacttaaaaaacttaacgttacgcgacaccaaattaacgaaaaacctcttaactttcttaataaaactctcgcgacgtacaaataacgcaaaaccctcgaaactacccgaatcgaacctctaacctccgacgtaatttcgaccccgccgcaaccgaatctaacgcaccgcgccctcgaaaaactccctcgtattataatacaatacgaccgacgtctcgatatacttacaactcaacgtcccgaccaaataacgaccctctacaaaaaaacaccgactcaaacgcccgctaaactatacgaaacccgaaacgaaaataaatctaaaaaaaacctaaacgtacgataacaaaaaattaatactaataaatcttacaaccgaaaaaacataactaaactcatat

SEQ ID NO: 18821 - DNA, 1198 bp, Artificial Sequence
  chemically treated genomic DNA (Homo sapiens) CpG-island No: 18821
gttcgtgcgcgttcgatttttagaattcggcgggttcggttaggagttcggaagtttcggaggttatcgtcgtcgcgggcgcgtaggcgggacgggtagaggttttttacgggcgattttcgttcgcggagtttcgtaattagcggcgttttagtttgcgggtttcggaacgtttcggcgttttacggtcgttttcgcggtagggttcgtacggtatagattagggcgttgaggttttgcggcggcgtcggatttcgaatttagggttcggttttcgattcggtttagattagagttatttcgcgtatttcgggtgggggagttttcggtttaatttcgttatttcgcgcgttttttttcgtcggatttgcgtatttagcgcgttttttgtttgaggcgttttcgcgtttcgttcgcgcgtttattacgtttttcgcgtttcgtttttcgcgtacgttcggttaatgaggcgcggcggcgaagcgtagtgttcgggggtgttgttcgcgtcgtgttcgtttattggttttattcggcgtttttattcgggttttgtcggtaggtacgaggggcggggcgcgcggttcgaggtgagggatcgcgggtcggaggggatttagcgagttagttgtcgtcgagggattagcgcgggtttagttgttgtcgttatttttattatttttgatcgcgtttgttcgggtttcgcgttaggaggagcggttaggtttagtttcggtatcgcgcgttcggggatttcgacggcgtttagttcggcgaggggttttagggggaggacgaggaggaaaggcggtttcgtcgggggattcggttatggcgttggattttttggttggatgcgcggggggtaaggaggcggcgggtcgggtcgggtcggggcgaggcgttcggggagggaggtcggtttattagtacgttttggtttcgcggtttttcgttggcgggggtcgtcgcgtttgtgaatggggattatagtttttttgtttcgggcgggtttcgtgggcgtaaattgattttaggttcgggttgttcgcgagggtaggtgtttttattttttttgggtacgttcggacgggaggtttggggcgtcggggtagtatcgtggttgagcggaggttaggattgtcgggaggatgttttattgtttttcgcgtcgaggtttcgggtttatttttttttt

SEQ ID NO: 18822 - DNA, 1198 bp, Artificial Sequence
  chemically treated genomic DNA (Homo sapiens) CpG-island No: 18822
aaaaaaaaaataaacccgaaacctcgacgcgaaaaacaataaaacatcctcccgacaatcctaacctccgctcaaccacgatactaccccgacgccccaaacctcccgtccgaacgtacccaaaaaaaataaaaacacctaccctcgcgaacaacccgaacctaaaatcaatttacgcccacgaaacccgcccgaaacaaaaaaactataatccccattcacaaacgcgacgacccccgccaacgaaaaaccgcgaaaccaaaacgtactaataaaccgacctccctccccgaacgcctcgccccgacccgacccgacccgccgcctccttaccccccgcgcatccaaccaaaaaatccaacgccataaccgaatcccccgacgaaaccgcctttcctcctcgtcctccccctaaaacccctcgccgaactaaacgccgtcgaaatccccgaacgcgcgataccgaaactaaacctaaccgctcctcctaacgcgaaacccgaacaaacgcgatcaaaaataataaaaataacgacaacaactaaacccgcgctaatccctcgacgacaactaactcgctaaatcccctccgacccgcgatccctcacctcgaaccgcgcgccccgcccctcgtacctaccgacaaaacccgaataaaaacgccgaataaaaccaataaacgaacacgacgcgaacaacacccccgaacactacgcttcgccgccgcgcctcattaaccgaacgtacgcgaaaaacgaaacgcgaaaaacgtaataaacgcgcgaacgaaacgcgaaaacgcctcaaacaaaaaacgcgctaaatacgcaaatccgacgaaaaaaaacgcgcgaaataacgaaattaaaccgaaaactcccccacccgaaatacgcgaaataactctaatctaaaccgaatcgaaaaccgaaccctaaattcgaaatccgacgccgccgcaaaacctcaacgccctaatctataccgtacgaaccctaccgcgaaaacgaccgtaaaacgccgaaacgttccgaaacccgcaaactaaaacgccgctaattacgaaactccgcgaacgaaaatcgcccgtaaaaaacctctacccgtcccgcctacgcgcccgcgacgacgataacctccgaaacttccgaactcctaaccgaacccgccgaattctaaaaatcgaacgcgcacgaac

SEQ ID NO: 18823 - DNA, 1198 bp, Artificial Sequence
  chemically treated genomic DNA (Homo sapiens) CpG-island No: 18823
gggaaggagatgagttcgggatttcggcgcggggggtagtggggtattttttcggtagttttggttttcgtttagttacggtgttgtttcggcgttttagatttttcgttcgagcgtgtttagagagaataaagatatttgttttcgcggatagttcgggtttgaagttaatttacgtttacgagattcgttcgaggtaagagaattgtggtttttatttatagacgcggcgattttcgttagcgggaagtcgcgaggttagggcgtgttggtgggtcgattttttttttcggacgtttcgtttcggttcggttcggttcgtcgtttttttatttttcgcgtatttagttaagaagtttagcgttatggtcgggtttttcggcgaggtcgtttttttttttcgttttttttttgaggtttttcgtcgggttgggcgtcgtcggggttttcgagcgcgcggtgtcggggttgggtttggtcgttttttttggcgcggagttcgggtaggcgcggttagggatggtggggatggcggtagtagttagattcgcgttggtttttcggcggtagttgattcgttggatttttttcggttcgcggttttttatttcgggtcgcgcgtttcgtttttcgtgtttgtcggtagggttcgggtgggggcgtcgagtgaggttaatgggcgggtacggcgcggataatattttcgggtattgcgtttcgtcgtcgcgttttattggtcgggcgtgcgcgggaggcggggcgcgggggacgtggtgggcgcgcgggcggggcgcggggacgttttagataaagagcgcgttgggtgcgtaggttcggcgggaggggacgcgcggggtggcggggttgagtcgaggatttttttattcggagtacgcggggtggttttggtttggatcgggtcgggaatcggattttgggttcggagttcggcgtcgtcgtagaattttagcgttttagtttgtgtcgtgcggattttgtcgcgaaaacggtcgtggagcgtcgggacgtttcgaggttcgtagattgggacgtcgttagttgcgaaatttcgcgagcgggaatcgttcgtggggagtttttgttcgtttcgtttgcgcgttcgcggcggcggtggttttcggggttttcggatttttggtcgaattcgtcgggttttgggggtcggacgcgtacgggt

SEQ ID NO: 18824 - DNA, 1198 bp, Artificial Sequence
  chemically treated genomic DNA (Homo sapiens) CpG-island No: 18824
acccgtacgcgtccgacccccaaaacccgacgaattcgaccaaaaatccgaaaaccccgaaaaccaccgccgccgcgaacgcgcaaacgaaacgaacaaaaactccccacgaacgattcccgctcgcgaaatttcgcaactaacgacgtcccaatctacgaacctcgaaacgtcccgacgctccacgaccgttttcgcgacaaaatccgcacgacacaaactaaaacgctaaaattctacgacgacgccgaactccgaacccaaaatccgattcccgacccgatccaaaccaaaaccaccccgcgtactccgaataaaaaaatcctcgactcaaccccgccaccccgcgcgtcccctcccgccgaacctacgcacccaacgcgctctttatctaaaacgtccccgcgccccgcccgcgcgcccaccacgtcccccgcgccccgcctcccgcgcacgcccgaccaataaaacgcgacgacgaaacgcaatacccgaaaatattatccgcgccgtacccgcccattaacctcactcgacgcccccacccgaaccctaccgacaaacacgaaaaacgaaacgcgcgacccgaaataaaaaaccgcgaaccgaaaaaaatccaacgaatcaactaccgccgaaaaaccaacgcgaatctaactactaccgccatccccaccatccctaaccgcgcctacccgaactccgcgccaaaaaaaacgaccaaacccaaccccgacaccgcgcgctcgaaaaccccgacgacgcccaacccgacgaaaaacctcaaaaaaaaaacgaaaaaaaaaaacgacctcgccgaaaaacccgaccataacgctaaacttcttaactaaatacgcgaaaaataaaaaaacgacgaaccgaaccgaaccgaaacgaaacgtccgaaaaaaaaaatcgacccaccaacacgccctaacctcgcgacttcccgctaacgaaaatcgccgcgtctataaataaaaaccacaattctcttacctcgaacgaatctcgtaaacgtaaattaacttcaaacccgaactatccgcgaaaacaaatatctttattctctctaaacacgctcgaacgaaaaatctaaaacgccgaaacaacaccgtaactaaacgaaaaccaaaactaccgaaaaaataccccactaccccccgcgccgaaatcccgaactcatctccttccc

SEQ ID NO: 18825 - DNA, 635 bp, Artificial Sequence
  chemically treated genomic DNA (Homo sapiens) CpG-island No: 18825
tgcggcggcgggcgttatttagtgcgttatttgttgttttatggagttggttaagacgcggttgtagttgtaggacgcgggtttagcgcgtatttataagggttcgttggattgtttcgcgtagatttacgggtacgagggtttgcgtggcgttaatcggggtatggtgtttacgttgttgcgtgagacgtttagtttcggcgtttatttttttatttatgacgtttttacgcgggcgttgggttgcgagtcgggcgatcgtttgttggtgtttaagttgttgttggcgggcggtacgttaggtatcgtgttttggttttttatttattttgtggacgtggttaagtcgcggttgtaggcggacggattgcggggcgtttcgcgttatcgcggtattttggattgcgtgtattagagttatcgcgtcgagggttggcgcgtttttatacgggggttggcgtttacgttgttgcgcgtttttttcgttaacgttgttattttcgttatcgttacggtggtgtttatttacgcgcgcggcgaggaggtcgggttcgagggcgaggttgtgttcgtcgtttttgcggggtttgttttggcgtagttttttagtttgtgacgtttatttcgtttttttt

SEQ ID NO: 18826 - DNA, 635 bp, Artificial Sequence
  chemically treated genomic DNA (Homo sapiens) CpG-island No: 18826
aaaaaaaacgaaataaacgtcacaaactaaaaaactacgccaaaacaaaccccgcaaaaacgacgaacacaacctcgccctcgaacccgacctcctcgccgcgcgcgtaaataaacaccaccgtaacgataacgaaaataacaacgttaacgaaaaaaacgcgcaacaacgtaaacgccaacccccgtataaaaacgcgccaaccctcgacgcgataactctaatacacgcaatccaaaataccgcgataacgcgaaacgccccgcaatccgtccgcctacaaccgcgacttaaccacgtccacaaaataaataaaaaaccaaaacacgatacctaacgtaccgcccgccaacaacaacttaaacaccaacaaacgatcgcccgactcgcaacccaacgcccgcgtaaaaacgtcataaataaaaaaataaacgccgaaactaaacgtctcacgcaacaacgtaaacaccataccccgattaacgccacgcaaaccctcgtacccgtaaatctacgcgaaacaatccaacgaacccttataaatacgcgctaaacccgcgtcctacaactacaaccgcgtcttaaccaactccataaaacaacaaataacgcactaaataacgcccgccgccgca

SEQ ID NO: 18827 - DNA, 635 bp, Artificial Sequence
  chemically treated genomic DNA (Homo sapiens) CpG-island No: 18827
aaggagggcggggtgagcgttataggttggagggttgcgttagggtaggtttcgtaggggcggcgggtatagtttcgttttcgggttcggttttttcgtcgcgcgcgtaggtgagtattatcgtgacggtggcgaaggtggtagcgttgacggggaaggcgcgtagtagcgtggacgttagttttcgtgtgaagacgcgttagttttcggcgcggtagttttggtgtacgtagtttaggatgtcgcggtagcgcggggcgtttcgtagttcgttcgtttgtagtcgcgatttgattacgtttataggataggtagagagttaggatacgatgtttgacgtatcgttcgttaatagtagtttgggtattagtaggcggtcgttcggttcgtagtttagcgttcgcgtgagagcgttataggtgaggaagtagacgtcgaagttgggcgttttacgtagtaacgtggatattatgtttcggttgacgttacgtagattttcgtgttcgtagatttgcgcgaggtagtttagcgagtttttgtaggtgcgcgttgggttcgcgttttgtagttgtagtcgcgttttggttagttttatggggtagtagatgacgtattggatggcgttcgtcgtcgta

SEQ ID NO: 18828 - DNA, 635 bp, Artificial Sequence
  chemically treated genomic DNA (Homo sapiens) CpG-island No: 18828
tacgacgacgaacgccatccaatacgtcatctactaccccataaaactaaccaaaacgcgactacaactacaaaacgcgaacccaacgcgcacctacaaaaactcgctaaactacctcgcgcaaatctacgaacacgaaaatctacgtaacgtcaaccgaaacataatatccacgttactacgtaaaacgcccaacttcgacgtctacttcctcacctataacgctctcacgcgaacgctaaactacgaaccgaacgaccgcctactaatacccaaactactattaacgaacgatacgtcaaacatcgtatcctaactctctacctatcctataaacgtaatcaaatcgcgactacaaacgaacgaactacgaaacgccccgcgctaccgcgacatcctaaactacgtacaccaaaactaccgcgccgaaaactaacgcgtcttcacacgaaaactaacgtccacgctactacgcgccttccccgtcaacgctaccaccttcgccaccgtcacgataatactcacctacgcgcgcgacgaaaaaaccgaacccgaaaacgaaactatacccgccgcccctacgaaacctaccctaacgcaaccctccaacctataacgctcaccccgccctcctt

SEQ ID NO: 18829 - DNA, 796 bp, Artificial Sequence
  chemically treated genomic DNA (Homo sapiens) CpG-island No: 18829
ttacggttcgacgggcgttttcgatagttttgtttattttttttttaattttgtttcgtcgaagggttagaggtaggagattgcggacgcgttcgtcgtgtattagtcggttgcgtttgtatttgtttttttcgcgggagtcgtcggggcgggtggtgcgttcgtagtcgtgtcgtcggttgtttagttattcgttttcgtagcgtagttcgttggagcgttggttgacgtcgaagtcgttgcgtcgatttgcgcgttattcgttcgcgtatatttttgtggtcgagttttcgatgagggcgggcggcgttgcggtcgggggttcgttggttttcgagtcgggcggttcggtgttgtttatttcgttgtttatttcgttgcgtagggagtttcgtttgttgtttagggagttgcgacgttcgttcgttcggagttcgttgagtagtagcgaacggcgaaagaattcgtcggtcgtcggagtgcgttttcgggacgacgcgtcgtcggcgttttcgggttcggttagtacgaagtcgtttcgggagttcgaggcggggttgtttttttcgtcgttcggtaagggtaggggcgggggtggcgtcggggggtcgttgtggtcggaatttagggaggtgcggcggggcgagcgtagtagcgtcgtttgatggtagggtatattttggcgtatttcgtagtcgtggcgtttttcggtttgttattggttttggtaggtgtttgcgggcggcggaggggtgggagaaagagttaggacgtgtcgttgggttttttgcgtttt

SEQ ID NO: 18830 - DNA, 796 bp, Artificial Sequence
  chemically treated genomic DNA (Homo sapiens) CpG-island No: 18830
aaaacgcaaaaaacccaacgacacgtcctaactctttctcccacccctccgccgcccgcaaacacctaccaaaaccaataacaaaccgaaaaacgccacgactacgaaatacgccaaaatataccctaccatcaaacgacgctactacgctcgccccgccgcacctccctaaattccgaccacaacgaccccccgacgccacccccgcccctacccttaccgaacgacgaaaaaaacaaccccgcctcgaactcccgaaacgacttcgtactaaccgaacccgaaaacgccgacgacgcgtcgtcccgaaaacgcactccgacgaccgacgaattctttcgccgttcgctactactcaacgaactccgaacgaacgaacgtcgcaactccctaaacaacaaacgaaactccctacgcaacgaaataaacaacgaaataaacaacaccgaaccgcccgactcgaaaaccaacgaacccccgaccgcaacgccgcccgccctcatcgaaaactcgaccacaaaaatatacgcgaacgaataacgcgcaaatcgacgcaacgacttcgacgtcaaccaacgctccaacgaactacgctacgaaaacgaataactaaacaaccgacgacacgactacgaacgcaccacccgccccgacgactcccgcgaaaaaaacaaatacaaacgcaaccgactaatacacgacgaacgcgtccgcaatctcctacctctaacccttcgacgaaacaaaattaaaaaaaaaataaacaaaactatcgaaaacgcccgtcgaaccgtaa

SEQ ID NO: 18831 - DNA, 796 bp, Artificial Sequence
  chemically treated genomic DNA (Homo sapiens) CpG-island No: 18831
ggggcgtaaggagtttagcggtacgttttgatttttttttttattttttcgtcgttcgtaggtatttattagggttagtggtaggtcgggaagcgttacggttacggggtacgttagagtgtgttttattattaggcggcgttgttgcgttcgtttcgtcgtatttttttggatttcggttatagcgatttttcgacgttattttcgtttttgtttttgtcgggcgacgagggaggtagtttcgtttcgggttttcggggcggtttcgtgttggtcgggttcggggacgtcgacggcgcgtcgtttcgaaagcgtatttcggcggtcggcggattttttcgtcgttcgttgttgtttagcgggtttcgagcgggcggacgtcgtagttttttgggtagtaagcgaggttttttgcgtagcgaggtgagtagcgaggtgggtagtatcggatcgttcggttcggaggttagcgggttttcggtcgtagcgtcgttcgtttttatcgagggttcggttatagaggtgtacgcgggcgagtggcgcgtagatcggcgtagcggtttcggcgttagttagcgttttaacgggttgcgttacgagggcgagtggttgggtaatcggcggtacggttacgggcgtattattcgtttcgacggttttcgcgaggagggtaagtataagcgtaatcggttggtgtacggcgggcgcgttcgtagttttttgtttttggtttttcggcggggtaaggttaaggagaaggtggatagggttgtcgagggcgttcgtcgagtcgtga

SEQ ID NO: 18832 - DNA, 796 bp, Artificial Sequence
  chemically treated genomic DNA (Homo sapiens) CpG-island No: 18832
tcacgactcgacgaacgccctcgacaaccctatccaccttctccttaaccttaccccgccgaaaaaccaaaaacaaaaaactacgaacgcgcccgccgtacaccaaccgattacgcttatacttaccctcctcgcgaaaaccgtcgaaacgaataatacgcccgtaaccgtaccgccgattacccaaccactcgccctcgtaacgcaacccgttaaaacgctaactaacgccgaaaccgctacgccgatctacgcgccactcgcccgcgtacacctctataaccgaaccctcgataaaaacgaacgacgctacgaccgaaaacccgctaacctccgaaccgaacgatccgatactacccacctcgctactcacctcgctacgcaaaaaacctcgcttactacccaaaaaactacgacgtccgcccgctcgaaacccgctaaacaacaacgaacgacgaaaaaatccgccgaccgccgaaatacgctttcgaaacgacgcgccgtcgacgtccccgaacccgaccaacacgaaaccgccccgaaaacccgaaacgaaactacctccctcgtcgcccgacaaaaacaaaaacgaaaataacgtcgaaaaatcgctataaccgaaatccaaaaaaatacgacgaaacgaacgcaacaacgccgcctaataataaaacacactctaacgtaccccgtaaccgtaacgcttcccgacctaccactaaccctaataaatacctacgaacgacgaaaaaataaaaaaaaaaatcaaaacgtaccgctaaactccttacgcccc

SEQ ID NO: 18833 - DNA, 537 bp, Artificial Sequence
  chemically treated genomic DNA (Homo sapiens) CpG-island No: 18833
cgtaagggcgtaaatggcgggcgaaggtttaaggttggggaaggcgtacgcggacgagtagatagatattggtgggtcgggtttcgtattttcgtcggagtaggttttagtgtcgtagtcgttttggaaatcgtttttttagagttcggcgtagcgtaggtcggatacgtttttttatacgtcgttgcgtttttttagttcgtttagttattcgtcgcggtacgtttagcggtttttgcgttttacgtttagtttttcgcgtttgttttgttgttagtggttttggtagttgtgttcgtcgggtttcgtgaagacgtttagtgattcgaagtcgtgtgtttagtagtcgttgtattcgttttgggcgtcggggttcgtgtatacgtcgtagttatgtgttcgtttcgttttttagttttttacgtagtagttttcgtcgttaaagtcgaatttgttttcgggggatatgtatgtagttggcgcggttttagtttttcggcggtttagcgtattttgggattggagagtttgttgggg

SEQ ID NO: 18834 - DNA, 537 bp, Artificial Sequence
  chemically treated genomic DNA (Homo sapiens) CpG-island No: 18834
ccccaacaaactctccaatcccaaaatacgctaaaccgccgaaaaactaaaaccgcgccaactacatacatatcccccgaaaacaaattcgactttaacgacgaaaactactacgtaaaaaactaaaaaacgaaacgaacacataactacgacgtatacacgaaccccgacgcccaaaacgaatacaacgactactaaacacacgacttcgaatcactaaacgtcttcacgaaacccgacgaacacaactaccaaaaccactaacaacaaaacaaacgcgaaaaactaaacgtaaaacgcaaaaaccgctaaacgtaccgcgacgaataactaaacgaactaaaaaaacgcaacgacgtataaaaaaacgtatccgacctacgctacgccgaactctaaaaaaacgatttccaaaacgactacgacactaaaacctactccgacgaaaatacgaaacccgacccaccaatatctatctactcgtccgcgtacgccttccccaaccttaaaccttcgcccgccatttacgcccttacg

SEQ ID NO: 18835 - DNA, 537 bp, Artificial Sequence
  chemically treated genomic DNA (Homo sapiens) CpG-island No: 18835
ttttagtaggttttttagttttaggatgcgttgagtcgtcggggggttgaggtcgcgttaattatatgtatgtttttcgggggtaagttcgattttgacgacgggggttgttacgtggggggttgggaggcggggcgggtatatggttacggcgtgtgtacgggtttcggcgtttagggcgagtatagcggttgttgggtatacggtttcgagttattgggcgtttttacggggttcggcggatatagttattagggttattggtagtagggtaagcgcgaagggttgggcgtggagcgtaagagtcgttggacgtatcgcggcgagtggttgggcgggttgaaggggcgtagcggcgtgtgggaaagcgtgttcggtttgcgttacgtcgggttttggaaggacggtttttaggacggttacggtattgagatttatttcgacggaggtgcggggttcggtttattagtgtttgtttgttcgttcgcgtgcgttttttttagttttgggttttcgttcgttatttgcgtttttgcg

SEQ ID NO: 18836 - DNA, 537 bp, Artificial Sequence
  chemically treated genomic DNA (Homo sapiens) CpG-island No: 18836
cgcaaaaacgcaaataacgaacgaaaacccaaaactaaaaaaaacgcacgcgaacgaacaaacaaacactaataaaccgaaccccgcacctccgtcgaaataaatctcaataccgtaaccgtcctaaaaaccgtccttccaaaacccgacgtaacgcaaaccgaacacgctttcccacacgccgctacgccccttcaacccgcccaaccactcgccgcgatacgtccaacgactcttacgctccacgcccaacccttcgcgcttaccctactaccaataaccctaataactatatccgccgaaccccgtaaaaacgcccaataactcgaaaccgtatacccaacaaccgctatactcgccctaaacgccgaaacccgtacacacgccgtaaccatatacccgccccgcctcccaaccccccacgtaacaacccccgtcgtcaaaatcgaacttacccccgaaaaacatacatataattaacgcgacctcaaccccccgacgactcaacgcatcctaaaactaaaaaacctactaaaa

SEQ ID NO: 18837 - DNA, 518 bp, Artificial Sequence
  chemically treated genomic DNA (Homo sapiens) CpG-island No: 18837
gggcgtagttgaggaggttggagtttttaatttcgaggcgttttttgtcgtcgtcgttttattgtggtttagagtttgggggttggcggcgggttcgggggtcggcgcgttttttagttggtcggttttttcgtgtatatttcgatggaggggcgagtcggcgttggggttagaggcgttagaggggtttttgcggtttttagggtcgtttttggcgtcgttgttttcgttttcgttttcgttttcgtcgtcggttttcggttgtttttcgtatttgaagcgtttttggcggcgtaagtagtagtcgttttcgaatatgttgtcggagttcgggtgtagcgtttagtaggagtttttgttcggtttgttcggggagcgtgttattttgacgaagtagttattgaaggatagcgagtggcggatggagttttgttagcgttgttggttttgtcggtaataggggaagaggtttatgatttattggtagatttcgtttagcgtgagtattttgttgggcg

SEQ ID NO: 18838 - DNA, 518 bp, Artificial Sequence
  chemically treated genomic DNA (Homo sapiens) CpG-island No: 18838
cgcccaacaaaatactcacgctaaacgaaatctaccaataaatcataaacctcttcccctattaccgacaaaaccaacaacgctaacaaaactccatccgccactcgctatccttcaataactacttcgtcaaaataacacgctccccgaacaaaccgaacaaaaactcctactaaacgctacacccgaactccgacaacatattcgaaaacgactactacttacgccgccaaaaacgcttcaaatacgaaaaacaaccgaaaaccgacgacgaaaacgaaaacgaaaacgaaaacaacgacgccaaaaacgaccctaaaaaccgcaaaaacccctctaacgcctctaaccccaacgccgactcgcccctccatcgaaatatacacgaaaaaaccgaccaactaaaaaacgcgccgacccccgaacccgccgccaacccccaaactctaaaccacaataaaacgacgacgacaaaaaacgcctcgaaattaaaaactccaacctcctcaactacgccc

SEQ ID NO: 18839 - DNA, 518 bp, Artificial Sequence
  chemically treated genomic DNA (Homo sapiens) CpG-island No: 18839
cgtttagtaagatgtttacgttgagcgagatttattagtggattatggatttttttttttattatcggtagaattagtagcgttggtagaattttattcgttattcgttgttttttaatgattgtttcgttaaggtggtacgtttttcggataagtcgggtaagggtttttattggacgttgtattcggatttcggtaatatgttcgagaacggttgttatttgcgtcgttagaagcgttttaagtgcgagaagtagtcgggggtcggcggcgggggcgggagcggaagcgggggtagcggcgttaagggcggttttgagagtcgtaaggatttttttggcgtttttaattttagcgtcgattcgtttttttatcggggtgtgtacgggaagatcggttagttagagggcgcgtcggttttcgggttcgtcgttagtttttagattttggattatagtggggcgacggcgatagggggcgtttcggagttgaagattttagtttttttaattgcgttt

SEQ ID NO: 18840 - DNA, 518 bp, Artificial Sequence
  chemically treated genomic DNA (Homo sapiens) CpG-island No: 18840
aaacgcaattaaaaaaactaaaatcttcaactccgaaacgccccctatcgccgtcgccccactataatccaaaatctaaaaactaacgacgaacccgaaaaccgacgcgccctctaactaaccgatcttcccgtacacaccccgataaaaaaacgaatcgacgctaaaattaaaaacgccaaaaaaatccttacgactctcaaaaccgcccttaacgccgctacccccgcttccgctcccgcccccgccgccgacccccgactacttctcgcacttaaaacgcttctaacgacgcaaataacaaccgttctcgaacatattaccgaaatccgaatacaacgtccaataaaaacccttacccgacttatccgaaaaacgtaccaccttaacgaaacaatcattaaaaaacaacgaataacgaataaaattctaccaacgctactaattctaccgataataaaaaaaaaaatccataatccactaataaatctcgctcaacgtaaacatcttactaaacg

SEQ ID NO: 18841 - DNA, 506 bp, Artificial Sequence
  chemically treated genomic DNA (Homo sapiens) CpG-island No: 18841
cgggcggtcgcgcggcgcggggcgggggaggggagttgagtagttgtagttattcgagcgttcgcgcgggtttaacgttattcgggcgaagaggaagtttagagttgcggggcgcggcgtgcgcggcggcggcggcggcgcggcgggcgggggtagcgtcgggggtaggcggttgtcgcggagcgcggcgtcggggagcgttttcgcgggaagtgagcgggttgtttttgcgaggtaagtgtagttgagttgatgtggattttacgtcgtttgagtgtttattttttcgttttttttttatttgttcgtcgtataaagacgttcgtatttataaagttcgaggtgtatttgtaaggcggtcgttcgttagttcggtcgtcgcgtttttcgtttcgtcgttttatcgttgcgcgcgatttttttttcgcgattttttttttaagcggggtttttattttgtttgtaaagtagtgtaattggtttaggttcggaggttagggaaagag

SEQ ID NO: 18842 - DNA, 506 bp, Artificial Sequence
  chemically treated genomic DNA (Homo sapiens) CpG-island No: 18842
ctctttccctaacctccgaacctaaaccaattacactactttacaaacaaaataaaaaccccgcttaaaaaaaaaatcgcgaaaaaaaaatcgcgcgcaacgataaaacgacgaaacgaaaaacgcgacgaccgaactaacgaacgaccgccttacaaatacacctcgaactttataaatacgaacgtctttatacgacgaacaaataaaaaaaaaacgaaaaaataaacactcaaacgacgtaaaatccacatcaactcaactacacttacctcgcaaaaacaacccgctcacttcccgcgaaaacgctccccgacgccgcgctccgcgacaaccgcctacccccgacgctacccccgcccgccgcgccgccgccgccgccgcgcacgccgcgccccgcaactctaaacttcctcttcgcccgaataacgttaaacccgcgcgaacgctcgaataactacaactactcaactcccctcccccgccccgcgccgcgcgaccgcccg

SEQ ID NO: 18843 - DNA, 506 bp, Artificial Sequence
  chemically treated genomic DNA (Homo sapiens) CpG-island No: 18843
ttttttttttagttttcgggtttaaattaattatattgttttgtaaataaagtgagggtttcgtttgggggaggggtcgcgggggaggggtcgcgcgtagcggtgaagcggcggggcgggaggcgcggcggtcggattggcgggcggtcgttttgtaggtgtatttcgggttttgtaggtgcgagcgtttttgtgcggcggataaatggggagaggacgaggaggtgggtatttaagcgacgtaagatttatattagtttaattgtatttgtttcgtagaggtagttcgtttatttttcgcggaggcgtttttcggcgtcgcgtttcgcggtagtcgtttgttttcggcgttgttttcgttcgtcgcgtcgtcgtcgtcgtcgcgtacgtcgcgtttcgtagttttgggtttttttttcgttcgggtggcgttgggttcgcgcgggcgttcgggtgattgtagttgtttagtttttttttttcgtttcgcgtcgcgcggtcgttcg

SEQ ID NO: 18844 - DNA, 506 bp, Artificial Sequence
  chemically treated genomic DNA (Homo sapiens) CpG-island No: 18844
cgaacgaccgcgcgacgcgaaacgaaaaaaaaaaactaaacaactacaatcacccgaacgcccgcgcgaacccaacgccacccgaacgaaaaaaaaacccaaaactacgaaacgcgacgtacgcgacgacgacgacgacgcgacgaacgaaaacaacgccgaaaacaaacgactaccgcgaaacgcgacgccgaaaaacgcctccgcgaaaaataaacgaactacctctacgaaacaaatacaattaaactaatataaatcttacgtcgcttaaatacccacctcctcgtcctctccccatttatccgccgcacaaaaacgctcgcacctacaaaacccgaaatacacctacaaaacgaccgcccgccaatccgaccgccgcgcctcccgccccgccgcttcaccgctacgcgcgacccctcccccgcgacccctcccccaaacgaaaccctcactttatttacaaaacaatataattaatttaaacccgaaaactaaaaaaaaaa

SEQ ID NO: 18845 - DNA, 954 bp, Artificial Sequence
  chemically treated genomic DNA (Homo sapiens) CpG-island No: 18845
tttttagattcggtcgggagagtttcgcgcgtcgcgatttcggagagagggcgtagggggtagacgatttttcgtcgcgttttttgtatttcgggttcggttggttgtggttcgcgttaaggtgtatgtttagttaagtagaaggagcgggtatcgcgtaggtagcgttgtttcgagggataaaggttgggtttatattttttacggtcgtagttcgcgcgtttgaggaagttcgtttggttgttaggggtttttcgttggtcggagtttgcgtagcgtgtgggggaaggggagttcggtcgttcgtttttttttcgtcgcgtttttagggatttgttgattaagatttttatagtttagtcgtcgtcgattcgttttttatttttacgtttcggtttcgcggagtttttcgtttcggtcgtttttacgtattgtagaagcgatagtttttcggcggtttttgaaatttcggataaagaatttagaaattttcgattttttattttagaatttttagttttcgttttcgttttatcgtttgtttttttcgtcgtcgtcgttatcgtcgtagtcgttagtaattttatttttagatcgcgcgagatcggtttttgcggtcgtcgcgagatcgcgtacgcgttttcgggattttggcgtagtgggcgcgcggattcgagttttatttcgttcgtgagaggttggcgcggtttgtttaatttcgagtcggagcggagagagcgttcgtttattggtttttttcgtagttttagtcgggtgcgcgtagtcgcgcgtttttaagtttaaaacgcggattgtttcgggttagttggttcggtagagttttttcgggatttggtcggcgggttttgtggggacgcgaggtttttttgggtttttatattttttggtttttgtttttggatgacgtattttgaagaaaatttgatttttttt

SEQ ID NO: 18846 - DNA, 954 bp, Artificial Sequence
  chemically treated genomic DNA (Homo sapiens) CpG-island No: 18846
aaaaaaaatcaaattttcttcaaaatacgtcatccaaaaacaaaaaccaaaaaatataaaaacccaaaaaaacctcgcgtccccacaaaacccgccgaccaaatcccgaaaaaactctaccgaaccaactaacccgaaacaatccgcgttttaaacttaaaaacgcgcgactacgcgcacccgactaaaactacgaaaaaaaccaataaacgaacgctctctccgctccgactcgaaattaaacaaaccgcgccaacctctcacgaacgaaataaaactcgaatccgcgcgcccactacgccaaaatcccgaaaacgcgtacgcgatctcgcgacgaccgcaaaaaccgatctcgcgcgatctaaaaataaaattactaacgactacgacgataacgacgacgacgaaaaaaacaaacgataaaacgaaaacgaaaactaaaaattctaaaataaaaaatcgaaaatttctaaattctttatccgaaatttcaaaaaccgccgaaaaactatcgcttctacaatacgtaaaaacgaccgaaacgaaaaactccgcgaaaccgaaacgtaaaaataaaaaacgaatcgacgacgactaaactataaaaatcttaatcaacaaatccctaaaaacgcgacgaaaaaaaaacgaacgaccgaactccccttcccccacacgctacgcaaactccgaccaacgaaaaacccctaacaaccaaacgaacttcctcaaacgcgcgaactacgaccgtaaaaaatataaacccaacctttatccctcgaaacaacgctacctacgcgatacccgctccttctacttaactaaacatacaccttaacgcgaaccacaaccaaccgaacccgaaatacaaaaaacgcgacgaaaaatcgtctaccccctacgccctctctccgaaatcgcgacgcgcgaaactctcccgaccgaatctaaaaa

SEQ ID NO: 18847 - DNA, 954 bp, Artificial Sequence
  chemically treated genomic DNA (Homo sapiens) CpG-island No: 18847
aagaggaattagattttttttaggatacgttatttagagataagagttaagggatgtagaaatttagggaagtttcgcgtttttataaagttcgtcggttaaatttcgaaggggttttatcgggttagttagttcggagtagttcgcgttttagatttagaggcgcgcgattgcgcgtattcggttggagttgcggagaggattaatgagcgggcgtttttttcgtttcggttcgggattgggtaagtcgcgttagttttttacgggcggggtgggattcggattcgcgcgtttattgcgttagagtttcgggggcgcgtgcgcggtttcgcggcggtcgtaggggtcggtttcgcgcggtttagaagtggagttgttggcggttgcggcggtgacggcggcgacggaggaggtaggcggtggggcgggggcggggattaaggattttgaggtggggagtcgggagtttttggattttttattcggaattttaagggtcgtcggagggttgtcgtttttgtagtgcgtaggagcggtcggggcgggaggtttcgcggagtcgaggcgtggaggtaagaggcggatcggcggcggttgggttgtagagattttaattaataggtttttgggagcgcggcgggggaggggcgggcggtcgggtttttttttttttatacgttgcgtaaatttcggttagcgggagatttttggtagttaggcgggtttttttaggcgcgcgagttgcggtcgtggagggtgtgagtttaatttttgtttttcggagtaacgttgtttgcgcggtgttcgttttttttgtttggttgggtatgtattttggcgcgggttatagttagtcgagttcgaggtgtagggggcgcggcggggagtcgtttgttttttgcgtttttttttcgaggtcgcgacgcgcgggattttttcggtcgggtttgggaa

SEQ ID NO: 18848 - DNA, 954 bp, Artificial Sequence
  chemically treated genomic DNA (Homo sapiens) CpG-island No: 18848
ttcccaaacccgaccgaaaaaatcccgcgcgtcgcgacctcgaaaaaaaaacgcaaaaaacaaacgactccccgccgcgccccctacacctcgaactcgactaactataacccgcgccaaaatacatacccaaccaaacaaaaaaaacgaacaccgcgcaaacaacgttactccgaaaaacaaaaattaaactcacaccctccacgaccgcaactcgcgcgcctaaaaaaacccgcctaactaccaaaaatctcccgctaaccgaaatttacgcaacgtataaaaaaaaaaaaacccgaccgcccgcccctcccccgccgcgctcccaaaaacctattaattaaaatctctacaacccaaccgccgccgatccgcctcttacctccacgcctcgactccgcgaaacctcccgccccgaccgctcctacgcactacaaaaacgacaaccctccgacgacccttaaaattccgaataaaaaatccaaaaactcccgactccccacctcaaaatccttaatccccgcccccgccccaccgcctacctcctccgtcgccgccgtcaccgccgcaaccgccaacaactccacttctaaaccgcgcgaaaccgacccctacgaccgccgcgaaaccgcgcacgcgcccccgaaactctaacgcaataaacgcgcgaatccgaatcccaccccgcccgtaaaaaactaacgcgacttacccaatcccgaaccgaaacgaaaaaaacgcccgctcattaatcctctccgcaactccaaccgaatacgcgcaatcgcgcgcctctaaatctaaaacgcgaactactccgaactaactaacccgataaaaccccttcgaaatttaaccgacgaactttataaaaacgcgaaacttccctaaatttctacatcccttaactcttatctctaaataacgtatcctaaaaaaaatctaattcctctt

SEQ ID NO: 18849 - DNA, 910 bp, Artificial Sequence
  chemically treated genomic DNA (Homo sapiens) CpG-island No: 18849
  misc_feature (267)..(267): n is either a, c, g or t
cgcgttttcgttgttgcgcgtcggtcggcgggtcgtcgcggttgttcgtcgtttttcgtttttttttttttcgtttttttaattattttaagttttatttttttatcgttttttttttttgcgttttgttttttttcgtgtttcgttcgttttttatgcgtcgttttttttttgggtatagtttagcgggggatttggtttgtcgtacgtcgcgttcggtcggttcgggcggcgagcgttttttcgttgttttgttttgtttcgttngttcggcgcgttttcggttcggtttttatgttacggttattattattttaatattagtgtcgcgttaaggttagcgcgtttttttcgggtttagtttagtgtgtgtgagcggcggcgcgttgcgggtcgggatacggcgcggtcggcggttttagtatggaggacggtttttttagttatagtagtttgtacgatacgttttcgttgttttagttttgtaacggtgaggggcggtcgcgcggggtcggggcggcgagcggttggtggcgggcggcggcgacggcgacggcggggattaagtcgaggggtcgaggttcggcggtcgcgggcgaggtcgcgtaaagttgttgcggaggggcgcgcggttttcgttttcgtcgtcggcgtattgtgttggagtcgcggggtcgcgtttcgtttcgggtcgtttcgggtttttcgtcgttatttcggttttcggtattggcgcgcggatttcgtcggttttagtattcgcggagcgcgttcgggcggaggcgcgtggggtatagggcggcggggaggttcgggtagttttcgcgtttcggggaacgtgttgtttttttgtttttcgatttatatttgtttggaaatgattggatgaagaattcgggaaataaatttt

SEQ ID NO: 18850 - DNA, 910 bp, Artificial Sequence
  chemically treated genomic DNA (Homo sapiens) CpG-island No: 18850
  misc_feature (644)..(644): n is either a, c, g or t
aaaatttatttcccgaattcttcatccaatcatttccaaacaaatataaatcgaaaaacaaaaaaacaacacgttccccgaaacgcgaaaactacccgaacctccccgccgccctataccccacgcgcctccgcccgaacgcgctccgcgaatactaaaaccgacgaaatccgcgcgccaataccgaaaaccgaaataacgacgaaaaacccgaaacgacccgaaacgaaacgcgaccccgcgactccaacacaatacgccgacgacgaaaacgaaaaccgcgcgcccctccgcaacaactttacgcgacctcgcccgcgaccgccgaacctcgacccctcgacttaatccccgccgtcgccgtcgccgccgcccgccaccaaccgctcgccgccccgaccccgcgcgaccgcccctcaccgttacaaaactaaaacaacgaaaacgtatcgtacaaactactataactaaaaaaaccgtcctccatactaaaaccgccgaccgcgccgtatcccgacccgcaacgcgccgccgctcacacacactaaactaaacccgaaaaaaacgcgctaaccttaacgcgacactaatattaaaataataataaccgtaacataaaaaccgaaccgaaaacgcgccgaacnaacgaaacaaaacaaaacaacgaaaaaacgctcgccgcccgaaccgaccgaacgcgacgtacgacaaaccaaatcccccgctaaactatacccaaaaaaaaaacgacgcataaaaaacgaacgaaacacgaaaaaaaacaaaacgcaaaaaaaaaaaacgataaaaaaataaaacttaaaataattaaaaaaacgaaaaaaaaaaaaacgaaaaacgacgaacaaccgcgacgacccgccgaccgacgcgcaacaacgaaaacgcg

SEQ ID NO: 18851 - DNA, 910 bp, Artificial Sequence
  chemically treated genomic DNA (Homo sapiens) CpG-island No: 18851
  misc_feature (644)..(644): n is either a, c, g or t
aggatttgtttttcgagttttttatttagttatttttaaatagatgtgggtcgggaagtaaaaaagtaatacgtttttcggaacgcggaggttgttcgggttttttcgtcgttttgtgttttacgcgttttcgttcgggcgcgtttcgcgggtgttggagtcggcggggttcgcgcgttagtgtcgggagtcggggtggcggcggggagttcggggcggttcggagcgaggcgcggtttcgcggttttaatataatgcgtcggcggcgggaacggggatcgcgcgttttttcgtaataattttgcgcggtttcgttcgcggtcgtcgggtttcggtttttcggtttggttttcgtcgtcgtcgtcgtcgtcgttcgttattagtcgttcgtcgtttcggtttcgcgcggtcgttttttatcgttgtagaattggagtagcgaggacgtgtcgtataggttgttgtagttggagaagtcgttttttatgttgaggtcgtcggtcgcgtcgtatttcggttcgtagcgcgtcgtcgtttatatatattgagttgaattcgaagaaaacgcgttggttttggcgcggtattgatgttgagatgatgatgatcgtaatatggaaatcgggtcggagacgcgtcgagtnggcgaaataaagtagaataacgaaaggacgttcgtcgttcgggtcggtcggacgcgacgtgcggtaggttagatttttcgttaagttatatttaggaggaggacggcgtatgaaagacgggcgaaatacgagaaaagatagaacgtaaaaagggggaacggtaaggaggtggggtttagggtggttaaaaaagcgagaaaggggggggcgggaagcgacgaataatcgcggcgattcgtcggtcggcgcgtaataacgaaagcgcg

SEQ ID NO: 18852 - DNA, 910 bp, Artificial Sequence
  chemically treated genomic DNA (Homo sapiens) CpG-island No: 18852
  misc_feature (267)..(267): n is either a, c, g or t
cgcgctttcgttattacgcgccgaccgacgaatcgccgcgattattcgtcgcttcccgcccccccctttctcgcttttttaaccaccctaaaccccacctccttaccgttccccctttttacgttctatcttttctcgtatttcgcccgtctttcatacgccgtcctcctcctaaatataacttaacgaaaaatctaacctaccgcacgtcgcgtccgaccgacccgaacgacgaacgtcctttcgttattctactttatttcgccnactcgacgcgtctccgacccgatttccatattacgatcatcatcatctcaacatcaataccgcgccaaaaccaacgcgttttcttcgaattcaactcaatatatataaacgacgacgcgctacgaaccgaaatacgacgcgaccgacgacctcaacataaaaaacgacttctccaactacaacaacctatacgacacgtcctcgctactccaattctacaacgataaaaaacgaccgcgcgaaaccgaaacgacgaacgactaataacgaacgacgacgacgacgacgacgaaaaccaaaccgaaaaaccgaaacccgacgaccgcgaacgaaaccgcgcaaaattattacgaaaaaacgcgcgatccccgttcccgccgccgacgcattatattaaaaccgcgaaaccgcgcctcgctccgaaccgccccgaactccccgccgccaccccgactcccgacactaacgcgcgaaccccgccgactccaacacccgcgaaacgcgcccgaacgaaaacgcgtaaaacacaaaacgacgaaaaaacccgaacaacctccgcgttccgaaaaacgtattacttttttacttcccgacccacatctatttaaaaataactaaataaaaaactcgaaaaacaaatcct

SEQ ID NO: 18853 - DNA, 584 bp, Artificial Sequence
  chemically treated genomic DNA (Homo sapiens) CpG-island No: 18853
aaaacgtgtggatagaggaacgcgtcggtcggatgtgggttatagtgagtcgcggcgtggaaacggtcgaaatgtgcgggcgcgttgtttatgtttggtcgtggagttgttcgcgggcgcgggaatagcgcgtcgggggcgggtgggtttgggtgttcgtggcggaggttatttcgggttttacgcgttcgttttttttcggttttggtttttgttttcgcgttttcgtaagagtcgttcgtcgcgtttcgtagtttttgagttttcgtgcgcggaggcggggtttggttaaggggatagcgggcggtagacgcgtttttgcggtttttaggtcgttcgggtcgcgtttttcgcggggaaagaggtcgtacgacggggaggttcggtttcgtttcgttacgtttttttttcggttcgggtttcgcggtcgtcgaggcgttttttcgcgggcggacgtggcgttgggttcgcgcggttgcggcggcggcggcgggttcggggttgttatggtaatcggtagtagtagtcgttatagtagggtcggtttagtttaattttgggagttcgtcgcgtattttattgtg

SEQ ID NO: 18854 - DNA, 584 bp, Artificial Sequence
  chemically treated genomic DNA (Homo sapiens) CpG-island No: 18854
cacaataaaatacgcgacgaactcccaaaattaaactaaaccgaccctactataacgactactactaccgattaccataacaaccccgaacccgccgccgccgccgcaaccgcgcgaacccaacgccacgtccgcccgcgaaaaaacgcctcgacgaccgcgaaacccgaaccgaaaaaaaaacgtaacgaaacgaaaccgaacctccccgtcgtacgacctctttccccgcgaaaaacgcgacccgaacgacctaaaaaccgcaaaaacgcgtctaccgcccgctatccccttaaccaaaccccgcctccgcgcacgaaaactcaaaaactacgaaacgcgacgaacgactcttacgaaaacgcgaaaacaaaaaccaaaaccgaaaaaaaacgaacgcgtaaaacccgaaataacctccgccacgaacacccaaacccacccgcccccgacgcgctattcccgcgcccgcgaacaactccacgaccaaacataaacaacgcgcccgcacatttcgaccgtttccacgccgcgactcactataacccacatccgaccgacgcgttcctctatccacacgtttt

SEQ ID NO: 18855 - DNA, 584 bp, Artificial Sequence
  chemically treated genomic DNA (Homo sapiens) CpG-island No: 18855
tatagtgaggtgcgcggcgggtttttagggttgggttgggtcggttttgttgtggcggttgttgttgtcggttattatggtaatttcgggttcgtcgtcgtcgtcgtagtcgcgcgagtttagcgttacgttcgttcgcgagggggcgtttcggcggtcgcggggttcgggtcgggagggggacgtggcggggcggggtcgagttttttcgtcgtgcggttttttttttcgcggggagcgcggttcgggcggtttgggagtcgtaggggcgcgtttgtcgttcgttgtttttttggttaggtttcgttttcgcgtacgggggtttaggggttgcggggcgcggcgggcggtttttgcgggggcgcggggataaagattaaggtcgggagagagcgggcgcgtggggttcggggtaattttcgttacggatatttaagtttattcgttttcgacgcgttgttttcgcgttcgcgggtagttttacgattaaatatggataacgcgttcgtatatttcggtcgtttttacgtcgcggtttattgtggtttatattcgatcggcgcgtttttttgtttatacgtttt

SEQ ID NO: 18856 - DNA, 584 bp, Artificial Sequence
  chemically treated genomic DNA (Homo sapiens) CpG-island No: 18856
aaaacgtataaacaaaaaaacgcgccgatcgaatataaaccacaataaaccgcgacgtaaaaacgaccgaaatatacgaacgcgttatccatatttaatcgtaaaactacccgcgaacgcgaaaacaacgcgtcgaaaacgaataaacttaaatatccgtaacgaaaattaccccgaaccccacgcgcccgctctctcccgaccttaatctttatccccgcgcccccgcaaaaaccgcccgccgcgccccgcaacccctaaacccccgtacgcgaaaacgaaacctaaccaaaaaaacaacgaacgacaaacgcgcccctacgactcccaaaccgcccgaaccgcgctccccgcgaaaaaaaaaaccgcacgacgaaaaaactcgaccccgccccgccacgtccccctcccgacccgaaccccgcgaccgccgaaacgccccctcgcgaacgaacgtaacgctaaactcgcgcgactacgacgacgacgacgaacccgaaattaccataataaccgacaacaacaaccgccacaacaaaaccgacccaacccaaccctaaaaacccgccgcgcacctcactata

SEQ ID NO: 18857 - DNA, 518 bp, Artificial Sequence
  chemically treated genomic DNA (Homo sapiens) CpG-island No: 18857
ttttcgtcggtttcgtttttttaggttgttttcggcgtttcgggtttttttcgcgtagtttttgagtttcgtaggttttgcgttttcgatgtatattttcgtttattttcgtggttttcggttcggtatggcgcgcgcggtggggttcgagcggtggttgttggtcgtttatatcggcggtattattggtatgcggagtgagttcggcggtgagttcgatattttgggcggagtaggtttttggatttggtcgcgatcggtagtttcggatttttttgtatttacggggtgtcgttggggagttaaattcgcgtttggatggcgggtgcggtttgcggtcgttttttttcggtttcggttatcggcgtttttacgtatggagtttcgatttggatagaggagattgcggtgggttttcgtcgtcgcggtgttttcgggagcgttttgcgattttggggttaggttttttgtgttgtcgttgcgtttttgagggttagcgttttgaagttttggaatat

SEQ ID NO: 18858 - DNA, 518 bp, Artificial Sequence
  chemically treated genomic DNA (Homo sapiens) CpG-island No: 18858
atattccaaaacttcaaaacgctaaccctcaaaaacgcaacgacaacacaaaaaacctaaccccaaaatcgcaaaacgctcccgaaaacaccgcgacgacgaaaacccaccgcaatctcctctatccaaatcgaaactccatacgtaaaaacgccgataaccgaaaccgaaaaaaaacgaccgcaaaccgcacccgccatccaaacgcgaatttaactccccaacgacaccccgtaaatacaaaaaaatccgaaactaccgatcgcgaccaaatccaaaaacctactccgcccaaaatatcgaactcaccgccgaactcactccgcataccaataataccgccgatataaacgaccaacaaccaccgctcgaaccccaccgcgcgcgccataccgaaccgaaaaccacgaaaataaacgaaaatatacatcgaaaacgcaaaacctacgaaactcaaaaactacgcgaaaaaaacccgaaacgccgaaaacaacctaaaaaaacgaaaccgacgaaaa

SEQ ID NO: 18859 - DNA, 518 bp, Artificial Sequence
  chemically treated genomic DNA (Homo sapiens) CpG-island No: 18859
atattttaggattttaggacgttggtttttaggggcgtagcggtagtatagggggtttggttttagggtcgtagggcgttttcgggagtatcgcgacggcgagaatttatcgtaattttttttgtttaggtcggggttttatgcgtggggacgtcggtggtcggaatcggaggagagcgatcgtagatcgtattcgttatttaggcgcggatttggttttttagcgatatttcgtgggtgtaggagggttcgaggttatcggtcgcggttaggtttagaggtttatttcgtttagggtatcggatttatcgtcgagtttatttcgtatgttaatggtgtcgtcggtgtagacggttagtagttatcgttcgggttttatcgcgcgcgttatgtcggatcggggattacgggagtggacgggggtgtgtatcggggacgtagggtttgcgggatttagggattgcgcggaggaggttcggggcgtcgggggtagtttgggagggcggggtcggcggggg

SEQ ID NO: 18860 - DNA, 518 bp, Artificial Sequence
  chemically treated genomic DNA (Homo sapiens) CpG-island No: 18860
cccccgccgaccccgccctcccaaactacccccgacgccccgaacctcctccgcgcaatccctaaatcccgcaaaccctacgtccccgatacacacccccgtccactcccgtaatccccgatccgacataacgcgcgcgataaaacccgaacgataactactaaccgtctacaccgacgacaccattaacatacgaaataaactcgacgataaatccgataccctaaacgaaataaacctctaaacctaaccgcgaccgataacctcgaaccctcctacacccacgaaatatcgctaaaaaaccaaatccgcgcctaaataacgaatacgatctacgatcgctctcctccgattccgaccaccgacgtccccacgcataaaaccccgacctaaacaaaaaaaattacgataaattctcgccgtcgcgatactcccgaaaacgccctacgaccctaaaaccaaaccccctatactaccgctacgcccctaaaaaccaacgtcctaaaatcctaaaatat

SEQ ID NO: 18861 - DNA, 917 bp, Artificial Sequence
  chemically treated genomic DNA (Homo sapiens) CpG-island No: 18861
tggagtttcgggtttttcgtgcgttcgagtattttcggtttagacgagacggttcgggcgtggttcggcggggatttagaattcgggaggttaggtgcgtttaggttaggcgttggaggttggggcgtcggatggggcggggcggtcgttgagttagggttattttcgcgcgggcgcgcggagtaggttttcgggtcgtggaggattagtcgcgggatttatgggttcgggagtcgtttcgttcggaaaaatcggtcgggttagcgcggcgcgggtatatttcggcgtcgggaagggcggttgcgtcgtataaaaggcgtcgtcgcgttggttatcgtcgttcggagtttagtcgttttgttacgcggggttcgcgggacgaggggacgtcggggttagcgaggacgcggcggggttgggtttggcggttgggattttttagcgttaggcgagggcgtttaaggcgttcggtacggcgtcggggtcgggtggttgtagtagggtagggggtgcgcgattagcggggatttgggcgtaggggtcggttttcgggattcgtaggcgacgcgggcggttttaagggcgtcgggggttttttttttcgtagttcggcgaatcgacggtgttggggattcgcgcgttgggtttagtggtttttaatagtttaatagttttgtagcgtaattgtgaaatgtttaggattattagattcggcgggcgcggcgatagcgacggagcgttttacgcgcggtttggagttagagttatagttaggggtgcgtcggcgattaatttaggggagtttacggatcggtttcgcgttttaggtcggtcgttttatgcgtcgcgtttcgtagtttttagggtttggttggttttatttgttgttagggaagattttcggtcggagagttaag

SEQ ID NO: 18862 - DNA, 917 bp, Artificial Sequence
  chemically treated genomic DNA (Homo sapiens) CpG-island No: 18862
cttaactctccgaccgaaaatcttccctaacaacaaataaaaccaaccaaaccctaaaaactacgaaacgcgacgcataaaacgaccgacctaaaacgcgaaaccgatccgtaaactcccctaaattaatcgccgacgcacccctaactataactctaactccaaaccgcgcgtaaaacgctccgtcgctatcgccgcgcccgccgaatctaataatcctaaacatttcacaattacgctacaaaactattaaactattaaaaaccactaaacccaacgcgcgaatccccaacaccgtcgattcgccgaactacgaaaaaaaaaacccccgacgcccttaaaaccgcccgcgtcgcctacgaatcccgaaaaccgacccctacgcccaaatccccgctaatcgcgcaccccctaccctactacaaccacccgaccccgacgccgtaccgaacgccttaaacgccctcgcctaacgctaaaaaatcccaaccgccaaacccaaccccgccgcgtcctcgctaaccccgacgtcccctcgtcccgcgaaccccgcgtaacaaaacgactaaactccgaacgacgataaccaacgcgacgacgccttttatacgacgcaaccgcccttcccgacgccgaaatatacccgcgccgcgctaacccgaccgatttttccgaacgaaacgactcccgaacccataaatcccgcgactaatcctccacgacccgaaaacctactccgcgcgcccgcgcgaaaataaccctaactcaacgaccgccccgccccatccgacgccccaacctccaacgcctaacctaaacgcacctaacctcccgaattctaaatccccgccgaaccacgcccgaaccgtctcgtctaaaccgaaaatactcgaacgcacgaaaaacccgaaactcca

SEQ ID NO: 18863 - DNA, 917 bp, Artificial Sequence
  chemically treated genomic DNA (Homo sapiens) CpG-island No: 18863
tttggtttttcggtcgagggttttttttggtagtaggtggagttagttaggttttggggattgcggggcgcggcgtatggggcggtcgatttggagcgcggagtcggttcgtgggtttttttggattggtcgtcggcgtatttttgattgtgattttgattttaggtcgcgcgtgggacgtttcgtcgttgtcgtcgcgttcgtcgggtttagtggttttaaatattttataattgcgttatagaattgttgaattgttaagaattattggatttagcgcgcgagtttttaatatcgtcggttcgtcgagttgcggagagaggagttttcgacgtttttgggatcgttcgcgtcgtttgcggatttcggggatcggtttttgcgtttagattttcgttggtcgcgtattttttgttttgttgtagttattcggtttcgacgtcgtatcggacgttttagacgttttcgtttggcgttgggggattttagtcgttaagtttagtttcgtcgcgttttcgttggtttcggcgttttttcgtttcgcgggtttcgcgtggtagggcggttgagtttcgagcggcggtggttagcgcggcggcgttttttatgcggcgtagtcgtttttttcggcgtcggaatgtgttcgcgtcgcgttggttcgatcggttttttcgggcggggcggttttcgggtttataggtttcgcgattgattttttacggttcggggatttgtttcgcgcgttcgcgcgggggtggttttgatttagcggtcgtttcgttttattcggcgttttagtttttagcgtttggtttgggcgtatttggtttttcgggttttgggttttcgtcgggttacgttcgaatcgtttcgtttgggtcgggggtgttcgggcgtacggagggttcggggtttta

SEQ ID NO: 18864 - DNA, 917 bp, Artificial Sequence
  chemically treated genomic DNA (Homo sapiens) CpG-island No: 18864
taaaaccccgaaccctccgtacgcccgaacacccccgacccaaacgaaacgattcgaacgtaacccgacgaaaacccaaaacccgaaaaaccaaatacgcccaaaccaaacgctaaaaactaaaacgccgaataaaacgaaacgaccgctaaatcaaaaccacccccgcgcgaacgcgcgaaacaaatccccgaaccgtaaaaaatcaatcgcgaaacctataaacccgaaaaccgccccgcccgaaaaaaccgatcgaaccaacgcgacgcgaacacattccgacgccgaaaaaaacgactacgccgcataaaaaacgccgccgcgctaaccaccgccgctcgaaactcaaccgccctaccacgcgaaacccgcgaaacgaaaaaacgccgaaaccaacgaaaacgcgacgaaactaaacttaacgactaaaatcccccaacgccaaacgaaaacgtctaaaacgtccgatacgacgtcgaaaccgaataactacaacaaaacaaaaaatacgcgaccaacgaaaatctaaacgcaaaaaccgatccccgaaatccgcaaacgacgcgaacgatcccaaaaacgtcgaaaactcctctctccgcaactcgacgaaccgacgatattaaaaactcgcgcgctaaatccaataattcttaacaattcaacaattctataacgcaattataaaatatttaaaaccactaaacccgacgaacgcgacgacaacgacgaaacgtcccacgcgcgacctaaaatcaaaatcacaatcaaaaatacgccgacgaccaatccaaaaaaacccacgaaccgactccgcgctccaaatcgaccgccccatacgccgcgccccgcaatccccaaaacctaactaactccacctactaccaaaaaaaaccctcgaccgaaaaaccaaa

SEQ ID NO: 18865 - DNA, 720 bp, Artificial Sequence
  chemically treated genomic DNA (Homo sapiens) CpG-island No: 18865
gcgtttcgcgcgtttcgggagaagaggagttgttcgcggggtagcggtgcgaggcgggagtttgttttcggcgtgagaagaagcgagcgggagggaggaagggagggagagagggcgggcggggaggggagagaagaggaggtgaggggattcgttacggttcgtcgggtcggtttcgcgaggtcgtgttggtttgttttcgttttcgatttttgcgtttcgttttttttcgtcgtcggtcgtttagtcgcgtttcgtatttttgggttagtcgcgaatttagttttgttattattattttcgttgagagaggtgcgcgtaggcgtattcgtgtttacgggttgggaaggcggaagtgaagtgaaggtcgagatttcggttcggaatggataatgtttgggtttggattcgttcggtaggaggtcgttcggggttggtggttcgttttgtttttgttggcgttttttttattttagggacggtgttcgttcgtttatatgtattttttgaacgcgagggtcggagattcgtttacgtttcgtgtcggttacgtattttcgtggggcggtcgcggggtcggtttaagttgatagttatggtcgttgttttcgaggcgtttaagcgttttttataaagtttgtaggggaagttgttttcgtcggggtggtagttataattttagtaggtaacgttgaggtttacggaaggaaggggcgaggt

SEQ ID NO: 18866 - DNA, 720 bp, Artificial Sequence
  chemically treated genomic DNA (Homo sapiens) CpG-island No: 18866
acctcgccccttccttccgtaaacctcaacgttacctactaaaattataactaccaccccgacgaaaacaacttcccctacaaactttataaaaaacgcttaaacgcctcgaaaacaacgaccataactatcaacttaaaccgaccccgcgaccgccccacgaaaatacgtaaccgacacgaaacgtaaacgaatctccgaccctcgcgttcaaaaaatacatataaacgaacgaacaccgtccctaaaataaaaaaaacgccaacaaaaacaaaacgaaccaccaaccccgaacgacctcctaccgaacgaatccaaacccaaacattatccattccgaaccgaaatctcgaccttcacttcacttccgccttcccaacccgtaaacacgaatacgcctacgcgcacctctctcaacgaaaataataataacaaaactaaattcgcgactaacccaaaaatacgaaacgcgactaaacgaccgacgacgaaaaaaaacgaaacgcaaaaatcgaaaacgaaaacaaaccaacacgacctcgcgaaaccgacccgacgaaccgtaacgaatcccctcacctcctcttctctcccctccccgcccgccctctctccctcccttcctccctcccgctcgcttcttctcacgccgaaaacaaactcccgcctcgcaccgctaccccgcgaacaactcctcttctcccgaaacgcgcgaaacgc

SEQ ID NO: 18867 - DNA, 720 bp, Artificial Sequence
  chemically treated genomic DNA (Homo sapiens) CpG-island No: 18867
atttcgtttttttttttcgtgggttttaacgttgtttgttgagattgtgattgttatttcgacgggagtagttttttttatagattttgtagagagcgtttaaacgtttcggggatagcggttatgattgttagtttgggtcgatttcgcggtcgttttacgggaatgcgtggtcgatacggggcgtgggcgaattttcgattttcgcgtttagggggtatatataaacgggcggatatcgtttttggggtaagggaggcgttagtaagaataaggcgggttattaatttcgagcgattttttatcggacggatttaaatttaaatattgtttatttcgggtcgaagtttcggtttttattttattttcgtttttttagttcgtgaatacgaatgcgtttgcgcgtattttttttagcggaagtaatagtgataaagttgggttcgcggttggtttaggagtgcggggcgcgattgggcggtcggcggcggggaggggcggagcgtaggagtcggaggcgggagtagattagtacggtttcgcggagtcggttcggcggatcgtgacgggtttttttatttttttttttttttttttttcgttcgttttttttttttttttttttttttttcgttcgtttttttttacgtcgggagtaggttttcgtttcgtatcgttgtttcgcgagtagttttttttttttcgaggcgcgcggggcgt

SEQ ID NO: 18868 - DNA, 720 bp, Artificial Sequence
  chemically treated genomic DNA (Homo sapiens) CpG-island No: 18868
acgccccgcgcgcctcgaaaaaaaaaaaactactcgcgaaacaacgatacgaaacgaaaacctactcccgacgtaaaaaaaaacgaacgaaaaaaaaaaaaaaaaaaaaaaaaaacgaacgaaaaaaaaaaaaaaaaaaaaataaaaaaacccgtcacgatccgccgaaccgactccgcgaaaccgtactaatctactcccgcctccgactcctacgctccgcccctccccgccgccgaccgcccaatcgcgccccgcactcctaaaccaaccgcgaacccaactttatcactattacttccgctaaaaaaaatacgcgcaaacgcattcgtattcacgaactaaaaaaacgaaaataaaataaaaaccgaaacttcgacccgaaataaacaatatttaaatttaaatccgtccgataaaaaatcgctcgaaattaataacccgccttattcttactaacgcctcccttaccccaaaaacgatatccgcccgtttatatataccccctaaacgcgaaaatcgaaaattcgcccacgccccgtatcgaccacgcattcccgtaaaacgaccgcgaaatcgacccaaactaacaatcataaccgctatccccgaaacgtttaaacgctctctacaaaatctataaaaaaaactactcccgtcgaaataacaatcacaatctcaacaaacaacgttaaaacccacgaaaaaaaaaaacgaaat

SEQ ID NO: 18869 - DNA, 575 bp, Artificial Sequence
  chemically treated genomic DNA (Homo sapiens) CpG-island No: 18869
ttggttacgtattttattaatggggttattaaattttcgttaacgtagcgtacggcgtggtggtgtgagcgttgtacgtacgttgggtttacgaaggggtaggcgttttgttttcgtttaatcggaagttagtaagaatttttcgggtcgttatgttttatttttttcgcgtcgcgttacgggtcgtttttttgtagtcgattaatttttttgatttttttgtgcgtattatttaattagagaggtcgaggcggggttttatttgatcgttttaagtcgtcgcgtagtttgcgtttttttcggtataggttgaggttattaaggtatattttgttgggttaggttgggcgggttttcgggatgggtagttttttcgacgagcggcgacgtcgtggttgagtttagaaagttagagttgttggatagttatcgcgggagcgcggagggaagtgggaggtttggacggagtgtgtacgtgttggtagtttcgtttcgtcgtcggagttattaggttaaatttgtgttggttttggttaaagaaatttttgcgggttaggttgttgttgtcggtgtag

SEQ ID NO: 18870 - DNA, 575 bp, Artificial Sequence
  chemically treated genomic DNA (Homo sapiens) CpG-island No: 18870
ctacaccgacaacaacaacctaacccgcaaaaatttctttaaccaaaaccaacacaaatttaacctaataactccgacgacgaaacgaaactaccaacacgtacacactccgtccaaacctcccacttccctccgcgctcccgcgataactatccaacaactctaactttctaaactcaaccacgacgtcgccgctcgtcgaaaaaactacccatcccgaaaacccgcccaacctaacccaacaaaatataccttaataacctcaacctataccgaaaaaaacgcaaactacgcgacgacttaaaacgatcaaataaaaccccgcctcgacctctctaattaaataatacgcacaaaaaaatcaaaaaaattaatcgactacaaaaaaacgacccgtaacgcgacgcgaaaaaaataaaacataacgacccgaaaaattcttactaacttccgattaaacgaaaacaaaacgcctaccccttcgtaaacccaacgtacgtacaacgctcacaccaccacgccgtacgctacgttaacgaaaatttaataaccccattaataaaatacgtaaccaa

SEQ ID NO: 18871 - DNA, 575 bp, Artificial Sequence
  chemically treated genomic DNA (Homo sapiens) CpG-island No: 18871
ttgtatcggtaatagtagtttgattcgtagaagtttttttggttagggttagtataggtttgatttggtggtttcgacggcggagcgagattgttaatacgtgtatatttcgtttagattttttattttttttcgcgttttcgcgatagttgtttagtaattttagttttttagatttaattacggcgtcgtcgttcgtcgagagggttgtttatttcggggattcgtttagtttggtttagtaaaatgtattttagtagttttaatttgtatcggagaaaacgtaggttgcgcggcggtttagagcggttaagtggaatttcgtttcgatttttttgattgggtaatgcgtataagaaaattaagaggattggtcggttgtagagaggcggttcgtaacgcgacgcgaaagaagtggggtatagcggttcggggaatttttgttagttttcgattggacgaaagtagaacgtttgttttttcgtagatttagcgtacgtataacgtttatattattacgtcgtacgttgcgttagcggaagtttaatggttttattggtgggatgcgtggttaa

SEQ ID NO: 18872 - DNA, 575 bp, Artificial Sequence
  chemically treated genomic DNA (Homo sapiens) CpG-island No: 18872
ttaaccacgcatcccaccaataaaaccattaaacttccgctaacgcaacgtacgacgtaataatataaacgttatacgtacgctaaatctacgaaaaaacaaacgttctactttcgtccaatcgaaaactaacaaaaattccccgaaccgctataccccacttctttcgcgtcgcgttacgaaccgcctctctacaaccgaccaatcctcttaattttcttatacgcattacccaatcaaaaaaatcgaaacgaaattccacttaaccgctctaaaccgccgcgcaacctacgttttctccgatacaaattaaaactactaaaatacattttactaaaccaaactaaacgaatccccgaaataaacaaccctctcgacgaacgacgacgccgtaattaaatctaaaaaactaaaattactaaacaactatcgcgaaaacgcgaaaaaaaataaaaaatctaaacgaaatatacacgtattaacaatctcgctccgccgtcgaaaccaccaaatcaaacctatactaaccctaaccaaaaaaacttctacgaatcaaactactattaccgatacaa

SEQ ID NO: 18873 - DNA, 942 bp, Artificial Sequence
  chemically treated genomic DNA (Homo sapiens) CpG-island No: 18873
gattttaggtgggtattgttggcgttcggttgttaatttatagtttacgtttttataggtgcgcgtttagagttacgcgtttagtatcgttcggttggtcgggaagaggcgatcgggttcgtggttcgagtttcgtattttcggtttttttttgggtttcggggtaatagtttttttcgggtcgtataggtcgtattgagggcgttatttcggggttttcgaattttcgggttttcggcggggacgaggcgtagggacgggggtattttcggttcgcggggttcgggtcgttcgttcgttcgattcgtttatttggttgtcgttgacgtagaagacgcggtcgttacggtttaggtatacgcgggcgttcgggggtttcgcggtcgcgtcgtagaaggtgaaggaatagcgcgaggtacgtagtcgtcgtatcgtggcgcgtacgagtttagtcggtcggcgattttagcgcgtttataggtataggtagtatagcgtgatgagtatggtcgcgtcgtcggtagggcgagttcgttttgttcgttcgttttagcgttttaggttcggtttcgtttcggtcggaagggtcgcgtcgttttttcgggttaggcggcgcgggggtggggacggcgggggaggcggggattcggaaggtgacgcgggtaattggaggttgcggcgggaggggcgggggggggtgaggtcgcgttcggttgtgtgatggggagtttcggaggtcgcgtttagggttggtggcggcggcgaggggtagcgttggggcggggggtgtgtatcggggttaggggacgtcggggttgtattcggagagggggttcgagggagtggaggtcggggtgcggggtcgcgttagggttgaggagtgggatgggtatgttgtggatgcgggggaggggaggttttagtggttgttcgatttgttta

SEQ ID NO: 18874 - DNA, 942 bp, Artificial Sequence
  chemically treated genomic DNA (Homo sapiens) CpG-island No: 18874
taaacaaatcgaacaaccactaaaacctcccctcccccgcatccacaacatacccatcccactcctcaaccctaacgcgaccccgcaccccgacctccactccctcgaaccccctctccgaatacaaccccgacgtcccctaaccccgatacacaccccccgccccaacgctacccctcgccgccgccaccaaccctaaacgcgacctccgaaactccccatcacacaaccgaacgcgacctcacccccccccgcccctcccgccgcaacctccaattacccgcgtcaccttccgaatccccgcctcccccgccgtccccacccccgcgccgcctaacccgaaaaaacgacgcgacccttccgaccgaaacgaaaccgaacctaaaacgctaaaacgaacgaacaaaacgaactcgccctaccgacgacgcgaccatactcatcacgctatactacctatacctataaacgcgctaaaatcgccgaccgactaaactcgtacgcgccacgatacgacgactacgtacctcgcgctattccttcaccttctacgacgcgaccgcgaaacccccgaacgcccgcgtatacctaaaccgtaacgaccgcgtcttctacgtcaacgacaaccaaataaacgaatcgaacgaacgaacgacccgaaccccgcgaaccgaaaatacccccgtccctacgcctcgtccccgccgaaaacccgaaaattcgaaaaccccgaaataacgccctcaatacgacctatacgacccgaaaaaaactattaccccgaaacccaaaaaaaaaccgaaaatacgaaactcgaaccacgaacccgatcgcctcttcccgaccaaccgaacgatactaaacgcgtaactctaaacgcgcacctataaaaacgtaaactataaattaacaaccgaacgccaacaatacccacctaaaatc

SEQ ID NO: 18875 - DNA, 942 bp, Artificial Sequence
  chemically treated genomic DNA (Homo sapiens) CpG-island No: 18875
taaataggtcgggtagttattggagttttttttttttcgtatttataatatatttattttattttttagttttggcgcggtttcgtatttcggtttttattttttcgagtttttttttcgggtgtagtttcggcgttttttgatttcggtgtatatttttcgttttagcgttgtttttcgtcgtcgttattagttttgggcgcggttttcggagttttttattatatagtcgggcgcggttttattttttttcgtttttttcgtcgtagtttttagttgttcgcgttatttttcgggttttcgtttttttcgtcgtttttattttcgcgtcgtttggttcgggggggcggcgcggttttttcggtcggggcggggtcgggtttggggcgttggggcgggcgggtaaggcgggttcgttttgtcggcggcgcggttatgtttattacgttgtgttatttgtatttgtgggcgcgttggggtcgtcggtcggttgagttcgtgcgcgttacggtgcggcggttgcgtgtttcgcgttgtttttttattttttgcggcgcggtcgcggagttttcgggcgttcgcgtgtgtttgagtcgtggcggtcgcgttttttgcgttagcgatagttaggtgggcgggtcgggcgggcgggcgattcgggtttcgcgagtcggaagtgttttcgtttttgcgtttcgttttcgtcgggagttcgggagttcgggagtttcggagtggcgtttttagtgcggtttgtgcggttcgggaggggttgttgtttcggggtttagagagaggtcggaggtgcgggattcggattacggattcggtcgttttttttcggttagtcgggcggtgttggacgcgtgattttaggcgcgtatttgtgaggacgtgagttgtggattgatagtcggacgttagtagtgtttatttggggtt

SEQ ID NO: 18876 - DNA, 942 bp, Artificial Sequence
  chemically treated genomic DNA (Homo sapiens) CpG-island No: 18876
aaccccaaataaacactactaacgtccgactatcaatccacaactcacgtcctcacaaatacgcgcctaaaatcacgcgtccaacaccgcccgactaaccgaaaaaaaacgaccgaatccgtaatccgaatcccgcacctccgacctctctctaaaccccgaaacaacaacccctcccgaaccgcacaaaccgcactaaaaacgccactccgaaactcccgaactcccgaactcccgacgaaaacgaaacgcaaaaacgaaaacacttccgactcgcgaaacccgaatcgcccgcccgcccgacccgcccacctaactatcgctaacgcaaaaaacgcgaccgccacgactcaaacacacgcgaacgcccgaaaactccgcgaccgcgccgcaaaaaataaaaaaacaacgcgaaacacgcaaccgccgcaccgtaacgcgcacgaactcaaccgaccgacgaccccaacgcgcccacaaatacaaataacacaacgtaataaacataaccgcgccgccgacaaaacgaacccgccttacccgcccgccccaacgccccaaacccgaccccgccccgaccgaaaaaaccgcgccgcccccccgaaccaaacgacgcgaaaataaaaacgacgaaaaaaacgaaaacccgaaaaataacgcgaacaactaaaaactacgacgaaaaaaacgaaaaaaaataaaaccgcgcccgactatataataaaaaactccgaaaaccgcgcccaaaactaataacgacgacgaaaaacaacgctaaaacgaaaaatatacaccgaaatcaaaaaacgccgaaactacacccgaaaaaaaaactcgaaaaaataaaaaccgaaatacgaaaccgcgccaaaactaaaaaataaaataaatatattataaatacgaaaaaaaaaaaactccaataactacccgacctattta

SEQ ID NO: 18877 - DNA, 849 bp, Artificial Sequence
  chemically treated genomic DNA (Homo sapiens) CpG-island No: 18877
gcgagtaggttttgcggttttgtttttaatatgggcgcggggtacgcggttaggggtcgtgggagggggatagggcgcgcgaatttaggtttttaggtcgcgtcgtcgcgcgtgcgtattgatagtcgggtcgagttagttcgggtttcgtagggaagaacgttagcggcgcgcggagtcgcgttgtttgggtcgcgaggtttttatggttgttttatcggaagtttcgtttttttttggtagttggaggcggtttttcggtcgtttcggttgtagtttcgaggtttcgatttaggagacggttgttttttggtagaggttcgcggtggattgtttgattttcgttcggttttagtacgttttcggcgaacgtttatttttgtttcggttcgtagcgtttcgatttatttttgaggtcgaaacgcggtcgtttttgcgtcgggtggtcgttcgcgaatttttgtcgcgtcgcgttgcgttttttcgtggttcgtttggtggtgtaattgggttttttgcgtagggtcgcggggtcgtttggtttttttttgttttggtcgcggtgtcgcgcgttcgggaacgcgggtttttcgtcgttagttagttttttttttcggttatttgttttttttcgtttacgttgtttgggaggcgcgtttttgtcgtttttttgatcgcgttcgttttagtttcgtttatttttgcggttttatagggtcgaattttattttgttttgcggaaggtaggtttatatttttttttcgcgtttttttttttgatcggtattaaatattacgttgttttttttagtatcgacgatttattttttagttttttgatattagttg

SEQ ID NO: 18878 - DNA, 849 bp, Artificial Sequence
  chemically treated genomic DNA (Homo sapiens) CpG-island No: 18878
caactaatatcaaaaaactaaaaaataaatcgtcgatactaaaaaaaacaacgtaatatttaataccgatcaaaaaaaaaaacgcgaaaaaaaaatataaacctaccttccgcaaaacaaaataaaattcgaccctataaaaccgcaaaaataaacgaaactaaaacgaacgcgatcaaaaaaacgacaaaaacgcgcctcccaaacaacgtaaacgaaaaaaaacaaataaccgaaaaaaaaaactaactaacgacgaaaaacccgcgttcccgaacgcgcgacaccgcgaccaaaacaaaaaaaaaccaaacgaccccgcgaccctacgcaaaaaacccaattacaccaccaaacgaaccacgaaaaaacgcaacgcgacgcgacaaaaattcgcgaacgaccacccgacgcaaaaacgaccgcgtttcgacctcaaaaataaatcgaaacgctacgaaccgaaacaaaaataaacgttcgccgaaaacgtactaaaaccgaacgaaaatcaaacaatccaccgcgaacctctaccaaaaaacaaccgtctcctaaatcgaaacctcgaaactacaaccgaaacgaccgaaaaaccgcctccaactaccaaaaaaaaacgaaacttccgataaaacaaccataaaaacctcgcgacccaaacaacgcgactccgcgcgccgctaacgttcttccctacgaaacccgaactaactcgacccgactatcaatacgcacgcgcgacgacgcgacctaaaaacctaaattcgcgcgccctatccccctcccacgacccctaaccgcgtaccccgcgcccatattaaaaacaaaaccgcaaaacctactcgc

SEQ ID NO: 18879 - DNA, 849 bp, Artificial Sequence
  chemically treated genomic DNA (Homo sapiens) CpG-island No: 18879
tagttggtgttagagaattggggaataggtcgtcgatgttggaaagggtaacgtggtgtttggtgtcggttagggaggaaggcgcggagggaaggtgtaggtttgtttttcgtagggtagggtgaggttcggttttgtaaggtcgtaggagtgggcgaggttagagcgagcgcggttaagaaggcggtagaagcgcgttttttaggtagcgtgggcgagagaggataggtggtcgagaggagaagttggttagcggcgaaaggttcgcgttttcgagcgcgcggtatcgcggttagggtaggaggaggttaggcggtttcgcggttttgcgtagagagtttagttgtattattaggcgggttacgagagggcgtagcgcggcgcggtagggattcgcgggcgattattcggcgtaggagcggtcgcgtttcggttttagaagtaagtcggggcgttgcgggtcgggataggggtgggcgttcgtcgggggcgtgttggggtcgggcgagggttaggtagtttatcgcgagtttttgttagggaatagtcgttttttgagtcgaggtttcggggttgtagtcgggacggtcggaaagtcgtttttagttgttagaagggggcggggttttcggtggggtagttatagggatttcgcggtttaggtagcgcggtttcgcgcgtcgttggcgtttttttttgcgggattcgggttggttcggttcggttgttagtgcgtacgcgcggcgacgcggtttgagaatttgggttcgcgcgttttgttttttttttacggtttttggtcgcgtgtttcgcgtttatgttaggggtagagtcgtagggtttattcgt

SEQ ID NO: 18880 - DNA, 849 bp, Artificial Sequence
  chemically treated genomic DNA (Homo sapiens) CpG-island No: 18880
acgaataaaccctacgactctacccctaacataaacgcgaaacacgcgaccaaaaaccgtaaaaaaaaaacaaaacgcgcgaacccaaattctcaaaccgcgtcgccgcgcgtacgcactaacaaccgaaccgaaccaacccgaatcccgcaaaaaaaaacgccaacgacgcgcgaaaccgcgctacctaaaccgcgaaatccctataactaccccaccgaaaaccccgcccccttctaacaactaaaaacgactttccgaccgtcccgactacaaccccgaaacctcgactcaaaaaacgactattccctaacaaaaactcgcgataaactacctaaccctcgcccgaccccaacacgcccccgacgaacgcccacccctatcccgacccgcaacgccccgacttacttctaaaaccgaaacgcgaccgctcctacgccgaataatcgcccgcgaatccctaccgcgccgcgctacgccctctcgtaacccgcctaataatacaactaaactctctacgcaaaaccgcgaaaccgcctaacctcctcctaccctaaccgcgataccgcgcgctcgaaaacgcgaacctttcgccgctaaccaacttctcctctcgaccacctatcctctctcgcccacgctacctaaaaaacgcgcttctaccgccttcttaaccgcgctcgctctaacctcgcccactcctacgaccttacaaaaccgaacctcaccctaccctacgaaaaacaaacctacaccttccctccgcgccttcctccctaaccgacaccaaacaccacgttaccctttccaacatcgacgacctattccccaattctctaacaccaacta

SEQ ID NO: 18881 - DNA, 693 bp, Artificial Sequence
  chemically treated genomic DNA (Homo sapiens) CpG-island No: 18881
ggcgttatttttttgagtttttttcgttttttttttattttcggttttttggttttttttcggaatttttttggtttttttcgttttttcgattcgggtttttttttcgtattttgcggtttttttcgtattttttacggagtttttcgggttttgtttttttttagcgtttgttcgcgtcgtttcgttttcgtttttaaatttggcgcgcgggtaggtgagcgcgttagttcgagtggatttaggcgcgttcgtaggtcggcgtcgtagtaaggggcgcgggtttcgtcggtattatggagttcgaagcggcggtcggagttcggaaggcgcgggggcgcggttgttattgtttcggggacgttttttggaggttttcgttatcgcgcgggtcggagaggtgagggtggtttcgcgtttcggtggacgcgttgagaggcgtgcgcggtggcggtgcggggagcgtagcgagcgggaggttggggcgttgttgaattttcgatttttagcggagtttcggagttcgacggcgacgttaagtaagtttttgagtcggtagtcgggttttcgggaggggcgtttagtttttcggttttaacgtatagttttgaagtgcggaggtttaggatgtagttggttaggaaaggggtcgacgttttcgtgtagaggagattttagttagttagtcgggga

SEQ ID NO: 18882 - DNA, 693 bp, Artificial Sequence
  chemically treated genomic DNA (Homo sapiens) CpG-island No: 18882
tccccgactaactaactaaaatctcctctacacgaaaacgtcgacccctttcctaaccaactacatcctaaacctccgcacttcaaaactatacgttaaaaccgaaaaactaaacgcccctcccgaaaacccgactaccgactcaaaaacttacttaacgtcgccgtcgaactccgaaactccgctaaaaatcgaaaattcaacaacgccccaacctcccgctcgctacgctccccgcaccgccaccgcgcacgcctctcaacgcgtccaccgaaacgcgaaaccaccctcacctctccgacccgcgcgataacgaaaacctccaaaaaacgtccccgaaacaataacaaccgcgcccccgcgccttccgaactccgaccgccgcttcgaactccataataccgacgaaacccgcgccccttactacgacgccgacctacgaacgcgcctaaatccactcgaactaacgcgctcacctacccgcgcgccaaatttaaaaacgaaaacgaaacgacgcgaacaaacgctaaaaaaaaacaaaacccgaaaaactccgtaaaaaatacgaaaaaaaccgcaaaatacgaaaaaaaaacccgaatcgaaaaaacgaaaaaaaccaaaaaaattccgaaaaaaaaccaaaaaaccgaaaataaaaaaaaaacgaaaaaaactcaaaaaaataacgcc

SEQ ID NO: 18883 - DNA, 693 bp, Artificial Sequence
  chemically treated genomic DNA (Homo sapiens) CpG-island No: 18883
ttttcggttggttaattgagattttttttatacggaagcgtcggttttttttttggttagttatattttgggttttcgtattttagagttgtgcgttggaatcggagaattgagcgtttttttcgggaattcggttgtcggtttaggagtttgtttggcgtcgtcgtcgagtttcggagtttcgttggggatcgggggtttagtagcgttttagtttttcgttcgttgcgtttttcgtatcgttatcgcgtacgttttttagcgcgtttatcggggcgcggggttatttttattttttcggttcgcgcggtggcggaggtttttagggagcgttttcggggtagtgatagtcgcgttttcgcgtttttcgggtttcggtcgtcgtttcgggttttatggtgtcggcggagttcgcgttttttgttgcggcgtcggtttacgagcgcgtttagatttattcgggttaacgcgtttatttattcgcgcgttaggtttaaaaacgggggcggggcggcgcgggtaagcgttgggagggggtaggattcgaggagtttcgtgaggggtgcggagggggtcgtagggtacgaaggaaaagttcgggtcggaggagcggaggggattagagaagtttcgggaggggattagggagtcggggatggggaggagacgagaaaagtttaaggaggtggcgtt

SEQ ID NO: 18884 - DNA, 693 bp, Artificial Sequence
  chemically treated genomic DNA (Homo sapiens) CpG-island No: 18884
aacgccacctccttaaacttttctcgtctcctccccatccccgactccctaatcccctcccgaaacttctctaatcccctccgctcctccgacccgaacttttccttcgtaccctacgaccccctccgcacccctcacgaaactcctcgaatcctaccccctcccaacgcttacccgcgccgccccgcccccgtttttaaacctaacgcgcgaataaataaacgcgttaacccgaataaatctaaacgcgctcgtaaaccgacgccgcaacaaaaaacgcgaactccgccgacaccataaaacccgaaacgacgaccgaaacccgaaaaacgcgaaaacgcgactatcactaccccgaaaacgctccctaaaaacctccgccaccgcgcgaaccgaaaaaataaaaataaccccgcgccccgataaacgcgctaaaaaacgtacgcgataacgatacgaaaaacgcaacgaacgaaaaactaaaacgctactaaacccccgatccccaacgaaactccgaaactcgacgacgacgccaaacaaactcctaaaccgacaaccgaattcccgaaaaaaacgctcaattctccgattccaacgcacaactctaaaatacgaaaacccaaaatataactaaccaaaaaaaaaaccgacgcttccgtataaaaaaaatctcaattaaccaaccgaaaa

SEQ ID NO: 18885 - DNA, 651 bp, Artificial Sequence
  chemically treated genomic DNA (Homo sapiens) CpG-island No: 18885
ggttcgcgcggcgtttattagtatgcgggtttattaggtcgcggcgtttaggtttcgggttttgtttattcgtggagatttttattttttattcgaggcggggtatgggggggttttcgatttcgggttttttatacgtttatttaggtttttttcgatatttcggttattttagcgttgagtttttcgcgtaagcgtcgattggggagtcgtagtggggaagaggaaaatttgagggaaaggtttaggcgcgacggtaatttttattttggcgtaggcgtataacgatttttttcgggtgggagttagcgagcgcgggggcgggcgtgatttcgcggttcgcgacggcgaaggagggggcggtggggtgcgattgcgtacgcgcgttgttagtttacgtgacgtatttcgttttaacgtcgttattcgttttttttcgtcgtcggttgacgtggagggtcggaggtggcggcggcggcggcggcggttgttgttgttgttgttcgcgttcgaggttcgcgggcggcgggttcgggtgagtgtatattcggcgcgttgtcgggttttcggatgtgttattttgtttcgttgtagtcgagatgtcgggggagcggggttttttatatttttttcgtgggtgtgtggtgagtg

SEQ ID NO: 18886 - DNA, 651 bp, Artificial Sequence
  chemically treated genomic DNA (Homo sapiens) CpG-island No: 18886
cactcaccacacacccacgaaaaaaatataaaaaaccccgctcccccgacatctcgactacaacgaaacaaaataacacatccgaaaacccgacaacgcgccgaatatacactcacccgaacccgccgcccgcgaacctcgaacgcgaacaacaacaacaacaaccgccgccgccgccgccgccacctccgaccctccacgtcaaccgacgacgaaaaaaaacgaataacgacgttaaaacgaaatacgtcacgtaaactaacaacgcgcgtacgcaatcgcaccccaccgccccctccttcgccgtcgcgaaccgcgaaatcacgcccgcccccgcgctcgctaactcccacccgaaaaaaatcgttatacgcctacgccaaaataaaaattaccgtcgcgcctaaacctttccctcaaattttcctcttccccactacgactccccaatcgacgcttacgcgaaaaactcaacgctaaaataaccgaaatatcgaaaaaaacctaaataaacgtataaaaaacccgaaatcgaaaacccccccataccccgcctcgaataaaaaataaaaatctccacgaataaacaaaacccgaaacctaaacgccgcgacctaataaacccgcatactaataaacgccgcgcgaacc

SEQ ID NO: 18887 - DNA, 651 bp, Artificial Sequence
  chemically treated genomic DNA (Homo sapiens) CpG-island No: 18887
tatttattatatatttacggagggggtgtggaaggtttcgttttttcggtatttcggttgtagcgggataaggtgatatattcgggagttcggtagcgcgtcgggtgtgtatttattcgggttcgtcgttcgcgagtttcggacgcgggtagtagtagtagtagtcgtcgtcgtcgtcgtcgttattttcggttttttacgttagtcgacggcgggagggagcgggtggcggcgttgaagcgaggtgcgttacgtgggttggtagcgcgcgtgcgtagtcgtattttatcgttttttttttcgtcgtcgcgagtcgcgggattacgttcgttttcgcgttcgttggtttttattcggggagggtcgttgtgcgtttgcgttagggtgggggttgtcgtcgcgtttaggttttttttttaggttttttttttttttattgcggttttttagtcggcgtttgcgcggagaatttagcgttgaggtggtcgaggtgtcgggaggggtttgggtgggcgtatgaaggattcgaggtcgagggtttttttatatttcgtttcgaatgagaaatagaagtttttacgaatgggtagggttcggggtttgggcgtcgcgatttagtaggttcgtatgttggtgggcgtcgcgcgagtt

SEQ ID NO: 18888 - DNA, 651 bp, Artificial Sequence
  chemically treated genomic DNA (Homo sapiens) CpG-island No: 18888
aactcgcgcgacgcccaccaacatacgaacctactaaatcgcgacgcccaaaccccgaaccctacccattcgtaaaaacttctatttctcattcgaaacgaaatataaaaaaaccctcgacctcgaatccttcatacgcccacccaaacccctcccgacacctcgaccacctcaacgctaaattctccgcgcaaacgccgactaaaaaaccgcaataaaaaaaaaaaaaacctaaaaaaaaaacctaaacgcgacgacaacccccaccctaacgcaaacgcacaacgaccctccccgaataaaaaccaacgaacgcgaaaacgaacgtaatcccgcgactcgcgacgacgaaaaaaaaaacgataaaatacgactacgcacgcgcgctaccaacccacgtaacgcacctcgcttcaacgccgccacccgctccctcccgccgtcgactaacgtaaaaaaccgaaaataacgacgacgacgacgacgactactactactactacccgcgtccgaaactcgcgaacgacgaacccgaataaatacacacccgacgcgctaccgaactcccgaatatatcaccttatcccgctacaaccgaaataccgaaaaaacgaaaccttccacaccccctccgtaaatatataataaata

SEQ ID NO: 18889 - DNA, 876 bp, Artificial Sequence
  chemically treated genomic DNA (Homo sapiens) CpG-island No: 18889
gcggtgaggcgcgaacgtcgcgaagtttatagttaaagtttcgttgataaattaagagatgatttcgtatttaaaattttttcgaataggaacgcgttagaggtcggaagttacgttacgtgattagttttttttcgcggttatttttagcgaggtagtaggtatcgtttttgttatattttttagtttttaaagcgcgggattaggcggaaacgtgcgataggaggcggttttatttagttttggattggagtgttagtagaattttcgttttttttagtaacgttttgtaagttttttatcgtaaagaattgtcgtagattttcgtttgggtgttaattacgtgattacgcgagcgttggagaggcgtaggttcgattttattattttatttttcgggtttcgttagtttagtattcgttacggcgcgtgataacgcggttcgtcggcggttttcgtttcggcgcgtttgcgtacgcggttttcgcggtgtttcgcgtttattttcgtttatttttgttttcgtttttttcgtttttttttttttttttattttgtttttcggcggcggcggcggcggcggtggtggttcgcgtacgttgttggttcgttatataaaggagagaagcgggcggatcggacggttggagttgtagtcggtggcggtagcggcggcgtagggagcggtgatcggtggtggtttttttttttggcgcggggtggggagcgggtaacgtttttcggatttttgaagggtcgtggttttttttttttttttaaggcgattttcgaggtttttagttgcgggaggagtgtttttttttttttttttttttcgtttttttttatttttttaggattgattttgtttaaaat

SEQ ID NO: 18890 - DNA, 876 bp, Artificial Sequence
  chemically treated genomic DNA (Homo sapiens) CpG-island No: 18890
attttaaacaaaatcaatcctaaaaaaataaaaaaaaacgaaaaaaaaaaaaaaaaaaaaacactcctcccgcaactaaaaacctcgaaaatcgccttaaaaaaaaaaaaaaaaccacgacccttcaaaaatccgaaaaacgttacccgctccccaccccgcgccaaaaaaaaaaaccaccaccgatcaccgctccctacgccgccgctaccgccaccgactacaactccaaccgtccgatccgcccgcttctctcctttatataacgaaccaacaacgtacgcgaaccaccaccgccgccgccgccgccgccgaaaaacaaaataaaaaaaaaaaaaaaaacgaaaaaaacgaaaacaaaaataaacgaaaataaacgcgaaacaccgcgaaaaccgcgtacgcaaacgcgccgaaacgaaaaccgccgacgaaccgcgttatcacgcgccgtaacgaatactaaactaacgaaacccgaaaaataaaataataaaatcgaacctacgcctctccaacgctcgcgtaatcacgtaattaacacccaaacgaaaatctacgacaattctttacgataaaaaacttacaaaacgttactaaaaaaaacgaaaattctactaacactccaatccaaaactaaataaaaccgcctcctatcgcacgtttccgcctaatcccgcgctttaaaaactaaaaaatataacaaaaacgatacctactacctcgctaaaaataaccgcgaaaaaaaactaatcacgtaacgtaacttccgacctctaacgcgttcctattcgaaaaaattttaaatacgaaatcatctcttaatttatcaacgaaactttaactataaacttcgcgacgttcgcgcctcaccgc

SEQ ID NO: 18891 - DNA, 876 bp, Artificial Sequence
  chemically treated genomic DNA (Homo sapiens) CpG-island No: 18891
attttaaataaaattaattttgaaggagtaggggagagcggagagaggaggaggaggggggtatttttttcgtagttgaaaatttcgagaatcgttttaaaaaaaaaaaaaaagttacgattttttaggggttcggggggcgttgttcgttttttatttcgcgttaaggagggaaattattatcggttatcgttttttgcgtcgtcgttgtcgttatcggttgtagttttagtcgttcggttcgttcgttttttttttttatatagcgagttaataacgtgcgcgagttattatcgtcgtcgtcgtcgtcgtcgagagatagggtgaagggggagggaggggcggaaagggcgggggtagaggtgggcggaaatgagcgcgagatatcgcgagagtcgcgtgcgtaggcgcgtcggggcggaggtcgtcggcgagtcgcgttgttacgcgtcgtggcgggtattggattggcggagttcggggagtgaagtagtgaaatcggatttacgtttttttaacgttcgcgtgattacgtggttggtatttaggcggaagtttgcggtagttttttgcggtgaagaatttgtaaagcgttgttggaaaagacgggagttttattgatattttagtttaaagttaggtgggatcgttttttgtcgtacgttttcgtttggtttcgcgttttaggagttaggaaatgtgatagaggcggtgtttattgtttcgttaggaatggtcgcggaggaggattggttacgtggcgtggttttcggtttttggcgcgtttttattcgggaaggttttaaatgcggagttattttttgatttgttagcgaggttttgattgtgagtttcgcggcgttcgcgttttatcgt

SEQ ID NO: 18892 - DNA, 876 bp, Artificial Sequence
  chemically treated genomic DNA (Homo sapiens) CpG-island No: 18892
acgataaaacgcgaacgccgcgaaactcacaatcaaaacctcgctaacaaatcaaaaaataactccgcatttaaaaccttcccgaataaaaacgcgccaaaaaccgaaaaccacgccacgtaaccaatcctcctccgcgaccattcctaacgaaacaataaacaccgcctctatcacatttcctaactcctaaaacgcgaaaccaaacgaaaacgtacgacaaaaaacgatcccacctaactttaaactaaaatatcaataaaactcccgtcttttccaacaacgctttacaaattcttcaccgcaaaaaactaccgcaaacttccgcctaaataccaaccacgtaatcacgcgaacgttaaaaaaacgtaaatccgatttcactacttcactccccgaactccgccaatccaatacccgccacgacgcgtaacaacgcgactcgccgacgacctccgccccgacgcgcctacgcacgcgactctcgcgatatctcgcgctcatttccgcccacctctacccccgccctttccgcccctccctcccccttcaccctatctctcgacgacgacgacgacgacgataataactcgcgcacgttattaactcgctatataaaaaaaaaaaacgaacgaaccgaacgactaaaactacaaccgataacgacaacgacgacgcaaaaaacgataaccgataataatttccctccttaacgcgaaataaaaaacgaacaacgccccccgaacccctaaaaaatcgtaactttttttttttttttaaaacgattctcgaaattttcaactacgaaaaaaatacccccctcctcctcctctctccgctctcccctactccttcaaaattaattttatttaaaat

SEQ ID NO: 18893 - DNA, 822 bp, Artificial Sequence
  chemically treated genomic DNA (Homo sapiens) CpG-island No: 18893
gtagatgcggcggcggcgtttgttttggggttttttcgtagggtagttagtttcgcgcgggaagtatttggcggggacgtatttggcgggaacgtatttattttggcggagacgtatttggcgggatagttttgtttcgtttagggacgcgggacgtgcgtagagcgatggagatagcggaatttgtagattcgtttaattttatttttatttttatttttagtttttatttatttcggcgtgataaattttattcgtttttttaattttgatgtttagggcggtttttatttttaatttttcgtagtagtcgttattttcggttgcgcgtgattttagggaaataaggggcgttttttcgtttcgttttgggtttcgtttttttttttttttgtcggtagtggtttacgtgatttcgtagcggcgtcgtatatattttttagtttcgaggggcgaatgtttacgttttttttttttcggtataagagtcggttttagtgcgggtcgaagcgttgttacggtttatttcgttttttttgggcgtgaaagacggggttaagttagttttatttttttcgtagggatagttttacgtcggaaatgtttttttgttgttcgggttagcggagggagggaggaacggtttttttcgcgtgtttcgcggttggaggcggagtcgagtttgtttgtcggttgtagtttgcgtaggaaggatgacgttttcgttaggttgtgcggcgtagacggtcgtttaatggagttgttttttaggaggttttaatttggtaatgtttgttttttttaaatgtttttagttttttt

SEQ ID NO: 18894 - DNA, 822 bp, Artificial Sequence
  chemically treated genomic DNA (Homo sapiens) CpG-island No: 18894
aaaaaaactaaaaacatttaaaaaaaacaaacattaccaaattaaaacctcctaaaaaacaactccattaaacgaccgtctacgccgcacaacctaacgaaaacgtcatccttcctacgcaaactacaaccgacaaacaaactcgactccgcctccaaccgcgaaacacgcgaaaaaaaccgttcctccctccctccgctaacccgaacaacaaaaaaacatttccgacgtaaaactatccctacgaaaaaaataaaactaacttaaccccgtctttcacgcccaaaaaaaacgaaataaaccgtaacaacgcttcgacccgcactaaaaccgactcttataccgaaaaaaaaaaaacgtaaacattcgcccctcgaaactaaaaaatatatacgacgccgctacgaaatcacgtaaaccactaccgacaaaaaaaaaaaaaaacgaaacccaaaacgaaacgaaaaaacgccccttatttccctaaaatcacgcgcaaccgaaaataacgactactacgaaaaattaaaaataaaaaccgccctaaacatcaaaattaaaaaaacgaataaaatttatcacgccgaaataaataaaaactaaaaataaaaataaaaataaaattaaacgaatctacaaattccgctatctccatcgctctacgcacgtcccgcgtccctaaacgaaacaaaactatcccgccaaatacgtctccgccaaaataaatacgttcccgccaaatacgtccccgccaaatacttcccgcgcgaaactaactaccctacgaaaaaaccccaaaacaaacgccgccgccgcatctac

SEQ ID NO: 18895 - DNA, 822 bp, Artificial Sequence
  chemically treated genomic DNA (Homo sapiens) CpG-island No: 18895
gaggagattaaggatatttgaggagggtaggtattattaagttaaaattttttgaaagataattttattgggcgatcgtttgcgtcgtatagtttgacgggagcgttattttttttgcgtaggttgtaatcgatagataggttcggtttcgtttttagtcgcggggtacgcggggagagtcgttttttttttttttcgttaattcggatagtaaaggagtattttcggcgtaagattgtttttacggaaggggtggggttagtttggtttcgttttttacgtttagagggggcggggtgaatcgtgatagcgtttcggttcgtattaaggtcggtttttgtgtcggaaggaggaaggcgtgggtattcgtttttcggagttagggagtgtgtgcgacgtcgttgcgaggttacgtgagttattgtcggtagagagggaaaggggcggggtttagaacgaagcggggaggcgttttttgtttttttggggttacgcgtagtcggaagtggcggttgttgcggagaattggagatggggatcgttttggatattaagattaaaagagcgaataaagtttattacgtcggggtaagtgggggttgggggtggggatggaggtggggttgggcgggtttgtaggtttcgttgtttttatcgttttgcgtacgtttcgcgtttttaggcggggtagggttgtttcgttaggtgcgttttcgttaaggtgggtgcgttttcgttaggtgcgttttcgttaggtgtttttcgcgcgaggttggttgttttgcgaggaggttttagggtaggcgtcgtcgtcgtatttgt

SEQ ID NO: 18896 - DNA, 822 bp, Artificial Sequence
  chemically treated genomic DNA (Homo sapiens) CpG-island No: 18896
acaaatacgacgacgacgcctaccctaaaacctcctcgcaaaacaaccaacctcgcgcgaaaaacacctaacgaaaacgcacctaacgaaaacgcacccaccttaacgaaaacgcacctaacgaaacaaccctaccccgcctaaaaacgcgaaacgtacgcaaaacgataaaaacaacgaaacctacaaacccgcccaaccccacctccatccccacccccaacccccacttaccccgacgtaataaactttattcgctcttttaatcttaatatccaaaacgatccccatctccaattctccgcaacaaccgccacttccgactacgcgtaaccccaaaaaaacaaaaaacgcctccccgcttcgttctaaaccccgcccctttccctctctaccgacaataactcacgtaacctcgcaacgacgtcgcacacactccctaactccgaaaaacgaatacccacgccttcctccttccgacacaaaaaccgaccttaatacgaaccgaaacgctatcacgattcaccccgccccctctaaacgtaaaaaacgaaaccaaactaaccccaccccttccgtaaaaacaatcttacgccgaaaatactcctttactatccgaattaacgaaaaaaaaaaaaaacgactctccccgcgtaccccgcgactaaaaacgaaaccgaacctatctatcgattacaacctacgcaaaaaaaataacgctcccgtcaaactatacgacgcaaacgatcgcccaataaaattatctttcaaaaaattttaacttaataatacctaccctcctcaaatatccttaatctcctc

SEQ ID NO: 18897 - DNA, 741 bp, Artificial Sequence
  chemically treated genomic DNA (Homo sapiens) CpG-island No: 18897
cgttataaaatttgggcggttcgatcggagttaggtgttagttttagggtcgtcgggttcggcgtagcgttcggaatttttgcgatgtttggggcgcggcggtggttttttttcgtttttattacggttttcgtcggtatttttcggttaggaggttcgttagtttttcgaagaatcggttttacgcgcggacggtcgcggtcgtcgcgtttttcggggagagaggcgagcgcggcgttcggatcgcggtgagagttttttaggttcgggcgcgcggggtgggtttttcgggttttcgttcgaaggtcgcggcgtttttttttttttttttttttcgttcggggtagttcgttttttttttcggcgcgggcggggttgcgggcgtcgacgcggaagcgcggggcgttagggttgcgggggcggcggcgcgggaggtcgcgcgcgtttttcgggtcgtagtcggcgcgggcgcggggcggggcggggcggtcgggaggcggcgggcgatcgcgtataggtttggtcgtcgtttcgtttttttttttttagtttttattttttttcggtttagtcgtttttttttttttttttttttcgggcgaattacgcgtttttttttgatattcgtagcggattcgagtttcgaatttattttttacgtgatttgagggggttgggtggttggttggggatagagggggagacggaaaggagggaacggaatttgtcgttatttgagta

SEQ ID NO: 18898 - DNA, 741 bp, Artificial Sequence
  chemically treated genomic DNA (Homo sapiens) CpG-island No: 18898
tactcaaataacgacaaattccgttccctcctttccgtctccccctctatccccaaccaaccacccaaccccctcaaatcacgtaaaaaataaattcgaaactcgaatccgctacgaatatcaaaaaaaaacgcgtaattcgcccgaaaaaaaaaaaaaaaaaaaaacgactaaaccgaaaaaaaataaaaactaaaaaaaaaaaaacgaaacgacgaccaaacctatacgcgatcgcccgccgcctcccgaccgccccgccccgccccgcgcccgcgccgactacgacccgaaaaacgcgcgcgacctcccgcgccgccgcccccgcaaccctaacgccccgcgcttccgcgtcgacgcccgcaaccccgcccgcgccgaaaaaaaaaacgaactaccccgaacgaaaaaaaaaaaaaaaaaaaaacgccgcgaccttcgaacgaaaacccgaaaaacccaccccgcgcgcccgaacctaaaaaactctcaccgcgatccgaacgccgcgctcgcctctctccccgaaaaacgcgacgaccgcgaccgtccgcgcgtaaaaccgattcttcgaaaaactaacgaacctcctaaccgaaaaataccgacgaaaaccgtaataaaaacgaaaaaaaaccaccgccgcgccccaaacatcgcaaaaattccgaacgctacgccgaacccgacgaccctaaaactaacacctaactccgatcgaaccgcccaaattttataacg

SEQ ID NO: 18899 - DNA, 741 bp, Artificial Sequence
  chemically treated genomic DNA (Homo sapiens) CpG-island No: 18899
tgtttaggtaacggtagatttcgttttttttttttcgtttttttttttgtttttagttaattatttaatttttttaggttacgtgaaggataaattcggagttcgggttcgttacgagtgttagaggagggcgcgtgattcgttcgggggaggggagaggagggggacggttaggtcgagggagggtaggggttggggaagggggggcgaggcggcggttaggtttgtgcgcgatcgttcgtcgtttttcggtcgtttcgtttcgtttcgcgttcgcgtcgattgcggttcggggagcgcgcgcggtttttcgcgtcgtcgttttcgtagttttagcgtttcgcgttttcgcgtcggcgttcgtagtttcgttcgcgtcggggggaggggcgggttgtttcgggcgggggagggggaggaggaggggcgtcgcggttttcgggcggggattcgggaagtttatttcgcgcgttcgggtttggagggtttttatcgcggttcgggcgtcgcgttcgttttttttttcgggaagcgcggcggtcgcgatcgttcgcgcgtggagtcggtttttcgaagggttggcgggttttttagtcggaaaatgtcggcggaggtcgtggtgggggcggggaggagttatcgtcgcgttttagatatcgtaggaatttcggacgttgcgtcgggttcggcggttttgaggttggtatttggtttcggtcgggtcgtttaggttttgtggcg

SEQ ID NO: 18900 - DNA, 741 bp, Artificial Sequence
  chemically treated genomic DNA (Homo sapiens) CpG-island No: 18900
cgccacaaaacctaaacgacccgaccgaaaccaaataccaacctcaaaaccgccgaacccgacgcaacgtccgaaattcctacgatatctaaaacgcgacgataactcctccccgcccccaccacgacctccgccgacattttccgactaaaaaacccgccaacccttcgaaaaaccgactccacgcgcgaacgatcgcgaccgccgcgcttcccgaaaaaaaaaacgaacgcgacgcccgaaccgcgataaaaaccctccaaacccgaacgcgcgaaataaacttcccgaatccccgcccgaaaaccgcgacgcccctcctcctccccctcccccgcccgaaacaacccgcccctccccccgacgcgaacgaaactacgaacgccgacgcgaaaacgcgaaacgctaaaactacgaaaacgacgacgcgaaaaaccgcgcgcgctccccgaaccgcaatcgacgcgaacgcgaaacgaaacgaaacgaccgaaaaacgacgaacgatcgcgcacaaacctaaccgccgcctcgcccccccttccccaacccctaccctccctcgacctaaccgtccccctcctctcccctcccccgaacgaatcacgcgccctcctctaacactcgtaacgaacccgaactccgaatttatccttcacgtaacctaaaaaaattaaataattaactaaaaacaaaaaaaaaaacgaaaaaaaaaaaacgaaatctaccgttacctaaaca

SEQ ID NO: 18901 - DNA, 1084 bp, Artificial Sequence
  chemically treated genomic DNA (Homo sapiens) CpG-island No: 18901
ggggtggcggcggtaatcgcggcgggggtattcggggagattgttgttgtcgttgttgttgatcgcggtttaggtcggttttagagagcggatatttcgagcggggggtgcgggcgtcgtcgtcgtcgtttttgttgttgttgtttttgttgttgttgttggtgtcgttgtcgtcgtcggcgagtaggcgggatcggtgtgagtgcgagtgtgtgtgcgagggagcgtgtgcgagggcgattgtgcgcgcgagtgtgcgggtgtgtgcgagtgtttgtttgtttgtgcggggattcgggggcgggcggttcgggtttttttggcggaggagtcgtcgtcgtcgttcgggtttcggcgtttttcgttgcgtaggttcggagcgcgcgttattttgtgagatttataaaatttttttcgggaagaagtcgtcggtagtagtcgtcgttcggcgttcggtttcgtcgacgtcgttttttgcgtcgggtcggtcgtgcggtttcgtcgtttggaatcggggttcggggattgcggtatttgtcggggagggggttgtcgttttttcggtttcgggcgtcgttggaatcgcgagtcgaggagagattgagtaggttgcggcgcggttaggagtcggagcgtcgggggcggagagaggttgtcggggcggcgttggttgcggaggtcgcggcgggagcgcggcgcgggagttcgaggttgagatttatcggaggaagcggcgcgagcgtttcgttatcgtttcggtgagtgttcggttcggtcgcggtttcgttcggtttggcgttcggttttttcggcggttcgtagtcgggtcggagtcgaggtcggtcgggcggagggagggatttgttattttaggaggaggcgtcgcgggtttagggtcggtcgtcgggggagggagttttaggtcgggtttcggaggagcggcgggcgcgagcggagggaaagttgcggagggtgggagcgggggtcgcggtttttcgggagtcggggtttggggggtcgtagatagcgttagatttttattggtcgttcgagcgaaggggtggaggttgtttttttttttttt

SEQ ID NO: 18902 - DNA, 1084 bp, Artificial Sequence
  chemically treated genomic DNA (Homo sapiens) CpG-island No: 18902
aaaaaaaaaaaaaacaacctccaccccttcgctcgaacgaccaataaaaatctaacgctatctacgaccccccaaaccccgactcccgaaaaaccgcgacccccgctcccaccctccgcaactttccctccgctcgcgcccgccgctcctccgaaacccgacctaaaactccctcccccgacgaccgaccctaaacccgcgacgcctcctcctaaaataacaaatccctccctccgcccgaccgacctcgactccgacccgactacgaaccgccgaaaaaaccgaacgccaaaccgaacgaaaccgcgaccgaaccgaacactcaccgaaacgataacgaaacgctcgcgccgcttcctccgataaatctcaacctcgaactcccgcgccgcgctcccgccgcgacctccgcaaccaacgccgccccgacaacctctctccgcccccgacgctccgactcctaaccgcgccgcaacctactcaatctctcctcgactcgcgattccaacgacgcccgaaaccgaaaaaacgacaaccccctccccgacaaataccgcaatccccgaaccccgattccaaacgacgaaaccgcacgaccgacccgacgcaaaaaacgacgtcgacgaaaccgaacgccgaacgacgactactaccgacgacttcttcccgaaaaaaattttataaatctcacaaaataacgcgcgctccgaacctacgcaacgaaaaacgccgaaacccgaacgacgacgacgactcctccgccaaaaaaacccgaaccgcccgcccccgaatccccgcacaaacaaacaaacactcgcacacacccgcacactcgcgcgcacaatcgccctcgcacacgctccctcgcacacacactcgcactcacaccgatcccgcctactcgccgacgacgacaacgacaccaacaacaacaacaaaaacaacaacaacaaaaacgacgacgacgacgcccgcaccccccgctcgaaatatccgctctctaaaaccgacctaaaccgcgatcaacaacaacgacaacaacaatctccccgaatacccccgccgcgattaccgccgccacccc

SEQ ID NO: 18903 - DNA, 1084 bp, Artificial Sequence
  chemically treated genomic DNA (Homo sapiens) CpG-island No: 18903
gaggaggaggaagataatttttattttttcgttcgggcggttagtgaaggtttggcgttgtttacggttttttaggtttcggttttcgggaggtcgcggttttcgtttttatttttcgtaatttttttttcgttcgcgttcgtcgttttttcgggattcggtttgaggttttttttttcggcggtcggttttgggttcgcggcgtttttttttaaaatggtaggttttttttttcgttcggtcggtttcggtttcggttcggttgcgggtcgtcgggggagtcgagcgttaggtcgggcggggtcgcggtcgggtcggatatttatcgggacgatggcggggcgttcgcgtcgtttttttcggtgagttttagtttcgggttttcgcgtcgcgttttcgtcgcggttttcgtagttagcgtcgtttcggtagttttttttcgttttcggcgtttcggtttttggtcgcgtcgtagtttgtttagttttttttcggttcgcggttttagcggcgttcggggtcggggaggcgatagtttttttttcggtaaatatcgtagttttcgggtttcgattttaggcggcggggtcgtacggtcggttcggcgtagagggcggcgtcggcgaggtcgggcgtcgagcggcggttgttgtcggcggttttttttcgaggaggattttgtaaattttataaaatggcgcgcgtttcgaatttgcgtagcgagaagcgtcggggttcgggcggcggcggcggttttttcgttaggagagttcgaatcgttcgttttcgagttttcgtatagatagatagatattcgtatatattcgtatattcgcgcgtataatcgttttcgtatacgttttttcgtatatatattcgtatttatatcggtttcgtttgttcgtcggcggcggtagcggtattaatagtagtagtaggaatagtagtagtagaagcggcggcggcggcgttcgtatttttcgttcggggtgttcgttttttgaggtcgatttgggtcgcgattagtagtagcgatagtagtagttttttcggatattttcgtcgcggttgtcgtcgttatttt

SEQ ID NO: 18904 - DNA, 1084 bp, Artificial Sequence
  chemically treated genomic DNA (Homo sapiens) CpG-island No: 18904
aaaataacgacgacaaccgcgacgaaaatatccgaaaaaactactactatcgctactactaatcgcgacccaaatcgacctcaaaaaacgaacaccccgaacgaaaaatacgaacgccgccgccgccgcttctactactactattcctactactactattaataccgctaccgccgccgacgaacaaacgaaaccgatataaatacgaatatatatacgaaaaaacgtatacgaaaacgattatacgcgcgaatatacgaatatatacgaatatctatctatctatacgaaaactcgaaaacgaacgattcgaactctcctaacgaaaaaaccgccgccgccgcccgaaccccgacgcttctcgctacgcaaattcgaaacgcgcgccattttataaaatttacaaaatcctcctcgaaaaaaaaccgccgacaacaaccgccgctcgacgcccgacctcgccgacgccgccctctacgccgaaccgaccgtacgaccccgccgcctaaaatcgaaacccgaaaactacgatatttaccgaaaaaaaaactatcgcctccccgaccccgaacgccgctaaaaccgcgaaccgaaaaaaaactaaacaaactacgacgcgaccaaaaaccgaaacgccgaaaacgaaaaaaaactaccgaaacgacgctaactacgaaaaccgcgacgaaaacgcgacgcgaaaacccgaaactaaaactcaccgaaaaaaacgacgcgaacgccccgccatcgtcccgataaatatccgacccgaccgcgaccccgcccgacctaacgctcgactcccccgacgacccgcaaccgaaccgaaaccgaaaccgaccgaacgaaaaaaaaaacctaccattttaaaaaaaaacgccgcgaacccaaaaccgaccgccgaaaaaaaaaacctcaaaccgaatcccgaaaaaacgacgaacgcgaacgaaaaaaaaattacgaaaaataaaaacgaaaaccgcgacctcccgaaaaccgaaacctaaaaaaccgtaaacaacgccaaaccttcactaaccgcccgaacgaaaaaataaaaattatcttcctcctcctc

SEQ ID NO: 18905 - DNA, 962 bp, Artificial Sequence
  chemically treated genomic DNA (Homo sapiens) CpG-island No: 18905
atggcgcgcgcgaagagcgagggcggcgttaggttcgttagttattggaatttgtttttatttagtagtcgttgttagcgcggtcggtcgtttagtagtttttggcgggtcgagtcggcggtatttacgggggtgtatagcgttaggaggtttagtagtagtaggcggcgttggcgcggtttttcgggagttgaggcgggggtttcggcggcggagggagtggtttcggcgtcgcggtttagttggcgtagtagtagttcgagaggcgtgaggtcgtcgtcgtttcgtagatcgggcgaggcgtcgtggtttagtagtaggaagaggtattcggggcgcgttagtttataggttacgtgtagcgacgtgttatcgttttttacgcggttgtagttacgtcggtttagtacgcgcgttcgtttttcggtcgggaagtcgcgtaaggtgcgtaggatgcggcgtagaatgtttacgcggttgtagcgtattgttagcgttacgtgcggttcgggagtcgcgtagtagcggaagtcggtattgggcggtgcgagcgcgcgtcgcgggaacgtggttagtaggtaatgcgcgtacgtttggtggtcgtgtacgagcgcgtagagtagcgttttagagggcgagtaggcggcggcgcgttcgcgttcgttttagtggaaggtttcgttggcgcgtatattttttagtagttatacgggtagtaggtcgcgtatcgtttggtagaaggcgaacgacgatttgcggtattgtttttgcgttcgcgagcgcgtcgcgttcgaggtttcgggttcgtcgttcgcgttatttttaggtcgtcgcgcgttttacggtatgttggcggcggggcgtttttgggttttaaggtatggatttcgcgaaggtatatttgcggggaaaggaagaggttacggtgaggcgcggggaaattggggaggttcggggatttt

SEQ ID NO: 18906 - DNA, 962 bp, Artificial Sequence
  chemically treated genomic DNA (Homo sapiens) CpG-island No: 18906
aaaatccccgaacctccccaatttccccgcgcctcaccgtaacctcttcctttccccgcaaatataccttcgcgaaatccataccttaaaacccaaaaacgccccgccgccaacataccgtaaaacgcgcgacgacctaaaaataacgcgaacgacgaacccgaaacctcgaacgcgacgcgctcgcgaacgcaaaaacaataccgcaaatcgtcgttcgccttctaccaaacgatacgcgacctactacccgtataactactaaaaaatatacgcgccaacgaaaccttccactaaaacgaacgcgaacgcgccgccgcctactcgccctctaaaacgctactctacgcgctcgtacacgaccaccaaacgtacgcgcattacctactaaccacgttcccgcgacgcgcgctcgcaccgcccaataccgacttccgctactacgcgactcccgaaccgcacgtaacgctaacaatacgctacaaccgcgtaaacattctacgccgcatcctacgcaccttacgcgacttcccgaccgaaaaacgaacgcgcgtactaaaccgacgtaactacaaccgcgtaaaaaacgataacacgtcgctacacgtaacctataaactaacgcgccccgaatacctcttcctactactaaaccacgacgcctcgcccgatctacgaaacgacgacgacctcacgcctctcgaactactactacgccaactaaaccgcgacgccgaaaccactccctccgccgccgaaacccccgcctcaactcccgaaaaaccgcgccaacgccgcctactactactaaacctcctaacgctatacacccccgtaaataccgccgactcgacccgccaaaaactactaaacgaccgaccgcgctaacaacgactactaaataaaaacaaattccaataactaacgaacctaacgccgccctcgctcttcgcgcgcgccat

SEQ ID NO: 18907 - DNA, 962 bp, Artificial Sequence
  chemically treated genomic DNA (Homo sapiens) CpG-island No: 18907
ggagttttcgggtttttttagttttttcgcgttttatcgtggttttttttttttttcgtaggtgtgttttcgcgggatttatgttttgaggtttaggaacgtttcgtcgttagtatgtcgtgggacgcgcggcggtttgggggtggcgcggacggcgggttcgaggtttcgggcgcggcgcgttcgcgagcgtagaagtagtgtcgtaagtcgtcgttcgttttttattaggcggtgcgcgatttgttattcgtgtggttgttggaggatatgcgcgttagcgaggttttttattgggacgagcgcgggcgcgtcgtcgtttattcgttttttgaggcgttgttttacgcgttcgtgtacgattattaagcgtacgcgtattatttgttggttacgttttcgcggcgcgcgttcgtatcgtttagtgtcggttttcgttgttgcgcggttttcgggtcgtacgtggcgttggtagtgcgttataatcgcgtgggtattttgcgtcgtattttgcgtattttgcgcgatttttcggtcgaggagcgggcgcgcgtgttggatcggcgtggttgtagtcgcgtggagggcggtggtacgtcgttgtacgtggtttgtgagttggcgcgtttcgagtgtttttttttgttgttgggttacggcgtttcgttcggtttgcgggacggcggcggttttacgtttttcgagttgttgttgcgttagttgggtcgcgacgtcggggttatttttttcgtcgtcggagttttcgttttagttttcggggagtcgcgttagcgtcgtttgttgttgttggattttttggcgttgtatattttcgtgggtgtcgtcggttcggttcgttaggagttgttgggcgatcggtcgcgttggtagcggttgttgggtgaggataagttttagtggttggcgggtttggcgtcgttttcgtttttcgcgcgcgttat

SEQ ID NO: 18908 - DNA, 962 bp, Artificial Sequence
  chemically treated genomic DNA (Homo sapiens) CpG-island No: 18908
ataacgcgcgcgaaaaacgaaaacgacgccaaacccgccaaccactaaaacttatcctcacccaacaaccgctaccaacgcgaccgatcgcccaacaactcctaacgaaccgaaccgacgacacccacgaaaatatacaacgccaaaaaatccaacaacaacaaacgacgctaacgcgactccccgaaaactaaaacgaaaactccgacgacgaaaaaaataaccccgacgtcgcgacccaactaacgcaacaacaactcgaaaaacgtaaaaccgccgccgtcccgcaaaccgaacgaaacgccgtaacccaacaacaaaaaaaaacactcgaaacgcgccaactcacaaaccacgtacaacgacgtaccaccgccctccacgcgactacaaccacgccgatccaacacgcgcgcccgctcctcgaccgaaaaatcgcgcaaaatacgcaaaatacgacgcaaaatacccacgcgattataacgcactaccaacgccacgtacgacccgaaaaccgcgcaacaacgaaaaccgacactaaacgatacgaacgcgcgccgcgaaaacgtaaccaacaaataatacgcgtacgcttaataatcgtacacgaacgcgtaaaacaacgcctcaaaaaacgaataaacgacgacgcgcccgcgctcgtcccaataaaaaacctcgctaacgcgcatatcctccaacaaccacacgaataacaaatcgcgcaccgcctaataaaaaacgaacgacgacttacgacactacttctacgctcgcgaacgcgccgcgcccgaaacctcgaacccgccgtccgcgccacccccaaaccgccgcgcgtcccacgacatactaacgacgaaacgttcctaaacctcaaaacataaatcccgcgaaaacacacctacgaaaaaaaaaaaaaaccacgataaaacgcgaaaaaactaaaaaaacccgaaaactcc

SEQ ID NO: 18909 - DNA, 557 bp, Artificial Sequence
  chemically treated genomic DNA (Homo sapiens) CpG-island No: 18909
  misc_feature (541)..(541): n is either a, c, g or t
cgggcgggttacgtaaagttcggtttttttacgttatcgggtagagttacggtcgcggttcgtgaataagggggttgggttatcgaaggtagcgtcgcgttcggggttattcgttattttttattcgttttttttcggtttgtacggttagacgtcgggcggcggagggtcgcggggtcgagcggggcgttcgcgcgtaggtggtcggcgtagcgagggttgtatttgcgtgcgcgtgtgtcggaggaggagggggcggcggcgtcggcgcgcgcgggggacgggatttatatggggggcgcgggggtataggcgggtttttttttttgttagatcgagtcgcgtcgttattcggtagtcggtaggttacgaggacgacggaggagataagacggtcgcgagcgattttacgcgcgcggttgaggcgcgttttttcgcgcgcgcggcgcggcgggggcgtttcgtcggtagatatttcgtttcgttttattttcgcgggtcggcggatttgcgcgttgcgtttttttcgcgcgggggcgtngcgttatttaatttcg

SEQ ID NO: 18910 - DNA, 557 bp, Artificial Sequence
  chemically treated genomic DNA (Homo sapiens) CpG-island No: 18910
  misc_feature (17)..(17): n is either a, c, g or t
cgaaattaaataacgcnacgcccccgcgcgaaaaaaacgcaacgcgcaaatccgccgacccgcgaaaataaaacgaaacgaaatatctaccgacgaaacgcccccgccgcgccgcgcgcgcgaaaaaacgcgcctcaaccgcgcgcgtaaaatcgctcgcgaccgtcttatctcctccgtcgtcctcgtaacctaccgactaccgaataacgacgcgactcgatctaacaaaaaaaaaaacccgcctatacccccgcgccccccatataaatcccgtcccccgcgcgcgccgacgccgccgccccctcctcctccgacacacgcgcacgcaaatacaaccctcgctacgccgaccacctacgcgcgaacgccccgctcgaccccgcgaccctccgccgcccgacgtctaaccgtacaaaccgaaaaaaaacgaataaaaaataacgaataaccccgaacgcgacgctaccttcgataacccaacccccttattcacgaaccgcgaccgtaactctacccgataacgtaaaaaaaccgaactttacgtaacccgcccg

SEQ ID NO: 18911 - DNA, 557 bp, Artificial Sequence
  chemically treated genomic DNA (Homo sapiens) CpG-island No: 18911
  misc_feature (17)..(17): n is either a, c, g or t
cgaagttgggtggcgtnacgttttcgcgcgagaagaacgtaacgcgtaagttcgtcggttcgcggaaatggggcgaggcggggtgtttgtcggcgaagcgttttcgtcgcgtcgcgcgcgcgggaggacgcgttttagtcgcgcgcgtagagtcgttcgcggtcgttttgtttttttcgtcgttttcgtgatttgtcggttgtcgggtgacggcgcggttcggtttggtagggggggaggttcgtttgtgttttcgcgttttttatgtgagtttcgtttttcgcgcgcgtcggcgtcgtcgtttttttttttttcggtatacgcgtacgtaggtgtagttttcgttgcgtcggttatttgcgcgcggacgtttcgttcggtttcgcgatttttcgtcgttcgacgtttggtcgtgtaggtcgggaggggacgggtaggaggtggcgggtggtttcgggcgcggcgttgttttcgatggtttaatttttttatttacgagtcgcggtcgtgattttgttcggtgacgtggggaggtcgaattttacgtaattcgttcg

SEQ ID NO: 18912 - DNA, 557 bp, Artificial Sequence
  chemically treated genomic DNA (Homo sapiens) CpG-island No: 18912
  misc_feature (541)..(541): n is either a, c, g or t
cgaacgaattacgtaaaattcgacctccccacgtcaccgaacaaaatcacgaccgcgactcgtaaataaaaaaattaaaccatcgaaaacaacgccgcgcccgaaaccacccgccacctcctacccgtcccctcccgacctacacgaccaaacgtcgaacgacgaaaaatcgcgaaaccgaacgaaacgtccgcgcgcaaataaccgacgcaacgaaaactacacctacgtacgcgtataccgaaaaaaaaaaaaacgacgacgccgacgcgcgcgaaaaacgaaactcacataaaaaacgcgaaaacacaaacgaacctccccccctaccaaaccgaaccgcgccgtcacccgacaaccgacaaatcacgaaaacgacgaaaaaaacaaaacgaccgcgaacgactctacgcgcgcgactaaaacgcgtcctcccgcgcgcgcgacgcgacgaaaacgcttcgccgacaaacaccccgcctcgccccatttccgcgaaccgacgaacttacgcgttacgttcttctcgcgcgaaaacgtnacgccacccaacttcg

SEQ ID NO: 18913 - DNA, 676 bp, Artificial Sequence
  chemically treated genomic DNA (Homo sapiens) CpG-island No: 18913
  misc_feature (170)..(170): n is either a, c, g or t
ttataggttcggcgttttcgtttttgtcgcggatcggagcgcgcgttgtttttcgcgggcgagcgggtaaaggttttacgacggacgtacgggagggagttatcgtcgttcgcgttcgtcgtagtcgcgtatcgagtcgtcgcggtcggaacgtagggcggcggggtcgncgtcggcggcgggcggcgggcggcgggcggcgggcggcgtagtgcggtttcggttaggtaggatagcgggatcgttcgtcgtcgttattggttcgcgtcgtcggttttcgttattatttattggtcgtcgcgttgtattattgttacgttattggtcggcgggcggggcgtatcgttggattcgcggaaaatttcggagaaatttgagggagcgtcggcggggagaacggagaggaggggcggggtcgtggcgaaaggggcggggcgttgatgggcgggggcggggttttcggaattcgagttgcgggcgaagaaaggtttcgagtttcgagttgttttagttcgggagggcgtcgttgttttgcgaattcgggcgcgcgcgtaggtggttcgtttttcgtcgtgcgtgatttttttcgtcgcgtttagttttttttttttttgattttacgtgattttgggaaaaatttttaggttgttattttatttgtatatgggagggtcgg

SEQ ID NO: 18914 - DNA, 676 bp, Artificial Sequence
  chemically treated genomic DNA (Homo sapiens) CpG-island No: 18914
  misc_feature (507)..(507): n is either a, c, g or t
ccgaccctcccatatacaaataaaataacaacctaaaaatttttcccaaaatcacgtaaaatcaaaaaaaaaaaaaactaaacgcgacgaaaaaaatcacgcacgacgaaaaacgaaccacctacgcgcgcgcccgaattcgcaaaacaacgacgccctcccgaactaaaacaactcgaaactcgaaacctttcttcgcccgcaactcgaattccgaaaaccccgcccccgcccatcaacgccccgcccctttcgccacgaccccgcccctcctctccgttctccccgccgacgctccctcaaatttctccgaaattttccgcgaatccaacgatacgccccgcccgccgaccaataacgtaacaataatacaacgcgacgaccaataaataataacgaaaaccgacgacgcgaaccaataacgacgacgaacgatcccgctatcctacctaaccgaaaccgcactacgccgcccgccgcccgccgcccgccgcccgccgccgacgncgaccccgccgccctacgttccgaccgcgacgactcgatacgcgactacgacgaacgcgaacgacgataactccctcccgtacgtccgtcgtaaaacctttacccgctcgcccgcgaaaaacaacgcgcgctccgatccgcgacaaaaacgaaaacgccgaacctataa

SEQ ID NO: 18915 - DNA, 676 bp, Artificial Sequence
  chemically treated genomic DNA (Homo sapiens) CpG-island No: 18915
  misc_feature (507)..(507): n is either a, c, g or t
tcggtttttttatgtgtagatggggtagtagtttggaggttttttttaaggttacgtaaggttaaagaaaaggggagttggacgcgacgaggaaagttacgtacggcggagggcgggttatttacgcgcgcgttcgagttcgtagagtagcggcgttttttcgggttagggtagttcggagttcggagttttttttcgttcgtagttcgggtttcgggagtttcgttttcgtttattaacgtttcgtttttttcgttacggtttcgtttttttttttcgtttttttcgtcggcgtttttttaagttttttcgaagtttttcgcgggtttagcggtgcgtttcgttcgtcggttagtgacgtaataatggtgtagcgcggcggttaatgggtggtggcgggggtcggcggcgcgggttaatggcggcggcggacggtttcgttgttttgtttggtcggggtcgtattgcgtcgttcgtcgttcgtcgttcgtcgttcgtcgtcggcgncggtttcgtcgttttgcgtttcggtcgcggcggttcggtgcgcggttgcggcgggcgcgggcggcggtggttttttttcgtgcgttcgtcgtgggatttttgttcgttcgttcgcgggggatagcgcgcgtttcggttcgcggtaggggcggggacgtcgagtttgtaa

SEQ ID NO: 18916 - DNA, 676 bp, Artificial Sequence
  chemically treated genomic DNA (Homo sapiens) CpG-island No: 18916
  misc_feature (170)..(170): n is either a, c, g or t
ttacaaactcgacgtccccgcccctaccgcgaaccgaaacgcgcgctatcccccgcgaacgaacgaacaaaaatcccacgacgaacgcacgaaaaaaaaccaccgccgcccgcgcccgccgcaaccgcgcaccgaaccgccgcgaccgaaacgcaaaacgacgaaaccgncgccgacgacgaacgacgaacgacgaacgacgaacgacgcaatacgaccccgaccaaacaaaacaacgaaaccgtccgccgccgccattaacccgcgccgccgacccccgccaccacccattaaccgccgcgctacaccattattacgtcactaaccgacgaacgaaacgcaccgctaaacccgcgaaaaacttcgaaaaaacttaaaaaaacgccgacgaaaaaaacgaaaaaaaaaaacgaaaccgtaacgaaaaaaacgaaacgttaataaacgaaaacgaaactcccgaaacccgaactacgaacgaaaaaaaactccgaactccgaactaccctaacccgaaaaaacgccgctactctacgaactcgaacgcgcgcgtaaataacccgccctccgccgtacgtaactttcctcgtcgcgtccaactccccttttctttaaccttacgtaaccttaaaaaaaacctccaaactactaccccatctacacataaaaaaaccga

SEQ ID NO: 18917 - DNA, 1011 bp, Artificial Sequence
  chemically treated genomic DNA (Homo sapiens) CpG-island No: 18917
gcgggcgcgttttttatttatatgtttcgattcgtcgggtttttgcgttcgtaagattatttttcgggttcgaggcggggaaggggtcgggatatgggttggggattgagcgtcgttgaattgcgttatggtcggagagagtttgtaggggcggaggtgttttttggtcggattttgtcgatcgttttcggggagaggcgaggttttggttcgtgacggttgggttcgggttttagtatttttattcgtttaggggaaagcgggcggtagttcggagttcgattttagcgtttagcgcggttcgatatcgttttttggcggtcgcggacgttattgcgattcgtagttttcgtcgaagtcgggcgagggattttcgattcgggcgtattaggttgcgggtgcgggggcggggacgtttagcgttttggtttcgggggcggggttcgcgggttgagtgtttatttcgtttttttttcgtttcgcggtttcggcgggtttttcgtttattagggtttttattttttttcgggtgaaatggttatagtttcgttattcgcgtcgtcgttattgcgtttgttttcggttgggtcgatcggaggtttcggcggggcgggcgaggtaggtggttcggcgggtttttttcgggttttttttttttagtcggagttcgcggatcgcgttgggcgtagggagggggttgtgcgcgttttcgtttttcggtttttttagcggggacgagcgtcgattttcgtttagtcgggagacgtttttaaggttttaggttttgtttttgttcgttcgcggttcgcggattgcgggtgatagggttttcggttcgagttttatttttttaggagagcggattttagcgtttttgtattttttatttggtggtcgtttacgtagttcggtttgttcgcgcgttttaattgttattttttttgttttttttagtcgtacgtttattaggtttttgtgtgtttgtttggttgggattttcgtatattttag

SEQ ID NO: 18918 - DNA, 1011 bp, Artificial Sequence
  chemically treated genomic DNA (Homo sapiens) CpG-island No: 18918
ctaaaatatacgaaaatcccaaccaaacaaacacacaaaaacctaataaacgtacgactaaaaaaaacaaaaaaaataacaattaaaacgcgcgaacaaaccgaactacgtaaacgaccaccaaataaaaaatacaaaaacgctaaaatccgctctcctaaaaaaataaaactcgaaccgaaaaccctatcacccgcaatccgcgaaccgcgaacgaacaaaaacaaaacctaaaaccttaaaaacgtctcccgactaaacgaaaatcgacgctcgtccccgctaaaaaaaccgaaaaacgaaaacgcgcacaaccccctccctacgcccaacgcgatccgcgaactccgactaaaaaaaaaaaacccgaaaaaaacccgccgaaccacctacctcgcccgccccgccgaaacctccgatcgacccaaccgaaaacaaacgcaataacgacgacgcgaataacgaaactataaccatttcacccgaaaaaaaataaaaaccctaataaacgaaaaacccgccgaaaccgcgaaacgaaaaaaaaacgaaataaacactcaacccgcgaaccccgcccccgaaaccaaaacgctaaacgtccccgcccccgcacccgcaacctaatacgcccgaatcgaaaatccctcgcccgacttcgacgaaaactacgaatcgcaataacgtccgcgaccgccaaaaaacgatatcgaaccgcgctaaacgctaaaatcgaactccgaactaccgcccgctttcccctaaacgaataaaaatactaaaacccgaacccaaccgtcacgaaccaaaacctcgcctctccccgaaaacgatcgacaaaatccgaccaaaaaacacctccgcccctacaaactctctccgaccataacgcaattcaacgacgctcaatccccaacccatatcccgaccccttccccgcctcgaacccgaaaaataatcttacgaacgcaaaaacccgacgaatcgaaacatataaataaaaaacgcgcccgc

SEQ ID NO: 18919 - DNA, 1011 bp, Artificial Sequence
  chemically treated genomic DNA (Homo sapiens) CpG-island No: 18919
ttggagtatgcggaagttttagttaggtagatatataggagtttggtagacgtgcggttggggaaggtaagggaagtggtagttgggacgcgcgagtaggtcgggttgcgtggacggttattaggtggagggtataggagcgttggggttcgtttttttagggagatggggttcggatcggggattttgttattcgtagttcgcgggtcgcgggcgggtagaagtagagtttgggattttgagggcgtttttcgattgggcgggggtcggcgttcgttttcgttgggaaggtcgggaagcggaggcgcgtatagttttttttttgcgtttagcgcggttcgcggatttcggttgggggaggggaattcggaaggggttcgtcggattatttgtttcgttcgtttcgtcgggattttcgatcggtttagtcgggggtaggcgtagtggcggcggcgcggatggcgggattgtggttattttattcggggggaggtggagattttggtgggcggggggttcgtcgaggtcgcggggcgaggggagagcggagtgggtatttagttcgcgaatttcgttttcggggttagggcgttgggcgttttcgttttcgtattcgtagtttggtgcgttcgggtcgggggtttttcgttcggtttcggcggaggttgcgggtcgtagtgacgttcgcggtcgttagggggcggtgtcgggtcgcgttgggcgttggggtcgggtttcgggttgtcgttcgtttttttttgagcggatggggatattgaggttcggatttagtcgttacgggttagggtttcgttttttttcgagggcggtcggtagggttcgattagggaatattttcgtttttgtaaatttttttcgattatggcgtagtttagcggcgtttagtttttaatttatgtttcggtttttttttcgtttcgggttcggaaagtgattttgcggacgtagggattcggcgggtcggggtatgtgggtagagggcgcgttcgt

SEQ ID NO: 18920 - DNA, 1011 bp, Artificial Sequence
  chemically treated genomic DNA (Homo sapiens) CpG-island No: 18920
acgaacgcgccctctacccacataccccgacccgccgaatccctacgtccgcaaaatcactttccgaacccgaaacgaaaaaaaaaccgaaacataaattaaaaactaaacgccgctaaactacgccataatcgaaaaaaatttacaaaaacgaaaatattccctaatcgaaccctaccgaccgccctcgaaaaaaaacgaaaccctaacccgtaacgactaaatccgaacctcaatatccccatccgctcaaaaaaaaacgaacgacaacccgaaacccgaccccaacgcccaacgcgacccgacaccgccccctaacgaccgcgaacgtcactacgacccgcaacctccgccgaaaccgaacgaaaaacccccgacccgaacgcaccaaactacgaatacgaaaacgaaaacgcccaacgccctaaccccgaaaacgaaattcgcgaactaaatacccactccgctctcccctcgccccgcgacctcgacgaaccccccgcccaccaaaatctccacctccccccgaataaaataaccacaatcccgccatccgcgccgccgccactacgcctacccccgactaaaccgatcgaaaatcccgacgaaacgaacgaaacaaataatccgacgaaccccttccgaattcccctcccccaaccgaaatccgcgaaccgcgctaaacgcaaaaaaaaaactatacgcgcctccgcttcccgaccttcccaacgaaaacgaacgccgacccccgcccaatcgaaaaacgccctcaaaatcccaaactctacttctacccgcccgcgacccgcgaactacgaataacaaaatccccgatccgaaccccatctccctaaaaaaacgaaccccaacgctcctataccctccacctaataaccgtccacgcaacccgacctactcgcgcgtcccaactaccacttcccttaccttccccaaccgcacgtctaccaaactcctatatatctacctaactaaaacttccgcatactccaa

SEQ ID NO: 18921 - DNA, 661 bp, Artificial Sequence
  chemically treated genomic DNA (Homo sapiens) CpG-island No: 18921
gaatcgatttaattcgggtcgttacgttgtgtttagaatatcgatagtcgtttttaggtaattagtatttgttgcgtttcgtttttagcgatttttttaatcgcgtggattcgtatttacgtgttcggcggggtcgtagtagaaaggttcggattttttaggacgatcggtcggtgggggtcggtggggtcgtagattcggggggcggggggcgttaggttttcgggttttgttttcgtttcgtggggaatagtaggacggcgtcgaggtcgtttcgttttttttcgcgtttatttgtcgggaggggatttcgtgtttcgatttgaaggtgacggtagagtttgcgggaggtttaggtcggtttcgttttacgggtttcgggggcgattttcgcgttgatattggcgtttaggtcgcggtttttgttttcgcgtttatttacgtcgggtttggttttcgttttttcgggaaaagtttcgtcggcggtcgcgagagcgcggaagcgtagtcgtagtgatcgcgagataaagattcggcggcgggggaggcggcggagagatttcgttagcgcggagattttagggaagtttttttggaagatttggtgttggttcgttttttcgggattttattttttttatgtggataacgggggcggggt

SEQ ID NO: 18922 - DNA, 661 bp, Artificial Sequence
  chemically treated genomic DNA (Homo sapiens) CpG-island No: 18922
accccgcccccgttatccacataaaaaaaataaaatcccgaaaaaacgaaccaacaccaaatcttccaaaaaaacttccctaaaatctccgcgctaacgaaatctctccgccgcctcccccgccgccgaatctttatctcgcgatcactacgactacgcttccgcgctctcgcgaccgccgacgaaacttttcccgaaaaaacgaaaaccaaacccgacgtaaataaacgcgaaaacaaaaaccgcgacctaaacgccaatatcaacgcgaaaatcgcccccgaaacccgtaaaacgaaaccgacctaaacctcccgcaaactctaccgtcaccttcaaatcgaaacacgaaatcccctcccgacaaataaacgcgaaaaaaaacgaaacgacctcgacgccgtcctactattccccacgaaacgaaaacaaaacccgaaaacctaacgccccccgccccccgaatctacgaccccaccgacccccaccgaccgatcgtcctaaaaaatccgaacctttctactacgaccccgccgaacacgtaaatacgaatccacgcgattaaaaaaatcgctaaaaacgaaacgcaacaaatactaattacctaaaaacgactatcgatattctaaacacaacgtaacgacccgaattaaatcgattc

SEQ ID NO: 18923 - DNA, 661 bp, Artificial Sequence
  chemically treated genomic DNA (Homo sapiens) CpG-island No: 18923
atttcgttttcgttgtttatataaggaaaatgaggtttcgggagagcggattagtattaggttttttagagaagtttttttggggttttcgcgttggcggggttttttcgtcgtttttttcgtcgtcgggtttttgtttcgcggttattacggttgcgttttcgcgttttcgcggtcgtcggcggggtttttttcgggggagcgagggttaggttcggcgtgggtgggcgcggaggtaggggtcgcggtttggacgttaatgttagcgcgagggtcgttttcgggattcgtagggcgggatcggtttaggtttttcgtaggttttgtcgttatttttaggtcggagtacggggttttttttcggtaaatgggcgcggaggaaagcgaaacggtttcggcgtcgttttgttgttttttacggggcgggggtaggattcggaagtttggcgtttttcgtttttcgagtttgcggttttatcggtttttatcggtcgatcgttttggggggttcgagtttttttgttgcggtttcgtcgggtacgtggatgcgagtttacgcggttggggaggtcgttggaaacggggcgtagtaggtgttggttgtttgggagcgattgtcggtgttttgaatataacgtggcggttcgggttgagtcgattt

SEQ ID NO: 18924 - DNA, 661 bp, Artificial Sequence
  chemically treated genomic DNA (Homo sapiens) CpG-island No: 18924
aaatcgactcaacccgaaccgccacgttatattcaaaacaccgacaatcgctcccaaacaaccaacacctactacgccccgtttccaacgacctccccaaccgcgtaaactcgcatccacgtacccgacgaaaccgcaacaaaaaaactcgaaccccccaaaacgatcgaccgataaaaaccgataaaaccgcaaactcgaaaaacgaaaaacgccaaacttccgaatcctacccccgccccgtaaaaaacaacaaaacgacgccgaaaccgtttcgctttcctccgcgcccatttaccgaaaaaaaaccccgtactccgacctaaaaataacgacaaaacctacgaaaaacctaaaccgatcccgccctacgaatcccgaaaacgaccctcgcgctaacattaacgtccaaaccgcgacccctacctccgcgcccacccacgccgaacctaaccctcgctcccccgaaaaaaaccccgccgacgaccgcgaaaacgcgaaaacgcaaccgtaataaccgcgaaacaaaaacccgacgacgaaaaaaacgacgaaaaaaccccgccaacgcgaaaaccccaaaaaaacttctctaaaaaacctaatactaatccgctctcccgaaacctcattttccttatataaacaacgaaaacgaaat

SEQ ID NO: 18925 - DNA, 1727 bp, Artificial Sequence
  chemically treated genomic DNA (Homo sapiens) CpG-island No: 18925
gcgggtagtatcgtagattcgagtttttacgtagttcgcgttaggggaggcggtcgtttgggaagttcgtttttcgcgtcgcggttttcgttttcgttagtttcgcgttttttgggaaaggcgggggcgtagcgagttttttttaattagttttttttttgtatggagttttagcgcgttcgtattttttcgcgtagcggaaagtagtttcggtcgggcgtttcgcggttttttagcgttagatatattttattttgagaagtcgacgggatttttagcggggttttttagatggggggttagaggttgcgggaggcgtgcgcgggtagtaagggtaggggtcgcggttaagggtagggggcggggagggcggcgaatttttcgtcgttgtttggagagatggattatggggcgtagggagatggtaaattttaaattacgtacggcgggcgatacgcgttaatcgaatttcgttaacggaagttcggagtcgttttttttcgttttttcgtttcgtcgtttcggacggacgggcgcgcggagttaattttcgttgtcgttggttgtttaaattttattagagttaatgggagcgcgagggggggcggagtcgtttcgcgttagttgggtgcgcgtttttttttttcggcgtttttgtaggtttcgtttttgttttttttttttttcgttcgttgttttcggagtagttggtgttagtgaagtgagggcggcgatgagagcgaaagttgcgttcggttcgtcgttgggggtttgaagcggtttcgcgttttgttcgtttgggtttttttcgattcggattcgcgttcgtgggttttcgtcgcgttcgttcggtttcgcgtcggtttcgcgttttttttttcgtttcggcgttttttttttaggagtcgcgggttttcgttattttcgtacggtttcggttttcgtcgatgtcggttatggtggagaagggtttcgaggttttagggaagcggagagggaggaataacgcggtcgttttcgttttcgtcgtcgtcgttttcgtcgtcgtttcggtcgtttgcgtttcgttagtcgttattgtcgtttcgggcgtcgtcgtttttttagtttcggtcgtcgtcgttttagtcgtcgtcgtttttaataatggttagaataaaagtttggcggcggcggcgtttaatggtaatagtagtagtaatttttgggaggaaggtagttcgggttcgtttagcgacgaggagtacggtaggtggtagtcgttttcgcggtttcgggtttcgcgtttcgcgtcgcgttgatcgtcgtattttgtttttttcgtaggtggcggtggtatgagggtcggattttagtattaggcggtggtgttcgatttcgatttcggtgagtagcggtttcggtcggtcggcggcggggatgagcgggagtttcgggttttcggcgagttcgagggggcgggagttcgtcgataattttttttttgtgcgttcgttttgtcgttcgtggggagaatagtagggcgaggacgaggaggcgtatacgtatacgagtgttttgtaaacgtgtttttgtattcgggggaggttaggtcgtttttagtagggtcggcgtcgttgtttttttgcgttttcgaggattgcgggtggcgtcggaggtggttatatttggtttgggggcgttgggggtttttgcgtttaggtgagttgcgtttcggttaggggtaa

SEQ ID NO: 18926 - DNA, 1727 bp, Artificial Sequence
  chemically treated genomic DNA (Homo sapiens) CpG-island No: 18926
ttacccctaaccgaaacgcaactcacctaaacgcaaaaacccccaacgcccccaaaccaaatataaccacctccgacgccacccgcaatcctcgaaaacgcaaaaaaacaacgacgccgaccctactaaaaacgacctaacctcccccgaatacaaaaacacgtttacaaaacactcgtatacgtatacgcctcctcgtcctcgccctactattctccccacgaacgacaaaacgaacgcacaaaaaaaaaattatcgacgaactcccgccccctcgaactcgccgaaaacccgaaactcccgctcatccccgccgccgaccgaccgaaaccgctactcaccgaaatcgaaatcgaacaccaccgcctaatactaaaatccgaccctcataccaccgccacctacgaaaaaaacaaaatacgacgatcaacgcgacgcgaaacgcgaaacccgaaaccgcgaaaacgactaccacctaccgtactcctcgtcgctaaacgaacccgaactaccttcctcccaaaaattactactactattaccattaaacgccgccgccgccaaacttttattctaaccattattaaaaacgacgacgactaaaacgacgacgaccgaaactaaaaaaacgacgacgcccgaaacgacaataacgactaacgaaacgcaaacgaccgaaacgacgacgaaaacgacgacgacgaaaacgaaaacgaccgcgttattcctccctctccgcttccctaaaacctcgaaacccttctccaccataaccgacatcgacgaaaaccgaaaccgtacgaaaataacgaaaacccgcgactcctaaaaaaaaaacgccgaaacgaaaaaaaaaacgcgaaaccgacgcgaaaccgaacgaacgcgacgaaaacccacgaacgcgaatccgaatcgaaaaaaacccaaacgaacaaaacgcgaaaccgcttcaaacccccaacgacgaaccgaacgcaactttcgctctcatcgccgccctcacttcactaacaccaactactccgaaaacaacgaacgaaaaaaaaaaaaaacaaaaacgaaacctacaaaaacgccgaaaaaaaaaaacgcgcacccaactaacgcgaaacgactccgccccccctcgcgctcccattaactctaataaaatttaaacaaccaacgacaacgaaaattaactccgcgcgcccgtccgtccgaaacgacgaaacgaaaaaacgaaaaaaaacgactccgaacttccgttaacgaaattcgattaacgcgtatcgcccgccgtacgtaatttaaaatttaccatctccctacgccccataatccatctctccaaacaacgacgaaaaattcgccgccctccccgccccctacccttaaccgcgacccctacccttactacccgcgcacgcctcccgcaacctctaaccccccatctaaaaaaccccgctaaaaatcccgtcgacttctcaaaataaaatatatctaacgctaaaaaaccgcgaaacgcccgaccgaaactactttccgctacgcgaaaaaatacgaacgcgctaaaactccatacaaaaaaaaaactaattaaaaaaaactcgctacgcccccgcctttcccaaaaaacgcgaaactaacgaaaacgaaaaccgcgacgcgaaaaacgaacttcccaaacgaccgcctcccctaacgcgaactacgtaaaaactcgaatctacgatactacccgc

SEQ ID NO: 18927 - DNA, 1727 bp, Artificial Sequence
  chemically treated genomic DNA (Homo sapiens) CpG-island No: 18927
ttatttttggtcgaggcgtagtttatttggacgtagggatttttagcgtttttaggttaggtgtggttattttcgacgttattcgtagttttcggaggcgtaagggggtagcggcgtcggttttgttgggggcgatttggtttttttcgggtgtagaggtacgtttgtagaatattcgtgtgcgtgtgcgttttttcgttttcgttttgttgttttttttacggacggtagggcgaacgtataaaaagaaagttgtcggcgggttttcgttttttcgggttcgtcggggattcggggttttcgtttattttcgtcgtcggtcggtcggggtcgttatttatcggggtcgaagtcgggtattatcgtttggtattggggttcgatttttatgttatcgttatttgcgggggaagtagaatacggcggttagcgcggcgcggggcgcggggttcggggtcgcgggggcggttgttatttatcgtgtttttcgtcgttggacgagttcgagttgttttttttttaggagttgttgttgttgttgttattgggcgtcgtcgtcgttaaatttttattttggttattattgggggcggcggcggttgaggcggcggcggtcgaggttgaggaggcggcggcgttcgaggcggtagtggcggttggcgaggcgtaggcggtcgaggcggcggcggaggcggcggcggcggaggcggaggcggtcgcgttgttttttttttttcgtttttttgagatttcggggtttttttttattatggtcggtatcggcgggggtcggggtcgtgcgaaagtggcggggattcgcggtttttgaggagggggcgtcgagacgggggagggggcgcggggtcggcgcggggtcgggcgggcgcggcgggagtttacgggcgcgagttcgagtcgggggaggtttaaacgggtagagcgcggagtcgttttaagtttttagcgacgagtcgagcgtaattttcgtttttatcgtcgtttttattttattggtattaattatttcgggagtagcgagcggagaggggaggaggtaggggcggggtttgtaggggcgtcgggggaggggggcgcgtatttaattgacgcgagacggtttcgttttttttcgcgtttttattggttttggtgggatttggatagttagcggtagcgagggttggtttcgcgcgttcgttcgttcggggcggcggggcgggggagcggggaggggcggtttcgggttttcgttggcgaggttcggttgacgcgtatcgttcgtcgtacgtggtttgaggtttgttatttttttacgttttatgatttatttttttaggtagcggcgaggagttcgtcgtttttttcgttttttatttttggtcgcggtttttgtttttgttgttcgcgtacgtttttcgtagtttttggttttttatttgaaggatttcgttgagagtttcgtcgattttttaaagtaaaatgtgtttggcgttgggaagtcgcggagcgttcggtcgggattatttttcgttgcgcggaggagtacgggcgcgttaagattttatataaagaggaaattaattgggggaaattcgttgcgttttcgttttttttaggggacgcggggttggcgggggcgggggtcgcggcgcgggggacgggttttttaggcggtcgttttttttggcgcgagttgcgtggggattcgggtttgcggtgttgttcgt

SEQ ID NO: 18928 - DNA, 1727 bp, Artificial Sequence
  chemically treated genomic DNA (Homo sapiens) CpG-island No: 18928
acgaacaacaccgcaaacccgaatccccacgcaactcgcgccaaaaaaaacgaccgcctaaaaaacccgtcccccgcgccgcgacccccgcccccgccaaccccgcgtcccctaaaaaaaacgaaaacgcaacgaatttcccccaattaatttcctctttatataaaatcttaacgcgcccgtactcctccgcgcaacgaaaaataatcccgaccgaacgctccgcgacttcccaacgccaaacacattttactttaaaaaatcgacgaaactctcaacgaaatccttcaaataaaaaaccaaaaactacgaaaaacgtacgcgaacaacaaaaacaaaaaccgcgaccaaaaataaaaaacgaaaaaaacgacgaactcctcgccgctacctaaaaaaataaatcataaaacgtaaaaaaataacaaacctcaaaccacgtacgacgaacgatacgcgtcaaccgaacctcgccaacgaaaacccgaaaccgcccctccccgctcccccgccccgccgccccgaacgaacgaacgcgcgaaaccaaccctcgctaccgctaactatccaaatcccaccaaaaccaataaaaacgcgaaaaaaaacgaaaccgtctcgcgtcaattaaatacgcgcccccctcccccgacgcccctacaaaccccgcccctacctcctcccctctccgctcgctactcccgaaataattaataccaataaaataaaaacgacgataaaaacgaaaattacgctcgactcgtcgctaaaaacttaaaacgactccgcgctctacccgtttaaacctcccccgactcgaactcgcgcccgtaaactcccgccgcgcccgcccgaccccgcgccgaccccgcgccccctcccccgtctcgacgccccctcctcaaaaaccgcgaatccccgccactttcgcacgaccccgacccccgccgataccgaccataataaaaaaaaaccccgaaatctcaaaaaaacgaaaaaaaaaaaacaacgcgaccgcctccgcctccgccgccgccgcctccgccgccgcctcgaccgcctacgcctcgccaaccgccactaccgcctcgaacgccgccgcctcctcaacctcgaccgccgccgcctcaaccgccgccgcccccaataataaccaaaataaaaatttaacgacgacgacgcccaataacaacaacaacaacaactcctaaaaaaaaaacaactcgaactcgtccaacgacgaaaaacacgataaataacaaccgcccccgcgaccccgaaccccgcgccccgcgccgcgctaaccgccgtattctacttcccccgcaaataacgataacataaaaatcgaaccccaataccaaacgataatacccgacttcgaccccgataaataacgaccccgaccgaccgacgacgaaaataaacgaaaaccccgaatccccgacgaacccgaaaaaacgaaaacccgccgacaactttctttttatacgttcgccctaccgtccgtaaaaaaaacaacaaaacgaaaacgaaaaaacgcacacgcacacgaatattctacaaacgtacctctacacccgaaaaaaaccaaatcgcccccaacaaaaccgacgccgctacccccttacgcctccgaaaactacgaataacgtcgaaaataaccacacctaacctaaaaacgctaaaaatccctacgtccaaataaactacgcctcgaccaaaaataa

SEQ ID NO: 18929 - DNA, 595 bp, Artificial Sequence
  chemically treated genomic DNA (Homo sapiens) CpG-island No: 18929
ggaacgtttcgcgggagaatatttgcgttaggggtcgggggtcgggggtcgcggcgggcgaaattcgagaggttcgggttttttttgtgcgcggtcggggaggggggcgtttgtcgggtcggggttggaggatttgcgcgcggtttcgggaggtttcgtttcgttttttagtttgtgaaatggggcgacggtttgggcgtggcggcgagtttttgttcgttgtcggcgggcgcggtcgtcgaggatatagttaggggaggcgtagaaatattcggaggcggtatcgtcgtttttttttcgggattttatatttcgtaggtttaggaggaaggcgcggttcgaggttttcggggcggggtgttttcgagacgggaattcgaattcgacggttttcgtttcgtttgcgtttttttaaggttttcggacgggttttagtggttttttcgtttttttttatcgcgtttcggtttttcgggcggggggtggggggggtcgcgtgcggacggttttttatttcgcgcgtgcgtatttttttttttttaggagattaagtggggattttgaattttgtttttagttttgatggggaggagta

SEQ ID NO: 18930 - DNA, 595 bp, Artificial Sequence
  chemically treated genomic DNA (Homo sapiens) CpG-island No: 18930
tactcctccccatcaaaactaaaaacaaaattcaaaatccccacttaatctcctaaaaaaaaaaaaatacgcacgcgcgaaataaaaaaccgtccgcacgcgaccccccccaccccccgcccgaaaaaccgaaacgcgataaaaaaaaacgaaaaaaccactaaaacccgtccgaaaaccttaaaaaaacgcaaacgaaacgaaaaccgtcgaattcgaattcccgtctcgaaaacaccccgccccgaaaacctcgaaccgcgccttcctcctaaacctacgaaatataaaatcccgaaaaaaaaacgacgataccgcctccgaatatttctacgcctcccctaactatatcctcgacgaccgcgcccgccgacaacgaacaaaaactcgccgccacgcccaaaccgtcgccccatttcacaaactaaaaaacgaaacgaaacctcccgaaaccgcgcgcaaatcctccaaccccgacccgacaaacgcccccctccccgaccgcgcacaaaaaaaacccgaacctctcgaatttcgcccgccgcgacccccgacccccgacccctaacgcaaatattctcccgcgaaacgttcc

SEQ ID NO: 18931 - DNA, 595 bp, Artificial Sequence
  chemically treated genomic DNA (Homo sapiens) CpG-island No: 18931
tatttttttttattagggttggagatagggtttagagtttttatttaattttttgggggaggagaggtgcgtacgcgcggggtggggaatcgttcgtacgcgattttttttatttttcgttcggggagtcgggacgcggtggggaggggcggggaagttattgaggttcgttcgggagttttgaaggggcgtaggcggaacggaggtcgtcgggttcgggttttcgtttcggggatatttcgtttcggaggtttcgggtcgcgttttttttttgaatttgcggggtgtgggatttcggggaggagacggcggtgtcgttttcgggtgtttttgcgttttttttagttgtgttttcgacgatcgcgttcgtcggtagcggataagaattcgtcgttacgtttaggtcgtcgttttattttatagattggaaggcgaggcggggtttttcggggtcgcgcgtaggttttttagtttcgattcggtaggcgttttttttttcggtcgcgtataggaggagttcgggtttttcggatttcgttcgtcgcggttttcggttttcggtttttggcgtagatgttttttcgcggggcgtttt

SEQ ID NO: 18932 - DNA, 595 bp, Artificial Sequence
  chemically treated genomic DNA (Homo sapiens) CpG-island No: 18932
aaaacgccccgcgaaaaaacatctacgccaaaaaccgaaaaccgaaaaccgcgacgaacgaaatccgaaaaacccgaactcctcctatacgcgaccgaaaaaaaaaacgcctaccgaatcgaaactaaaaaacctacgcgcgaccccgaaaaaccccgcctcgccttccaatctataaaataaaacgacgacctaaacgtaacgacgaattcttatccgctaccgacgaacgcgatcgtcgaaaacacaactaaaaaaaacgcaaaaacacccgaaaacgacaccgccgtctcctccccgaaatcccacaccccgcaaattcaaaaaaaaaacgcgacccgaaacctccgaaacgaaatatccccgaaacgaaaacccgaacccgacgacctccgttccgcctacgccccttcaaaactcccgaacgaacctcaataacttccccgcccctccccaccgcgtcccgactccccgaacgaaaaataaaaaaaatcgcgtacgaacgattccccaccccgcgcgtacgcacctctcctcccccaaaaaattaaataaaaactctaaaccctatctccaaccctaataaaaaaaaata

SEQ ID NO: 18933 - DNA, 567 bp, Artificial Sequence
  chemically treated genomic DNA (Homo sapiens) CpG-island No: 18933
ttttcgggttttaagtttttttgagaggacgacgtggagagtggagataaagatgtttaaaagttaggaaatcgtaggttcggaagtttttacgtatgtttttgaacgtagcgttatttcggggttgcggcgggattaagcgggacgtttgtaggttgtcggcggcgggggtcgcgagtcgtcggcgtaggtcgttttagttggaagattttatcgttagggttttagggggttgcggacgttttcgaggggtttaaggcgaaagaacgtagttcgtttgtcggttacgtgatcgttttcgttcgcgttcgtagcgattacgtgattgtgcgttcgcggcgtcgattgattgggagttttttggttacgttttaagcgttagtttcgggtttcggggggcggtgttgttgcggttgttatggcgtttttcgagcgcgtaggcgtgggtttagagtagtttttcgggtatttgttatcggttttcggtagggttggttatttttgtttgttgagtttcgcgttttgcgttttttggtttttagtaatttgtagggtagtcgtttttta

SEQ ID NO: 18934 - DNA, 567 bp, Artificial Sequence
  chemically treated genomic DNA (Homo sapiens) CpG-island No: 18934
taaaaaacgactaccctacaaattactaaaaaccaaaaaacgcaaaacgcgaaactcaacaaacaaaaataaccaaccctaccgaaaaccgataacaaatacccgaaaaactactctaaacccacgcctacgcgctcgaaaaacgccataacaaccgcaacaacaccgccccccgaaacccgaaactaacgcttaaaacgtaaccaaaaaactcccaatcaatcgacgccgcgaacgcacaatcacgtaatcgctacgaacgcgaacgaaaacgatcacgtaaccgacaaacgaactacgttctttcgccttaaacccctcgaaaacgtccgcaaccccctaaaaccctaacgataaaatcttccaactaaaacgacctacgccgacgactcgcgacccccgccgccgacaacctacaaacgtcccgcttaatcccgccgcaaccccgaaataacgctacgttcaaaaacatacgtaaaaacttccgaacctacgatttcctaacttttaaacatctttatctccactctccacgtcgtcctctcaaaaaaacttaaaacccgaaaa

SEQ ID NO: 18935 - DNA, 567 bp, Artificial Sequence
  chemically treated genomic DNA (Homo sapiens) CpG-island No: 18935
tgagggacggttgttttgtaagttgttggggattaaaggacgtagggcgcgaagtttagtaagtaaaggtgattagttttatcgagagtcggtagtaaatattcgaaaagttattttgggtttacgtttgcgcgttcggaagacgttatggtaatcgtagtagtatcgtttttcgaagttcggggttggcgtttagggcgtggttagggagtttttagttaatcgacgtcgcggacgtatagttacgtggtcgttgcggacgcggacggggacggttacgtggtcgataagcgggttgcgttttttcgttttgggtttttcggaagcgttcgtagttttttggaattttagcggtggggttttttagttggagcggtttacgtcggcggttcgcggttttcgtcgtcgatagtttgtaagcgtttcgtttggtttcgtcgtagtttcgagatggcgttgcgtttagaggtatgcgtgggggttttcgagtttgcgattttttggtttttgagtatttttgtttttattttttacgtcgtttttttaggaaaatttgaggttcgagag

SEQ ID NO: 18936 - DNA, 567 bp, Artificial Sequence
  chemically treated genomic DNA (Homo sapiens) CpG-island No: 18936
ctctcgaacctcaaattttcctaaaaaaacgacgtaaaaaataaaaacaaaaatactcaaaaaccaaaaaatcgcaaactcgaaaacccccacgcatacctctaaacgcaacgccatctcgaaactacgacgaaaccaaacgaaacgcttacaaactatcgacgacgaaaaccgcgaaccgccgacgtaaaccgctccaactaaaaaaccccaccgctaaaattccaaaaaactacgaacgcttccgaaaaacccaaaacgaaaaaacgcaacccgcttatcgaccacgtaaccgtccccgtccgcgtccgcaacgaccacgtaactatacgtccgcgacgtcgattaactaaaaactccctaaccacgccctaaacgccaaccccgaacttcgaaaaacgatactactacgattaccataacgtcttccgaacgcgcaaacgtaaacccaaaataacttttcgaatatttactaccgactctcgataaaactaatcacctttacttactaaacttcgcgccctacgtcctttaatccccaacaacttacaaaacaaccgtccctca

SEQ ID NO: 18937 - DNA, 630 bp, Artificial Sequence
  chemically treated genomic DNA (Homo sapiens) CpG-island No: 18937
gtgcgcgacgggttcgtttgatcgtggtcggttttgtatcgtggggcgttcgtttgattggagtaacggttagttggggggttcggggagcgtcggggtttggggcgggttttggatcgaaatagattgcgtggaagggcgagtttttcggtgaaggtgggagtcggggcggggttgtttcggggcggagttaggtagcgtcgggtttttagggtagagtcgggtgcgatttggcgttgattcggtttttgtatttttttttcgtagttggtagagcggtttttcgacgcggcgttggtttcgatgtttgtgcgggagttaaatcggtagttgcggggttgcgggcgcgacgaggcgttgcggttgaagtagaggcgtcgtacgttgaagaatcgcggttacgcgtaggtttgtcgttttaagcggttgtagtagcggcgcgggttggaggtcgagcgcgttcgtttggtcgtttagttggacgcgttgcgggtcgaggtggttcgtttggttcgggagcgcgatttttataaggttcgttgtgatcggttaatttcgagcggtttcgggttcggggattttttttatttttttttttgagtcgtttagagtattttgtggtgtagtggg

SEQ ID NO: 18938 - DNA, 630 bp, Artificial Sequence
  chemically treated genomic DNA (Homo sapiens) CpG-island No: 18938
cccactacaccacaaaatactctaaacgactcaaaaaaaaaaataaaaaaaatccccgaacccgaaaccgctcgaaattaaccgatcacaacgaaccttataaaaatcgcgctcccgaaccaaacgaaccacctcgacccgcaacgcgtccaactaaacgaccaaacgaacgcgctcgacctccaacccgcgccgctactacaaccgcttaaaacgacaaacctacgcgtaaccgcgattcttcaacgtacgacgcctctacttcaaccgcaacgcctcgtcgcgcccgcaaccccgcaactaccgatttaactcccgcacaaacatcgaaaccaacgccgcgtcgaaaaaccgctctaccaactacgaaaaaaaaatacaaaaaccgaatcaacgccaaatcgcacccgactctaccctaaaaacccgacgctacctaactccgccccgaaacaaccccgccccgactcccaccttcaccgaaaaactcgcccttccacgcaatctatttcgatccaaaacccgccccaaaccccgacgctccccgaaccccccaactaaccgttactccaatcaaacgaacgccccacgatacaaaaccgaccacgatcaaacgaacccgtcgcgcac

SEQ ID NO: 18939 - DNA, 630 bp, Artificial Sequence
  chemically treated genomic DNA (Homo sapiens) CpG-island No: 18939
tttattatattataaggtgttttgaacggtttagaggaagaggtgggaggggttttcggattcggggtcgttcgaggttagtcggttatagcgagttttgtagagatcgcgttttcgggttaggcgggttatttcggttcgtagcgcgtttagttgggcggttaggcgggcgcgttcggtttttagttcgcgtcgttgttgtagtcgtttggagcgataggtttgcgcgtagtcgcggttttttagcgtgcggcgtttttgttttagtcgtagcgtttcgtcgcgttcgtagtttcgtagttgtcggtttagttttcgtatagatatcgagattagcgtcgcgtcggaaaatcgttttgttagttgcggagggagaatgtagaaatcgggttagcgttaggtcgtattcggttttgttttgagggttcgacgttatttggtttcgtttcgggatagtttcgtttcggtttttatttttatcggaaggttcgtttttttacgtagtttgtttcggtttagagttcgttttaggtttcgacgtttttcgggttttttagttgatcgttgttttagttaggcgggcgttttacggtgtagggtcggttacggttaggcgagttcgtcgcgtat

SEQ ID NO: 18940 - DNA, 630 bp, Artificial Sequence
  chemically treated genomic DNA (Homo sapiens) CpG-island No: 18940
atacgcgacgaactcgcctaaccgtaaccgaccctacaccgtaaaacgcccgcctaactaaaacaacgatcaactaaaaaacccgaaaaacgtcgaaacctaaaacgaactctaaaccgaaacaaactacgtaaaaaaacgaaccttccgataaaaataaaaaccgaaacgaaactatcccgaaacgaaaccaaataacgtcgaaccctcaaaacaaaaccgaatacgacctaacgctaacccgatttctacattctccctccgcaactaacaaaacgattttccgacgcgacgctaatctcgatatctatacgaaaactaaaccgacaactacgaaactacgaacgcgacgaaacgctacgactaaaacaaaaacgccgcacgctaaaaaaccgcgactacgcgcaaacctatcgctccaaacgactacaacaacgacgcgaactaaaaaccgaacgcgcccgcctaaccgcccaactaaacgcgctacgaaccgaaataacccgcctaacccgaaaacgcgatctctacaaaactcgctataaccgactaacctcgaacgaccccgaatccgaaaacccctcccacctcttcctctaaaccgttcaaaacaccttataatataataaa

SEQ ID NO: 18941 - DNA, 599 bp, Artificial Sequence
  chemically treated genomic DNA (Homo sapiens) CpG-island No: 18941
gaaggttttttgcgttttaggtaaggagtttttcgttaggttgaggtcgtcgtcggtgagggcggaagtggtaagattgacgtgttttgggtcgcgttgtcgatcgtcgggaggattttcgtttcgtcgaagacgggcggggtaagtcgagttttacggggttttcggagttgggtcgggtttttagatggagaaggcgtaacggggagtttttgagtaagttagagcggtgtttagcgcggtgtagtcgtagtcgtcgttgttaggcgtagtaacgggtaatttcgtagaagtcggtcggtaggttttttttaattcgtcgtagcgcgtcgttgtgggagagattttagtaggagtttaaaggtagttacgggggcgcgaagtggtcgtggcgtcgtttcggttagtttttttcgcgcggtgaggatttcggggttgtggcgggaagggattcgaggtgcgagatcgagcggcgttgttatggaaacgggttagggcgcgtagtagaggtttcgggttagacgggttgcgggtggggtgaattttaggttgggaggatgagagagtagaggtggagcggggtttttgggatagagaga

SEQ ID NO: 18942 - DNA, 599 bp, Artificial Sequence
  chemically treated genomic DNA (Homo sapiens) CpG-island No: 18942
tctctctatcccaaaaaccccgctccacctctactctctcatcctcccaacctaaaattcaccccacccgcaacccgtctaacccgaaacctctactacgcgccctaacccgtttccataacaacgccgctcgatctcgcacctcgaatcccttcccgccacaaccccgaaatcctcaccgcgcgaaaaaaactaaccgaaacgacgccacgaccacttcgcgcccccgtaactacctttaaactcctactaaaatctctcccacaacgacgcgctacgacgaattaaaaaaaacctaccgaccgacttctacgaaattacccgttactacgcctaacaacgacgactacgactacaccgcgctaaacaccgctctaacttactcaaaaactccccgttacgccttctccatctaaaaacccgacccaactccgaaaaccccgtaaaactcgacttaccccgcccgtcttcgacgaaacgaaaatcctcccgacgatcgacaacgcgacccaaaacacgtcaatcttaccacttccgccctcaccgacgacgacctcaacctaacgaaaaactccttacctaaaacgcaaaaaaccttc

SEQ ID NO: 18943 - DNA, 599 bp, Artificial Sequence
  chemically treated genomic DNA (Homo sapiens) CpG-island No: 18943
tttttttattttaaagatttcgttttatttttgtttttttatttttttaatttggggtttattttattcgtagttcgtttggttcggggtttttattacgcgttttggttcgtttttatggtaacgtcgttcggtttcgtatttcgggttttttttcgttatagtttcggggtttttatcgcgcgggaagggttggtcgaggcggcgttacggttatttcgcgttttcgtagttgtttttgggtttttgttggggttttttttatagcggcgcgttacggcgggttggagaggatttgtcgatcgatttttacggggttgttcgttgttgcgtttgatagcggcggttgcggttatatcgcgttggatatcgttttggtttatttaagaatttttcgttgcgttttttttatttggaggttcggtttagtttcggggatttcgtgaggttcggtttgtttcgttcgttttcggcgaggcgggggttttttcggcgatcggtagcgcggtttaggatacgttagttttattattttcgtttttatcggcggcgattttagtttggcggaaagttttttgtttggaacgtagagggttttt

SEQ ID NO: 18944 - DNA, 599 bp, Artificial Sequence
  chemically treated genomic DNA (Homo sapiens) CpG-island No: 18944
aaaaaccctctacgttccaaacaaaaaactttccgccaaactaaaatcgccgccgataaaaacgaaaataataaaactaacgtatcctaaaccgcgctaccgatcgccgaaaaaacccccgcctcgccgaaaacgaacgaaacaaaccgaacctcacgaaatccccgaaactaaaccgaacctccaaataaaaaaaacgcaacgaaaaattcttaaataaaccaaaacgatatccaacgcgatataaccgcaaccgccgctatcaaacgcaacaacgaacaaccccgtaaaaatcgatcgacaaatcctctccaacccgccgtaacgcgccgctataaaaaaaaccccaacaaaaacccaaaaacaactacgaaaacgcgaaataaccgtaacgccgcctcgaccaacccttcccgcgcgataaaaaccccgaaactataacgaaaaaaaacccgaaatacgaaaccgaacgacgttaccataaaaacgaaccaaaacgcgtaataaaaaccccgaaccaaacgaactacgaataaaataaaccccaaattaaaaaaataaaaaaacaaaaataaaacgaaatctttaaaataaaaaaa

SEQ ID NO: 18945 - DNA, 603 bp, Artificial Sequence
  chemically treated genomic DNA (Homo sapiens) CpG-island No: 18945
gcgaatttgcgggcggggtacgttaattagaataagattagtttattcggtatagtattagtagtgagttaggcggcgatcggtcgaaagtttttaaagtaaaaagtagttttaattttgtttaagagtacggagttcgtcgggttattatcgttggtcgattttttaagtattttttgttaaggcgtttgcgtcgtttttacggtttcggtatttttaaattgtcggttcgtagttgaggtttcgtatttttaaattgttcgttcgtttttgtcggagggatttcgatggtcgcgaggatttttagtcgattattttggtggttcggatgtgttttattacggggcgacgttcgtaggtagttggttttataagcgtattatcgggaaagaaacgaggcggtgatagttatcggtaggaatttttttaattcgttagcgttagttagttcgtcggcggttattattgcgtaggcgtcgtttgcgagcgtcgtcgtttagaaatattttcgtaaattttaattatcgagaggattttggttgcgagtagagagttttcgatagagattggtattggtagggtcgtatttagcgttttttttga

SEQ ID NO: 18946 - DNA, 603 bp, Artificial Sequence
  chemically treated genomic DNA (Homo sapiens) CpG-island No: 18946
tcaaaaaaaacgctaaatacgaccctaccaataccaatctctatcgaaaactctctactcgcaaccaaaatcctctcgataattaaaatttacgaaaatatttctaaacgacgacgctcgcaaacgacgcctacgcaataataaccgccgacgaactaactaacgctaacgaattaaaaaaattcctaccgataactatcaccgcctcgtttctttcccgataatacgcttataaaaccaactacctacgaacgtcgccccgtaataaaacacatccgaaccaccaaaataatcgactaaaaatcctcgcgaccatcgaaatccctccgacaaaaacgaacgaacaatttaaaaatacgaaacctcaactacgaaccgacaatttaaaaataccgaaaccgtaaaaacgacgcaaacgccttaacaaaaaatacttaaaaaatcgaccaacgataataacccgacgaactccgtactcttaaacaaaattaaaactactttttactttaaaaactttcgaccgatcgccgcctaactcactactaatactataccgaataaactaatcttattctaattaacgtaccccgcccgcaaattcgc

SEQ ID NO: 18947 - DNA, 603 bp, Artificial Sequence
  chemically treated genomic DNA (Homo sapiens) CpG-island No: 18947
ttagagagggcgttgggtgcgattttgttagtattaatttttgtcggagattttttgttcgtagttaggattttttcggtggttggggtttgcggaagtgtttttaggcgacggcgttcgtagacgacgtttgcgtagtggtagtcgtcggcgggttggttgacgttggcgggttgagggagtttttgtcggtggttgttatcgtttcgtttttttttcgatggtgcgtttgtaaggttagttgtttgcgggcgtcgtttcgtgatggagtatattcgaattattaaggtagtcggttggagattttcgcggttatcggggttttttcggtagaggcgggcgggtagtttgggggtgcggggttttagttgcgggtcggtagtttgggggtgtcgaggtcgtgaggacggcgtaggcgttttggtaggaggtgtttggggagtcgattaacggtggtagttcggcgagtttcgtgtttttgggtaagattgaggttgttttttattttgggggttttcggtcgatcgtcgtttggtttattgttggtattgtgtcgggtgagttagttttgttttaattaacgtgtttcgttcgtagattcgt

SEQ ID NO: 18948 - DNA, 603 bp, Artificial Sequence
  chemically treated genomic DNA (Homo sapiens) CpG-island No: 18948
acgaatctacgaacgaaacacgttaattaaaacaaaactaactcacccgacacaataccaacaataaaccaaacgacgatcgaccgaaaacccccaaaataaaaaacaacctcaatcttacccaaaaacacgaaactcgccgaactaccaccgttaatcgactccccaaacacctcctaccaaaacgcctacgccgtcctcacgacctcgacacccccaaactaccgacccgcaactaaaaccccgcacccccaaactacccgcccgcctctaccgaaaaaaccccgataaccgcgaaaatctccaaccgactaccttaataattcgaatatactccatcacgaaacgacgcccgcaaacaactaaccttacaaacgcaccatcgaaaaaaaaacgaaacgataacaaccaccgacaaaaactccctcaacccgccaacgtcaaccaacccgccgacgactaccactacgcaaacgtcgtctacgaacgccgtcgcctaaaaacacttccgcaaaccccaaccaccgaaaaaatcctaactacgaacaaaaaatctccgacaaaaattaatactaacaaaatcgcacccaacgccctctctaa

SEQ ID NO: 18949 - DNA, 525 bp, Artificial Sequence
  chemically treated genomic DNA (Homo sapiens) CpG-island No: 18949
ggcggggcgttagtatcgtttttatttcgattttaggggtttttgcgcgtcgggtgcgtttgttttcggtgcgttcggcgcgcgcgtagcgtcgcgcgtgcgttgacgtgcggtttcgttttttttattttcgtcgcgttgtttgttgttggggttgaatttttcgttttgttttttttgggttattgcgatgttgtacgttttatttcggtattgaggggatagaagcgttttaggtcgttttatttttgttgacggcgtcgcgtttacggtcgttatgtttatcgggtttttttttgggttcgggacgttgggttttattatcgtggttttcggagggatcggtataggcggcgggttttttttcgggatcggtacgtcgaggtaatcgtgtttataaggtttcgatggtttggtgttttttcgcgaggttcggtttgtcgaggtttgtttttaggttgtaaggttgtcgtgcgagtttcgtagtaggagggcgacggttgggtgggggatttttgttgttag

SEQ ID NO: 18950 - DNA, 525 bp, Artificial Sequence
  chemically treated genomic DNA (Homo sapiens) CpG-island No: 18950
ctaacaacaaaaatcccccacccaaccgtcgccctcctactacgaaactcgcacgacaaccttacaacctaaaaacaaacctcgacaaaccgaacctcgcgaaaaaacaccaaaccatcgaaaccttataaacacgattacctcgacgtaccgatcccgaaaaaaaacccgccgcctataccgatccctccgaaaaccacgataataaaacccaacgtcccgaacccaaaaaaaaacccgataaacataacgaccgtaaacgcgacgccgtcaacaaaaataaaacgacctaaaacgcttctatcccctcaataccgaaataaaacgtacaacatcgcaataacccaaaaaaaacaaaacgaaaaattcaaccccaacaacaaacaacgcgacgaaaataaaaaaaacgaaaccgcacgtcaacgcacgcgcgacgctacgcgcgcgccgaacgcaccgaaaacaaacgcacccgacgcgcaaaaacccctaaaatcgaaataaaaacgatactaacgccccgcc

SEQ ID NO: 18951 - DNA, 525 bp, Artificial Sequence
  chemically treated genomic DNA (Homo sapiens) CpG-island No: 18951
ttggtagtaggggttttttatttaatcgtcgtttttttgttgcggggttcgtacggtagttttgtaatttgaaggtagatttcgataagtcgagtttcgcggggaagtattaggttatcgaagttttgtaaatacggttatttcgacgtgtcggtttcgaaagagaattcgtcgtttgtgtcggttttttcgggagttacggtagtggagtttagcgtttcggatttaaaggagaattcggtggatatggcggtcgtgggcgcgacgtcgttagtaaggatggagcgatttgggacgtttttgtttttttagtgtcgaggtagaacgtgtaatatcgtagtggtttagaagagatagggcgggaagtttaattttagtagtaagtagcgcggcgaggatggaggaggcggggtcgtacgttaacgtacgcgcgacgttgcgcgcgcgtcgaacgtatcggaagtaagcgtattcgacgcgtaggggtttttgggatcggagtggaggcggtgttagcgtttcgtt

SEQ ID NO: 18952 - DNA, 525 bp, Artificial Sequence
  chemically treated genomic DNA (Homo sapiens) CpG-island No: 18952
aacgaaacgctaacaccgcctccactccgatcccaaaaacccctacgcgtcgaatacgcttacttccgatacgttcgacgcgcgcgcaacgtcgcgcgtacgttaacgtacgaccccgcctcctccatcctcgccgcgctacttactactaaaattaaacttcccgccctatctcttctaaaccactacgatattacacgttctacctcgacactaaaaaaacaaaaacgtcccaaatcgctccatccttactaacgacgtcgcgcccacgaccgccatatccaccgaattctcctttaaatccgaaacgctaaactccactaccgtaactcccgaaaaaaccgacacaaacgacgaattctctttcgaaaccgacacgtcgaaataaccgtatttacaaaacttcgataacctaatacttccccgcgaaactcgacttatcgaaatctaccttcaaattacaaaactaccgtacgaaccccgcaacaaaaaaacgacgattaaataaaaaacccctactaccaa

SEQ ID NO: 18953 - DNA, 1843 bp, Artificial Sequence
  chemically treated genomic DNA (Homo sapiens) CpG-island No: 18953
gttgttttgcggggtcgcgcgggtgttatcgaggcgggtatagattgtatagtgtttttaagggttcgcgtacgttttttaagatttgttagcgcgcgggaaaaggtaggtttcgagttaattagggttgattcgggggtaagattaggagacgcgacgattggaatcgggtgagtgtggtcgagtcggcgtttcgagggtcgttagtttggattttaggttgggatacgggcgttttcgggtgtaggggatttagaggcgtcgtgcgcggcgggggttgggcgcgaaggcgtcgagacggtattttttttttgtagtatttcgtttcgcggtcggggggagggggcgttatttgatagcgcgtaataatttttttaggtttcgagggggtaagcggtagtcgtcggggttggggggcgtacggcgcgttgttttcgtttaatggcgaggtttgtaaataaaagcgggttttacgcgggtttttagtcgggtggcgaggggcgcggcgtagtagtatcgtagcggtagagttggtgagagggcgaggcggggacgggatagggcgcggggatttagggtatagttttcgggattcgatcgttcggatgaggtattgtttgcgtattcgtaggatttcgtttttaatgttttttttcgggggttcgtcgcgggtttttagtttcgtgcgtcggttttcgggtttttcgttcggtgagttcggtttcgagggcggtacggatcgttaaggtgagcgtttaggacgcgtcgtcgaaaagttaggttcggaggtgtttaagttagggatcgagacgtaaatatagatataaggatgtataagtacgtttttttcgaagttgataaaaattagtcgataaaatataaagtgtcgcggtcgtcgtaggttagcgttgattttttgttgtcgagaggatcgaatgtcgacgttcggacgttgttatttttatttagcgaaggtatttgggttgtacggtttcgtttttttttttcgcgcgagggatgtttttttttgtttttttttttcgtatttttttattttttaagtgtgtgaatacgaaaataatacgtggaaagttcgatcggggggagttaggattcgtcgggagttttagtgtgcgggagacgggggttagaacgtgttcggtacgggtatcgaggtttcgggtattttcgtcgtcgtttttcggggcggtttcggtcggacgttcgcgtattttaggttcgcggtatttattcgcgacggtcgttcgggattttcgcgacggggtcgggtacgatgcggggtagtcgtgtttttggggttgcgggcgttaaggcgttcgcggagttgtagagttgcgcgttcgacggcggcggcgttgttttgtcggtcgcgttcgaattcgttcgtggtttgttaatcggagttgttagggttttttcgtttgcggtttcgggggtcgggtcgcgggagttcgtgggaaatcgagtttcgattgggtcgtttgataatcgtttcgttttcggttagttaattcgaggcggtggatgtaggagcggggcgttcggagttgggttgtagagcgattatgggcgtacgtcgggtattcgcgtcgtagttaggttcggagcgcgcggttggaggggcgcgggcggcgcgcgttttagagatgtttttttgcgaggtttcgttagcgcggttcggggagatcgttcgtaggtagcggaggcgcggcgggtcgggggacgattagggagtttttaataaagtagttttgggagggtcggaggtttttgtttttttcggcgataggttcgcgaagttgtttgttatttcgtataggtg

SEQ ID NO: 18954 - DNA, 1843 bp, Artificial Sequence
  chemically treated genomic DNA (Homo sapiens) CpG-island No: 18954
cacctatacgaaataacaaacaacttcgcgaacctatcgccgaaaaaaacaaaaacctccgaccctcccaaaactactttattaaaaactccctaatcgtcccccgacccgccgcgcctccgctacctacgaacgatctccccgaaccgcgctaacgaaacctcgcaaaaaaacatctctaaaacgcgcgccgcccgcgcccctccaaccgcgcgctccgaacctaactacgacgcgaatacccgacgtacgcccataatcgctctacaacccaactccgaacgccccgctcctacatccaccgcctcgaattaactaaccgaaaacgaaacgattatcaaacgacccaatcgaaactcgatttcccacgaactcccgcgacccgacccccgaaaccgcaaacgaaaaaaccctaacaactccgattaacaaaccacgaacgaattcgaacgcgaccgacaaaacaacgccgccgccgtcgaacgcgcaactctacaactccgcgaacgccttaacgcccgcaaccccaaaaacacgactaccccgcatcgtacccgaccccgtcgcgaaaatcccgaacgaccgtcgcgaataaataccgcgaacctaaaatacgcgaacgtccgaccgaaaccgccccgaaaaacgacgacgaaaatacccgaaacctcgatacccgtaccgaacacgttctaacccccgtctcccgcacactaaaactcccgacgaatcctaactccccccgatcgaactttccacgtattattttcgtattcacacacttaaaaaataaaaaaatacgaaaaaaaaaaacaaaaaaaaacatccctcgcgcgaaaaaaaaaaacgaaaccgtacaacccaaataccttcgctaaataaaaataacaacgtccgaacgtcgacattcgatcctctcgacaacaaaaaatcaacgctaacctacgacgaccgcgacactttatattttatcgactaatttttatcaacttcgaaaaaaacgtacttatacatccttatatctatatttacgtctcgatccctaacttaaacacctccgaacctaacttttcgacgacgcgtcctaaacgctcaccttaacgatccgtaccgccctcgaaaccgaactcaccgaacgaaaaacccgaaaaccgacgcacgaaactaaaaacccgcgacgaacccccgaaaaaaaacattaaaaacgaaatcctacgaatacgcaaacaatacctcatccgaacgatcgaatcccgaaaactataccctaaatccccgcgccctatcccgtccccgcctcgccctctcaccaactctaccgctacgatactactacgccgcgcccctcgccacccgactaaaaacccgcgtaaaacccgcttttatttacaaacctcgccattaaacgaaaacaacgcgccgtacgccccccaaccccgacgactaccgcttaccccctcgaaacctaaaaaaattattacgcgctatcaaataacgccccctccccccgaccgcgaaacgaaatactacaaaaaaaaaataccgtctcgacgccttcgcgcccaacccccgccgcgcacgacgcctctaaatcccctacacccgaaaacgcccgtatcccaacctaaaatccaaactaacgaccctcgaaacgccgactcgaccacactcacccgattccaatcgtcgcgtctcctaatcttacccccgaatcaaccctaattaactcgaaacctaccttttcccgcgcgctaacaaatcttaaaaaacgtacgcgaacccttaaaaacactatacaatctatacccgcctcgataacacccgcgcgaccccgcaaaacaac

SEQ ID NO: 18955 - DNA, 1843 bp, Artificial Sequence
  chemically treated genomic DNA (Homo sapiens) CpG-island No: 18955
tatttatgcgagatgataggtagtttcgcggatttatcgtcgagggaggtagaggttttcggtttttttaaagttgttttgttaggggttttttggtcgtttttcggttcgtcgcgttttcgttgtttgcgggcgattttttcgggtcgcgttgacggagtttcgtaggaaggtatttttggagcgcgcgtcgttcgcgtttttttagtcgcgcgtttcgagtttggttgcggcgcggatattcggcgtgcgtttatagtcgttttatagtttaatttcgaacgtttcgtttttgtatttatcgtttcggattggttggtcggaggcggagcgattgttaggcggtttaatcggagttcggttttttacgggttttcgcggttcggttttcgaggtcgtaggcggaggggttttgatagtttcgattggtagattacgagcgggttcgagcgcggtcggtagagtagcgtcgtcgtcgtcgggcgcgtagttttgtagtttcgcggacgttttggcgttcgtagttttaggggtacggttgtttcgtatcgtgttcggtttcgtcgcggagatttcggacgatcgtcgcgggtgagtatcgcgggtttggggtgcgcgggcgttcggtcggagtcgtttcgggagacggcggcgaggatgttcggagtttcggtgttcgtgtcgggtacgttttgattttcgtttttcgtatattggggttttcggcgggttttagtttttttcgatcgggttttttacgtattgttttcgtgtttatatatttgggaggtggggagatgcggggaggagaggtaggaggaggtatttttcgcgcgaaggagggagacgagatcgtgtagtttaggtgttttcgttggatggaaatgatagcgttcggacgtcggtattcggttttttcggtagtaggaggttagcgttgatttgcggcggtcgcggtattttgtattttatcggttgatttttgttaatttcggggagggcgtgtttgtgtatttttgtgtttatgtttgcgtttcggtttttgatttaggtattttcgggtttggtttttcggcgacgcgttttgggcgtttattttggcgattcgtgtcgttttcggggtcgggtttatcgggcggaaagttcgggggtcggcgtacggagttggggattcgcgacgaattttcggaggggggtattaaaagcggaattttgcgggtgcgtagataatgttttattcgggcggtcgggtttcggggattgtgttttgggttttcgcgttttatttcgttttcgtttcgtttttttattagttttgtcgttgcgatgttgttgcgtcgcgtttttcgttattcggttggggattcgcgtggggttcgtttttgtttatagatttcgttattgggcgagagtagcgcgtcgtgcgttttttagtttcggcggttgtcgtttgttttttcgaaatttggagaagttgttgcgcgttgttaggtgacgtttttttttttcggtcgcggggcgggatgttgtaggggaaagatgtcgtttcggcgttttcgcgtttagttttcgtcgcgtacggcgtttttaggttttttgtattcgggggcgttcgtgttttagtttggggtttaggttggcggttttcggggcgtcgattcggttatatttattcggttttagtcgtcgcgttttttggttttgttttcgggttagttttggttgattcggagtttgttttttttcgcgcgttggtaggttttgaaggacgtgcgcgagtttttggggatattgtgtagtttgtgttcgtttcggtgatattcgcgcggtttcgtagggtagt

SEQ ID NO: 18956 - DNA, 1843 bp, Artificial Sequence
  chemically treated genomic DNA (Homo sapiens) CpG-island No: 18956
actaccctacgaaaccgcgcgaatatcaccgaaacgaacacaaactacacaatatccccaaaaactcgcgcacgtccttcaaaacctaccaacgcgcgaaaaaaaacaaactccgaatcaaccaaaactaacccgaaaacaaaaccaaaaaacgcgacgactaaaaccgaataaatataaccgaatcgacgccccgaaaaccgccaacctaaaccccaaactaaaacacgaacgcccccgaatacaaaaaacctaaaaacgccgtacgcgacgaaaactaaacgcgaaaacgccgaaacgacatctttcccctacaacatcccgccccgcgaccgaaaaaaaaaaacgtcacctaacaacgcgcaacaacttctccaaatttcgaaaaaacaaacgacaaccgccgaaactaaaaaacgcacgacgcgctactctcgcccaataacgaaatctataaacaaaaacgaaccccacgcgaatccccaaccgaataacgaaaaacgcgacgcaacaacatcgcaacgacaaaactaataaaaaaacgaaacgaaaacgaaataaaacgcgaaaacccaaaacacaatccccgaaacccgaccgcccgaataaaacattatctacgcacccgcaaaattccgcttttaatacccccctccgaaaattcgtcgcgaatccccaactccgtacgccgacccccgaactttccgcccgataaacccgaccccgaaaacgacacgaatcgccaaaataaacgcccaaaacgcgtcgccgaaaaaccaaacccgaaaatacctaaatcaaaaaccgaaacgcaaacataaacacaaaaatacacaaacacgccctccccgaaattaacaaaaatcaaccgataaaatacaaaataccgcgaccgccgcaaatcaacgctaacctcctactaccgaaaaaaccgaataccgacgtccgaacgctatcatttccatccaacgaaaacacctaaactacacgatctcgtctccctccttcgcgcgaaaaatacctcctcctacctctcctccccgcatctccccacctcccaaatatataaacacgaaaacaatacgtaaaaaacccgatcgaaaaaaactaaaacccgccgaaaaccccaatatacgaaaaacgaaaatcaaaacgtacccgacacgaacaccgaaactccgaacatcctcgccgccgtctcccgaaacgactccgaccgaacgcccgcgcaccccaaacccgcgatactcacccgcgacgatcgtccgaaatctccgcgacgaaaccgaacacgatacgaaacaaccgtacccctaaaactacgaacgccaaaacgtccgcgaaactacaaaactacgcgcccgacgacgacgacgctactctaccgaccgcgctcgaacccgctcgtaatctaccaatcgaaactatcaaaacccctccgcctacgacctcgaaaaccgaaccgcgaaaacccgtaaaaaaccgaactccgattaaaccgcctaacaatcgctccgcctccgaccaaccaatccgaaacgataaatacaaaaacgaaacgttcgaaattaaactataaaacgactataaacgcacgccgaatatccgcgccgcaaccaaactcgaaacgcgcgactaaaaaaacgcgaacgacgcgcgctccaaaaataccttcctacgaaactccgtcaacgcgacccgaaaaaatcgcccgcaaacaacgaaaacgcgacgaaccgaaaaacgaccaaaaaacccctaacaaaacaactttaaaaaaaccgaaaacctctacctccctcgacgataaatccgcgaaactacctatcatctcgcataaata

SEQ ID NO: 18957 - DNA, 921 bp, Artificial Sequence
  chemically treated genomic DNA (Homo sapiens) CpG-island No: 18957
tcggggttttggacgtttttcggttgcggggcggggggagttttcggcgtacgcggttttttggtttcgtttttagttattttcggttattcgcgattcgaggttgtcgtagggggcgggttgagcgcgtgcgaggcgattggtttggggttagagtgggcgaggcgcggaggtttggtttataaagtagtcgcggagacggggtgttggtttgcgtcgtagttttttgtagcgtttggggttttcgttgtagttttcggaattaggatttcggcgtggtttagcgagttatggcgacgaaggtcgtgtgcgtgttgaagggcgacggtttagtgtagggtattattaatttcgagtagaaggtaagggttgggacggaggtttgtttgcgaggtcgtttttattcgttcgttttttcgcgtatttttgttaggagcgggtcgttcgttaggtttcggggtcgttttggtttagcgttcggtttcggttcgtgtcgttcggtcggtgttttcgtttttagcggtgcggtgtttaagtgttgagttatcgggcgggttcgggcgcggggcgtgggatcgaggtcgtcgcggggttgggtttgcgcgtggcgggagcgcggggagggattgtcgcgggtcggggaggggcgggggcgggcgtgttgttttttgtggtttttgggtcgtcgtcgcgggtttgtcgtggtgtttggagcggttgtgttcgttttttgtttggtcgtgttttcgtttttgagggtttcgcggatatcgagtggcgtagtgttaggtttagttcggggatggcgattgcgtttgggttcgtttggtgttttcgtattttttttcgtttttcggttttagcgttttaggttagggagttttcgtttttgtatagttttaaggttaggaatggttttta

SEQ ID NO: 18958 - DNA, 921 bp, Artificial Sequence
  chemically treated genomic DNA (Homo sapiens) CpG-island No: 18958
taaaaaccattcctaaccttaaaactatacaaaaacgaaaactccctaacctaaaacgctaaaaccgaaaaacgaaaaaaaatacgaaaacaccaaacgaacccaaacgcaatcgccatccccgaactaaacctaacactacgccactcgatatccgcgaaaccctcaaaaacgaaaacacgaccaaacaaaaaacgaacacaaccgctccaaacaccacgacaaacccgcgacgacgacccaaaaaccacaaaaaacaacacgcccgcccccgcccctccccgacccgcgacaatccctccccgcgctcccgccacgcgcaaacccaaccccgcgacgacctcgatcccacgccccgcgcccgaacccgcccgataactcaacacttaaacaccgcaccgctaaaaacgaaaacaccgaccgaacgacacgaaccgaaaccgaacgctaaaccaaaacgaccccgaaacctaacgaacgacccgctcctaacaaaaatacgcgaaaaaacgaacgaataaaaacgacctcgcaaacaaacctccgtcccaacccttaccttctactcgaaattaataataccctacactaaaccgtcgcccttcaacacgcacacgaccttcgtcgccataactcgctaaaccacgccgaaatcctaattccgaaaactacaacgaaaaccccaaacgctacaaaaaactacgacgcaaaccaacaccccgtctccgcgactactttataaaccaaacctccgcgcctcgcccactctaaccccaaaccaatcgcctcgcacgcgctcaacccgccccctacgacaacctcgaatcgcgaataaccgaaaataactaaaaacgaaaccaaaaaaccgcgtacgccgaaaactccccccgccccgcaaccgaaaaacgtccaaaaccccga

SEQ ID NO: 18959 - DNA, 921 bp, Artificial Sequence
  chemically treated genomic DNA (Homo sapiens) CpG-island No: 18959
taaaaattatttttagttttagagttgtataaaagcgaagattttttgatttagagcgttgaagtcggaaagcggagagggatgcgaagatattaggcgggtttaggcgtagtcgttattttcgggttgggtttggtattgcgttattcggtgttcgcgggatttttaggaacgagaatacggttaagtaagggacgagtatagtcgttttaggtattacgatagattcgcggcggcggtttaaggattatagagggtagtacgttcgttttcgttttttttcggttcgcggtaattttttttcgcgttttcgttacgcgtaggtttagtttcgcggcggtttcggttttacgtttcgcgttcgggttcgttcggtgatttagtatttgggtatcgtatcgttgggggcgaaggtatcgatcgggcggtacgggtcgggatcgggcgttggattagggcggtttcgaggtttggcgggcgattcgtttttagtaaaggtgcgcggggggacgagcgggtgggagcggtttcgtaaataagttttcgttttagtttttgttttttgttcgaaattgatgatgttttgtattgggtcgtcgttttttagtacgtatacggttttcgtcgttataattcgttaggttacgtcgaggttttggtttcgaggattgtaacggaaattttagacgttgtaggagattacgacgtaaattagtatttcgttttcgcgattattttataggttagattttcgcgtttcgtttattttggttttaaattaatcgtttcgtacgcgtttagttcgttttttgcggtagtttcgggtcgcgagtggtcgggaatgattgggggcggggttaaggggtcgcgtgcgtcggagatttttttcgtttcgtagtcgggaaacgtttagaatttcga

SEQ ID NO: 18960 - DNA, 921 bp, Artificial Sequence
  chemically treated genomic DNA (Homo sapiens) CpG-island No: 18960
tcgaaattctaaacgtttcccgactacgaaacgaaaaaaatctccgacgcacgcgaccccttaaccccgcccccaatcattcccgaccactcgcgacccgaaactaccgcaaaaaacgaactaaacgcgtacgaaacgattaatttaaaaccaaaataaacgaaacgcgaaaatctaacctataaaataatcgcgaaaacgaaatactaatttacgtcgtaatctcctacaacgtctaaaatttccgttacaatcctcgaaaccaaaacctcgacgtaacctaacgaattataacgacgaaaaccgtatacgtactaaaaaacgacgacccaatacaaaacatcatcaatttcgaacaaaaaacaaaaactaaaacgaaaacttatttacgaaaccgctcccacccgctcgtccccccgcgcacctttactaaaaacgaatcgcccgccaaacctcgaaaccgccctaatccaacgcccgatcccgacccgtaccgcccgatcgataccttcgcccccaacgatacgatacccaaatactaaatcaccgaacgaacccgaacgcgaaacgtaaaaccgaaaccgccgcgaaactaaacctacgcgtaacgaaaacgcgaaaaaaaattaccgcgaaccgaaaaaaaacgaaaacgaacgtactaccctctataatccttaaaccgccgccgcgaatctatcgtaatacctaaaacgactatactcgtcccttacttaaccgtattctcgttcctaaaaatcccgcgaacaccgaataacgcaataccaaacccaacccgaaaataacgactacgcctaaacccgcctaatatcttcgcatccctctccgctttccgacttcaacgctctaaatcaaaaaatcttcgcttttatacaactctaaaactaaaaataattttta

SEQ ID NO: 18961 - DNA, 1442 bp, Artificial Sequence
  chemically treated genomic DNA (Homo sapiens) CpG-island No: 18961
ttagtcgtcgacgcgtcgcggtttgagtaataggagagttgaagttattttttcgttagttttacgatcggtagatgttttcgttttttcgtttttaattttatacgttcgttcgcgttttttttttagttttttgcgggttttcggtattgcgaattcgataacggggttcgcggagtagagagcgagggcgtttagattcgaaaaagggttaagttagaggaataggtatagatttgggttatgggaggtcgtaagggggcgaggggagaagttcgaggtcgcggttcgggggtgggtagtggggggaggggtgcggggttagttttcgtggtcgtcgcgatttttttcgggttataggtttcgtttcgcgtaggtttcgtcgtttcggaatcggggtaggaagcgtttttattcggattaaagttttaaattttcggcggcgggagaaacgagtttcggttttcgtagtaggttcggtatttttttgttttaaatattttttattttttggttgaaggcgttgacggcgtttatgttcgcgttgcggcggcggttgtttcgggttcgtcggttatatagatttcgcgtcgcggcggagcggggttgggaaattagtcgggtttggtggtcggggggaggcgacgagcggcggagttcgaggttcgggtaggaagaggttgcgttcgaagcggcgaggcgggcggtcgaggtagaggcggagaggtggcgggtttttttttagtttcgttcgtaggatgaggaaaaggaggcggcggtagcgttggtttttaatatgttcgtttggtggtggcggttgcgttttgcgtttcgttgatacggtttttcgcgtttttacgtattggtttatattggttcggtcggcgagcgggcgggtttttttttttttttttttagcgggatggcggtagcggttcgagtttacgtcgcgcggggtattttgggacggtttaggtttttcggcgttttttgtgttcggcgttcgtttcgtttcgtcgcgttggtttcgtttttttttcgtttcgtttcgttttgcgtcgttttgtatcgtttcgcgtgtagggttgttggcgcgtgacgtcgggacgttgggcgttttttcgtcggcggcggcggcggtcgcggtcgcgggtcggggagacggttttgtagagcgcgggattttagggttgcgagggtgatttagagtaagttttggcgtacgcgcgtttcgttcgacgcggtgttttcggggtgcgtttttgcgaaacgttcggttttaatcggttttgtattcggcgggggcggcgggtattgagtcgttggttttcggttgtcgcgaataaagggcgtaggatttaatttcggttttttgggcgtgtttttgtaggttttcgtgcgttttgttggggaaaagaaaaaaagtttttgttaatgttagt

SEQ ID NO: 18962 - DNA, 1442 bp, Artificial Sequence
  chemically treated genomic DNA (Homo sapiens) CpG-island No: 18962
actaacattaacaaaaactttttttcttttccccaacaaaacgcacgaaaacctacaaaaacacgcccaaaaaaccgaaattaaatcctacgccctttattcgcgacaaccgaaaaccaacgactcaatacccgccgcccccgccgaatacaaaaccgattaaaaccgaacgtttcgcaaaaacgcaccccgaaaacaccgcgtcgaacgaaacgcgcgtacgccaaaacttactctaaatcaccctcgcaaccctaaaatcccgcgctctacaaaaccgtctccccgacccgcgaccgcgaccgccgccgccgccgacgaaaaaacgcccaacgtcccgacgtcacgcgccaacaaccctacacgcgaaacgatacaaaacgacgcaaaacgaaacgaaacgaaaaaaaaacgaaaccaacgcgacgaaacgaaacgaacgccgaacacaaaaaacgccgaaaaacctaaaccgtcccaaaataccccgcgcgacgtaaactcgaaccgctaccgccatcccgctaaaaaaaaaaaaaaaaaaacccgcccgctcgccgaccgaaccaatataaaccaatacgtaaaaacgcgaaaaaccgtatcaacgaaacgcaaaacgcaaccgccaccaccaaacgaacatattaaaaaccaacgctaccgccgcctccttttcctcatcctacgaacgaaactaaaaaaaaacccgccacctctccgcctctacctcgaccgcccgcctcgccgcttcgaacgcaacctcttcctacccgaacctcgaactccgccgctcgtcgcctccccccgaccaccaaacccgactaatttcccaaccccgctccgccgcgacgcgaaatctatataaccgacgaacccgaaacaaccgccgccgcaacgcgaacataaacgccgtcaacgccttcaaccaaaaaataaaaaatatttaaaacaaaaaaataccgaacctactacgaaaaccgaaactcgtttctcccgccgccgaaaatttaaaactttaatccgaataaaaacgcttcctaccccgattccgaaacgacgaaacctacgcgaaacgaaacctataacccgaaaaaaatcgcgacgaccacgaaaactaaccccgcacccctccccccactacccacccccgaaccgcgacctcgaacttctcccctcgcccccttacgacctcccataacccaaatctatacctattcctctaacttaaccctttttcgaatctaaacgccctcgctctctactccgcgaaccccgttatcgaattcgcaataccgaaaacccgcaaaaaactaaaaaaaaaacgcgaacgaacgtataaaattaaaaacgaaaaaacgaaaacatctaccgatcgtaaaactaacgaaaaaataacttcaactctcctattactcaaaccgcgacgcgtcgacgactaa

SEQ ID NO: 18963 - DNA, 1442 bp, Artificial Sequence
  chemically treated genomic DNA (Homo sapiens) CpG-island No: 18963
attggtattggtagaagtttttttttttttttttagtagagcgtacgagggtttgtaaaggtacgtttagagagtcgaggttaaattttgcgttttttgttcgcggtagtcgagagttagcggtttagtgttcgtcgttttcgtcgggtgtagggtcggttagggtcgagcgtttcgtagagacgtatttcgggagtatcgcgtcgagcggagcgcgcgtgcgttagggtttgttttgggttattttcgtagttttgggatttcgcgttttgtaaggtcgttttttcggttcgcggtcgcggtcgtcgtcgtcgtcggcgggaaagcgtttagcgtttcggcgttacgcgttagtagttttgtacgcggggcggtgtagggcggcgtagggcgggacgaggcggggagggggcggggttagcgcgacggggcggggcgaacgtcgggtataggaagcgtcgggaggtttgagtcgttttagggtgtttcgcgcggcgtggattcgggtcgttgtcgttatttcgttggagagagggagagagaggttcgttcgttcgtcggtcgggttagtgtgagttagtgcgtgagggcgcggggggtcgtgttagcgagacgtagagcgtagtcgttattattaaacggatatgttgaagattagcgttgtcgtcgtttttttttttttattttgcgaacgggattgagagggggttcgttattttttcgtttttgtttcggtcgttcgtttcgtcgtttcgggcgtagtttttttttgttcgggtttcggatttcgtcgttcgtcgttttttttcggttattaggttcggttggttttttagtttcgtttcgtcgcggcgcgaggtttatgtgatcggcgggttcggagtagtcgtcgtcgtagcgcgaatatggacgtcgttaacgtttttaattaggaggtaaggggtgtttggggtaggggggtgtcgggtttgttgcgggagtcggggttcgtttttttcgtcgtcggaggtttaaagttttggttcgggtggggacgttttttgtttcggtttcggggcggcggggtttgcgcggagcggggtttgtggttcgggagaggtcgcggcgattacgggaattgatttcgtatttttttttttattgtttattttcggatcgcgatttcgggttttttttttcgtttttttgcggttttttatagtttaagtttgtgtttgtttttttaatttggttttttttcgggtttgggcgttttcgttttttgtttcgcgagtttcgttgtcgggttcgtagtgtcgggagttcgtaaagggttaagaaagaagcgcgggcgggcgtgtggggttgggggcgggggagcgggagtatttgtcggtcgtggggttggcggagaggtggttttagtttttttgttgtttaggtcgcggcgcgtcgacggttgg

SEQ ID NO: 18964 - DNA, 1442 bp, Artificial Sequence
  chemically treated genomic DNA (Homo sapiens) CpG-island No: 18964
ccaaccgtcgacgcgccgcgacctaaacaacaaaaaaactaaaaccacctctccgccaaccccacgaccgacaaatactcccgctcccccgcccccaaccccacacgcccgcccgcgcttctttcttaaccctttacgaactcccgacactacgaacccgacaacgaaactcgcgaaacaaaaaacgaaaacgcccaaacccgaaaaaaaaccaaattaaaaaaacaaacacaaacttaaactataaaaaaccgcaaaaaaacgaaaaaaaaaacccgaaatcgcgatccgaaaataaacaataaaaaaaaaaatacgaaatcaattcccgtaatcgccgcgacctctcccgaaccacaaaccccgctccgcgcaaaccccgccgccccgaaaccgaaacaaaaaacgtccccacccgaaccaaaactttaaacctccgacgacgaaaaaaacgaaccccgactcccgcaacaaacccgacacccccctaccccaaacaccccttacctcctaattaaaaacgttaacgacgtccatattcgcgctacgacgacgactactccgaacccgccgatcacataaacctcgcgccgcgacgaaacgaaactaaaaaaccaaccgaacctaataaccgaaaaaaaacgacgaacgacgaaatccgaaacccgaacaaaaaaaaactacgcccgaaacgacgaaacgaacgaccgaaacaaaaacgaaaaaataacgaaccccctctcaatcccgttcgcaaaataaaaaaaaaaaaacgacgacaacgctaatcttcaacatatccgtttaataataacgactacgctctacgtctcgctaacacgaccccccgcgccctcacgcactaactcacactaacccgaccgacgaacgaacgaacctctctctccctctctccaacgaaataacgacaacgacccgaatccacgccgcgcgaaacaccctaaaacgactcaaacctcccgacgcttcctatacccgacgttcgccccgccccgtcgcgctaaccccgccccctccccgcctcgtcccgccctacgccgccctacaccgccccgcgtacaaaactactaacgcgtaacgccgaaacgctaaacgctttcccgccgacgacgacgacgaccgcgaccgcgaaccgaaaaaacgaccttacaaaacgcgaaatcccaaaactacgaaaataacccaaaacaaaccctaacgcacgcgcgctccgctcgacgcgatactcccgaaatacgtctctacgaaacgctcgaccctaaccgaccctacacccgacgaaaacgacgaacactaaaccgctaactctcgactaccgcgaacaaaaaacgcaaaatttaacctcgactctctaaacgtacctttacaaaccctcgtacgctctactaaaaaaaaaaaaaaaaacttctaccaataccaat

SEQ ID NO: 18965 - DNA, 557 bp, Artificial Sequence
  chemically treated genomic DNA (Homo sapiens) CpG-island No: 18965
gggcgtatgatatattcgatataggatatatgacgtttttgatataggatgtatgatatattcgatataggaggtatgacgtttttgatataggacgtacgatatattgatataggacgaatgacgtttcgatataggacgtatgacgtttttgatataggacgcgtgatatattcgatataggacgtgtgacgttttcggtataggacgtgtgacgtatttgatatacgacgcgtgatatattcgatataggacgtgtgacgtttttgatatgacgtgtgaaatatttgatataggatacgtgacgtatttgatatgcgacgtatgacgtgatataggatgcgtgatatattcgatataggacgtatggcgtttttgatataagacgtgtgaaatatttgatataggacgtatgacgtattcgacgtaggacgcgtgatgtattcgatataggatgcgtgacgtttttgatataggatgtgtgatatttgatataggacgcgtgacgtttttgatataggatgtatgatatatgacgtatttgatatacgacgtaa

SEQ ID NO: 18966 - DNA, 557 bp, Artificial Sequence
  chemically treated genomic DNA (Homo sapiens) CpG-island No: 18966
ttacgtcgtatatcaaatacgtcatatatcatacatcctatatcaaaaacgtcacgcgtcctatatcaaatatcacacatcctatatcaaaaacgtcacgcatcctatatcgaatacatcacgcgtcctacgtcgaatacgtcatacgtcctatatcaaatatttcacacgtcttatatcaaaaacgccatacgtcctatatcgaatatatcacgcatcctatatcacgtcatacgtcgcatatcaaatacgtcacgtatcctatatcaaatatttcacacgtcatatcaaaaacgtcacacgtcctatatcgaatatatcacgcgtcgtatatcaaatacgtcacacgtcctataccgaaaacgtcacacgtcctatatcgaatatatcacgcgtcctatatcaaaaacgtcatacgtcctatatcgaaacgtcattcgtcctatatcaatatatcgtacgtcctatatcaaaaacgtcatacctcctatatcgaatatatcatacatcctatatcaaaaacgtcatatatcctatatcgaatatatcatacgccc

SEQ ID NO: 18967 - DNA, 557 bp, Artificial Sequence
  chemically treated genomic DNA (Homo sapiens) CpG-island No: 18967
ttacgtcgtatgttagatgcgttatgtgttatgtattttatgttaggggcgttacgcgttttatgttagatgttatatattttatgttaggggcgttacgtattttatgtcggatgtattacgcgttttgcgtcggatgcgttatgcgttttatgttagatgttttatacgttttatgttaggggcgttatgcgttttatgtcggatgtgttacgtattttatgttacgttatgcgtcgtatgttagatgcgttacgtgttttatgttagatgttttatacgttatgttaggggcgttatacgttttatgtcggatatgttacgcgtcgtatgttagatgcgttatacgttttatgtcgggggcgttatacgttttatgtcggatgtgttacgcgttttatgttaggggcgttatgcgttttatgtcggggcgttattcgttttatgttagtgtgtcgtgcgttttatgttaggggcgttatgttttttatgtcggatgtgttatgtattttatgttaggggcgttatgtgttttatgtcggatatgttatgcgttt

SEQ ID NO: 18968 - DNA, 557 bp, Artificial Sequence
  chemically treated genomic DNA (Homo sapiens) CpG-island No: 18968
aaacgcataacatatccgacataaaacacataacgcccctaacataaaatacataacacatccgacataaaaaacataacgcccctaacataaaacgcacgacacactaacataaaacgaataacgccccgacataaaacgcataacgcccctaacataaaacgcgtaacacatccgacataaaacgtataacgcccccgacataaaacgtataacgcatctaacatacgacgcgtaacatatccgacataaaacgtataacgcccctaacataacgtataaaacatctaacataaaacacgtaacgcatctaacatacgacgcataacgtaacataaaatacgtaacacatccgacataaaacgcataacgcccctaacataaaacgtataaaacatctaacataaaacgcataacgcatccgacgcaaaacgcgtaatacatccgacataaaatacgtaacgcccctaacataaaatatataacatctaacataaaacgcgtaacgcccctaacataaaatacataacacataacgcatctaacatacgacgtaa

SEQ ID NO: 18969 - DNA, 523 bp, Artificial Sequence
  chemically treated genomic DNA (Homo sapiens) CpG-island No: 18969
gtcgtacggcgcgtatgcgtattagaggtcgttcgtcgtttcgttttttttaggtttttgttttttttcggttttcgttatcgtttttcgtttcgcgtatgagtagcggcggtttttttttttatggcgttttggggcgcgggcgatttgtaggtaatggtaggcgttcggttattgaggtgtagtagaggatgcgttggcggttgtgagtgcggcgataagggtaaatgtagcgatttttcgttgttgggtaagagatttttcgaagattcgagtcgttattagttgttgtagaagtgggcgagtatgtggagttttatgagcgaagacgcgtcggtggtcgatatggagagggcgtagttggaggaggaggcggcggttgcggaggagaggtcgttggtgtttttgtgtttcggttgtcggcggtcgttgggcgattcgttgagttgggtggttagttaggaggatattaattgtattttgtttcgttgttagttgggtcgagtcgggtagggggggcgtg

SEQ ID NO: 18970 - DNA, 523 bp, Artificial Sequence
  chemically treated genomic DNA (Homo sapiens) CpG-island No: 18970
cacgccccccctacccgactcgacccaactaacaacgaaacaaaatacaattaatatcctcctaactaaccacccaactcaacgaatcgcccaacgaccgccgacaaccgaaacacaaaaacaccaacgacctctcctccgcaaccgccgcctcctcctccaactacgccctctccatatcgaccaccgacgcgtcttcgctcataaaactccacatactcgcccacttctacaacaactaataacgactcgaatcttcgaaaaatctcttacccaacaacgaaaaatcgctacatttacccttatcgccgcactcacaaccgccaacgcatcctctactacacctcaataaccgaacgcctaccattacctacaaatcgcccgcgccccaaaacgccataaaaaaaaaaaccgccgctactcatacgcgaaacgaaaaacgataacgaaaaccgaaaaaaaacaaaaacctaaaaaaaacgaaacgacgaacgacctctaatacgcatacgcgccgtacgac

SEQ ID NO: 18971 - DNA, 523 bp, Artificial Sequence
  chemically treated genomic DNA (Homo sapiens) CpG-island No: 18971
tacgttttttttgttcggttcgatttaattgatagcgaagtaggatgtagttggtgtttttttggttggttatttagtttagcgagtcgtttagcggtcgtcggtagtcggagtataggaatattagcggtttttttttcgtagtcgtcgtttttttttttagttgcgttttttttatgtcggttatcgacgcgttttcgtttatggagttttatatgttcgtttatttttgtaatagttggtggcggttcgagttttcggagagttttttgtttaatagcgaggagtcgttgtatttgtttttgtcgtcgtatttatagtcgttagcgtattttttgttatattttagtgatcgaacgtttgttattatttataaatcgttcgcgttttagagcgttatgggaaaaaaaatcgtcgttgtttatgcgcggggcggggagcggtggcggaggtcgagaaggggtaaaagtttgaagggggcgggacggcgggcggtttttagtgcgtatgcgcgtcgtgcggt

SEQ ID NO: 18972 - DNA, 523 bp, Artificial Sequence
  chemically treated genomic DNA (Homo sapiens) CpG-island No: 18972
accgcacgacgcgcatacgcactaaaaaccgcccgccgtcccgcccccttcaaacttttaccccttctcgacctccgccaccgctccccgccccgcgcataaacaacgacgattttttttcccataacgctctaaaacgcgaacgatttataaataataacaaacgttcgatcactaaaatataacaaaaaatacgctaacgactataaatacgacgacaaaaacaaatacaacgactcctcgctattaaacaaaaaactctccgaaaactcgaaccgccaccaactattacaaaaataaacgaacatataaaactccataaacgaaaacgcgtcgataaccgacataaaaaaaacgcaactaaaaaaaaaaacgacgactacgaaaaaaaaaccgctaatattcctatactccgactaccgacgaccgctaaacgactcgctaaactaaataaccaaccaaaaaaacaccaactacatcctacttcgctatcaattaaatcgaaccgaacaaaaaaaacgta

SEQ ID NO: 18973 - DNA, 716 bp, Artificial Sequence
  chemically treated genomic DNA (Homo sapiens) CpG-island No: 18973
tatcgtcgttttttttgtttcgggttatcgtcggttggggggacggtaggcggggtcgataaatacgaatggttattcgggaagagttacgattcggggtatcgattcgattggggtttttcgggggtttcgggtagtcgattgttcgggaaagcggttttttttcggagagacggaagagtcgagtagtttaaattttttatttatgcgttagaagagatatttcggcgtttaggcggattcggttcgttttcgcgggcgggttgatagtcgttgttattatagtttttagtttgacgcggtatttcgtataattagtggtttgtttataatttcgttcgttttttcgtatttcggttgttcgcggtcgttttttatcgttttcgttgacgttgcggaggtagagattggttttggaggcgttcgttcgttcggttgttcgtgggtttggtcgtagtagtttttcgtttttcgtcggtttgtttattttttttttcggtttttttttttttttttttcgtagtcgtcgttatagtcgtcgggagcgttattttcgttttagtaggtttatttttttcgtattgcgtcgcggtcgggggcggaagattcgtttcgcgcgagggaaggggcggggtattaggagggagattacgtttattttgcgtcgatcggttgggtttggtattcgcgggcggttttagttttagtttttagtt

SEQ ID NO: 18974 - DNA, 716 bp, Artificial Sequence
  chemically treated genomic DNA (Homo sapiens) CpG-island No: 18974
aactaaaaactaaaactaaaaccgcccgcgaataccaaacccaaccgatcgacgcaaaataaacgtaatctccctcctaataccccgccccttccctcgcgcgaaacgaatcttccgcccccgaccgcgacgcaatacgaaaaaaataaacctactaaaacgaaaataacgctcccgacgactataacgacgactacgaaaaaaaaaaaaaaaaaaaccgaaaaaaaaaataaacaaaccgacgaaaaacgaaaaactactacgaccaaacccacgaacaaccgaacgaacgaacgcctccaaaaccaatctctacctccgcaacgtcaacgaaaacgataaaaaacgaccgcgaacaaccgaaatacgaaaaaacgaacgaaattataaacaaaccactaattatacgaaataccgcgtcaaactaaaaactataataacaacgactatcaacccgcccgcgaaaacgaaccgaatccgcctaaacgccgaaatatctcttctaacgcataaataaaaaatttaaactactcgactcttccgtctctccgaaaaaaaaccgctttcccgaacaatcgactacccgaaacccccgaaaaaccccaatcgaatcgataccccgaatcgtaactcttcccgaataaccattcgtatttatcgaccccgcctaccgtccccccaaccgacgataacccgaaacaaaaaaaacgacgata

SEQ ID NO: 18975 - DNA, 716 bp, Artificial Sequence
  chemically treated genomic DNA (Homo sapiens) CpG-island No: 18975
agttggagattgaggttggggtcgttcgcgggtgttaggtttagtcggtcggcgtagagtgggcgtggttttttttttgatgtttcgttttttttttcgcgcggggcggatttttcgttttcggtcgcggcgtaatgcggaagagatgggtttgttggagcggaagtgacgttttcggcggttgtggcggcggttgcgggagaaggaggaggaggagtcggaggaagaggtgagtaagtcggcggggggcggggagttgttgcggttagatttacgggtagtcgggcgggcggacgtttttaagattagtttttgttttcgtagcgttagcgggagcggtgaggggcgatcgcgagtagtcggggtgcgggaggacgggcggggttgtgagtagattattggttgtgcggggtgtcgcgttaggttgggggttgtggtgatagcggttgttagttcgttcgcgggaacgaatcgaattcgtttgggcgtcggggtattttttttggcgtataaatggagggtttgggttgttcggttttttcgttttttcgagaaggagtcgttttttcgggtagtcgattgttcgggattttcgaggagttttagtcgggtcggtgtttcgagtcgtgatttttttcgggtggttattcgtatttatcggtttcgtttgtcgtttttttagtcggcggtagttcggggtaggagaggcggcggta

SEQ ID NO: 18976 - DNA, 716 bp, Artificial Sequence
  chemically treated genomic DNA (Homo sapiens) CpG-island No: 18976
taccgccgcctctcctaccccgaactaccgccgactaaaaaaacgacaaacgaaaccgataaatacgaataaccacccgaaaaaaatcacgactcgaaacaccgacccgactaaaactcctcgaaaatcccgaacaatcgactacccgaaaaaacgactccttctcgaaaaaacgaaaaaaccgaacaacccaaaccctccatttatacgccaaaaaaaataccccgacgcccaaacgaattcgattcgttcccgcgaacgaactaacaaccgctatcaccacaacccccaacctaacgcgacaccccgcacaaccaataatctactcacaaccccgcccgtcctcccgcaccccgactactcgcgatcgcccctcaccgctcccgctaacgctacgaaaacaaaaactaatcttaaaaacgtccgcccgcccgactacccgtaaatctaaccgcaacaactccccgccccccgccgacttactcacctcttcctccgactcctcctcctccttctcccgcaaccgccgccacaaccgccgaaaacgtcacttccgctccaacaaacccatctcttccgcattacgccgcgaccgaaaacgaaaaatccgccccgcgcgaaaaaaaaaacgaaacatcaaaaaaaaaaccacgcccactctacgccgaccgactaaacctaacacccgcgaacgaccccaacctcaatctccaact

SEQ ID NO: 18977 - DNA, 761 bp, Artificial Sequence
  chemically treated genomic DNA (Homo sapiens) CpG-island No: 18977
cgggaacgcgttttttgttcgagtagaaggtcggaggttggggaagattcgtagtcggtcggacggtaggggatttcgttttagggtttcggggttgggcgtttagagaatacgggggcgggggacgggggtttgcgtcggggatgcggtcgtttaagggcgttcgaagcgcgtattttattttttttttcgttttggaagttgagtaggttggttcggggtatttttttgttttcgcgaggttttttgcgcggttttagttcgttgtcgggtttcgcgtcgtcggggaagtcgttttcggttttagtttcgaggttcggggttagcgcggaaggcggcgacggtttcgggtttagtagcgatttttcgttaggggttttgtcgtcgttatcggggttcgttttttcgttcgtgttcggcggcggtaataacggcggcggtttttgttttttatcgcgttttcgtttttttttttcggagtcgtttcgtttgcgtacgtttattcgtcgggtttttcggaatattttcgcggttcgtacggcggtcgaatattcgtttttatatcgcggtttcggtagcgtcgagttcgtgacggcgtacgcgcgtttttcggagttttagtcgggtcgagttttttgttgttatcgcgtattttacgagcgcgtatgcgtttatgtttttacgcgtttttaatatttggagaaagagagagagtgagagagagagagagagagagagagagagagagagagagagagaga

SEQ ID NO: 18978 - DNA, 761 bp, Artificial Sequence
  chemically treated genomic DNA (Homo sapiens) CpG-island No: 18978
tctctctctctctctctctctctctctctctctctctctctctctcactctctctctttctccaaatattaaaaacgcgtaaaaacataaacgcatacgcgctcgtaaaatacgcgataacaacaaaaaactcgacccgactaaaactccgaaaaacgcgcgtacgccgtcacgaactcgacgctaccgaaaccgcgatataaaaacgaatattcgaccgccgtacgaaccgcgaaaatattccgaaaaacccgacgaataaacgtacgcaaacgaaacgactccgaaaaaaaaaaacgaaaacgcgataaaaaacaaaaaccgccgccgttattaccgccgccgaacacgaacgaaaaaacgaaccccgataacgacgacaaaacccctaacgaaaaatcgctactaaacccgaaaccgtcgccgccttccgcgctaaccccgaacctcgaaactaaaaccgaaaacgacttccccgacgacgcgaaacccgacaacgaactaaaaccgcgcaaaaaacctcgcgaaaacaaaaaaataccccgaaccaacctactcaacttccaaaacgaaaaaaaaaataaaatacgcgcttcgaacgcccttaaacgaccgcatccccgacgcaaacccccgtcccccgcccccgtattctctaaacgcccaaccccgaaaccctaaaacgaaatcccctaccgtccgaccgactacgaatcttccccaacctccgaccttctactcgaacaaaaaacgcgttcccg

SEQ ID NO: 18979 - DNA, 761 bp, Artificial Sequence
  chemically treated genomic DNA (Homo sapiens) CpG-island No: 18979
ttttttttttttttttttttttttttttttttttttttttttttttattttttttttttttttaagtattgagagcgcgtgggagtataggcgtatgcgcgttcgtggggtgcgcggtagtaatagaggattcgattcggttggagtttcggagagcgcgcgtgcgtcgttacgagttcggcgttgtcggggtcgcggtgtggaagcgagtattcgatcgtcgtgcgggtcgcggggatgtttcgaaaggttcggcgggtgaacgtgcgtaagcggaacgatttcgaagaggaagagcgggaacgcgatgaggagtaggagtcgtcgtcgttgttgtcgtcgtcgggtacgggcgaagaggcgggtttcggtggcggcgatagggtttttggcggggagtcgttgttgggttcggggtcgtcgtcgtttttcgcgttgatttcgggtttcggggttgaggtcgggggcggttttttcggcggcgcggagttcggtaacgggttgaagtcgcgtaagaggtttcgcgagaataaagaggtgtttcgggttagtttgtttagtttttaggacgaggaggaaggtaaagtgcgcgtttcggacgtttttagacggtcgtattttcgacgtaggttttcgtttttcgttttcgtattttttggacgtttagtttcggagttttggaacggagttttttgtcgttcgatcggttgcgaattttttttagttttcggttttttgttcgggtaagggacgcgttttcg

SEQ ID NO: 18980 - DNA, 761 bp, Artificial Sequence
  chemically treated genomic DNA (Homo sapiens) CpG-island No: 18980
cgaaaacgcgtcccttacccgaacaaaaaaccgaaaactaaaaaaaattcgcaaccgatcgaacgacaaaaaactccgttccaaaactccgaaactaaacgtccaaaaaatacgaaaacgaaaaacgaaaacctacgtcgaaaatacgaccgtctaaaaacgtccgaaacgcgcactttaccttcctcctcgtcctaaaaactaaacaaactaacccgaaacacctctttattctcgcgaaacctcttacgcgacttcaacccgttaccgaactccgcgccgccgaaaaaaccgcccccgacctcaaccccgaaacccgaaatcaacgcgaaaaacgacgacgaccccgaacccaacaacgactccccgccaaaaaccctatcgccgccaccgaaacccgcctcttcgcccgtacccgacgacgacaacaacgacgacgactcctactcctcatcgcgttcccgctcttcctcttcgaaatcgttccgcttacgcacgttcacccgccgaacctttcgaaacatccccgcgacccgcacgacgatcgaatactcgcttccacaccgcgaccccgacaacgccgaactcgtaacgacgcacgcgcgctctccgaaactccaaccgaatcgaatcctctattactaccgcgcaccccacgaacgcgcatacgcctatactcccacgcgctctcaatacttaaaaaaaaaaaaaaaataaaaaaaaaaaaaaaaaaaaaaaaaaaaaaaaaaaaaaaaaaaaaa

SEQ ID NO: 18981 - DNA, 1199 bp, Artificial Sequence
  chemically treated genomic DNA (Homo sapiens) CpG-island No: 18981
cgtattttcgtgcgcgaggagggaagatcgtggttgagtgcgggtggtttgggcggaaggtttagcggggataggttgggtcgtagttttgttgtgttgtgtcgtgcgacgtttttcgtaggagcgcgtaaagtgttagttacggcgttaagtaagttggacgtgcgtgtatgagcgcgttcggattgatagggaagcgaaaagggggttagggcgtattatagaaaagtcgcggtagaaacgtacgatatagttcgaggcggcgggggcgagagtttcggggtagggacggcgacgcggcgtattcggtttggcgtttttgcgcggcggtcggtcgtttcgtagcgttttaggtggtcgtcggcggggtcgtcgtcgggggagtggattttttcgttttcgtcgggttcggttgttttcggtagttttttcgtttggttttttttcgattttttttttttttttttttcggttcgcgatggattgggttttttcgtcgcgtcgtcgtcgtcgtcgttcgtagtatcgcgcgggtttttgagttgtagggtttgaggagtcgcgtgttggggattggacgttcgttggttttgtcgtacgcgagaatttttcgtttttttgttattaggttttcgcggaggaaggggagggacgaggcgcggttttttttgtgtcgtttgttcggttcgatttgcgcgcgtgcggttttttgggaattttagggtcgcggtcgggtttggttttgtcggcggtttgttgggagttggatcggagcggtttggaacgataagttcgagtaagagtttgcgggaaggggaggcgggagcgtttcggatcgtcggaagggttttgcgtgggggcgcggatttcggacgttcggcgagtggcggaaagcgagatttcggcgtcgagtgaggtcggttaggttgttgtcgattttttcgttggtttttttgtttttttttcggggttttgtcggcggcggggttcggttgttcgcgttagagttttaggtcggttttttttgtttttgagaagggttcgttgttaggttttcgagtttcgggcgtagttttcgggagagtcggcgttttgtttggttcggcggttttttttcgggtacgaaggtttgttgttgtttttttagaatttttttttttcgtagatataggtagttaatttagcggggtttggtgttg

SEQ ID NO: 18982 - DNA, 1199 bp, Artificial Sequence
  chemically treated genomic DNA (Homo sapiens) CpG-island No: 18982
caacaccaaaccccgctaaattaactacctatatctacgaaaaaaaaaaattctaaaaaaacaacaacaaaccttcgtacccgaaaaaaaaccgccgaaccaaacaaaacgccgactctcccgaaaactacgcccgaaactcgaaaacctaacaacgaacccttctcaaaaacaaaaaaaaccgacctaaaactctaacgcgaacaaccgaaccccgccgccgacaaaaccccgaaaaaaaaacaaaaaaaccaacgaaaaaatcgacaacaacctaaccgacctcactcgacgccgaaatctcgctttccgccactcgccgaacgtccgaaatccgcgcccccacgcaaaacccttccgacgatccgaaacgctcccgcctccccttcccgcaaactcttactcgaacttatcgttccaaaccgctccgatccaactcccaacaaaccgccgacaaaaccaaacccgaccgcgaccctaaaattcccaaaaaaccgcacgcgcgcaaatcgaaccgaacaaacgacacaaaaaaaaccgcgcctcgtccctccccttcctccgcgaaaacctaataacaaaaaaacgaaaaattctcgcgtacgacaaaaccaacgaacgtccaatccccaacacgcgactcctcaaaccctacaactcaaaaacccgcgcgatactacgaacgacgacgacgacgacgcgacgaaaaaacccaatccatcgcgaaccgaaaaaaaaaaaaaaaaaaaatcgaaaaaaaaccaaacgaaaaaactaccgaaaacaaccgaacccgacgaaaacgaaaaaatccactcccccgacgacgaccccgccgacgaccacctaaaacgctacgaaacgaccgaccgccgcgcaaaaacgccaaaccgaatacgccgcgtcgccgtccctaccccgaaactctcgcccccgccgcctcgaactatatcgtacgtttctaccgcgacttttctataatacgccctaacccccttttcgcttccctatcaatccgaacgcgctcatacacgcacgtccaacttacttaacgccgtaactaacactttacgcgctcctacgaaaaacgtcgcacgacacaacacaacaaaactacgacccaacctatccccgctaaaccttccgcccaaaccacccgcactcaaccacgatcttccctcctcgcgcacgaaaatacg

SEQ ID NO: 18983 - DNA, 1199 bp, Artificial Sequence
  chemically treated genomic DNA (Homo sapiens) CpG-island No: 18983
tagtattaaatttcgttaagttaattatttgtgtttacgaggaagggaagttttggagaagtagtagtaagttttcgtgttcgagaggaggtcgtcgggttaggtagggcgtcggttttttcgggagttgcgttcggaattcgaaggtttggtagcgaattttttttaagggtaaaaggagtcggtttgaggttttggcgcgggtaatcgggtttcgtcgtcggtagggtttcgggaggggaataaaggggttagcggggaagtcggtagtagtttggtcgattttattcggcgtcggggtttcgtttttcgttattcgtcgggcgttcgggattcgcgtttttacgtagggttttttcgacggttcgaggcgttttcgtttttttttttcgtaggtttttattcgggtttgtcgttttaaatcgtttcgatttagtttttaataggtcgtcggtagagttaggttcggtcgcggttttagagtttttaagaagtcgtacgcgcgtaggtcgaatcgggtaggcggtataggaaaagtcgcgtttcgtttttttttttttttcgcgaggatttggtgatagggaagcgagaggttttcgcgtgcggtagagttagcggacgtttagtttttagtacgcggttttttaggttttgtaatttagaggttcgcgcggtgttgcgggcgacggcggcggcggcgcggcggggaggtttagtttatcgcgaatcgggagggggaggggaggagggtcgagggagagttaggcggggaagttgtcgagggtagtcgagttcggcggaggcggagaaatttattttttcggcggcgatttcgtcggcggttatttggggcgttgcgggacggtcgatcgtcgcgtaggggcgttaaatcgggtacgtcgcgtcgtcgtttttgtttcggagttttcgttttcgtcgtttcgggttgtgtcgtacgtttttgtcgcggtttttttatggtgcgttttggtttttttttcgtttttttgttagttcgagcgcgtttatgtacgtacgtttagtttgtttggcgtcgtggttaatattttgcgcgtttttgcggagggcgtcgtacggtatagtatagtaaagttgcggtttaatttgttttcgttgagtttttcgtttaggttattcgtatttagttacgatttttttttttcgcgtacggaagtgcg

SEQ ID NO: 18984 - DNA, 1199 bp, Artificial Sequence
  chemically treated genomic DNA (Homo sapiens) CpG-island No: 18984
cgcacttccgtacgcgaaaaaaaaaaatcgtaactaaatacgaataacctaaacgaaaaactcaacgaaaacaaattaaaccgcaactttactatactataccgtacgacgccctccgcaaaaacgcgcaaaatattaaccacgacgccaaacaaactaaacgtacgtacataaacgcgctcgaactaacaaaaaaacgaaaaaaaaaccaaaacgcaccataaaaaaaccgcgacaaaaacgtacgacacaacccgaaacgacgaaaacgaaaactccgaaacaaaaacgacgacgcgacgtacccgatttaacgcccctacgcgacgatcgaccgtcccgcaacgccccaaataaccgccgacgaaatcgccgccgaaaaaataaatttctccgcctccgccgaactcgactaccctcgacaacttccccgcctaactctccctcgaccctcctcccctccccctcccgattcgcgataaactaaacctccccgccgcgccgccgccgccgtcgcccgcaacaccgcgcgaacctctaaattacaaaacctaaaaaaccgcgtactaaaaactaaacgtccgctaactctaccgcacgcgaaaacctctcgcttccctatcaccaaatcctcgcgaaaaaaaaaaaaaaacgaaacgcgacttttcctataccgcctacccgattcgacctacgcgcgtacgacttcttaaaaactctaaaaccgcgaccgaacctaactctaccgacgacctattaaaaactaaatcgaaacgatttaaaacgacaaacccgaataaaaacctacgaaaaaaaaaaacgaaaacgcctcgaaccgtcgaaaaaaccctacgtaaaaacgcgaatcccgaacgcccgacgaataacgaaaaacgaaaccccgacgccgaataaaatcgaccaaactactaccgacttccccgctaacccctttattcccctcccgaaaccctaccgacgacgaaacccgattacccgcgccaaaacctcaaaccgactccttttacccttaaaaaaaattcgctaccaaaccttcgaattccgaacgcaactcccgaaaaaaccgacgccctacctaacccgacgacctcctctcgaacacgaaaacttactactacttctccaaaacttcccttcctcgtaaacacaaataattaacttaacgaaatttaatacta

SEQ ID NO: 18985 - DNA, 933 bp, Artificial Sequence
  chemically treated genomic DNA (Homo sapiens) CpG-island No: 18985
tgcgacgattatttttttttggggttatggattcggacgttagtttggtgtttagtcgttcgtcgtcgttagagttcgatgatttttttttgtcggttcggagtaagggtagtagcggtagcgtttttattgggggtatcgtgttttcgtttatttcgagtgattgttcgtcggagttgagcgtcgagttgcgcggcgttatgggttttgcgggcgcgtattttggggataagttaggaggtagtggttttaagttattttcgtttagtatttcgtcgtttacgtcgtcggcggttgcgtcgtttattaagaaggataagaagtaaatgatagagtcggagttgtagtagttgcgttttaagattaatagtcgcgagcgtaagcgtatgtacgattttaatatcgttatggatggttttcgcgaggttatgtcgtacgtatacggtttttcggtgcgtaagttttttaagatcgttacgttgttgttggcgcgtaattatatttttatgtttattaattcgttggaggagatgaagcgattggtgagcgagatttacgggggttattacgttggtttttattcgtcggtttgcggcggtttggcgtatttcgcgtttttgttcgtcgttatcgcgtattcggtagtagtagcgtacgtcgtatattatttcgcggtgtattattttattttgtcgttcgtcgtcgtagcggttgttgtcgtcgttgtagtcgcggttgtgtttagcgtttttttgttcggattcgggttgtcgtcggtcggttttattcgtttatcgtacggtttatttaagttttcgtttgttgtcgcggtcgtttcgttggggggcgggggcggcggtagtggggcgagcgggggtttttagtattggggcggtatgttttgtttttgtagtatgtgttaggtgtcgtcgt

SEQ ID NO: 18986 - DNA, 933 bp, Artificial Sequence
  chemically treated genomic DNA (Homo sapiens) CpG-island No: 18986
acgacgacacctaacacatactacaaaaacaaaacataccgccccaatactaaaaacccccgctcgccccactaccgccgcccccgccccccaacgaaacgaccgcgacaacaaacgaaaacttaaataaaccgtacgataaacgaataaaaccgaccgacgacaacccgaatccgaacaaaaaaacgctaaacacaaccgcgactacaacgacgacaacaaccgctacgacgacgaacgacaaaataaaataatacaccgcgaaataatatacgacgtacgctactactaccgaatacgcgataacgacgaacaaaaacgcgaaatacgccaaaccgccgcaaaccgacgaataaaaaccaacgtaataacccccgtaaatctcgctcaccaatcgcttcatctcctccaacgaattaataaacataaaaatataattacgcgccaacaacaacgtaacgatcttaaaaaacttacgcaccgaaaaaccgtatacgtacgacataacctcgcgaaaaccatccataacgatattaaaatcgtacatacgcttacgctcgcgactattaatcttaaaacgcaactactacaactccgactctatcatttacttcttatccttcttaataaacgacgcaaccgccgacgacgtaaacgacgaaatactaaacgaaaataacttaaaaccactacctcctaacttatccccaaaatacgcgcccgcaaaacccataacgccgcgcaactcgacgctcaactccgacgaacaatcactcgaaataaacgaaaacacgatacccccaataaaaacgctaccgctactacccttactccgaaccgacaaaaaaaaatcatcgaactctaacgacgacgaacgactaaacaccaaactaacgtccgaatccataaccccaaaaaaaaataatcgtcgca

SEQ ID NO: 18987 - DNA, 933 bp, Artificial Sequence
  chemically treated genomic DNA (Homo sapiens) CpG-island No: 18987
gcggcggtatttggtatatgttgtaggggtagggtatgtcgttttagtgttggaagttttcgttcgttttattgtcgtcgttttcgttttttagcggggcggtcgcggtagtagacggagatttgagtaggtcgtgcggtggacggatggagtcgatcgacggtagttcggattcgggtagagaggcgttggatatagtcgcggttgtagcggcggtagtagtcgttgcggcggcgggcggtaggatggggtggtgtatcgcggggtgatgtgcggcgtgcgttgttgttgtcgggtgcgcggtggcggcgggtaggggcgcggagtgcgttaggtcgtcgtaggtcgacgggtggaagttagcgtggtggttttcgtagatttcgtttattagtcgttttattttttttagcgagttggtgagtatgaggatgtagttgcgcgttagtagtagcgtggcgattttggaaagtttgcgtatcgaagggtcgtgtgcgtacggtatgatttcgcggaggttatttatggcgatgttgaggtcgtgtatgcgtttgcgttcgcggttgttgattttgagacgtagttgttgtagtttcggttttgttatttgttttttgttttttttggtggacgacgtagtcgtcgacgacgtagacgacgaggtgttggacgaggatgatttgaagttattgttttttagtttgtttttaggatgcgcgttcgtagagtttatagcgtcgcgtagttcggcgtttagtttcggcgggtagttattcggggtggacgaggatacggtgtttttagtgaaggcgttgtcgttgttgtttttatttcgggtcggtagaaaaaggttatcgggttttggcgacgacgggcggttggatattaggttggcgttcgagtttatggttttaggggaagatagtcgtcgta

SEQ ID NO: 18988 - DNA, 933 bp, Artificial Sequence
  chemically treated genomic DNA (Homo sapiens) CpG-island No: 18988
tacgacgactatcttcccctaaaaccataaactcgaacgccaacctaatatccaaccgcccgtcgtcgccaaaacccgataacctttttctaccgacccgaaataaaaacaacaacgacaacgccttcactaaaaacaccgtatcctcgtccaccccgaataactacccgccgaaactaaacgccgaactacgcgacgctataaactctacgaacgcgcatcctaaaaacaaactaaaaaacaataacttcaaatcatcctcgtccaacacctcgtcgtctacgtcgtcgacgactacgtcgtccaccaaaaaaaacaaaaaacaaataacaaaaccgaaactacaacaactacgtctcaaaatcaacaaccgcgaacgcaaacgcatacacgacctcaacatcgccataaataacctccgcgaaatcataccgtacgcacacgacccttcgatacgcaaactttccaaaatcgccacgctactactaacgcgcaactacatcctcatactcaccaactcgctaaaaaaaataaaacgactaataaacgaaatctacgaaaaccaccacgctaacttccacccgtcgacctacgacgacctaacgcactccgcgcccctacccgccgccaccgcgcacccgacaacaacaacgcacgccgcacatcaccccgcgatacaccaccccatcctaccgcccgccgccgcaacgactactaccgccgctacaaccgcgactatatccaacgcctctctacccgaatccgaactaccgtcgatcgactccatccgtccaccgcacgacctactcaaatctccgtctactaccgcgaccgccccgctaaaaaacgaaaacgacgacaataaaacgaacgaaaacttccaacactaaaacgacataccctacccctacaacatataccaaataccgccgc

SEQ ID NO: 18989 - DNA, 769 bp, Artificial Sequence
  chemically treated genomic DNA (Homo sapiens) CpG-island No: 18989
gcgcgcgagaagtcggaggcgtcggtcgagtttttaggtttcgggttcgggttaggcgcgtattcgggcggtagcgttcggtcggacgttaaggaggagtagtagtagtagttgcggcgtaagattaatagtcgcgagcggaagcgtatgtaggatttgaatttggttatggacgttttgcgcgaggttattttgttttatttagcggcgtattgttagggcgcgttcggtcgtaagttttttaagatagttacgttgttgttcgttcgtaattatattttattgttgggtagttcgttgtaggagttgcgtcgcgcgttgggcgagggcgtcgggttcgtcgcgtcgcgtttgttgttggtcgggttgtttttgttcgtcgtcgcgttcggtttcgtgttgttggcgttcggcgtcgtaggatttttcgacgcgttgcgtttcgttaagtatttgtcgttggcgttggacgagtcgtcgtgcggttagttcgtttttttcggcggcggcgtaggcggtttcggtttttgtatttgcgtcgtgtgtaagttttcgtatttggtttcggttagtttgggtttggtcgtcgtgtaggcgtaattttttaagtgagggcgggtttgggtttggggcgcgatttcggttcggttttttttcgtttagttttttcgcgtttttgttttttgcgtttgggagagcgaggtcgagtaaggaaagtatttcgaattttttagtttagaggaagggattgtcgggtattttttttttt

SEQ ID NO: 18990 - DNA, 769 bp, Artificial Sequence
  chemically treated genomic DNA (Homo sapiens) CpG-island No: 18990
aaaaaaaaaaatacccgacaatcccttcctctaaactaaaaaattcgaaatactttccttactcgacctcgctctcccaaacgcaaaaaacaaaaacgcgaaaaaactaaacgaaaaaaaaccgaaccgaaatcgcgccccaaacccaaacccgccctcacttaaaaaattacgcctacacgacgaccaaacccaaactaaccgaaaccaaatacgaaaacttacacacgacgcaaatacaaaaaccgaaaccgcctacgccgccgccgaaaaaaacgaactaaccgcacgacgactcgtccaacgccaacgacaaatacttaacgaaacgcaacgcgtcgaaaaatcctacgacgccgaacgccaacaacacgaaaccgaacgcgacgacgaacaaaaacaacccgaccaacaacaaacgcgacgcgacgaacccgacgccctcgcccaacgcgcgacgcaactcctacaacgaactacccaacaataaaatataattacgaacgaacaacaacgtaactatcttaaaaaacttacgaccgaacgcgccctaacaatacgccgctaaataaaacaaaataacctcgcgcaaaacgtccataaccaaattcaaatcctacatacgcttccgctcgcgactattaatcttacgccgcaactactactactactcctccttaacgtccgaccgaacgctaccgcccgaatacgcgcctaacccgaacccgaaacctaaaaactcgaccgacgcctccgacttctcgcgcgc

SEQ ID NO: 18991 - DNA, 769 bp, Artificial Sequence
  chemically treated genomic DNA (Homo sapiens) CpG-island No: 18991
ggggaagggggtgttcgatagtttttttttttggattggaaggttcgaaatgttttttttgttcggtttcgtttttttagacgtagggagtaggggcgcggagaagttgagcgaagggaggtcgggtcgaggtcgcgttttaggtttaggttcgtttttatttggagaattgcgtttgtacggcggttaggtttaggttggtcgggattaggtgcgggaatttgtatacggcgtaggtgtagaggtcggggtcgtttgcgtcgtcgtcggggagagcgaattggtcgtacggcggttcgtttagcgttagcgataggtatttggcggggcgtagcgcgtcggggggttttacggcgtcgggcgttagtagtacggagtcgggcgcggcggcgagtaggggtagttcggttagtagtaggcgcggcgcggcgggttcggcgttttcgtttagcgcgcggcgtagtttttgtagcgagttgtttagtagtaggatgtagttgcgggcgagtagtagcgtggttattttggagagtttgcggtcgggcgcgttttggtagtgcgtcgttgagtagggtaggatgatttcgcgtagggcgtttatggttaggtttaggttttgtatgcgttttcgttcgcggttgttgattttgcgtcgtagttgttgttgttgtttttttttggcgttcggtcgggcgttgtcgttcgggtgcgcgtttgattcgggttcggggtttggaggttcggtcggcgttttcggtttttcgcgcgt

SEQ ID NO: 18992 - DNA, 769 bp, Artificial Sequence
  chemically treated genomic DNA (Homo sapiens) CpG-island No: 18992
acgcgcgaaaaaccgaaaacgccgaccgaacctccaaaccccgaacccgaatcaaacgcgcacccgaacgacaacgcccgaccgaacgccaaaaaaaaacaacaacaacaactacgacgcaaaatcaacaaccgcgaacgaaaacgcatacaaaacctaaacctaaccataaacgccctacgcgaaatcatcctaccctactcaacgacgcactaccaaaacgcgcccgaccgcaaactctccaaaataaccacgctactactcgcccgcaactacatcctactactaaacaactcgctacaaaaactacgccgcgcgctaaacgaaaacgccgaacccgccgcgccgcgcctactactaaccgaactacccctactcgccgccgcgcccgactccgtactactaacgcccgacgccgtaaaaccccccgacgcgctacgccccgccaaatacctatcgctaacgctaaacgaaccgccgtacgaccaattcgctctccccgacgacgacgcaaacgaccccgacctctacacctacgccgtatacaaattcccgcacctaatcccgaccaacctaaacctaaccgccgtacaaacgcaattctccaaataaaaacgaacctaaacctaaaacgcgacctcgacccgacctcccttcgctcaacttctccgcgcccctactccctacgtctaaaaaaacgaaaccgaacaaaaaaaacatttcgaaccttccaatccaaaaaaaaaaactatcgaacacccccttcccc

SEQ ID NO: 18993 - DNA, 753 bp, Artificial Sequence
  chemically treated genomic DNA (Homo sapiens) CpG-island No: 18993
ttttcggttcggttttcgttttcggttttgttttagtttcgttagcggtttaggattcgtttttggtttcggtttcgtttttggtttcgttttcgttttcgcgtcggcggcggcgcggcgttcgcgttttcgtatcgtttttcgtaggtcggggttcggcgcgcgtattcgtattaaagacgttttttttcggcgggtaggaatttcgtcggcgagtcgaatagtttttcgagcgtagttcgcggattattattcggtcgtacgggtcgtttttgtttttcgttcgtcgtttttgttcgagaggtcgttcgcgaggcgtattttgatcgcgagcgtcgggttttagagtcgggcgcggttggggttcgaggttagtatttttcgggagtcgtaaggcgagagttgtaaaggtaacgtagcgtggcggggtcgcgggagcggagcgcgtggttagttgattggagggaaaacgtcgtttttttgtagcggttttcggaatttttttcggttttttttcgtttttttcgatttttttttttttttttgttttttttttgcgttttgagtatgcggttagtgcgttttttttttttttcggggtcgtatttgcgattttaggatttttttcgggttttgttttgcgttttttacgcgtcgtttttgttgggagttcgttttcgttgtattttttcgcgttttattttattttattaaggatgtttaggatatcgggtatttgttattgtaagatgt

SEQ ID NO: 18994 - DNA, 753 bp, Artificial Sequence
  chemically treated genomic DNA (Homo sapiens) CpG-island No: 18994
acatcttacaataacaaatacccgatatcctaaacatccttaataaaataaaataaaacgcgaaaaaatacaacgaaaacgaactcccaacaaaaacgacgcgtaaaaaacgcaaaacaaaacccgaaaaaaatcctaaaatcgcaaatacgaccccgaaaaaaaaaaaaaacgcactaaccgcatactcaaaacgcaaaaaaaaaacaaaaaaaaaaaaaaaaatcgaaaaaaacgaaaaaaaaccgaaaaaaattccgaaaaccgctacaaaaaaacgacgttttccctccaatcaactaaccacgcgctccgctcccgcgaccccgccacgctacgttacctttacaactctcgccttacgactcccgaaaaatactaacctcgaaccccaaccgcgcccgactctaaaacccgacgctcgcgatcaaaatacgcctcgcgaacgacctctcgaacaaaaacgacgaacgaaaaacaaaaacgacccgtacgaccgaataataatccgcgaactacgctcgaaaaactattcgactcgccgacgaaattcctacccgccgaaaaaaaacgtctttaatacgaatacgcgcgccgaaccccgacctacgaaaaacgatacgaaaacgcgaacgccgcgccgccgccgacgcgaaaacgaaaacgaaaccaaaaacgaaaccgaaaccaaaaacgaatcctaaaccgctaacgaaactaaaacaaaaccgaaaacgaaaaccgaaccgaaaa

SEQ ID NO: 18995 - DNA, 753 bp, Artificial Sequence
  chemically treated genomic DNA (Homo sapiens) CpG-island No: 18995
atattttgtagtggtaaatgttcggtattttgggtatttttggtggggtggggtgggacgcggaggggtgtaacgaaagcggatttttagtaggggcgacgcgtggagggcgtaggatagggttcgggaggggttttggggtcgtaggtgcggtttcgggagagaggaagggcgtattagtcgtatatttaagacgtagagggagggtaggaggaggaggaggagtcggggagagcgagagggaatcggaggggatttcgggaatcgttgtagggaggcggcgttttttttttagttagttggttacgcgtttcgttttcgcgatttcgttacgttgcgttatttttgtagttttcgttttgcggttttcgagagatgttagtttcgggttttagtcgcgttcggttttgggattcgacgttcgcggttaggatgcgtttcgcgggcggtttttcggatagaagcggcgggcgggggataaaagcggttcgtgcggtcgggtggtggttcgcgggttgcgttcggggaattgttcggttcgtcggcgggatttttattcgtcgggaagaagcgtttttagtgcgggtgcgcgcgtcgagtttcggtttacgaggagcgatacggaagcgcgggcgtcgcgtcgtcgtcggcgcgggggcgggggcggagttaggggcggggtcggagttaggggcgggttttgggtcgttggcggggttggagtagggtcggaggcggaggtcgggtcggggg

SEQ ID NO: 18996 - DNA, 753 bp, Artificial Sequence
  chemically treated genomic DNA (Homo sapiens) CpG-island No: 18996
cccccgacccgacctccgcctccgaccctactccaaccccgccaacgacccaaaacccgcccctaactccgaccccgcccctaactccgcccccgcccccgcgccgacgacgacgcgacgcccgcgcttccgtatcgctcctcgtaaaccgaaactcgacgcgcgcacccgcactaaaaacgcttcttcccgacgaataaaaatcccgccgacgaaccgaacaattccccgaacgcaacccgcgaaccaccacccgaccgcacgaaccgcttttatcccccgcccgccgcttctatccgaaaaaccgcccgcgaaacgcatcctaaccgcgaacgtcgaatcccaaaaccgaacgcgactaaaacccgaaactaacatctctcgaaaaccgcaaaacgaaaactacaaaaataacgcaacgtaacgaaatcgcgaaaacgaaacgcgtaaccaactaactaaaaaaaaaacgccgcctccctacaacgattcccgaaatcccctccgattccctctcgctctccccgactcctcctcctcctcctaccctccctctacgtcttaaatatacgactaatacgcccttcctctctcccgaaaccgcacctacgaccccaaaacccctcccgaaccctatcctacgccctccacgcgtcgcccctactaaaaatccgctttcgttacacccctccgcgtcccaccccaccccaccaaaaatacccaaaataccgaacatttaccactacaaaatat

SEQ ID NO: 18997 - DNA, 706 bp, Artificial Sequence
  chemically treated genomic DNA (Homo sapiens) CpG-island No: 18997
ttgcgatttttaaggcgcgcgcgtataggggtgttgtaattaggatggggtaatgggagtttggagaaggggtgttagttaggaggaaaggcgcgtgcgtggaggaacggcgcgtgcgcggaggggcggtgtgtgtgttagaagaggcggcgcgtgcgtagaggggcggtgagagttaagaggggtagcgcgtgtgtagaggggcggtgtgatttaggacggggcgatggcggttgagaggagttgcgcgtgcgcgaatatgtaattggtgggatttgcggcggtttttagatgatggtcgtttttttgggcgcgacgattttagtgttcgtcgtcgtggcgttatgggtgttgttcgtagtcgtaggtgagaggcggggaggagagttttggcgtagggcgggaggtagggtacgtagttgggttacgggggcggcgatgttgttgggggcgatagacgtttagtttgggaaattttcggtttattttgtcgcgttaaagattaaattcgatttgggttcgtaaattaattaggagaaagtggtgttttgggtttttttttgtcgtttgtttgtggtcgtgtacgggttttcgggagcgttcgggttttattttcgtgaaatggcggtgttagagttttgtgtcgagtttgatttttttcgggaaagtatcgcggtttcgttggtttgtttgataataaataaaa

SEQ ID NO: 18998 - DNA, 706 bp, Artificial Sequence
  chemically treated genomic DNA (Homo sapiens) CpG-island No: 18998
ttttatttattatcaaacaaaccaacgaaaccgcgatactttcccgaaaaaaatcaaactcgacacaaaactctaacaccgccatttcacgaaaataaaacccgaacgctcccgaaaacccgtacacgaccacaaacaaacgacaaaaaaaaacccaaaacaccactttctcctaattaatttacgaacccaaatcgaatttaatctttaacgcgacaaaataaaccgaaaatttcccaaactaaacgtctatcgcccccaacaacatcgccgcccccgtaacccaactacgtaccctacctcccgccctacgccaaaactctcctccccgcctctcacctacgactacgaacaacacccataacgccacgacgacgaacactaaaatcgtcgcgcccaaaaaaacgaccatcatctaaaaaccgccgcaaatcccaccaattacatattcgcgcacgcgcaactcctctcaaccgccatcgccccgtcctaaatcacaccgcccctctacacacgcgctacccctcttaactctcaccgcccctctacgcacgcgccgcctcttctaacacacacaccgcccctccgcgcacgcgccgttcctccacgcacgcgcctttcctcctaactaacaccccttctccaaactcccattaccccatcctaattacaacacccctatacgcgcgcgccttaaaaatcgcaa

SEQ ID NO: 18999 - DNA, 706 bp, Artificial Sequence
  chemically treated genomic DNA (Homo sapiens) CpG-island No: 18999
ttttgtttattattaaatagattagcggagtcgcggtattttttcggaaagaattaaattcgatataaagttttggtatcgttattttacgggggtgggattcgggcgttttcgaggattcgtatacggttataggtaagcggtaagagaggatttagaatattatttttttttggttgatttgcgagtttaggtcgggtttaatttttggcgcggtaaagtggatcgaaggttttttagattgggcgtttgtcgtttttaatagtatcgtcgttttcgtagtttagttgcgtgttttatttttcgttttgcgttaagattttttttttcgttttttatttgcggttgcggataatatttatggcgttacggcgacgagtattagggtcgtcgcgtttaggaggacgattattatttgggagtcgtcgtagattttattagttatatgttcgcgtacgcgtagttttttttagtcgttatcgtttcgttttaagttatatcgtttttttgtatacgcgttgttttttttagtttttatcgtttttttacgtacgcgtcgttttttttgatatatatatcgttttttcgcgtacgcgtcgtttttttacgtacgcgtttttttttttagttagtattttttttttaagtttttattgttttattttaattgtagtatttttgtgcgcgcgcgttttagaaatcgtag

SEQ ID NO: 19000 - DNA, 706 bp, Artificial Sequence
  chemically treated genomic DNA (Homo sapiens) CpG-island No: 19000
ctacgatttctaaaacgcgcgcgcacaaaaatactacaattaaaataaaacaataaaaacttaaaaaaaaaatactaactaaaaaaaaaaacgcgtacgtaaaaaaacgacgcgtacgcgaaaaaacgatatatatatcaaaaaaaacgacgcgtacgtaaaaaaacgataaaaactaaaaaaaacaacgcgtatacaaaaaaacgatataacttaaaacgaaacgataacgactaaaaaaaactacgcgtacgcgaacatataactaataaaatctacgacgactcccaaataataatcgtcctcctaaacgcgacgaccctaatactcgtcgccgtaacgccataaatattatccgcaaccgcaaataaaaaacgaaaaaaaaaatcttaacgcaaaacgaaaaataaaacacgcaactaaactacgaaaacgacgatactattaaaaacgacaaacgcccaatctaaaaaaccttcgatccactttaccgcgccaaaaattaaacccgacctaaactcgcaaatcaaccaaaaaaaaataatattctaaatcctctcttaccgcttacctataaccgtatacgaatcctcgaaaacgcccgaatcccacccccgtaaaataacgataccaaaactttatatcgaatttaattctttccgaaaaaataccgcgactccgctaatctatttaataataaacaaaa

SEQ ID NO: 19001 - DNA, 574 bp, Artificial Sequence
  chemically treated genomic DNA (Homo sapiens) CpG-island No: 19001
gatcgcggttttcgaaggtgggcgtttcgcggggttttagtttttaggacgtttcgggaggtttcgcgttttgggaggtcggttgcgtggggttttcgcgttgtagtcgtagaggttttttagggtcgcggttttcggagcgggaaagtttcgcgcgggggcggtggtttcgggggcgggacggggcgggggcgggggcgcgggcggtcgagtcgaattttttttatcgggacgtttcgttgttgttcgggaagaggcgggttttgcgcgttttgcgttcgttatggcggtttgggcggcgacgtgagcggtttcgcggatttcgagcggggtttcggtcgcgatttgagtcgtcgtcgagcgttcggggttatgcgatcgacgttgttgtggtcgttgttgttgttgttcggagttttcgtcgtcgtcgtcgcggtttcgttaggtgagtcgggtttgggttttcgcggcgggacgcgggcgtagtcgtagtatgtgggggttgggggattttcggatcgtggggtggggggaatttgtcgggtgtttagagtgggtgggaatttgcggggtg

SEQ ID NO: 19002 - DNA, 574 bp, Artificial Sequence
  chemically treated genomic DNA (Homo sapiens) CpG-island No: 19002
caccccgcaaattcccacccactctaaacacccgacaaattccccccaccccacgatccgaaaatcccccaacccccacatactacgactacgcccgcgtcccgccgcgaaaacccaaacccgactcacctaacgaaaccgcgacgacgacgacgaaaactccgaacaacaacaacaacgaccacaacaacgtcgatcgcataaccccgaacgctcgacgacgactcaaatcgcgaccgaaaccccgctcgaaatccgcgaaaccgctcacgtcgccgcccaaaccgccataacgaacgcaaaacgcgcaaaacccgcctcttcccgaacaacaacgaaacgtcccgataaaaaaaattcgactcgaccgcccgcgcccccgcccccgccccgtcccgcccccgaaaccaccgcccccgcgcgaaactttcccgctccgaaaaccgcgaccctaaaaaacctctacgactacaacgcgaaaaccccacgcaaccgacctcccaaaacgcgaaacctcccgaaacgtcctaaaaactaaaaccccgcgaaacgcccaccttcgaaaaccgcgatc

SEQ ID NO: 19003 - DNA, 574 bp, Artificial Sequence
  chemically treated genomic DNA (Homo sapiens) CpG-island No: 19003
tatttcgtagatttttatttattttgagtattcggtagattttttttattttacgattcgggagttttttagtttttatatgttgcggttgcgttcgcgtttcgtcgcggaggtttaggttcggtttatttggcggggtcgcggcggcggcggcgaagatttcgagtagtagtagtagcgattatagtagcgtcggtcgtatggtttcgggcgttcggcggcggtttaggtcgcggtcggggtttcgttcggggttcgcggagtcgtttacgtcgtcgtttaaatcgttatggcgagcgtagggcgcgtagggttcgttttttttcgagtagtagcggggcgtttcggtggaggggattcggttcggtcgttcgcgttttcgttttcgtttcgtttcgttttcgaggttatcgttttcgcgcgggattttttcgtttcgggaatcgcggttttggggggtttttgcggttgtagcgcggggattttacgtagtcggttttttagagcgcggagtttttcggaacgttttggagattggagtttcgcgggacgtttattttcgggggtcgcgatt

SEQ ID NO: 19004 - DNA, 574 bp, Artificial Sequence
  chemically treated genomic DNA (Homo sapiens) CpG-island No: 19004
aatcgcgacccccgaaaataaacgtcccgcgaaactccaatctccaaaacgttccgaaaaactccgcgctctaaaaaaccgactacgtaaaatccccgcgctacaaccgcaaaaaccccccaaaaccgcgattcccgaaacgaaaaaatcccgcgcgaaaacgataacctcgaaaacgaaacgaaacgaaaacgaaaacgcgaacgaccgaaccgaatcccctccaccgaaacgccccgctactactcgaaaaaaaacgaaccctacgcgccctacgctcgccataacgatttaaacgacgacgtaaacgactccgcgaaccccgaacgaaaccccgaccgcgacctaaaccgccgccgaacgcccgaaaccatacgaccgacgctactataatcgctactactactactcgaaatcttcgccgccgccgccgcgaccccgccaaataaaccgaacctaaacctccgcgacgaaacgcgaacgcaaccgcaacatataaaaactaaaaaactcccgaatcgtaaaataaaaaaaatctaccgaatactcaaaataaataaaaatctacgaaata

SEQ ID NO: 19005 - DNA, 890 bp, Artificial Sequence
  chemically treated genomic DNA (Homo sapiens) CpG-island No: 19005
acgggaggggcgaagaagggttggagtcgtttcggggttttcgtttcggtttcgggagggcgtcgcggtcgtagtagggcgtttcgaaaatcgtcgttttcgtgttcgtcgcgcgagaaggtgaaaggtacgagatggagtttttttagttttttttaggaacgtaatttgacggcgtgatagcgcggtagggtagttttttcgggttgtttgcgggtcgcggcggcgttacggttacggtcggttcgaagggacgcgggtaggggtaagaaggggcggcgggggtttcgcgggttcgagtttgtaggtcggcgtcgaacgtagggaaaattcggttggacggttttatagtttttagaaggtcgggtcggatagggttcgacgagggagtttttttacgcgcgggcggcgggcgcgagttttttacggttgtttggcgtcggagatttatagataggatttatttagtttttttaaacgtttacgtcgattttaggcgcgcgcgtaggaaggagattgttgcgttataattttgtcggcgtttcgcggttttattttagtttcgggagttcggagttgggagtagacgcgaggatagagcgtcggtgaggcggggcgaggcgtcgtgtgtatcgtagcgattaatcggagcgtagtaagtggtcggtcgggggcggggcgggacgcgagggggcggggagagggcgttggttgggcgtagcgggacgtcgggcgtttttcgcgattaatcggcgtgtagtaagtggtcggtcgggggtagggcgagtttcgagggacggggtgggttgttttgtaggtttttcggagtcggagtttagatttagttatttacggtttcgggtagagcgggacgggttttttttgttttt

SEQ ID NO: 19006 - DNA, 890 bp, Artificial Sequence
  chemically treated genomic DNA (Homo sapiens) CpG-island No: 19006
aaaaacaaaaaaaacccgtcccgctctacccgaaaccgtaaataactaaatctaaactccgactccgaaaaacctacaaaacaacccaccccgtccctcgaaactcgccctacccccgaccgaccacttactacacgccgattaatcgcgaaaaacgcccgacgtcccgctacgcccaaccaacgccctctccccgccccctcgcgtcccgccccgcccccgaccgaccacttactacgctccgattaatcgctacgatacacacgacgcctcgccccgcctcaccgacgctctatcctcgcgtctactcccaactccgaactcccgaaactaaaataaaaccgcgaaacgccgacaaaattataacgcaacaatctccttcctacgcgcgcgcctaaaatcgacgtaaacgtttaaaaaaactaaataaatcctatctataaatctccgacgccaaacaaccgtaaaaaactcgcgcccgccgcccgcgcgtaaaaaaactccctcgtcgaaccctatccgacccgaccttctaaaaactataaaaccgtccaaccgaattttccctacgttcgacgccgacctacaaactcgaacccgcgaaacccccgccgccccttcttacccctacccgcgtcccttcgaaccgaccgtaaccgtaacgccgccgcgacccgcaaacaacccgaaaaaactaccctaccgcgctatcacgccgtcaaattacgttcctaaaaaaaactaaaaaaactccatctcgtacctttcaccttctcgcgcgacgaacacgaaaacgacgattttcgaaacgccctactacgaccgcgacgccctcccgaaaccgaaacgaaaaccccgaaacgactccaacccttcttcgcccctcccgt

SEQ ID NO: 19007 - DNA, 890 bp, Artificial Sequence
  chemically treated genomic DNA (Homo sapiens) CpG-island No: 19007
ggggataggagaggttcgtttcgttttgttcggaatcgtagatagttgggtttgaatttcggtttcgggaggtttgtagagtagtttatttcgtttttcggagttcgttttgttttcggtcggttatttgttgtacgtcgattggtcgcgaggagcgttcggcgtttcgttgcgtttagttaacgtttttttttcgttttttcgcgtttcgtttcgttttcggtcggttatttgttgcgtttcgattggtcgttgcggtgtatacggcgtttcgtttcgttttatcggcgttttattttcgcgtttgtttttagtttcgggttttcggggttgaggtggagtcgcgggacgtcggtagggttgtggcgtagtagttttttttttgcgcgcgcgtttgaagtcggcgtgggcgtttgaggaagttgggtgagttttgtttgtgggttttcggcgttaggtaatcgtagagggttcgcgttcgtcgttcgcgcgtaaggaggttttttcgtcgggttttgttcggttcggttttttgggggttgtggggtcgtttagtcgggttttttttgcgttcggcgtcggtttgtagattcgggttcgcggagttttcgtcgtttttttttgtttttgttcgcgttttttcgggtcgatcgtgatcgtggcgtcgtcgcgattcgtaagtagttcggggaggttgttttgtcgcgttgttacgtcgttaggttgcgtttttggggagggttggagaggttttatttcgtgttttttattttttcgcgcggcgggtacggaggcgacggttttcgggacgttttgttgcggtcgcgacgttttttcgaggtcggagcgagggtttcggggcggttttagttttttttcgtttttttcgt

SEQ ID NO: 19008 - DNA, 890 bp, Artificial Sequence
  chemically treated genomic DNA (Homo sapiens) CpG-island No: 19008
acgaaaaaaacgaaaaaaaactaaaaccgccccgaaaccctcgctccgacctcgaaaaaacgtcgcgaccgcaacaaaacgtcccgaaaaccgtcgcctccgtacccgccgcgcgaaaaaataaaaaacacgaaataaaacctctccaaccctccccaaaaacgcaacctaacgacgtaacaacgcgacaaaacaacctccccgaactacttacgaatcgcgacgacgccacgatcacgatcgacccgaaaaaacgcgaacaaaaacaaaaaaaaacgacgaaaactccgcgaacccgaatctacaaaccgacgccgaacgcaaaaaaaacccgactaaacgaccccacaacccccaaaaaaccgaaccgaacaaaacccgacgaaaaaacctccttacgcgcgaacgacgaacgcgaaccctctacgattacctaacgccgaaaacccacaaacaaaactcacccaacttcctcaaacgcccacgccgacttcaaacgcgcgcgcaaaaaaaaaactactacgccacaaccctaccgacgtcccgcgactccacctcaaccccgaaaacccgaaactaaaaacaaacgcgaaaataaaacgccgataaaacgaaacgaaacgccgtatacaccgcaacgaccaatcgaaacgcaacaaataaccgaccgaaaacgaaacgaaacgcgaaaaaacgaaaaaaaaacgttaactaaacgcaacgaaacgccgaacgctcctcgcgaccaatcgacgtacaacaaataaccgaccgaaaacaaaacgaactccgaaaaacgaaataaactactctacaaacctcccgaaaccgaaattcaaacccaactatctacgattccgaacaaaacgaaacgaacctctcctatcccc

SEQ ID NO: 19009 - DNA, 529 bp, Artificial Sequence
  chemically treated genomic DNA (Homo sapiens) CpG-island No: 19009
tataaattagtttttttaagttgtgtaagagcgatcgtcgcggagggattaagaaattttttttttttttttgtttcgcgggattttttcggtttcgttttagatttaatttagatagatattattatttaggtttcgttttttgtttttacggtttttgaaatttattttatttgatttcgttatcgggtgcgattagttagagtcgtagcgttcgggaatttatggttagcgtttttatagtagcggtgagaatcgtcgcgcgtaagttttttttcgtttttttttttcggaaatcgaacgcgtattcggagtttcgtaggataggtttgtttcggatttagtatttagattgttcgtttttatcggggggcgttaggtttcgttggggatttagtggttgagatttcgagattcggagtcggggcgcgttatttgtgttcgatatttgggcgcggttatttatttagaggtgtagggtttttagggcggtcggtttgtcgtttattacgtaggttttgtagggaaa

SEQ ID NO: 19010 - DNA, 529 bp, Artificial Sequence
  chemically treated genomic DNA (Homo sapiens) CpG-island No: 19010
tttccctacaaaacctacgtaataaacgacaaaccgaccgccctaaaaaccctacacctctaaataaataaccgcgcccaaatatcgaacacaaataacgcgccccgactccgaatctcgaaatctcaaccactaaatccccaacgaaacctaacgccccccgataaaaacgaacaatctaaatactaaatccgaaacaaacctatcctacgaaactccgaatacgcgttcgatttccgaaaaaaaaaaacgaaaaaaaacttacgcgcgacgattctcaccgctactataaaaacgctaaccataaattcccgaacgctacgactctaactaatcgcacccgataacgaaatcaaataaaataaatttcaaaaaccgtaaaaacaaaaaacgaaacctaaataataatatctatctaaattaaatctaaaacgaaaccgaaaaaatcccgcgaaacaaaaaaaaaaaaaaaatttcttaatccctccgcgacgatcgctcttacacaacttaaaaaaactaatttata

SEQ ID NO: 19011 - DNA, 529 bp, Artificial Sequence
  chemically treated genomic DNA (Homo sapiens) CpG-island No: 19011
tttttttgtagagtttacgtggtgggcggtaggtcgatcgttttgggggttttgtatttttgggtaggtgatcgcgtttaggtatcgagtataggtaacgcgtttcggtttcgagtttcggggttttagttattgaatttttagcgaggtttgacgtttttcggtggaggcgagtagtttgagtgttgggttcggaatagatttgttttgcggaatttcgagtgcgcgttcggttttcgggggaggagggcggagaaggatttgcgcgcgacggtttttatcgttgttatggaggcgttggttatgggttttcgggcgttgcggttttggttggtcgtattcggtggcgggattaaatggagtgagttttagaggtcgtagggatagggagcgaggtttagatagtggtgtttgtttagattgggtttgaggcggggtcggggaggtttcgcggggtagaggaaggaggagggttttttagttttttcgcggcggtcgtttttgtatagtttgggaggattaatttatg

SEQ ID NO: 19012 - DNA, 529 bp, Artificial Sequence
  chemically treated genomic DNA (Homo sapiens) CpG-island No: 19012
cataaattaatcctcccaaactatacaaaaacgaccgccgcgaaaaaactaaaaaaccctcctccttcctctaccccgcgaaacctccccgaccccgcctcaaacccaatctaaacaaacaccactatctaaacctcgctccctatccctacgacctctaaaactcactccatttaatcccgccaccgaatacgaccaaccaaaaccgcaacgcccgaaaacccataaccaacgcctccataacaacgataaaaaccgtcgcgcgcaaatccttctccgccctcctcccccgaaaaccgaacgcgcactcgaaattccgcaaaacaaatctattccgaacccaacactcaaactactcgcctccaccgaaaaacgtcaaacctcgctaaaaattcaataactaaaaccccgaaactcgaaaccgaaacgcgttacctatactcgatacctaaacgcgatcacctacccaaaaatacaaaacccccaaaacgatcgacctaccgcccaccacgtaaactctacaaaaaaa

SEQ ID NO: 19013 - DNA, 519 bp, Artificial Sequence
  chemically treated genomic DNA (Homo sapiens) CpG-island No: 19013
tttagtcgcgggagttgtaggttttattcggagagacgttgtacgtggagttttcgtcgttgtcgtttttagtcggttttggagtgcgggcgggggcgatagggtcgatttcggagtgggtgagtgcggtcgtcggggaggaggggagcgcgggttttcgcgggtcggtttcgtttcggggtttttttttttataagggttttttcgcggtcgtttttgtgttttgttttcgttggttttcggcgttgtgatttttattttcgttcgtggagatttgagggagtcgggtggggaggggcgggagagttgtgcggggagcgaaggggaggggcggggggcgagcggtttggagttcggggggatcgggtatcgtcgggattcgtgtcggacgggtcgtttgtcgtcgttttttttttttcgcgtttttttttcgttcgttcgtattttttagtagttttagtttgtttagttgggatgtggttttgacgttttcgagattttaagagtaaaatgtagatt

SEQ ID NO: 19014 - DNA, 519 bp, Artificial Sequence
  chemically treated genomic DNA (Homo sapiens) CpG-island No: 19014
aatctacattttactcttaaaatctcgaaaacgtcaaaaccacatcccaactaaacaaactaaaactactaaaaaatacgaacgaacgaaaaaaaaacgcgaaaaaaaaaaaacgacgacaaacgacccgtccgacacgaatcccgacgatacccgatccccccgaactccaaaccgctcgccccccgcccctccccttcgctccccgcacaactctcccgcccctccccacccgactccctcaaatctccacgaacgaaaataaaaatcacaacgccgaaaaccaacgaaaacaaaacacaaaaacgaccgcgaaaaaacccttataaaaaaaaaaaccccgaaacgaaaccgacccgcgaaaacccgcgctcccctcctccccgacgaccgcactcacccactccgaaatcgaccctatcgcccccgcccgcactccaaaaccgactaaaaacgacaacgacgaaaactccacgtacaacgtctctccgaataaaacctacaactcccgcgactaaa

SEQ ID NO: 19015 - DNA, 519 bp, Artificial Sequence
  chemically treated genomic DNA (Homo sapiens) CpG-island No: 19015
ggtttgtattttgtttttaaaatttcgggggcgttaggattatattttagttgagtaggttgagattgttgaggagtgcggacgggcgaggaggggacgcggaaaggagggagcggcgataggcgattcgttcggtacgggtttcggcggtgttcggttttttcgggttttaggtcgttcgtttttcgtttttttttttcgtttttcgtatagttttttcgtttttttttattcggtttttttaagtttttacgaacggaaatgggagttatagcgtcggggattagcggaaataaaatatagaggcggtcgcgggggggtttttgtgggggaaaaggtttcggaacgaggtcggttcgcgagggttcgcgtttttttttttttcggcggtcgtatttatttatttcggaatcggttttgtcgttttcgttcgtattttagagtcggttgagaacggtagcggcgagggttttacgtgtagcgttttttcgggtaagatttgtagttttcgcgattaga

SEQ ID NO: 19016 - DNA, 519 bp, Artificial Sequence
  chemically treated genomic DNA (Homo sapiens) CpG-island No: 19016
tctaatcgcgaaaactacaaatcttacccgaaaaaacgctacacgtaaaaccctcgccgctaccgttctcaaccgactctaaaatacgaacgaaaacgacaaaaccgattccgaaataaataaatacgaccgccgaaaaaaaaaaaaacgcgaaccctcgcgaaccgacctcgttccgaaaccttttcccccacaaaaacccccccgcgaccgcctctatattttatttccgctaatccccgacgctataactcccatttccgttcgtaaaaacttaaaaaaaccgaataaaaaaaaacgaaaaaactatacgaaaaacgaaaaaaaaaaacgaaaaacgaacgacctaaaacccgaaaaaaccgaacaccgccgaaacccgtaccgaacgaatcgcctatcgccgctccctcctttccgcgtcccctcctcgcccgtccgcactcctcaacaatctcaacctactcaactaaaatataatcctaacgcccccgaaattttaaaaacaaaatacaaacc

SEQ ID NO: 19017 - DNA, 697 bp, Artificial Sequence
  chemically treated genomic DNA (Homo sapiens) CpG-island No: 19017
gttcgcgggtcggttcgtcggggggtttcgcggcgattcgcggtcggttgtttaggcgggcgaaggggttttttcgagtagcggtcgggtcgtcgtcgttgttatcgtttttgtttttcgtagtagggaaagggcgaagaggtagtttcgttattagggcggttcggcgggtcgtcggtttcgttagtttacggggcggggaggcggtagttttacggtttcgggttttttttcgtcggagtcgtattatttcgggcggttttcggaagttcggtgagtagtcgggtatcgaaagggttatgacgcgcggcggttgagggtagtcggtcgttttatagagatttttcgcgcgcgtcgggttcgtttttgacgtggcgtttcgtcgagttttcgttttcgacgcggtttcgttttcgttttcgtcggtttcgagcggagtatgcgtagtgggtagttcgcgagacgtagttcgtagcggcgatttcgggtggtcgttaacgtttattgttttagcggtgattttgttttggcgtttttgttaggttttcggttagagtttagtcgttaggtttagcgacgtttttggaaagtatgcgatttagggcgttgatgtgtattattttgtggggtatcgaaatagtttaattttatttaagttcgtagtagggatgtgattagttcggggtttggcgtttgg

SEQ ID NO: 19018 - DNA, 697 bp, Artificial Sequence
  chemically treated genomic DNA (Homo sapiens) CpG-island No: 19018
ccaaacgccaaaccccgaactaatcacatccctactacgaacttaaataaaattaaactatttcgataccccacaaaataatacacatcaacgccctaaatcgcatactttccaaaaacgtcgctaaacctaacgactaaactctaaccgaaaacctaacaaaaacgccaaaacaaaatcaccgctaaaacaataaacgttaacgaccacccgaaatcgccgctacgaactacgtctcgcgaactacccactacgcatactccgctcgaaaccgacgaaaacgaaaacgaaaccgcgtcgaaaacgaaaactcgacgaaacgccacgtcaaaaacgaacccgacgcgcgcgaaaaatctctataaaacgaccgactaccctcaaccgccgcgcgtcataaccctttcgatacccgactactcaccgaacttccgaaaaccgcccgaaataatacgactccgacgaaaaaaaacccgaaaccgtaaaactaccgcctccccgccccgtaaactaacgaaaccgacgacccgccgaaccgccctaataacgaaactacctcttcgccctttccctactacgaaaaacaaaaacgataacaacgacgacgacccgaccgctactcgaaaaaaccccttcgcccgcctaaacaaccgaccgcgaatcgccgcgaaaccccccgacgaaccgacccgcgaac

SEQ ID NO: 19019 - DNA, 697 bp, Artificial Sequence
  chemically treated genomic DNA (Homo sapiens) CpG-island No: 19019
ttaggcgttaaatttcgggttgattatatttttgttgcgggtttaaatagagttaagttatttcggtgttttatagggtagtgtatattagcgttttggatcgtatattttttagaagcgtcgttgaatttggcgattggattttggtcgaggatttggtagaagcgttagggtagggttatcgttgggatagtgggcgttgacggttattcgggatcgtcgttgcgggttgcgtttcgcgggttgtttattgcgtatgtttcgttcggaatcggcgggggcggaggcggggtcgcgtcgggggcgggagttcggcgaggcgttacgttaggggcgggttcggcgcgcgcgggaagtttttgtagggcggtcggttatttttagtcgtcgcgcgttatggttttttcggtgttcggttatttatcgggttttcgaaagtcgttcgaggtagtgcggtttcgacggaaaagggttcggagtcgtggagttgtcgttttttcgtttcgtgagttgacggagtcggcggttcgtcgagtcgttttggtggcggggttgttttttcgttttttttttgttgcggggggtagaggcggtggtagcggcggcggttcggtcgttgttcggaggaattttttcgttcgtttggataatcgatcgcgggtcgtcgcggagtttttcgacgggtcggttcgcgagt

SEQ ID NO: 19020 - DNA, 697 bp, Artificial Sequence
  chemically treated genomic DNA (Homo sapiens) CpG-island No: 19020
actcgcgaaccgacccgtcgaaaaactccgcgacgacccgcgatcgattatccaaacgaacgaaaaaattcctccgaacaacgaccgaaccgccgccgctaccaccgcctctaccccccgcaacaaaaaaaaaacgaaaaaacaaccccgccaccaaaacgactcgacgaaccgccgactccgtcaactcacgaaacgaaaaaacgacaactccacgactccgaacccttttccgtcgaaaccgcactacctcgaacgactttcgaaaacccgataaataaccgaacaccgaaaaaaccataacgcgcgacgactaaaaataaccgaccgccctacaaaaacttcccgcgcgcgccgaacccgcccctaacgtaacgcctcgccgaactcccgcccccgacgcgaccccgcctccgcccccgccgattccgaacgaaacatacgcaataaacaacccgcgaaacgcaacccgcaacgacgatcccgaataaccgtcaacgcccactatcccaacgataaccctaccctaacgcttctaccaaatcctcgaccaaaatccaatcgccaaattcaacgacgcttctaaaaaatatacgatccaaaacgctaatatacactaccctataaaacaccgaaataacttaactctatttaaacccgcaacaaaaatataatcaacccgaaatttaacgcctaa

SEQ ID NO: 19021 - DNA, 982 bp, Artificial Sequence
  chemically treated genomic DNA (Homo sapiens) CpG-island No: 19021
gcgggagcgagggagcgagggagggagcgaaggaggtagagaagagtggaggcgttaggggagggagcgtagtttggttgtttcgtagtacggcggttcgcgaggaagaatttcgagcgggtttcgggacggatagagaggcgggcggggatggtgtgcggggttgcggtttttgcgttttttttagcggcgcgtgagcggtattgatttgtttttggggcggtagcgcggattcgttcggagatgaggtgaggagagggttgtaaggcggcggtttggattacgggcggttgtagcgggggcgggggtcggcgcgggggtttgcgcgatggttgttcggggtattcgtttcgcgttcggcgtttgttttttcggtcgtttttagtttttcgtcgcgcgttcgagagacggtagcggttgtttttttgttttgtttttttcgttttcgggggtggcggcggagtggcgggcggattcgtattgggaggtcgggggtcgcggtgggtcgtggggtggcggtcgcgggacgggcgtggggatgaatgggcgtcgcggtttcgtcgtcgagcgggtttttttttttcgcggggatttcgggcggtcgttttttttcgggttgatttcgttgttttcggtcgtcggcgaggggcggttcggtttcgtttttcgtcggtttttcggggattcgcgttggcgggagcggcgtcgtttttgtttggagtttcggtttttttttcggtttttcgttcgtaagtttgtagaattttgggttagtgaagggtaggtaatgtcgttcggttttagggcgcgtcgcggggtcgtttttgaaggtatttaaaggggagcgtttttcgcgttttgtgagcgcgttttcgggttcgtcgcgttttttttttttttacgtatcgatacggttttgtggtgtggatttaagatataattgtagttttttgtttgtacgaatgtaattcgaatttttaaa

SEQ ID NO: 19022 - DNA, 982 bp, Artificial Sequence
  chemically treated genomic DNA (Homo sapiens) CpG-island No: 19022
tttaaaaattcgaattacattcgtacaaacaaaaaactacaattatatcttaaatccacaccacaaaaccgtatcgatacgtaaaaaaaaaaaaaacgcgacgaacccgaaaacgcgctcacaaaacgcgaaaaacgctcccctttaaataccttcaaaaacgaccccgcgacgcgccctaaaaccgaacgacattacctacccttcactaacccaaaattctacaaacttacgaacgaaaaaccgaaaaaaaaaccgaaactccaaacaaaaacgacgccgctcccgccaacgcgaatccccgaaaaaccgacgaaaaacgaaaccgaaccgcccctcgccgacgaccgaaaacaacgaaatcaacccgaaaaaaaacgaccgcccgaaatccccgcgaaaaaaaaaaacccgctcgacgacgaaaccgcgacgcccattcatccccacgcccgtcccgcgaccgccaccccacgacccaccgcgacccccgacctcccaatacgaatccgcccgccactccgccgccacccccgaaaacgaaaaaaacaaaacaaaaaaacaaccgctaccgtctctcgaacgcgcgacgaaaaactaaaaacgaccgaaaaaacaaacgccgaacgcgaaacgaataccccgaacaaccatcgcgcaaacccccgcgccgacccccgcccccgctacaaccgcccgtaatccaaaccgccgccttacaaccctctcctcacctcatctccgaacgaatccgcgctaccgccccaaaaacaaatcaataccgctcacgcgccgctaaaaaaaacgcaaaaaccgcaaccccgcacaccatccccgcccgcctctctatccgtcccgaaacccgctcgaaattcttcctcgcgaaccgccgtactacgaaacaaccaaactacgctccctcccctaacgcctccactcttctctacctccttcgctccctccctcgctccctcgctcccgc

SEQ ID NO: 19023 - DNA, 982 bp, Artificial Sequence
  chemically treated genomic DNA (Homo sapiens) CpG-island No: 19023
tttgggaattcggattgtattcgtgtaagtaagggattgtaattgtgttttgggtttatattataaaatcgtgtcggtgcgtaagaagggaagggacgcggcggattcggggacgcgtttatagggcgcggaagacgtttttttttaaatgtttttaggggcggtttcgcggcgcgttttggggtcgaacggtattgtttgttttttattgatttaggattttgtaggtttgcgagcgaggggtcgaggaaggagtcggggttttaggtagaggcggcgtcgttttcgttaacgcgggttttcgggaggtcggcgggaggcgaggtcgggtcgtttttcgtcggcggtcgagggtagcgaggttagttcgggaaggagcggtcgttcggggttttcgcgagaggagggagttcgttcggcggcggggtcgcggcgtttatttatttttacgttcgtttcgcggtcgttattttacggtttatcgcggttttcggttttttagtgcgggttcgttcgttatttcgtcgttattttcgaggacgggaaggataaggtagaggggtagtcgttgtcgtttttcgggcgcgcggcgaggggttaagggcggtcggggagataagcgtcgggcgcgggacggatgtttcgggtagttatcgcgtagattttcgcgtcgattttcgttttcgttgtagtcgttcgtggtttaggtcgtcgttttgtagttttttttttattttattttcgggcgggttcgcgttgtcgttttagggataaattagtgtcgtttacgcgtcgttgggagggacgtaggagtcgtagtttcgtatattattttcgttcgtttttttgttcgtttcggagttcgttcgggattttttttcgcgagtcgtcgtattacggagtaattaagttacgtttttttttttggcgtttttatttttttttatttttttcgttttttttttcgttttttcgttttcgt

SEQ ID NO: 19024 - DNA, 982 bp, Artificial Sequence
  chemically treated genomic DNA (Homo sapiens) CpG-island No: 19024
acgaaaacgaaaaaacgaaaaaaaaaacgaaaaaaataaaaaaaaataaaaacgccaaaaaaaaaaacgtaacttaattactccgtaatacgacgactcgcgaaaaaaaatcccgaacgaactccgaaacgaacaaaaaaacgaacgaaaataatatacgaaactacgactcctacgtccctcccaacgacgcgtaaacgacactaatttatccctaaaacgacaacgcgaacccgcccgaaaataaaataaaaaaaaaactacaaaacgacgacctaaaccacgaacgactacaacgaaaacgaaaatcgacgcgaaaatctacgcgataactacccgaaacatccgtcccgcgcccgacgcttatctccccgaccgcccttaacccctcgccgcgcgcccgaaaaacgacaacgactacccctctaccttatccttcccgtcctcgaaaataacgacgaaataacgaacgaacccgcactaaaaaaccgaaaaccgcgataaaccgtaaaataacgaccgcgaaacgaacgtaaaaataaataaacgccgcgaccccgccgccgaacgaactccctcctctcgcgaaaaccccgaacgaccgctccttcccgaactaacctcgctaccctcgaccgccgacgaaaaacgacccgacctcgcctcccgccgacctcccgaaaacccgcgttaacgaaaacgacgccgcctctacctaaaaccccgactccttcctcgacccctcgctcgcaaacctacaaaatcctaaatcaataaaaaacaaacaataccgttcgaccccaaaacgcgccgcgaaaccgcccctaaaaacatttaaaaaaaaacgtcttccgcgccctataaacgcgtccccgaatccgccgcgtcccttcccttcttacgcaccgacacgattttataatataaacccaaaacacaattacaatcccttacttacacgaatacaatccgaattcccaaa

SEQ ID NO: 19025 - DNA, 500 bp, Artificial Sequence
  chemically treated genomic DNA (Homo sapiens) CpG-island No: 19025
cgtttttcgaggcgcggtatttatttttagcgttcgagtcgtttaggcggttagtaggagtagtgttaaatcgggtagtatcgcgattttgcgcggggtatcgagtgcgttgttgtgcgagtgggattcgtcgcgtttttgttttgttcgcgtcgttatcgtcgtcgtttttcggggttttcgcgtacgttttttcgcgtgttttcgtttatcgttgtcgaggaaattgacggagttcgagcgcggcggcggggtttagagttaggcgagttagttgattcggtttatttcgttcggtattcgagagagatttttagcggcgtcgtcggggaattgcgttcgttcgcgtcgggaggggttttcgcgtttcgcgtttataggtgtacgcgtttttggcgtcgtttgtattttacgcgtttttttcgtttttcggtcgacggtttatttgggtttcgtgaatagtgggagggagagtttggggttaggagagggacggtgta

SEQ ID NO: 19026 - DNA, 500 bp, Artificial Sequence
  chemically treated genomic DNA (Homo sapiens) CpG-island No: 19026
tacaccgtccctctcctaaccccaaactctccctcccactattcacgaaacccaaataaaccgtcgaccgaaaaacgaaaaaaacgcgtaaaatacaaacgacgccaaaaacgcgtacacctataaacgcgaaacgcgaaaacccctcccgacgcgaacgaacgcaattccccgacgacgccgctaaaaatctctctcgaataccgaacgaaataaaccgaatcaactaactcgcctaactctaaaccccgccgccgcgctcgaactccgtcaatttcctcgacaacgataaacgaaaacacgcgaaaaaacgtacgcgaaaaccccgaaaaacgacgacgataacgacgcgaacaaaacaaaaacgcgacgaatcccactcgcacaacaacgcactcgataccccgcgcaaaatcgcgatactacccgatttaacactactcctactaaccgcctaaacgactcgaacgctaaaaataaataccgcgcctcgaaaaacg

SEQ ID NO: 19027 - DNA, 500 bp, Artificial Sequence
  chemically treated genomic DNA (Homo sapiens) CpG-island No: 19027
tgtatcgttttttttttggttttagatttttttttttattgtttacgaagtttaggtgggtcgtcggtcggggagcggagggggcgcgtggggtgtaggcggcgttaagggcgcgtgtatttgtgggcgcggggcgcgagggtttttttcggcgcgagcgggcgtagtttttcggcggcgtcgttaggggtttttttcgggtgtcgagcggggtgggtcggattagttgattcgtttggttttgagtttcgtcgtcgcgttcgggtttcgttagttttttcggtagcggtaggcgagagtacgcggaggagcgtgcgcgggggtttcgggagacggcggcggtggcggcgcgggtagagtaaggacgcggcggattttattcgtatagtagcgtattcggtgtttcgcgtagggtcgcgatgttgttcggtttggtattgtttttgttggtcgtttggacggttcgggcgttggaggtgggtgtcgcgtttcggaaggcg

SEQ ID NO: 19028 - DNA, 500 bp, Artificial Sequence
  chemically treated genomic DNA (Homo sapiens) CpG-island No: 19028
cgccttccgaaacgcgacacccacctccaacgcccgaaccgtccaaacgaccaacaaaaacaataccaaaccgaacaacatcgcgaccctacgcgaaacaccgaatacgctactatacgaataaaatccgccgcgtccttactctacccgcgccgccaccgccgccgtctcccgaaacccccgcgcacgctcctccgcgtactctcgcctaccgctaccgaaaaaactaacgaaacccgaacgcgacgacgaaactcaaaaccaaacgaatcaactaatccgacccaccccgctcgacacccgaaaaaaacccctaacgacgccgccgaaaaactacgcccgctcgcgccgaaaaaaaccctcgcgccccgcgcccacaaatacacgcgcccttaacgccgcctacaccccacgcgccccctccgctccccgaccgacgacccacctaaacttcgtaaacaataaaaaaaaaaatctaaaaccaaaaaaaaaacgataca

SEQ ID NO: 19029 - DNA, 1099 bp, Artificial Sequence
  chemically treated genomic DNA (Homo sapiens) CpG-island No: 19029
aggtgatttttttttttagcgagtaaatgcggggcgatggcgagagcgtagggggcggcggcgttgttttattttggggagcgaatttatttttttagtcgtattagtttgggcgtatacgggggtcggggcgagtttgtgggattttgtagtgagtttcgcgcgtttcgggggtgttaggggatcgggattttcggggcgtcgtttttacgttttagttttgacgggttcgcggtcgagtagttcgggggacgtcgttgttttttcgtttcgcgcgcggtcgggattgggcgttgcgattcgcgtcgttttttcgggtaataagtgttcgtttttcgtttcgacggttcgttcggcgcggtttttattcggtataggtcgtttacgaatacgcgcgggtttaggtgataggcgatggtggcgttgggtaggttttgtaggtttattttttttatttcgtagttaatgaagttttagtcgtcgtcgttttcgttcgtttcggtcgttttcgagaggggcgcgaagggtcgtagcgttatttcgggtcgcgttcgcgtttcggtcgttttcgtcgttttcgtcgcggtttcgagttggggatcggttacgtcgttttttattttcgcgttcgcgcgattttgtgcgttttagcgggttgtttcgggtttgcgcgtcggagttttacgcgtttcggttcgcgttcggtcggcggtttcgtcgttaattttttcggaatcgcgcggcggtaggcggcgggttgttagtagttttttagcgatacggttttttagcgttagtttcgttcgttatcgtttcgcgcgggaggggtagaagttcggcgcggcgatcgtttttttagtttttagggtcggttatcggtagatttaacggtggtttttttaaggtcggcgtcggttgggttattgtatttcgtttttttaggagacggggttaataaaggaacggaattttttttacgtgattttttttttgtcgttcgaagttcgaagttttagggcggttatgttggttaggggtaaagttttcgtttttagtttcgtttttttgatagttggtgttagttgaaggacgtcgggta

SEQ ID NO: 19030 - DNA, 1099 bp, Artificial Sequence
  chemically treated genomic DNA (Homo sapiens) CpG-island No: 19030
tacccgacgtccttcaactaacaccaactatcaaaaaaacgaaactaaaaacgaaaactttacccctaaccaacataaccgccctaaaacttcgaacttcgaacgacaaaaaaaaaatcacgtaaaaaaaattccgttcctttattaaccccgtctcctaaaaaaacgaaatacaataacccaaccgacgccgaccttaaaaaaaccaccgttaaatctaccgataaccgaccctaaaaactaaaaaaacgatcgccgcgccgaacttctacccctcccgcgcgaaacgataacgaacgaaactaacgctaaaaaaccgtatcgctaaaaaactactaacaacccgccgcctaccgccgcgcgattccgaaaaaattaacgacgaaaccgccgaccgaacgcgaaccgaaacgcgtaaaactccgacgcgcaaacccgaaacaacccgctaaaacgcacaaaatcgcgcgaacgcgaaaataaaaaacgacgtaaccgatccccaactcgaaaccgcgacgaaaacgacgaaaacgaccgaaacgcgaacgcgacccgaaataacgctacgacccttcgcgcccctctcgaaaacgaccgaaacgaacgaaaacgacgacgactaaaacttcattaactacgaaataaaaaaaataaacctacaaaacctacccaacgccaccatcgcctatcacctaaacccgcgcgtattcgtaaacgacctataccgaataaaaaccgcgccgaacgaaccgtcgaaacgaaaaacgaacacttattacccgaaaaaacgacgcgaatcgcaacgcccaatcccgaccgcgcgcgaaacgaaaaaacaacgacgtcccccgaactactcgaccgcgaacccgtcaaaactaaaacgtaaaaacgacgccccgaaaatcccgatcccctaacacccccgaaacgcgcgaaactcactacaaaatcccacaaactcgccccgacccccgtatacgcccaaactaatacgactaaaaaaataaattcgctccccaaaataaaacaacgccgccgccccctacgctctcgccatcgccccgcatttactcgctaaaaaaaaaaatcacct

SEQ ID NO: 19031 - DNA, 1099 bp, Artificial Sequence
  chemically treated genomic DNA (Homo sapiens) CpG-island No: 19031
tgttcggcgttttttagttggtattagttgttagaaaagcggaattggggacgaggattttgtttttaattaatatggtcgttttgaggtttcgggtttcgggcggtagaaggaaggttacgtgaagagaatttcgtttttttattggtttcgttttttggaagggcggggtataataatttaatcggcgtcggttttaaaggggttatcgttggatttgtcggtggtcggttttaggggttgggggggcggtcgtcgcgtcgggtttttgtttttttcgcgcggaacggtgacgggcggggttggcgttgggaggtcgtgtcgttgggagattgttgatagttcgtcgtttgtcgtcgcgcgatttcgagggggttaacggcggagtcgtcggtcgggcgcggatcggagcgcgtgaggtttcggcgcgtaagttcggagtagttcgttggggcgtatagggtcgcgcgggcgcggggatggaggacggcgtggtcggtttttagttcggggtcgcggcggaggcggcggaggcggtcgaggcgcgagcgcggttcggggtgacgttgcggtttttcgcgtttttttcgggggcggtcgaggcggacgagggcggcggcgattggagttttattgattgcgagatggaggaggtggatttgtaggatttgtttagcgttattatcgtttgttatttggattcgcgcgtgttcgtggacggtttgtgtcgggtgaggatcgcgtcgggcgggtcgtcggggcggagggcggatatttgttgttcgaggaggcggcgcgggtcgtagcgtttagtttcggtcgcgcgcggggcggggaggtagcgacgtttttcgggttgttcggtcgcggattcgttagggttggggcgtggggacggcgtttcgagggtttcggttttttagtattttcggggcgcgcggagtttattgtagagttttataggttcgtttcggttttcgtgtgcgtttaggttggtgcgattaggggggtgaattcgttttttaaggtggggtagcgtcgtcgttttttgcgttttcgttatcgtttcgtatttattcgttggaggagggggttattt

SEQ ID NO: 19032 - DNA, 1099 bp, Artificial Sequence
  chemically treated genomic DNA (Homo sapiens) CpG-island No: 19032
aaataaccccctcctccaacgaataaatacgaaacgataacgaaaacgcaaaaaacgacgacgctaccccaccttaaaaaacgaattcacccccctaatcgcaccaacctaaacgcacacgaaaaccgaaacgaacctataaaactctacaataaactccgcgcgccccgaaaatactaaaaaaccgaaaccctcgaaacgccgtccccacgccccaaccctaacgaatccgcgaccgaacaacccgaaaaacgtcgctacctccccgccccgcgcgcgaccgaaactaaacgctacgacccgcgccgcctcctcgaacaacaaatatccgccctccgccccgacgacccgcccgacgcgatcctcacccgacacaaaccgtccacgaacacgcgcgaatccaaataacaaacgataataacgctaaacaaatcctacaaatccacctcctccatctcgcaatcaataaaactccaatcgccgccgccctcgtccgcctcgaccgcccccgaaaaaaacgcgaaaaaccgcaacgtcaccccgaaccgcgctcgcgcctcgaccgcctccgccgcctccgccgcgaccccgaactaaaaaccgaccacgccgtcctccatccccgcgcccgcgcgaccctatacgccccaacgaactactccgaacttacgcgccgaaacctcacgcgctccgatccgcgcccgaccgacgactccgccgttaaccccctcgaaatcgcgcgacgacaaacgacgaactatcaacaatctcccaacgacacgacctcccaacgccaaccccgcccgtcaccgttccgcgcgaaaaaaacaaaaacccgacgcgacgaccgcccccccaacccctaaaaccgaccaccgacaaatccaacgataacccctttaaaaccgacgccgattaaattattataccccgcccttccaaaaaacgaaaccaataaaaaaacgaaattctcttcacgtaaccttccttctaccgcccgaaacccgaaacctcaaaacgaccatattaattaaaaacaaaatcctcgtccccaattccgcttttctaacaactaataccaactaaaaaacgccgaaca

SEQ ID NO: 19033 - DNA, 1322 bp, Artificial Sequence
  chemically treated genomic DNA (Homo sapiens) CpG-island No: 19033
ggagtcggcgttttttaaggagtatagagggtttcgtagtacgttttttgtttagcgttatcgatttttaagtagcgttaaggaaggagtttcgattaaggatagggatttgcggttatggtcgaggtcgcggagtcggagggggttgtttcgggtttttaggggtcgtcggaggttttcgcgtttttggttgagagattcggagagttaggagtcgcgggcggggaggtagaagggtcggaggggagcgagggcgtagaggaggcgtcgaggggcgtcgtcgttgtgaaggaggtaggaggcggcgggttagataggggttcggaggtcgaggcgcggggtacgaggggggcgtacggcgagattgaggtcgaggagggagtttcggagggtgtcgaggtgttttaaggaggggaggagataagcggcgcgtagtaggtggagggggcgagttcgggacgcggcgcgtagggcgagtttcgcggggaggtttagagggagttcgaggattttgcggttttcgagaggtaggaggaggcggagtagaggtttgaggtttcggaaggtagcgcgttcggggaggcgggggatagcgtagacgcggagggttcgttgggggataatatagaagcggagggttcggcgggcgatagcgtagaggcggagggtcgggtgggggatagcgtagacgcggaaggttcggcgggggatagcgtagacgcggagggttcgttgggggataatatataagtcgagggttcggcgggggatagcgtagacgcggagggtcgggtgggggatagcgtagacgcggaaggttcggcgggggatagcgtagacgcggagggtcgggtgggggatagcgtagaggcgggggattcggcgggggacggcgtagaagcgggggtttcggcgggggatagcgtagaagtcgaaggttcggcgggggatagtatggacgtcgagggttcggtaggaagggcgcgtcgggtttcgggtgagtcgtagtaatcgggggacggtagtttttcgttttaggtcgaggtaattgaggtcgtagtcggggagagtgcggggcgtagtttcggtgagttcgtttgggacgtagcggaggaggcggaggtttcgggggtaaaggggttcgaagaagcggttttcggggacgtaagggtagacgttggcgaggatagggtaggggatgggttatagtaggagtcgggggaggacgaagagagacgagagcggagttcggaggggttaagggaggaggaagtagcggggggcgaagaggaatttttcgatagtagtttatatggggaggt

SEQ ID NO: 19034 - DNA, 1322 bp, Artificial Sequence
  chemically treated genomic DNA (Homo sapiens) CpG-island No: 19034
acctccccatataaactactatcgaaaaattcctcttcgccccccgctacttcctcctcccttaacccctccgaactccgctctcgtctctcttcgtcctcccccgactcctactataacccatcccctaccctatcctcgccaacgtctacccttacgtccccgaaaaccgcttcttcgaacccctttacccccgaaacctccgcctcctccgctacgtcccaaacgaactcaccgaaactacgccccgcactctccccgactacgacctcaattacctcgacctaaaacgaaaaactaccgtcccccgattactacgactcacccgaaacccgacgcgcccttcctaccgaaccctcgacgtccatactatcccccgccgaaccttcgacttctacgctatcccccgccgaaacccccgcttctacgccgtcccccgccgaatcccccgcctctacgctatcccccacccgaccctccgcgtctacgctatcccccgccgaaccttccgcgtctacgctatcccccacccgaccctccgcgtctacgctatcccccgccgaaccctcgacttatatattatcccccaacgaaccctccgcgtctacgctatcccccgccgaaccttccgcgtctacgctatcccccacccgaccctccgcctctacgctatcgcccgccgaaccctccgcttctatattatcccccaacgaaccctccgcgtctacgctatcccccgcctccccgaacgcgctaccttccgaaacctcaaacctctactccgcctcctcctacctctcgaaaaccgcaaaatcctcgaactccctctaaacctccccgcgaaactcgccctacgcgccgcgtcccgaactcgccccctccacctactacgcgccgcttatctcctcccctccttaaaacacctcgacaccctccgaaactccctcctcgacctcaatctcgccgtacgcccccctcgtaccccgcgcctcgacctccgaacccctatctaacccgccgcctcctacctccttcacaacgacgacgcccctcgacgcctcctctacgccctcgctcccctccgacccttctacctccccgcccgcgactcctaactctccgaatctctcaaccaaaaacgcgaaaacctccgacgacccctaaaaacccgaaacaaccccctccgactccgcgacctcgaccataaccgcaaatccctatccttaatcgaaactccttccttaacgctacttaaaaatcgataacgctaaacaaaaaacgtactacgaaaccctctatactccttaaaaaacgccgactcc

SEQ ID NO: 19035 - DNA, 1322 bp, Artificial Sequence
  chemically treated genomic DNA (Homo sapiens) CpG-island No: 19035
gtttttttatgtgggttgttgtcgggggattttttttcgtttttcgttgttttttttttttttggttttttcgggtttcgttttcgttttttttcgttttttttcggtttttgttgtggtttattttttattttgttttcgttagcgtttgtttttgcgttttcgggggtcgttttttcggatttttttattttcgggattttcgtttttttcgttgcgttttaggcgagtttatcggggttgcgtttcgtatttttttcggttgcgattttaattgtttcggtttggggcgagaggttgtcgtttttcgattgttgcggtttattcgagattcggcgcgttttttttgtcggattttcggcgtttatgttgtttttcgtcgggttttcggtttttacgttgtttttcgtcgggattttcgtttttacgtcgtttttcgtcgggtttttcgtttttacgttgttttttattcggtttttcgcgtttacgttgtttttcgtcggatttttcgcgtttacgttgttttttattcggtttttcgcgtttacgttgtttttcgtcgggttttcggtttgtatgttgttttttagcgggtttttcgcgtttacgttgtttttcgtcggatttttcgcgtttacgttgttttttattcggtttttcgtttttacgttgtcgttcgtcgggtttttcgtttttatgttgttttttagcgggtttttcgcgtttacgttgtttttcgttttttcggacgcgttatttttcgggattttaggtttttgtttcgtttttttttgtttttcgggggtcgtagagttttcgggttttttttgagttttttcgcggggttcgttttgcgcgtcgcgtttcgggttcgttttttttatttgttgcgcgtcgtttgtttttttttttttttggggtatttcggtatttttcggggtttttttttcggttttagtttcgtcgtgcgtttttttcgtgtttcgcgtttcggttttcgggtttttgtttggttcgtcgttttttgttttttttatagcggcggcgtttttcggcgttttttttgcgttttcgttttttttcggtttttttgttttttcgttcgcggtttttggtttttcgggttttttagttagaggcgcggggattttcggcggtttttggggattcggggtaatttttttcggtttcgcggtttcggttatggtcgtagatttttgtttttgatcgggattttttttttgacgttgtttaagggtcggtggcgttgggtaaggggcgtgttacggggttttttgtgttttttgaaggacgtcggtttt

SEQ ID NO: 19036 - DNA, 1322 bp, Artificial Sequence
  chemically treated genomic DNA (Homo sapiens) CpG-island No: 19036
aaaaccgacgtccttcaaaaaacacaaaaaaccccgtaacacgccccttacccaacgccaccgacccttaaacaacgtcaaaaaaaaaatcccgatcaaaaacaaaaatctacgaccataaccgaaaccgcgaaaccgaaaaaaattaccccgaatccccaaaaaccgccgaaaatccccgcgcctctaactaaaaaacccgaaaaaccaaaaaccgcgaacgaaaaaacaaaaaaaccgaaaaaaaacgaaaacgcaaaaaaaacgccgaaaaacgccgccgctataaaaaaaacaaaaaacgacgaaccaaacaaaaacccgaaaaccgaaacgcgaaacacgaaaaaaacgcacgacgaaactaaaaccgaaaaaaaaaccccgaaaaataccgaaataccccaaaaaaaaaaaaaaacaaacgacgcgcaacaaataaaaaaaacgaacccgaaacgcgacgcgcaaaacgaaccccgcgaaaaaactcaaaaaaaacccgaaaactctacgacccccgaaaaacaaaaaaaaacgaaacaaaaacctaaaatcccgaaaaataacgcgtccgaaaaaacgaaaaacaacgtaaacgcgaaaaacccgctaaaaaacaacataaaaacgaaaaacccgacgaacgacaacgtaaaaacgaaaaaccgaataaaaaacaacgtaaacgcgaaaaatccgacgaaaaacaacgtaaacgcgaaaaacccgctaaaaaacaacatacaaaccgaaaacccgacgaaaaacaacgtaaacgcgaaaaaccgaataaaaaacaacgtaaacgcgaaaaatccgacgaaaaacaacgtaaacgcgaaaaaccgaataaaaaacaacgtaaaaacgaaaaacccgacgaaaaacgacgtaaaaacgaaaatcccgacgaaaaacaacgtaaaaaccgaaaacccgacgaaaaacaacataaacgccgaaaatccgacaaaaaaaacgcgccgaatctcgaataaaccgcaacaatcgaaaaacgacaacctctcgccccaaaccgaaacaattaaaatcgcaaccgaaaaaaatacgaaacgcaaccccgataaactcgcctaaaacgcaacgaaaaaaacgaaaatcccgaaaataaaaaaatccgaaaaaacgacccccgaaaacgcaaaaacaaacgctaacgaaaacaaaataaaaaataaaccacaacaaaaaccgaaaaaaaacgaaaaaaaacgaaaacgaaacccgaaaaaaccaaaaaaaaaaaaaacaacgaaaaacgaaaaaaaatcccccgacaacaacccacataaaaaaac

SEQ ID NO: 19037 - DNA, 1243 bp, Artificial Sequence
  chemically treated genomic DNA (Homo sapiens) CpG-island No: 19037
ttcggtcgcggggcgttcgtttcgttcgcgttcgttggttttatgaatgagagtgtttggaaatgaacgtgtttttattgtaagttcggtcggaggaattttatttttttagttcgtttgtataggggcggtcggcggttaattataggttttttcggtattagttagggcgcggttcgtcgtcgtcggtttttggaattggttcgcgcgttttcgtcgtcgcgtcgcgcgttattgtacgtagttcgggcggggagtcggaggttattttcgcgtttcgtatttaagtttgtatgttggttcggggtttcgttcgcgtgcggattttttttcgtagttatacgtaggtttgtgcggtttcgcgagtggttacggttcggagatttggaaaaagaaagtaggtttcgtcggttcgaggaggattcggtcggcgcgtcgtattcggagaggttcggtttcgcgagtcgttgtaggtaggcgtagtggtcgttacgaggttttcgaatcgggttgtagttcgcggacggttttagattttgcgcggtcgtttagggttaggttttcgtttttagggcgggggtgcgatttggtcgcggggttcgggggagttatttcgcgtttttgtatcgttcggttggtagttgcggcgaagcggcgttgattttttgtatgaggtcggacggcgttcgcgcgtgtcgtttgtttttagcgtttttttttgggtcggtttttgtaatgggtgttttttatcgttgcgttcgggtcgcggttcgattttttcgcgcgttttatttgttgcgtgcgttagcggttagcgaagagttttttagttaggaaagattttaagaacgcgcggttggaaggaaagttgaaagtagttacgcggtttgttttcgggttttgtagcgtcggtattcgtagtagtcggatagtttgttcgggtttcgcgtttttttttcggtttttcggaagcggttttcgttttttttttcgttttcgtgcgttcgagcggttttaggtgcggaatttatttcggtttcgcgtgcgggcggtcgtttttttttgcgtcggttttcgcggtgttgcgggtattttcgcggagttcggagggtttcgttttcggttcggcgtgcgttgttaatttcgatttcgttcggcggggtttttttttagcggaggttgttttcgttattatgagtttttttacgttttttttgtcgggttttgtatttttcggggtttt

SEQ ID NO: 19038 - DNA, 1243 bp, Artificial Sequence
  chemically treated genomic DNA (Homo sapiens) CpG-island No: 19038
aaaaccccgaaaaatacaaaacccgacaaaaaaaacgtaaaaaaactcataataacgaaaacaacctccgctaaaaaaaaaccccgccgaacgaaatcgaaattaacaacgcacgccgaaccgaaaacgaaaccctccgaactccgcgaaaatacccgcaacaccgcgaaaaccgacgcaaaaaaaaacgaccgcccgcacgcgaaaccgaaataaattccgcacctaaaaccgctcgaacgcacgaaaacgaaaaaaaaaacgaaaaccgcttccgaaaaaccgaaaaaaaaacgcgaaacccgaacaaactatccgactactacgaataccgacgctacaaaacccgaaaacaaaccgcgtaactactttcaactttccttccaaccgcgcgttcttaaaatctttcctaactaaaaaactcttcgctaaccgctaacgcacgcaacaaataaaacgcgcgaaaaaatcgaaccgcgacccgaacgcaacgataaaaaacacccattacaaaaaccgacccaaaaaaaaacgctaaaaacaaacgacacgcgcgaacgccgtccgacctcatacaaaaaatcaacgccgcttcgccgcaactaccaaccgaacgatacaaaaacgcgaaataactcccccgaaccccgcgaccaaatcgcacccccgccctaaaaacgaaaacctaaccctaaacgaccgcgcaaaatctaaaaccgtccgcgaactacaacccgattcgaaaacctcgtaacgaccactacgcctacctacaacgactcgcgaaaccgaacctctccgaatacgacgcgccgaccgaatcctcctcgaaccgacgaaacctactttctttttccaaatctccgaaccgtaaccactcgcgaaaccgcacaaacctacgtataactacgaaaaaaaatccgcacgcgaacgaaaccccgaaccaacatacaaacttaaatacgaaacgcgaaaataacctccgactccccgcccgaactacgtacaataacgcgcgacgcgacgacgaaaacgcgcgaaccaattccaaaaaccgacgacgacgaaccgcgccctaactaataccgaaaaaacctataattaaccgccgaccgcccctatacaaacgaactaaaaaaataaaattcctccgaccgaacttacaataaaaacacgttcatttccaaacactctcattcataaaaccaacgaacgcgaacgaaacgaacgccccgcgaccgaa

SEQ ID NO: 19039 - DNA, 1243 bp, Artificial Sequence
  chemically treated genomic DNA (Homo sapiens) CpG-island No: 19039
gaggtttcgggaggtgtagggttcggtagggagggcgtggagggatttatggtgacgggagtagttttcgttgggagggagtttcgtcgggcggggtcggagttggtagcgtacgtcggatcgggggcggggtttttcgagtttcgcgaaaatgttcgtagtatcgcggggatcggcgtagggggaagcggtcgttcgtacgcgaagtcggggtgggtttcgtatttggggtcgttcgagcgtacgggggcggggagaggagcgggggtcgttttcggggagtcggaggggagacgcggggttcgggtaggttgttcggttgttgcgggtgtcggcgttataaggttcgggagtaagtcgcgtggttgtttttaattttttttttagtcgcgcgtttttggggttttttttgattaggaaatttttcgttggtcgttgacgtacgtagtaagtgagacgcgcggagggatcgagtcgcggttcgggcgtagcggtaaaaaatatttattatagaaatcgatttaagggaagacgttgagagtaaacggtacgcgcggacgtcgttcggttttatgtaaggaattagcgtcgtttcgtcgtagttgttagtcggacggtgtaggagcgcggagtggttttttcgggtttcgcggttaaatcgtattttcgttttggaagcggaggtttggttttgggcggtcgcgtaggatttggggtcgttcgcgggttgtagttcggttcgggagtttcgtggcggttattgcgtttgtttgtagcggttcgcggggtcgggttttttcgggtgcggcgcgtcggtcgggtttttttcgggtcggcggggtttgttttttttttttaggttttcggatcgtggttattcgcggagtcgtataagtttgcgtgtggttgcggaaaggggttcgtacgcgggcggggtttcgggttagtatgtaggtttggatgcggggcgcgggggtggttttcgatttttcgttcgggttgcgtatagtagcgcgcggcgcggcggcgggggcgcgcgggttaattttaggagtcggcggcggcgagtcgcgttttggttgatatcggaaaggtttgtgattggtcgtcggtcgtttttatgtaaacgagttgagggaatggaattttttcggtcgggtttatagtaaaagtacgtttatttttaggtatttttatttatagagttagcgggcgcgggcgggacgggcgtttcgcggtcgga

SEQ ID NO: 19040 - DNA, 1243 bp, Artificial Sequence
  chemically treated genomic DNA (Homo sapiens) CpG-island No: 19040
tccgaccgcgaaacgcccgtcccgcccgcgcccgctaactctataaataaaaatacctaaaaataaacgtacttttactataaacccgaccgaaaaaattccattccctcaactcgtttacataaaaacgaccgacgaccaatcacaaacctttccgatatcaaccaaaacgcgactcgccgccgccgactcctaaaattaacccgcgcgcccccgccgccgcgccgcgcgctactatacgcaacccgaacgaaaaatcgaaaaccacccccgcgccccgcatccaaacctacatactaacccgaaaccccgcccgcgtacgaacccctttccgcaaccacacgcaaacttatacgactccgcgaataaccacgatccgaaaacctaaaaaaaaaaaacaaaccccgccgacccgaaaaaaacccgaccgacgcgccgcacccgaaaaaacccgaccccgcgaaccgctacaaacaaacgcaataaccgccacgaaactcccgaaccgaactacaacccgcgaacgaccccaaatcctacgcgaccgcccaaaaccaaacctccgcttccaaaacgaaaatacgatttaaccgcgaaacccgaaaaaaccactccgcgctcctacaccgtccgactaacaactacgacgaaacgacgctaattccttacataaaaccgaacgacgtccgcgcgtaccgtttactctcaacgtcttcccttaaatcgatttctataataaatattttttaccgctacgcccgaaccgcgactcgatccctccgcgcgtctcacttactacgtacgtcaacgaccaacgaaaaatttcctaatcaaaaaaaaccccaaaaacgcgcgactaaaaaaaaaattaaaaacaaccacgcgacttactcccgaaccttataacgccgacacccgcaacaaccgaacaacctacccgaaccccgcgtctcccctccgactccccgaaaacgacccccgctcctctccccgcccccgtacgctcgaacgaccccaaatacgaaacccaccccgacttcgcgtacgaacgaccgcttccccctacgccgatccccgcgatactacgaacattttcgcgaaactcgaaaaaccccgcccccgatccgacgtacgctaccaactccgaccccgcccgacgaaactccctcccaacgaaaactactcccgtcaccataaatccctccacgccctccctaccgaaccctacacctcccgaaacctc

SEQ ID NO: 19041 - DNA, 743 bp, Artificial Sequence
  chemically treated genomic DNA (Homo sapiens) CpG-island No: 19041
gttttatcgcgggttgttttgtggttttcgcggagttttttaattaagtttttcggcgcgggggtttttcgtcgattttacggggtttttgacgttcgttttttttttttttagggttagggtgttgtggtcgttgtcgcgtagggattgttttcgggcgttgtcgcgggttcggacgtaggagggggtcggggttgattggcgtggaggtttttttcgggcgggttcggattgcgcggagttgtcgggacgcgtcgcgggttttggcggacgttagggggtagtagtcgttttttttggacgtcgcgcgtagttttcggagttttcggaacgttttcgacggcgcggggttgtgcggttcgtttcgtggttttcgggtcgttcgggaagaattagcgttcgaggataaaagataggaagtcgttttagagtttatttgagttggaacggttaaggcgcgttttcgaggttttaatatagagtcgtagtcggttaggtggggattttcggattaggttttttcgttgtgcggttcggtcggggttttttttcgaagtttttgtttttggggtttgattcgggtcgtttttggttatttgtgttttaggagttcgggttttcggggggttaaggcgggcggttcgcggttttaatttttttcgttttcgttttttttgggtattgttagtattcgagtttagttttgttttaatggatttggggtttcggaaagaaaatttatt

SEQ ID NO: 19042 - DNA, 743 bp, Artificial Sequence
  chemically treated genomic DNA (Homo sapiens) CpG-island No: 19042
aataaattttctttccgaaaccccaaatccattaaaacaaaactaaactcgaatactaacaatacccaaaaaaaacgaaaacgaaaaaaattaaaaccgcgaaccgcccgccttaaccccccgaaaacccgaactcctaaaacacaaataaccaaaaacgacccgaatcaaaccccaaaaacaaaaacttcgaaaaaaaaccccgaccgaaccgcacaacgaaaaaacctaatccgaaaatccccacctaaccgactacgactctatattaaaacctcgaaaacgcgccttaaccgttccaactcaaataaactctaaaacgacttcctatcttttatcctcgaacgctaattcttcccgaacgacccgaaaaccacgaaacgaaccgcacaaccccgcgccgtcgaaaacgttccgaaaactccgaaaactacgcgcgacgtccaaaaaaaacgactactaccccctaacgtccgccaaaacccgcgacgcgtcccgacaactccgcgcaatccgaacccgcccgaaaaaaacctccacgccaatcaaccccgaccccctcctacgtccgaacccgcgacaacgcccgaaaacaatccctacgcgacaacgaccacaacaccctaaccctaaaaaaaaaaaaaacgaacgtcaaaaaccccgtaaaatcgacgaaaaacccccgcgccgaaaaacttaattaaaaaactccgcgaaaaccacaaaacaacccgcgataaaac

SEQ ID NO: 19043 - DNA, 743 bp, Artificial Sequence
  chemically treated genomic DNA (Homo sapiens) CpG-island No: 19043
agtaagtttttttttcgagattttaggtttattaaaataaaattgaattcgggtgttggtagtgtttagggggagcggaggcggagagggttgaggtcgcgggtcgttcgttttagtttttcggaagttcgggtttttgaagtatagatagttaagagcggttcgagttaagttttaggaataggggtttcgggaagagatttcgatcgggtcgtatagcggggaggtttggttcgagagtttttatttggtcggttgcgattttatattggaatttcggaaacgcgttttggtcgttttagtttaagtgggttttggggcggttttttgttttttattttcgaacgttagtttttttcgggcgattcgaaggttacgaggcgggtcgtatagtttcgcgtcgtcgggggcgtttcgggagtttcggggattgcgcgcggcgtttagggagggcggttgttgttttttggcgttcgttagagttcgcggcgcgtttcgatagtttcgcgtagttcgggttcgttcgggaaaggtttttacgttagttaatttcggtttttttttgcgttcgggttcgcggtaacgttcggggatagtttttgcgcggtagcggttatagtattttagttttgggggagggaggagcgggcgttaggggtttcgtgaggtcggcgagggattttcgcgtcggggagtttaattgaggggtttcgcggggattataaagtagttcgcggtggaat

SEQ ID NO: 19044 - DNA, 743 bp, Artificial Sequence
  chemically treated genomic DNA (Homo sapiens) CpG-island No: 19044
attccaccgcgaactactttataatccccgcgaaacccctcaattaaactccccgacgcgaaaatccctcgccgacctcacgaaacccctaacgcccgctcctccctcccccaaaactaaaatactataaccgctaccgcgcaaaaactatccccgaacgttaccgcgaacccgaacgcaaaaaaaaaccgaaattaactaacgtaaaaacctttcccgaacgaacccgaactacgcgaaactatcgaaacgcgccgcgaactctaacgaacgccaaaaaacaacaaccgccctccctaaacgccgcgcgcaatccccgaaactcccgaaacgcccccgacgacgcgaaactatacgacccgcctcgtaaccttcgaatcgcccgaaaaaaactaacgttcgaaaataaaaaacaaaaaaccgccccaaaacccacttaaactaaaacgaccaaaacgcgtttccgaaattccaatataaaatcgcaaccgaccaaataaaaactctcgaaccaaacctccccgctatacgacccgatcgaaatctcttcccgaaacccctattcctaaaacttaactcgaaccgctcttaactatctatacttcaaaaacccgaacttccgaaaaactaaaacgaacgacccgcgacctcaaccctctccgcctccgctccccctaaacactaccaacacccgaattcaattttattttaataaacctaaaatctcgaaaaaaaaacttact

SEQ ID NO: 19045 - DNA, 631 bp, Artificial Sequence
  chemically treated genomic DNA (Homo sapiens) CpG-island No: 19045
ggatttttcgcgagaatatttttttttttcgcgcgcgttgttgtgtgacgttgtagtttttaaatagaaaaagttcgcggtgcgtttatcgtttgtttgaggaagtataattttacgatcgttttaaggttaggcgcgcgggtagaggtgggtcggtttttcgcgtcggcggtggtcgcgggtttggtaggttgaaggtggaggaagttagatggttagtgcggttttttggaggattttttttcgagttagggattgacgcggcgtattttcgtggttacgattggatattttgcgtagaagagggtttttgagagcgttggtcgtgtcgtgtcgttaaatattttttattatcgaatgtgggaaacgttttttttggagtttagtattttttgttcgtttcggatggaatttggttttttgcgtagggtcgttttttggagttcgtttttaaatgattttaagagggaagggaatttagggaggtcgattttaggggcgagggtggaaaatttaggtcgggtagtcgaggagcggcgtgggtattagaagcggttcgtcgttttttattgtgagaggcggaaagcgaagtttcggggtgtgtcggggtattcggaatgtagataagttt

SEQ ID NO: 19046 - DNA, 631 bp, Artificial Sequence
  chemically treated genomic DNA (Homo sapiens) CpG-island No: 19046
aaacttatctacattccgaataccccgacacaccccgaaacttcgctttccgcctctcacaataaaaaacgacgaaccgcttctaatacccacgccgctcctcgactacccgacctaaattttccaccctcgcccctaaaatcgacctccctaaattcccttccctcttaaaatcatttaaaaacgaactccaaaaaacgaccctacgcaaaaaaccaaattccatccgaaacgaacaaaaaatactaaactccaaaaaaaacgtttcccacattcgataataaaaaatatttaacgacacgacacgaccaacgctctcaaaaaccctcttctacgcaaaatatccaatcgtaaccacgaaaatacgccgcgtcaatccctaactcgaaaaaaaatcctccaaaaaaccgcactaaccatctaacttcctccaccttcaacctaccaaacccgcgaccaccgccgacgcgaaaaaccgacccacctctacccgcgcgcctaaccttaaaacgatcgtaaaattatacttcctcaaacaaacgataaacgcaccgcgaactttttctatttaaaaactacaacgtcacacaacaacgcgcgcgaaaaaaaaaaatattctcgcgaaaaatcc

SEQ ID NO: 19047 - DNA, 631 bp, Artificial Sequence
  chemically treated genomic DNA (Homo sapiens) CpG-island No: 19047
aaatttgtttatatttcgagtgtttcggtatatttcggggtttcgtttttcgttttttatagtaggaagcggcgagtcgtttttagtgtttacgtcgtttttcggttgttcggtttgggttttttattttcgtttttggaatcggtttttttagattttttttttttttaaaattatttggaaacgggttttaaggggcgattttgcgtagaaaattaaattttattcggggcgggtagggagtgttagattttaaggaagacgttttttatattcggtggtgaggagtgtttggcggtacggtacggttagcgtttttaaggatttttttttgcgtagaatatttagtcgtagttacgaaaatacgtcgcgttagtttttgattcgaaaggaagttttttagagagtcgtattaattatttagttttttttatttttagtttgttaggttcgcggttatcgtcggcgcgggaggtcggtttatttttgttcgcgcgtttggttttaaagcggtcgtggaattatgtttttttaggtaggcggtggacgtatcgcgggttttttttgtttgaagattatagcgttatatagtaacgcgcgcgagagaagagagtattttcgcgagaagttt

SEQ ID NO: 19048 - DNA, 631 bp, Artificial Sequence
  chemically treated genomic DNA (Homo sapiens) CpG-island No: 19048
aaacttctcgcgaaaatactctcttctctcgcgcgcgttactatataacgctataatcttcaaacaaaaaaaacccgcgatacgtccaccgcctacctaaaaaaacataattccacgaccgctttaaaaccaaacgcgcgaacaaaaataaaccgacctcccgcgccgacgataaccgcgaacctaacaaactaaaaataaaaaaaactaaataattaatacgactctctaaaaaacttcctttcgaatcaaaaactaacgcgacgtattttcgtaactacgactaaatattctacgcaaaaaaaaatccttaaaaacgctaaccgtaccgtaccgccaaacactcctcaccaccgaatataaaaaacgtcttccttaaaatctaacactccctacccgccccgaataaaatttaattttctacgcaaaatcgccccttaaaacccgtttccaaataattttaaaaaaaaaaaaaatctaaaaaaaccgattccaaaaacgaaaataaaaaacccaaaccgaacaaccgaaaaacgacgtaaacactaaaaacgactcgccgcttcctactataaaaaacgaaaaacgaaaccccgaaatataccgaaacactcgaaatataaacaaattt

SEQ ID NO: 19049 - DNA, 710 bp, Artificial Sequence
  chemically treated genomic DNA (Homo sapiens) CpG-island No: 19049
ttaacgtgttcgtgatttcgttggtcgtagtcgatttggtgatgggatttttggtggtgtcgtcggcggttattttggcgttgattggttattggtcgttgggcgttattggttgcgagttgtggatttcggtggacgtgttgtgtgtgatcgttagtatcgaaattttgtgcgttttggtcgtggatcgttatttggttgtgattaattcgttgcgttacggcgtattggttattaagcgttgcgttcggatagttgtggttttggtgtgggtcgtgtcggtcgcggtgtcgtttgcgtttattatgagttagtggtggcgcgtaggggtcgacgtcgaggcgtagcgttgttattttaattcgcgttgttgtgttttcgtttttaatatgttttacgtgttgttgttttttttcgtttttttttattttttttttttcgtgatgtttttcgtttacgcgcgggttttcgtggtggttacgcgttagttgcgtttgttgcgcggggagttgggtcgtttttcgttcgaggagttttcgtcggcgtcgtcgcgttttttggtttcggtttcggtggggacgtgcgtttcgttcgaaggggtgttcgtttgcggtcggcggttcgcgcgttttttgttttttcgggaatatcgggttttgtgtattttgggttttattatgggtatttttattttttgttggttgtttttt

SEQ ID NO: 19050 - DNA, 710 bp, Artificial Sequence
  chemically treated genomic DNA (Homo sapiens) CpG-island No: 19050
aaaaaacaaccaacaaaaaataaaaatacccataataaaacccaaaatacacaaaacccgatattcccgaaaaaacaaaaaacgcgcgaaccgccgaccgcaaacgaacaccccttcgaacgaaacgcacgtccccaccgaaaccgaaaccaaaaaacgcgacgacgccgacgaaaactcctcgaacgaaaaacgacccaactccccgcgcaacaaacgcaactaacgcgtaaccaccacgaaaacccgcgcgtaaacgaaaaacatcacgaaaaaaaaaaaataaaaaaaaacgaaaaaaaacaacaacacgtaaaacatattaaaaacgaaaacacaacaacgcgaattaaaataacaacgctacgcctcgacgtcgacccctacgcgccaccactaactcataataaacgcaaacgacaccgcgaccgacacgacccacaccaaaaccacaactatccgaacgcaacgcttaataaccaatacgccgtaacgcaacgaattaatcacaaccaaataacgatccacgaccaaaacgcacaaaatttcgatactaacgatcacacacaacacgtccaccgaaatccacaactcgcaaccaataacgcccaacgaccaataaccaatcaacgccaaaataaccgccgacgacaccaccaaaaatcccatcaccaaatcgactacgaccaacgaaatcacgaacacgttaa

SEQ ID NO: 19051 - DNA, 710 bp, Artificial Sequence
  chemically treated genomic DNA (Homo sapiens) CpG-island No: 19051
gaagggtaattagtagagagtgaaggtgtttatgatgagatttaaggtgtatagggttcggtgttttcggagaggtaggaggcgcgcgggtcgtcggtcgtaggcgggtattttttcgggcggagcgtacgtttttatcggggtcggggttagagagcgcgacggcgtcggcggagatttttcgggcggaaagcggtttagtttttcgcgtagtaagcgtagttggcgcgtagttattacgaaaattcgcgcgtagacgaagagtattacgagaagaggaaggtagaaggagacggaggaggatagtagtacgtagggtatgttggaggcgaaggtatagtagcgcgggttggagtggtagcgttgcgtttcggcgtcggtttttacgcgttattattggtttatgatgggcgtaaacgatatcgcggtcgatacgatttatattaggattatagttgttcgggcgtagcgtttggtgattagtgcgtcgtaacgtagcgggttggttatagttaggtagcggtttacggttagggcgtatagggtttcgatgttggcggttatatatagtacgtttatcgaggtttatagttcgtagttagtggcgtttaacggttagtggttagttagcgttaaggtggtcgtcggcggtattattaggagttttattattaggtcggttgcggttagcgaagttacgaatacgttgg

SEQ ID NO: 19052 - DNA, 710 bp, Artificial Sequence
  chemically treated genomic DNA (Homo sapiens) CpG-island No: 19052
ccaacgtattcgtaacttcgctaaccgcaaccgacctaataataaaactcctaataataccgccgacgaccaccttaacgctaactaaccactaaccgttaaacgccactaactacgaactataaacctcgataaacgtactatatataaccgccaacatcgaaaccctatacgccctaaccgtaaaccgctacctaactataaccaacccgctacgttacgacgcactaatcaccaaacgctacgcccgaacaactataatcctaatataaatcgtatcgaccgcgatatcgtttacgcccatcataaaccaataataacgcgtaaaaaccgacgccgaaacgcaacgctaccactccaacccgcgctactataccttcgcctccaacataccctacgtactactatcctcctccgtctccttctaccttcctcttctcgtaatactcttcgtctacgcgcgaattttcgtaataactacgcgccaactacgcttactacgcgaaaaactaaaccgctttccgcccgaaaaatctccgccgacgccgtcgcgctctctaaccccgaccccgataaaaacgtacgctccgcccgaaaaaatacccgcctacgaccgacgacccgcgcgcctcctacctctccgaaaacaccgaaccctatacaccttaaatctcatcataaacaccttcactctctactaattacccttc

SEQ ID NO: 19053 - DNA, 514 bp, Artificial Sequence
  chemically treated genomic DNA (Homo sapiens) CpG-island No: 19053
  misc_feature (351)..(351): n is either a, c, g or t
cgggcggcgggcggggggaggtgtagatggtaggaggcggcggcggcggcggcggcggcggcgttgtttagggtttcgaggtttcggggggagggcggttagaagtttttcggttttcggtagtcgtgttgggttcgtaggtggttgagtagttttttcgaggtggcgaagcgtttgtcgatcggtttattggttgttatttagttgtagttgtgcgttacggtttcgttttgtagtatgaagtcgtaggtgtagagcgggtggtcggggagcgcggttgggcggcgtggggatcgagagcgcgggcgggtttgtagcgggtgttcggggtataattacggtagttttttnttttaggttgggttcggtagggtcgtgcgcgttgtaggtggagtagttggagtcgtcgaggtgcgaggcgtcgtggtaattttttaagtaataggggtcgcggtataattttgtaggaaggaggggggaggtttcggtgagcgggttggagttggggggtttg

SEQ ID NO: 19054 - DNA, 514 bp, Artificial Sequence
  chemically treated genomic DNA (Homo sapiens) CpG-island No: 19054
  misc_feature (164)..(164): n is either a, c, g or t
caaaccccccaactccaacccgctcaccgaaacctcccccctccttcctacaaaattataccgcgacccctattacttaaaaaattaccacgacgcctcgcacctcgacgactccaactactccacctacaacgcgcacgaccctaccgaacccaacctaaaanaaaaaactaccgtaattataccccgaacacccgctacaaacccgcccgcgctctcgatccccacgccgcccaaccgcgctccccgaccacccgctctacacctacgacttcatactacaaaacgaaaccgtaacgcacaactacaactaaataacaaccaataaaccgatcgacaaacgcttcgccacctcgaaaaaactactcaaccacctacgaacccaacacgactaccgaaaaccgaaaaacttctaaccgccctccccccgaaacctcgaaaccctaaacaacgccgccgccgccgccgccgccgccgcctcctaccatctacacctccccccgcccgccgcccg

SEQ ID NO: 19055 - DNA, 514 bp, Artificial Sequence
  chemically treated genomic DNA (Homo sapiens) CpG-island No: 19055
  misc_feature (164)..(164): n is either a, c, g or t
taagttttttagttttagttcgtttatcggggtttttttttttttttttgtaggattatgtcgcgatttttattgtttgggaggttattacggcgtttcgtatttcggcggttttagttgttttatttgtagcgcgtacgattttgtcgggtttagtttgaagnggggggttatcgtggttgtatttcgggtattcgttgtaggttcgttcgcgttttcggtttttacgtcgtttagtcgcgtttttcggttattcgttttatatttacggttttatgttgtagaacggaatcgtggcgtatagttgtaattgggtggtagttagtgggtcggtcgataagcgtttcgttatttcggaggagttgtttagttatttacggatttaatacggttgtcgggagtcgagaaatttttggtcgtttttttttcggggtttcggggttttgggtagcgtcgtcgtcgtcgtcgtcgtcgtcgttttttgttatttgtattttttttcgttcgtcgttcg

SEQ ID NO: 19056 - DNA, 514 bp, Artificial Sequence
  chemically treated genomic DNA (Homo sapiens) CpG-island No: 19056
  misc_feature (351)..(351): n is either a, c, g or t
cgaacgacgaacgaaaaaaaatacaaataacaaaaaacgacgacgacgacgacgacgacgacgctacccaaaaccccgaaaccccgaaaaaaaaacgaccaaaaatttctcgactcccgacaaccgtattaaatccgtaaataactaaacaactcctccgaaataacgaaacgcttatcgaccgacccactaactaccacccaattacaactatacgccacgattccgttctacaacataaaaccgtaaatataaaacgaataaccgaaaaacgcgactaaacgacgtaaaaaccgaaaacgcgaacgaacctacaacgaatacccgaaatacaaccacgataaccccccncttcaaactaaacccgacaaaatcgtacgcgctacaaataaaacaactaaaaccgccgaaatacgaaacgccgtaataacctcccaaacaataaaaatcgcgacataatcctacaaaaaaaaaaaaaaaaaccccgataaacgaactaaaactaaaaaactta

SEQ ID NO: 19057 - DNA, 755 bp, Artificial Sequence
  chemically treated genomic DNA (Homo sapiens) CpG-island No: 19057
ggcgtaggcgtttacgatggagtcgtggtagttaatgttggagggcggtagcgggaatatcgagtggttcggtttgtagggagatatcggcgttacgtggtcggtttttattagcgtcgagggcggttcggatttgcgttcggaggtttcggattcggcgttattcgtgcgtttcgggttttttatcgtcgtcgcggtttacggttgtcggtttcgggttgggtttgggtttttggttttttttgtttagtttttcgtcgttaatttcgtcgtcgtttttgtagttagagtggtgcggggagtcgtcgcgggagtcgtcgggcgacgacgaggacgaggatgcggagatcggcgttttatgcggggggaaagggcgggtaggcggcgttggggattttgaagttcgttttgtttttcggggacgaggaggacgaggaggaggtggaagatatcgaggaggagtcgttgtttttgcgggagtcgtcgtcgtcggagtttttggagtagggtttgaagttggatttgttttcggtcggtgagttttttagttgttttagggtcgcggttgcggaggcggcgttcggggttgagcggtcggggttttttttcgtttttagttcgttggtcgtcgtcgttatcgagttgagtttggaggagggcggcgggttcggtttgtcgatttgcgataggtttgagttaggtaagcgttaaggggttttttttggcgtttagttgtgggagatagaagtaggggg

SEQ ID NO: 19058 - DNA, 755 bp, Artificial Sequence
  chemically treated genomic DNA (Homo sapiens) CpG-island No: 19058
ccccctacttctatctcccacaactaaacgccaaaaaaaaccccttaacgcttacctaactcaaacctatcgcaaatcgacaaaccgaacccgccgccctcctccaaactcaactcgataacgacgacgaccaacgaactaaaaacgaaaaaaaaccccgaccgctcaaccccgaacgccgcctccgcaaccgcgaccctaaaacaactaaaaaactcaccgaccgaaaacaaatccaacttcaaaccctactccaaaaactccgacgacgacgactcccgcaaaaacaacgactcctcctcgatatcttccacctcctcctcgtcctcctcgtccccgaaaaacaaaacgaacttcaaaatccccaacgccgcctacccgccctttccccccgcataaaacgccgatctccgcatcctcgtcctcgtcgtcgcccgacgactcccgcgacgactccccgcaccactctaactacaaaaacgacgacgaaattaacgacgaaaaactaaacaaaaaaaaccaaaaacccaaacccaacccgaaaccgacaaccgtaaaccgcgacgacgataaaaaacccgaaacgcacgaataacgccgaatccgaaacctccgaacgcaaatccgaaccgccctcgacgctaataaaaaccgaccacgtaacgccgatatctccctacaaaccgaaccactcgatattcccgctaccgccctccaacattaactaccacgactccatcgtaaacgcctacgcc

SEQ ID NO: 19059 - DNA, 755 bp, Artificial Sequence
  chemically treated genomic DNA (Homo sapiens) CpG-island No: 19059
ttttttgtttttgttttttatagttggacgttaagaagagttttttggcgtttgtttggtttagatttgtcgtagatcggtaagtcggattcgtcgtttttttttaaatttaattcggtggcggcggcggttaacgggttgggagcggagaaggatttcggtcgtttagtttcgggcgtcgttttcgtagtcgcggttttgaagtagttgggggatttatcggtcgaggataagtttagttttaagttttattttaagggtttcggcggcggcgattttcgtaaagatagcggttttttttcggtgttttttatttttttttcgtttttttcgttttcgggagataaggcgggttttagggtttttagcgtcgtttgttcgtttttttttttcgtatggagcgtcggttttcgtattttcgttttcgtcgtcgttcggcggttttcgcggcggtttttcgtattattttgattgtaagaacggcggcggggttggcggcggggaattggataagaaagattaggagtttaagtttagttcggagtcggtagtcgtgagtcgcggcggcggtggggagttcggggcgtacgggtggcgtcgagttcggggttttcgggcgtaagttcgagtcgttttcggcgttggtgggggtcggttacgtggcgtcggtgtttttttataagtcgggttattcggtgttttcgttgtcgttttttagtattggttattacggttttatcgtgggcgtttacgtt

SEQ ID NO: 19060 - DNA, 755 bp, Artificial Sequence
  chemically treated genomic DNA (Homo sapiens) CpG-island No: 19060
aacgtaaacgcccacgataaaaccgtaataaccaatactaaaaaacgacaacgaaaacaccgaataacccgacttataaaaaaacaccgacgccacgtaaccgacccccaccaacgccgaaaacgactcgaacttacgcccgaaaaccccgaactcgacgccacccgtacgccccgaactccccaccgccgccgcgactcacgactaccgactccgaactaaacttaaactcctaatctttcttatccaattccccgccgccaaccccgccgccgttcttacaatcaaaataatacgaaaaaccgccgcgaaaaccgccgaacgacgacgaaaacgaaaatacgaaaaccgacgctccatacgaaaaaaaaaaacgaacaaacgacgctaaaaaccctaaaacccgccttatctcccgaaaacgaaaaaaacgaaaaaaaaataaaaaacaccgaaaaaaaaccgctatctttacgaaaatcgccgccgccgaaacccttaaaataaaacttaaaactaaacttatcctcgaccgataaatcccccaactacttcaaaaccgcgactacgaaaacgacgcccgaaactaaacgaccgaaatccttctccgctcccaacccgttaaccgccgccgccaccgaattaaatttaaaaaaaaacgacgaatccgacttaccgatctacgacaaatctaaaccaaacaaacgccaaaaaactcttcttaacgtccaactataaaaaacaaaaacaaaaaa

SEQ ID NO: 19061 - DNA, 691 bp, Artificial Sequence
  chemically treated genomic DNA (Homo sapiens) CpG-island No: 19061
tcgggagtcggttcgtttggcgtagggggttcgtcggtggtaagagggatatcgttgtcggtatcgtcggttttttttcgtcgtcgtcgttgtcgttgtcgttgttttcgggtgtttttgggttagatttagcgggcgaatcgtttatttggaggaggtagcgtcgttgggggggcggggagggcgggggagtatcggggagcgagtttcgttgcggtgggttcgtttcgtagcgtcgatcgcgtgtgatacgggtagttgcgttttttcgtcgtttttttttttttatcgacgttttcgtcgtcgtcgttatcgtcgttggtttcggttagtaatataaaaattttcgtttttttcgagtcgtacgttaaatagtcgcgatcggtagttatattttaaagggatcgtcgcgttcgtttaatcgtagttttcgtcgggatttcggggcggggagagcggcgggttgaggtcggttttatcggtgggcggggagagttttaaaggggtcgcgtcgcgcgtcgtcgttgtttcggtttcggtcgttttcgggatttttttttttttttcgattgggtttttttcgttttggggtttttcgtttgggacgggattttttcgggattttgagttttgcgtttcgttttttttttcggtcgtttttttttttttttttttttttattattgggtgg

SEQ ID NO: 19062 - DNA, 691 bp, Artificial Sequence
  chemically treated genomic DNA (Homo sapiens) CpG-island No: 19062
ccacccaataataaaaaaaaaaaaaaaaaaaaaaacgaccgaaaaaaaaaacgaaacgcaaaactcaaaatcccgaaaaaatcccgtcccaaacgaaaaaccccaaaacgaaaaaaacccaatcgaaaaaaaaaaaaaaatcccgaaaacgaccgaaaccgaaacaacgacgacgcgcgacgcgacccctttaaaactctccccgcccaccgataaaaccgacctcaacccgccgctctccccgccccgaaatcccgacgaaaactacgattaaacgaacgcgacgatccctttaaaatataactaccgatcgcgactatttaacgtacgactcgaaaaaaacgaaaatttttatattactaaccgaaaccaacgacgataacgacgacgacgaaaacgtcgataaaaaaaaaaaaacgacgaaaaaacgcaactacccgtatcacacgcgatcgacgctacgaaacgaacccaccgcaacgaaactcgctccccgatactcccccgccctccccgcccccccaacgacgctacctcctccaaataaacgattcgcccgctaaatctaacccaaaaacacccgaaaacaacgacaacgacaacgacgacgacgaaaaaaaaccgacgataccgacaacgatatccctcttaccaccgacgaaccccctacgccaaacgaaccgactcccga

SEQ ID NO: 19063 - DNA, 691 bp, Artificial Sequence
  chemically treated genomic DNA (Homo sapiens) CpG-island No: 19063
ttatttagtggtgagaagggagagaggagagagagcggtcggaaaggaggacggggcgtagagtttagggtttcggagaagtttcgttttaggcgggggattttagggcgaggaaggtttagtcggggggaggggaggaatttcgggagcggtcgagatcgaggtagcggcggcgcgcggcgcggtttttttaaggtttttttcgtttatcgatggagtcggttttagttcgtcgtttttttcgtttcggggtttcggcgagagttgcgattgggcgggcgcggcgatttttttgaagtgtggttgtcgatcgcggttatttgacgtgcggttcgaggaaggcgaaggtttttgtgttgttagtcggggttagcggcggtggcggcggcggcggaggcgtcggtggaggaggggaggcggcgaggaggcgtagttgttcgtgttatacgcgatcgacgttgcggagcgagtttatcgtaacggagttcgtttttcggtgttttttcgtttttttcgtttttttagcggcgttgttttttttaaatgagcgattcgttcgttggatttaatttaaggatattcgaaagtagcggtagcggtagcggcggcggcgggaagaggtcggcggtgtcggtagcggtgttttttttgttatcggcggattttttgcgttaggcgaatcggttttcga

SEQ ID NO: 19064 - DNA, 691 bp, Artificial Sequence
  chemically treated genomic DNA (Homo sapiens) CpG-island No: 19064
tcgaaaaccgattcgcctaacgcaaaaaatccgccgataacaaaaaaaacaccgctaccgacaccgccgacctcttcccgccgccgccgctaccgctaccgctactttcgaatatccttaaattaaatccaacgaacgaatcgctcatttaaaaaaaacaacgccgctaaaaaaacgaaaaaaacgaaaaaacaccgaaaaacgaactccgttacgataaactcgctccgcaacgtcgatcgcgtataacacgaacaactacgcctcctcgccgcctcccctcctccaccgacgcctccgccgccgccgccaccgccgctaaccccgactaacaacacaaaaaccttcgccttcctcgaaccgcacgtcaaataaccgcgatcgacaaccacacttcaaaaaaatcgccgcgcccgcccaatcgcaactctcgccgaaaccccgaaacgaaaaaaacgacgaactaaaaccgactccatcgataaacgaaaaaaaccttaaaaaaaccgcgccgcgcgccgccgctacctcgatctcgaccgctcccgaaattcctcccctccccccgactaaaccttcctcgccctaaaatcccccgcctaaaacgaaacttctccgaaaccctaaactctacgccccgtcctcctttccgaccgctctctctcctctctcccttctcaccactaaataa

SEQ ID NO: 19065 - DNA, 1092 bp, Artificial Sequence
  chemically treated genomic DNA (Homo sapiens) CpG-island No: 19065
ttttacgcgattttacgcgcgatagttatcgggttgagtagacgcgaggttgggtatgcggtgggaggcggcggaggataatacggggttttagtcgcgagggcggtgttgatgtgttatagttcgggcgggtcgcgggcgaggggtcgggttggcgttcgagggtagggaggggggtggggtagggatttcgcggtttttagttttcgttcgtttcgggtaaagtacggcgcgcgcgggtaaataatagtttcggtagtgtagggggttcggtcgtcgacgggacgtttttttcggcgtcgcggttatttttaggatttcggtcgtcggcgtttttcgcgggtttcgttacgtgtttttcgcgtttcgtttagtttagaaagagtcgttttcggttcgttcgcgtttttattggatttgttcgtcggtttttttttataggttcgcggttttgatcgcgttaattttttcggagaagggtcggcgggacggtcgagttatttattagagttgaggcgcggcgcggttcgattgattgaagcgagagcgttcggcgggcggcgagggtagcggttaggtgatttatttttttcgcgcggttagtcgtttttttttttttgcgtcgttttgttgtcgttatttcgcggcgttaaaatttcgttcgttcgttgaaggtttcgttttcggcgtcgaagtttcgttttgtcgttttcgaagtttttgttagcgaacgagcgcgcgtaatagcgcggggtaggggtcgtcgcggtcggaagtttacgcggggggttgtagggacgggtcgtaaggggcggggcgggtttcgaggaggcggcggtggggttttcggattttcgcgcgtggtatagttcgtattttgaattgatttttattcgaggattatttttttttttttttttgagggcggaacggaaaggttaagcgttttttcgtttcgggagttgtaggacgttttaatttagtcgagtcgtcgcgtgttcgggtgttcgcgaatagtaggagagaggacgggcgttggttttataggggtcgttttattttttgaagagtttttcgttgtttgttttgggg

SEQ ID NO: 19066 - DNA, 1092 bp, Artificial Sequence
  chemically treated genomic DNA (Homo sapiens) CpG-island No: 19066
ccccaaaacaaacaacgaaaaactcttcaaaaaataaaacgacccctataaaaccaacgcccgtcctctctcctactattcgcgaacacccgaacacgcgacgactcgactaaattaaaacgtcctacaactcccgaaacgaaaaaacgcttaacctttccgttccgccctcaaaaaaaaaaaaaaaaataatcctcgaataaaaatcaattcaaaatacgaactataccacgcgcgaaaatccgaaaaccccaccgccgcctcctcgaaacccgccccgccccttacgacccgtccctacaaccccccgcgtaaacttccgaccgcgacgacccctaccccgcgctattacgcgcgctcgttcgctaacaaaaacttcgaaaacgacaaaacgaaacttcgacgccgaaaacgaaaccttcaacgaacgaacgaaattttaacgccgcgaaataacgacaacaaaacgacgcaaaaaaaaaaaaacgactaaccgcgcgaaaaaaataaatcacctaaccgctaccctcgccgcccgccgaacgctctcgcttcaatcaatcgaaccgcgccgcgcctcaactctaataaataactcgaccgtcccgccgacccttctccgaaaaaattaacgcgatcaaaaccgcgaacctataaaaaaaaaccgacgaacaaatccaataaaaacgcgaacgaaccgaaaacgactctttctaaactaaacgaaacgcgaaaaacacgtaacgaaacccgcgaaaaacgccgacgaccgaaatcctaaaaataaccgcgacgccgaaaaaaacgtcccgtcgacgaccgaaccccctacactaccgaaactattatttacccgcgcgcgccgtactttacccgaaacgaacgaaaactaaaaaccgcgaaatccctaccccacccccctccctaccctcgaacgccaacccgacccctcgcccgcgacccgcccgaactataacacatcaacaccgccctcgcgactaaaaccccgtattatcctccgccgcctcccaccgcatacccaacctcgcgtctactcaacccgataactatcgcgcgtaaaatcgcgtaaaa

SEQ ID NO: 19067 - DNA, 1092 bp, Artificial Sequence
  chemically treated genomic DNA (Homo sapiens) CpG-island No: 19067
ttttagggtaggtagcgaggagttttttaaggggtaaagcgatttttgtggggttagcgttcgtttttttttttgttgttcgcgggtattcgggtacgcggcgattcggttgaattagggcgttttgtagttttcgaggcgaggaggcgtttggttttttcgtttcgtttttagaagggagaggagaggtggttttcgagtgggagttagtttaggatgcgggttgtgttacgcgcggaggttcggggattttatcgtcgttttttcgaggttcgtttcgttttttacgattcgtttttgtaatttttcgcgtgggttttcggtcgcggcgatttttgtttcgcgttattgcgcgcgttcgttcgttgatagaggtttcgagggcggtagggcggggtttcggcgtcgggggcggggtttttagcgggcgggcggggttttggcgtcgcgaggtggcggtagtagagcggcgtagaagggagggggcggttggtcgcgcggaaggagtgagttatttgatcgttgttttcgtcgttcgtcgggcgttttcgttttagttagtcgggtcgcgtcgcgttttagttttggtgagtggttcggtcgtttcgtcggttttttttcgggagggttggcgcggttagggtcgcgggtttgtgaggggaggtcggcggataggtttagtgaaggcgcgggcgggtcgggggcggttttttttgggttgggcggggcgcggggggtacgtagcggggttcgcggggggcgtcggcggtcgggattttggaagtggtcgcgacgtcggaaggggcgtttcgtcggcggtcgaattttttgtattgtcggagttgttgtttattcgcgcgcgtcgtattttattcggggcgggcgggggttgggggtcgcggggtttttgttttatttttttttttgttttcgggcgttagttcggtttttcgttcgcggttcgttcgggttgtgatatattagtatcgttttcgcggttggggtttcgtattgtttttcgtcgttttttatcgtatgtttagtttcgcgtttatttagttcggtggttgtcgcgcgtggaatcgcgtaaga

SEQ ID NO: 19068 - DNA, 1092 bp, Artificial Sequence
  chemically treated genomic DNA (Homo sapiens) CpG-island No: 19068
tcttacgcgattccacgcgcgacaaccaccgaactaaataaacgcgaaactaaacatacgataaaaaacgacgaaaaacaatacgaaaccccaaccgcgaaaacgatactaatatatcacaacccgaacgaaccgcgaacgaaaaaccgaactaacgcccgaaaacaaaaaaaaaaataaaacaaaaaccccgcgacccccaacccccgcccgccccgaataaaatacgacgcgcgcgaataaacaacaactccgacaatacaaaaaattcgaccgccgacgaaacgccccttccgacgtcgcgaccacttccaaaatcccgaccgccgacgccccccgcgaaccccgctacgtaccccccgcgccccgcccaacccaaaaaaaaccgcccccgacccgcccgcgccttcactaaacctatccgccgacctcccctcacaaacccgcgaccctaaccgcgccaaccctcccgaaaaaaaaccgacgaaacgaccgaaccactcaccaaaactaaaacgcgacgcgacccgactaactaaaacgaaaacgcccgacgaacgacgaaaacaacgatcaaataactcactccttccgcgcgaccaaccgccccctcccttctacgccgctctactaccgccacctcgcgacgccaaaaccccgcccgcccgctaaaaaccccgcccccgacgccgaaaccccgccctaccgccctcgaaacctctatcaacgaacgaacgcgcgcaataacgcgaaacaaaaatcgccgcgaccgaaaacccacgcgaaaaattacaaaaacgaatcgtaaaaaacgaaacgaacctcgaaaaaacgacgataaaatccccgaacctccgcgcgtaacacaacccgcatcctaaactaactcccactcgaaaaccacctctcctctcccttctaaaaacgaaacgaaaaaaccaaacgcctcctcgcctcgaaaactacaaaacgccctaattcaaccgaatcgccgcgtacccgaatacccgcgaacaacaaaaaaaaaaacgaacgctaaccccacaaaaatcgctttaccccttaaaaaactcctcgctacctaccctaaaa

SEQ ID NO: 19069 - DNA, 1205 bp, Artificial Sequence
  chemically treated genomic DNA (Homo sapiens) CpG-island No: 19069
ggcgtagtcggaggcggttcgatttgggcggttcgggagcgcgcgttttcgaggtcgcgtaggttttttttgtttggcgtttaggtggttttttcgtttatttcgtcgttttttttttcgggtttttttttttttagcgagggtcgagtttgattgtggcgcgcggggaaggaggggttattagggatttgaaagtgtacgggttgcggagtggagttcgtatttgttttcgtcgttcgcgagcggattaaatttttgtaaatttaaattgaatggggtttttttttgttgttttttagagggcgtcggtagttcgtcgcgcgttttttttcggcgggagcggtcgtttagcgtacggttaggagcgatcgcgggagttcgatttaagttcgtgcgggttagacggcggcggcgaggcggaggttgcggaggtattcgggttttcggatttaggtattcggatttcgggatttaggcgtcgtcggatcgcgttttatttcgcgcgttcgagtagggcgattgttattagttttttggacgggattcggggcgggattttggtgttttgaaaggggttcgggcgattttaagaggaagaatttttgggggcggggttttcggtttcgcgttttttgggtagtcgttattgtttacgcgtttcgttgggcggcgcggggggcgtgatcgcggcggtttcgggttttgggtgcggagatttaggcggggttgggtttagggcggcggcgggagaagtcggggaagtcgaagagtttggggaggaggagttgcgagcgcgggagacgagtaggagtcgcgcgggtcgcggcgagcgcgatgtcggcggcggcgggggacgggtttttgggggagtcggcggcgtttgggggcggcggcggcgcggaggacgcggttaggttcgcggcggtttgcgagggaagttttttgtttgtttgggtgagcggcgtgtttcgcgagcggtttcgcgatttttagtattataagcgcgtgggtaattattttatcggtagtaggaagttgggcgagggtttttttgttaaggtgcgcgaggggttgtacgtgttgatcggggagaaggtgagtttttcgggcgtcgtggggttggggtataggggcgggagtcggcggttaggatttcgcggggagtattgtattgggagttttagtgtgtagtttcgggttaagcg

SEQ ID NO: 19070 - DNA, 1205 bp, Artificial Sequence
  chemically treated genomic DNA (Homo sapiens) CpG-island No: 19070
cgcttaacccgaaactacacactaaaactcccaatacaatactccccgcgaaatcctaaccgccgactcccgcccctataccccaaccccacgacgcccgaaaaactcaccttctccccgatcaacacgtacaacccctcgcgcaccttaacaaaaaaaccctcgcccaacttcctactaccgataaaataattacccacgcgcttataatactaaaaatcgcgaaaccgctcgcgaaacacgccgctcacccaaacaaacaaaaaacttccctcgcaaaccgccgcgaacctaaccgcgtcctccgcgccgccgccgcccccaaacgccgccgactcccccaaaaacccgtcccccgccgccgccgacatcgcgctcgccgcgacccgcgcgactcctactcgtctcccgcgctcgcaactcctcctccccaaactcttcgacttccccgacttctcccgccgccgccctaaacccaaccccgcctaaatctccgcacccaaaacccgaaaccgccgcgatcacgccccccgcgccgcccaacgaaacgcgtaaacaataacgactacccaaaaaacgcgaaaccgaaaaccccgcccccaaaaattcttcctcttaaaatcgcccgaacccctttcaaaacaccaaaatcccgccccgaatcccgtccaaaaaactaataacaatcgccctactcgaacgcgcgaaataaaacgcgatccgacgacgcctaaatcccgaaatccgaatacctaaatccgaaaacccgaatacctccgcaacctccgcctcgccgccgccgtctaacccgcacgaacttaaatcgaactcccgcgatcgctcctaaccgtacgctaaacgaccgctcccgccgaaaaaaaacgcgcgacgaactaccgacgccctctaaaaaacaacaaaaaaaaaccccattcaatttaaatttacaaaaatttaatccgctcgcgaacgacgaaaacaaatacgaactccactccgcaacccgtacactttcaaatccctaataacccctccttccccgcgcgccacaatcaaactcgaccctcgctaaaaaaaaaaaaacccgaaaaaaaaaacgacgaaataaacgaaaaaaccacctaaacgccaaacaaaaaaaacctacgcgacctcgaaaacgcgcgctcccgaaccgcccaaatcgaaccgcctccgactacgcc

SEQ ID NO: 19071 - DNA, 1205 bp, Artificial Sequence
  chemically treated genomic DNA (Homo sapiens) CpG-island No: 19071
cgtttggttcgggattgtatattgggatttttagtgtagtgtttttcgcggggttttggtcgtcgattttcgtttttgtgttttagttttacggcgttcgggagatttatttttttttcggttagtacgtgtagtttttcgcgtattttggtaaaggagttttcgtttagttttttgttgtcgatgaggtagttgtttacgcgtttgtggtgttggaagtcgcggagtcgttcgcggggtacgtcgtttatttaggtaggtaggaaatttttttcgtaggtcgtcgcgggtttggtcgcgtttttcgcgtcgtcgtcgtttttaggcgtcgtcggtttttttaggagttcgtttttcgtcgtcgtcggtatcgcgttcgtcgcggttcgcgcggtttttgttcgtttttcgcgttcgtagttttttttttttaggtttttcggttttttcggtttttttcgtcgtcgttttgggtttagtttcgtttgggttttcgtatttagagttcggggtcgtcgcgattacgtttttcgcgtcgtttagcgaggcgcgtagataatagcggttgtttaggggacgcgggatcggggatttcgtttttaaaagtttttttttttagggtcgttcgggttttttttaggatattaggatttcgtttcgggtttcgtttaggaagttaatgatagtcgttttgttcgggcgcgcggggtggggcgcggttcggcggcgtttgggtttcggggttcgggtgtttgggttcgggagttcgggtgttttcgtagttttcgtttcgtcgtcgtcgtttggttcgtacgggtttgggtcgggttttcgcgatcgtttttagtcgtgcgttgggcggtcgttttcgtcggagagaagcgcgcggcgggttgtcggcgttttttggaaggtagtagaagaaagttttatttagtttgaatttgtagaaatttaattcgttcgcgggcggcgggaatagatgcgagttttatttcgtagttcgtgtatttttaaatttttagtagttttttttttttcgcgcgttatagttaaattcgattttcgttggagaggggagggttcggggaggggagcggcggagtggacggagaagttatttgagcgttagatagggagaatttgcgcggtttcggaggcgcgcgttttcgggtcgtttaggtcgggtcgttttcggttgcgtt

SEQ ID NO: 19072 - DNA, 1205 bp, Artificial Sequence
  chemically treated genomic DNA (Homo sapiens) CpG-island No: 19072
aacgcaaccgaaaacgacccgacctaaacgacccgaaaacgcgcgcctccgaaaccgcgcaaattctccctatctaacgctcaaataacttctccgtccactccgccgctcccctccccgaaccctcccctctccaacgaaaatcgaatttaactataacgcgcgaaaaaaaaaaaactactaaaaatttaaaaatacacgaactacgaaataaaactcgcatctattcccgccgcccgcgaacgaattaaatttctacaaattcaaactaaataaaactttcttctactaccttccaaaaaacgccgacaacccgccgcgcgcttctctccgacgaaaacgaccgcccaacgcacgactaaaaacgatcgcgaaaacccgacccaaacccgtacgaaccaaacgacgacgacgaaacgaaaactacgaaaacacccgaactcccgaacccaaacacccgaaccccgaaacccaaacgccgccgaaccgcgccccaccccgcgcgcccgaacaaaacgactatcattaacttcctaaacgaaacccgaaacgaaatcctaatatcctaaaaaaaacccgaacgaccctaaaaaaaaaaacttttaaaaacgaaatccccgatcccgcgtcccctaaacaaccgctattatctacgcgcctcgctaaacgacgcgaaaaacgtaatcgcgacgaccccgaactctaaatacgaaaacccaaacgaaactaaacccaaaacgacgacgaaaaaaaccgaaaaaaccgaaaaacctaaaaaaaaaaaactacgaacgcgaaaaacgaacaaaaaccgcgcgaaccgcgacgaacgcgataccgacgacgacgaaaaacgaactcctaaaaaaaccgacgacgcctaaaaacgacgacgacgcgaaaaacgcgaccaaacccgcgacgacctacgaaaaaaatttcctacctacctaaataaacgacgtaccccgcgaacgactccgcgacttccaacaccacaaacgcgtaaacaactacctcatcgacaacaaaaaactaaacgaaaactcctttaccaaaatacgcgaaaaactacacgtactaaccgaaaaaaaaataaatctcccgaacgccgtaaaactaaaacacaaaaacgaaaatcgacgaccaaaaccccgcgaaaaacactacactaaaaatcccaatatacaatcccgaaccaaacg

SEQ ID NO: 19073 - DNA, 524 bp, Artificial Sequence
  chemically treated genomic DNA (Homo sapiens) CpG-island No: 19073
ttagcggtcgtcggtagtcggagtataggaatattagcggtttttttttcgtagtcgtcgtttttttttttagttgcgttttttttatgtcggttatcgacgcgttttcgtttatggagttttatatgttcgtttatttttgtaatagttggtggcggttcgagttttcggagagttttttgtttaatagcgaggagtcgttgtatttgtttttgtcgtcgtatttatagtcgttagcgtattttttgttatattttagtgatcgaacgtttgttattatttataaatcgttcgcgttttagagcgttatgggaaaaaaaatcgtcgttgtttatgcgcggggcggggagcggtggcggaggtcgagaaggggtaaaagtttgaagggggcgggacggcgggcggtttttagtgcgtatgcgcgtcgtgcggttttggttaagcgtgatagttattgcgtttgcgttaggttttttagtttgaagaaattgatgatgtagatttgtttgtttgtttttttaagg

SEQ ID NO: 19074 - DNA, 524 bp, Artificial Sequence
  chemically treated genomic DNA (Homo sapiens) CpG-island No: 19074
ccttaaaaaaacaaacaaacaaatctacatcatcaatttcttcaaactaaaaaacctaacgcaaacgcaataactatcacgcttaaccaaaaccgcacgacgcgcatacgcactaaaaaccgcccgccgtcccgcccccttcaaacttttaccccttctcgacctccgccaccgctccccgccccgcgcataaacaacgacgattttttttcccataacgctctaaaacgcgaacgatttataaataataacaaacgttcgatcactaaaatataacaaaaaatacgctaacgactataaatacgacgacaaaaacaaatacaacgactcctcgctattaaacaaaaaactctccgaaaactcgaaccgccaccaactattacaaaaataaacgaacatataaaactccataaacgaaaacgcgtcgataaccgacataaaaaaaacgcaactaaaaaaaaaaacgacgactacgaaaaaaaaaccgctaatattcctatactccgactaccgacgaccgctaa

SEQ ID NO: 19075 - DNA, 524 bp, Artificial Sequence
  chemically treated genomic DNA (Homo sapiens) CpG-island No: 19075
ttttaggaagataagtaaataggtttgtattattaatttttttaggttggaaaatttgacgtaggcgtagtgattattacgtttggttaaggtcgtacggcgcgtatgcgtattagaggtcgttcgtcgtttcgttttttttaggtttttgttttttttcggttttcgttatcgtttttcgtttcgcgtatgagtagcggcggtttttttttttatggcgttttggggcgcgggcgatttgtaggtaatggtaggcgttcggttattgaggtgtagtagaggatgcgttggcggttgtgagtgcggcgataagggtaaatgtagcgatttttcgttgttgggtaagagatttttcgaagattcgagtcgttattagttgttgtagaagtgggcgagtatgtggagttttatgagcgaagacgcgtcggtggtcgatatggagagggcgtagttggaggaggaggcggcggttgcggaggagaggtcgttggtgtttttgtgtttcggttgtcggcggtcgttgg

SEQ ID NO: 19076 - DNA, 524 bp, Artificial Sequence
  chemically treated genomic DNA (Homo sapiens) CpG-island No: 19076
ccaacgaccgccgacaaccgaaacacaaaaacaccaacgacctctcctccgcaaccgccgcctcctcctccaactacgccctctccatatcgaccaccgacgcgtcttcgctcataaaactccacatactcgcccacttctacaacaactaataacgactcgaatcttcgaaaaatctcttacccaacaacgaaaaatcgctacatttacccttatcgccgcactcacaaccgccaacgcatcctctactacacctcaataaccgaacgcctaccattacctacaaatcgcccgcgccccaaaacgccataaaaaaaaaaaccgccgctactcatacgcgaaacgaaaaacgataacgaaaaccgaaaaaaaacaaaaacctaaaaaaaacgaaacgacgaacgacctctaatacgcatacgcgccgtacgaccttaaccaaacgtaataatcactacgcctacgtcaaattttccaacctaaaaaaattaataatacaaacctatttacttatcttcctaaaa

SEQ ID NO: 19077 - DNA, 557 bp, Artificial Sequence
  chemically treated genomic DNA (Homo sapiens) CpG-island No: 19077
gcgttacgtattttatgtcggatgtattacgcgttttgcgtcggatgcgttatgcgttttatgttagatgttttatacgttttatgttaggggcgttatgcgttttatgtcggatgtgttacgtattttatgttacgttatgcgtcgtatgttagatgcgttacgtgttttatgttagatgttttatacgttatgttaggggcgttatacgttttatgtcggatatgttacgcgtcgtatgttagatgcgttatacgttttatgtcgggggcgttatacgttttatgtcggatgtgttacgcgttttatgttaggggcgttatgcgttttatgtcggggcgttattcgttttatgttagtgtgtcgtgcgttttatgttaggggcgttatgttttttatgtcggatgtgttatgtattttatgttaggggcgttatgtgttttatgtcggatatgttatgcgttttatgttaggggcgttatgcgttttatgtcgggtgttatgtattttatgtcggggcgttatgtgtttatgtgttatgatatatcgtgtatgtt

SEQ ID NO: 19078 - DNA, 557 bp, Artificial Sequence
  chemically treated genomic DNA (Homo sapiens) CpG-island No: 19078
aacatacacgatatatcataacacataaacacataacgccccgacataaaatacataacacccgacataaaacgcataacgcccctaacataaaacgcataacatatccgacataaaacacataacgcccctaacataaaatacataacacatccgacataaaaaacataacgcccctaacataaaacgcacgacacactaacataaaacgaataacgccccgacataaaacgcataacgcccctaacataaaacgcgtaacacatccgacataaaacgtataacgcccccgacataaaacgtataacgcatctaacatacgacgcgtaacatatccgacataaaacgtataacgcccctaacataacgtataaaacatctaacataaaacacgtaacgcatctaacatacgacgcataacgtaacataaaatacgtaacacatccgacataaaacgcataacgcccctaacataaaacgtataaaacatctaacataaaacgcataacgcatccgacgcaaaacgcgtaatacatccgacataaaatacgtaacgc

SEQ ID NO: 19079 - DNA, 557 bp, Artificial Sequence
  chemically treated genomic DNA (Homo sapiens) CpG-island No: 19079
gatatatacgatatattatgatatatagatatatgacgtttcgatataggatgtatgatattcgatataggacgtatgacgtttttgatatagggcgtatgatatattcgatataggatatatgacgtttttgatataggatgtatgatatattcgatataggaggtatgacgtttttgatataggacgtacgatatattgatataggacgaatgacgtttcgatataggacgtatgacgtttttgatataggacgcgtgatatattcgatataggacgtgtgacgttttcggtataggacgtgtgacgtatttgatatacgacgcgtgatatattcgatataggacgtgtgacgtttttgatatgacgtgtgaaatatttgatataggatacgtgacgtatttgatatgcgacgtatgacgtgatataggatgcgtgatatattcgatataggacgtatggcgtttttgatataagacgtgtgaaatatttgatataggacgtatgacgtattcgacgtaggacgcgtgatgtattcgatataggatgcgtgacgt

SEQ ID NO: 19080 - DNA, 557 bp, Artificial Sequence
  chemically treated genomic DNA (Homo sapiens) CpG-island No: 19080
acgtcacgcatcctatatcgaatacatcacgcgtcctacgtcgaatacgtcatacgtcctatatcaaatatttcacacgtcttatatcaaaaacgccatacgtcctatatcgaatatatcacgcatcctatatcacgtcatacgtcgcatatcaaatacgtcacgtatcctatatcaaatatttcacacgtcatatcaaaaacgtcacacgtcctatatcgaatatatcacgcgtcgtatatcaaatacgtcacacgtcctataccgaaaacgtcacacgtcctatatcgaatatatcacgcgtcctatatcaaaaacgtcatacgtcctatatcgaaacgtcattcgtcctatatcaatatatcgtacgtcctatatcaaaaacgtcatacctcctatatcgaatatatcatacatcctatatcaaaaacgtcatatatcctatatcgaatatatcatacgccctatatcaaaaacgtcatacgtcctatatcgaatatcatacatcctatatcgaaacgtcatatatctatatatcataatatatcgtatatatc

SEQ ID NO: 19081 - DNA, 1083 bp, Artificial Sequence
  chemically treated genomic DNA (Homo sapiens) CpG-island No: 19081
ttacgcggcgcgtgttcggtgaatgaatatagcgtgggagaatcgtgtgtgtgtggtgtttacgcggcgtatgttcggtgaatgaatatagcgtgggagaattgtgtgtgtggtgtttacgtagcgcgtgttcggtgaatgaatatagcgtgggagaattgtgtgtgtgtggtgtttacgcggcgcgtgttcggtgaatgaatatagcgtgggagaattgtgtgtgtggtgtttacgcggcgcgtgattggtgaatgaatatagcgtgggagaattgtgtgtgtggtgtttacgcggtacgtgtttggtgaatgaatatagcgtgggagaattgtgtgtgtggtgtttacgcggcgtgtgttcggtgaatgaatatagcgtgggagaattgtgtgtgtgtggtgtttacgtggtatatgttcggtgagtgaatatagcgtgggagaatcgtgtgtgtgtggtgtttacgtggtatatgttcggtgaatgaatatagcgtgggagaatcgtgtgtgtgtggtgtttacgcggtacgtgtttggtgaatgaatatagcgtgggagaatagtgtgtgtttggtgtttacgcggcgcgtgttcggtgaatgaatatagcgtgggagaattgtgtgtgtggtgtttacgcggtacgtgttcggtgaattaatttagcgtgggagaatcgtgtatgtgtggtgtttacgcggcgtgtgttcggtgaatgaatatagcgtgggagaattgtgtgtgtggtgtttacgcggcgcgtgttcggtgaatgaatatagcgtgggagaattgtgtgtgtggtgtttacgcggcgcgtgttcggtgaatgaatatagcgtgggagaattgtgtgtgtgtggtgtttacgtggcgcgtgttcggtgaatgaatatagcgtgggagaattgtgtgtgtggtgtttacgcggcgcgtgttcggtgaatgaatatagcgtgggagaattgtgtgtgtgtggtgtttacgtggcgcgtgttcggtgaatgaatatagcgtgggaatgttttttgagtgaatatagcgtgggagagttttaaaaaataataataataataat

SEQ ID NO: 19082 - DNA, 1083 bp, Artificial Sequence
  chemically treated genomic DNA (Homo sapiens) CpG-island No: 19082
attattattattattattttttaaaactctcccacgctatattcactcaaaaaacattcccacgctatattcattcaccgaacacgcgccacgtaaacaccacacacacacaattctcccacgctatattcattcaccgaacacgcgccgcgtaaacaccacacacacaattctcccacgctatattcattcaccgaacacgcgccacgtaaacaccacacacacacaattctcccacgctatattcattcaccgaacacgcgccgcgtaaacaccacacacacaattctcccacgctatattcattcaccgaacacgcgccgcgtaaacaccacacacacaattctcccacgctatattcattcaccgaacacacgccgcgtaaacaccacacatacacgattctcccacgctaaattaattcaccgaacacgtaccgcgtaaacaccacacacacaattctcccacgctatattcattcaccgaacacgcgccgcgtaaacaccaaacacacactattctcccacgctatattcattcaccaaacacgtaccgcgtaaacaccacacacacacgattctcccacgctatattcattcaccgaacatataccacgtaaacaccacacacacacgattctcccacgctatattcactcaccgaacatataccacgtaaacaccacacacacacaattctcccacgctatattcattcaccgaacacacgccgcgtaaacaccacacacacaattctcccacgctatattcattcaccaaacacgtaccgcgtaaacaccacacacacaattctcccacgctatattcattcaccaatcacgcgccgcgtaaacaccacacacacaattctcccacgctatattcattcaccgaacacgcgccgcgtaaacaccacacacacacaattctcccacgctatattcattcaccgaacacgcgctacgtaaacaccacacacacaattctcccacgctatattcattcaccgaacatacgccgcgtaaacaccacacacacacgattctcccacgctatattcattcaccgaacacgcgccgcgtaa

SEQ ID NO: 19083 - DNA, 1083 bp, Artificial Sequence
  chemically treated genomic DNA (Homo sapiens) CpG-island No: 19083
gttgttattgttgttgttttttgagatttttttacgttgtgtttatttagggagtatttttacgttgtgtttatttatcgagtacgcgttacgtgggtattatatatatataatttttttacgttatgtttatttatcgagtacgcgtcgcgtgggtattatatatataatttttttacgttgtgtttatttatcgagtacgcgttacgtgggtattatatatatataatttttttacgttgtgtttatttatcgagtacgcgtcgcgtgggtattatatatataatttttttacgttgtgtttatttatcgagtacgcgtcgcgtgggtattatatatataatttttttacgttgtgtttatttatcgagtatacgtcgcgtgggtattatatatatacgatttttttacgttgagttgatttatcgagtacgtgtcgcgtgggtattatatatataatttttttacgttgtgtttatttatcgagtacgcgtcgcgtgggtattaaatatatattatttttttacgttgtgtttatttattaagtacgtgtcgcgtgggtattatatatatacgatttttttacgttgtgtttatttatcgagtatgtgttacgtgggtattatatatatacgatttttttacgttgtgtttatttatcgagtatgtgttacgtgggtattatatatatataatttttttacgttgtgtttatttatcgagtatacgtcgcgtgggtattatatatataatttttttacgttgtgtttatttattaagtacgtgtcgcgtgggtattatatatataatttttttacgttgtgtttatttattaattacgcgtcgcgtgggtattatatatataatttttttacgttgtgtttatttatcgagtacgcgtcgcgtgggtattatatatatataatttttttacgttgtgtttatttatcgagtacgcgttgcgtgggtattatatatataatttttttacgttgtgtttatttatcgagtatgcgtcgcgtgggtattatatatatacgatttttttacgttgtgtttatttatcgagtacgcgtcgcgtgg

SEQ ID NO: 19084 - DNA, 1083 bp, Artificial Sequence
  chemically treated genomic DNA (Homo sapiens) CpG-island No: 19084
ccacgcgacgcgtactcgataaataaacacaacgtaaaaaaatcgtatatatataatacccacgcgacgcatactcgataaataaacacaacgtaaaaaaattatatatataatacccacgcaacgcgtactcgataaataaacacaacgtaaaaaaattatatatatataatacccacgcgacgcgtactcgataaataaacacaacgtaaaaaaattatatatataatacccacgcgacgcgtaattaataaataaacacaacgtaaaaaaattatatatataatacccacgcgacacgtacttaataaataaacacaacgtaaaaaaattatatatataatacccacgcgacgtatactcgataaataaacacaacgtaaaaaaattatatatatataatacccacgtaacacatactcgataaataaacacaacgtaaaaaaatcgtatatatataatacccacgtaacacatactcgataaataaacacaacgtaaaaaaatcgtatatatataatacccacgcgacacgtacttaataaataaacacaacgtaaaaaaataatatatatttaatacccacgcgacgcgtactcgataaataaacacaacgtaaaaaaattatatatataatacccacgcgacacgtactcgataaatcaactcaacgtaaaaaaatcgtatatatataatacccacgcgacgtatactcgataaataaacacaacgtaaaaaaattatatatataatacccacgcgacgcgtactcgataaataaacacaacgtaaaaaaattatatatataatacccacgcgacgcgtactcgataaataaacacaacgtaaaaaaattatatatatataatacccacgtaacgcgtactcgataaataaacacaacgtaaaaaaattatatatataatacccacgcgacgcgtactcgataaataaacataacgtaaaaaaattatatatatataatacccacgtaacgcgtactcgataaataaacacaacgtaaaaatactccctaaataaacacaacgtaaaaaaatctcaaaaaacaacaacaataacaac

SEQ ID NO: 19085 - DNA, 1297 bp, Artificial Sequence
  chemically treated genomic DNA (Homo sapiens) CpG-island No: 19085
gtttcgacgttattacggattgcgtagcgttcgcgattagtatagttcgaaagggaagatagcggttaacgcggacgcgttatggcgcggggattaaggaggagtttcgagaggggcggggttggtcggagggtcgcgcgcggggttattagcggcgtttaggggttagcgttaacgtttacgggttggttatttttatttaggcgtttcgggtcgtaattaagtagtttgttcgttttaagttcgttatttttaagtaggtttagcgtagagtttgtcgggagcggcgttttttcgttttttttaatgggagttcggagcggtatcgacgcgttttcggggttaatggaagcgaggttttggtgttgttgggcggggtcgggagggttgcgcgggttcgagatttattgcgtacgcgcgttcgttattcgtttttttcgtcgcgtacgcgttttcgtgtagggtcggtcgggcgtttaggagcgcgcggggtagcggcggcgcggcggagttattcgcgttcgtgttcgcgcgggtgcgttgttgttttggtcgcgtttttgtttcgtcgtttttcgtttttcgtttggcggatgtaggttgttggtttgaggggagttacgtagtcgaggtttgcgttgtcgtcgttaggttcggttcggttttagtttttgttcggacgttagtcggtttggttatggttgatcgcgggtgttcgttggaggcggcgtcgttgtttgtcgaggtgcgggagagtttggttgagttggagttggagttgtcggaaggtgagtcggatttcgtttttaattttcgcgattcgtttttagttcggtttttcgcgtagttttttatttcgggattttcgcgcggttttttattttaggattttcgttttttattttcgggatttttacgcggtttcgtttttgggatttttgttttttaacgggatttcggtttttttattttggaattcgtttttcgtttcggagatatcgttttttaattttaggatttcgttttttatgtgggattttagtacgatttttcgtttcgagatttcggttttttattttcgggaattttcgttttttattttcgggattttttgttttttattttcggaatttcgcgcggttttttatttcggggatttcgttttttattttgggagtttcgcgttgttttttcggattttcgatttttagtttcgggatattcgcgcggttttttaaattagggattattgtttcgttttttatataaggattttttttttatataaggatttttt

SEQ ID NO: 19086 - DNA, 1297 bp, Artificial Sequence
  chemically treated genomic DNA (Homo sapiens) CpG-island No: 19086
aaaaaatccttatataaaaaaaaaatccttatataaaaaacgaaacaataatccctaatttaaaaaaccgcgcgaatatcccgaaactaaaaatcgaaaatccgaaaaaacaacgcgaaactcccaaaataaaaaacgaaatccccgaaataaaaaaccgcgcgaaattccgaaaataaaaaacaaaaaatcccgaaaataaaaaacgaaaattcccgaaaataaaaaaccgaaatctcgaaacgaaaaatcgtactaaaatcccacataaaaaacgaaatcctaaaattaaaaaacgatatctccgaaacgaaaaacgaattccaaaataaaaaaaccgaaatcccgttaaaaaacaaaaatcccaaaaacgaaaccgcgtaaaaatcccgaaaataaaaaacgaaaatcctaaaataaaaaaccgcgcgaaaatcccgaaataaaaaactacgcgaaaaaccgaactaaaaacgaatcgcgaaaattaaaaacgaaatccgactcaccttccgacaactccaactccaactcaaccaaactctcccgcacctcgacaaacaacgacgccgcctccaacgaacacccgcgatcaaccataaccaaaccgactaacgtccgaacaaaaactaaaaccgaaccgaacctaacgacgacaacgcaaacctcgactacgtaactcccctcaaaccaacaacctacatccgccaaacgaaaaacgaaaaacgacgaaacaaaaacgcgaccaaaacaacaacgcacccgcgcgaacacgaacgcgaataactccgccgcgccgccgctaccccgcgcgctcctaaacgcccgaccgaccctacacgaaaacgcgtacgcgacgaaaaaaacgaataacgaacgcgcgtacgcaataaatctcgaacccgcgcaaccctcccgaccccgcccaacaacaccaaaacctcgcttccattaaccccgaaaacgcgtcgataccgctccgaactcccattaaaaaaaacgaaaaaacgccgctcccgacaaactctacgctaaacctacttaaaaataacgaacttaaaacgaacaaactacttaattacgacccgaaacgcctaaataaaaataaccaacccgtaaacgttaacgctaacccctaaacgccgctaataaccccgcgcgcgaccctccgaccaaccccgcccctctcgaaactcctccttaatccccgcgccataacgcgtccgcgttaaccgctatcttccctttcgaactatactaatcgcgaacgctacgcaatccgtaataacgtcgaaac

SEQ ID NO: 19087 - DNA, 1297 bp, Artificial Sequence
  chemically treated genomic DNA (Homo sapiens) CpG-island No: 19087
gaggagtttttgtatgggggaggggtttttgtatgagaggcggggtagtggtttttggtttgaggggtcgcgcgggtgtttcggggttgagggtcgggagttcggaggggtagcgcggggtttttagggtgaagggcggggttttcggggtgaggggtcgcgcggggtttcgggggtgaggggtaggaggtttcgggggtgaggggcgggagttttcgggggtaaggggtcggggtttcggggcgaggggtcgtgttggggttttatatgaggggcggggttttagggttgaggaacggtgttttcggggcgaggggcgggttttagggtagaggaatcggggtttcgttgaggggtagaggttttaggggcgaggtcgcgtgggggtttcgggggtgaagggcgggggttttggagtgaggggtcgcgcgggggtttcggagtgaggggttgcgcgggggatcgggttgagggcgggtcgcgggggttgagggcggggttcggtttatttttcgatagttttagttttagtttagttaggttttttcgtatttcggtaggtagcggcgtcgtttttagcgggtattcgcggttagttatggttaggtcggttagcgttcgggtagaggttggaatcggatcgggtttggcggcggtagcgtaaatttcggttacgtagttttttttaggttaataatttatattcgttaggcgaggagcgggaggcggcgggataggggcgcggttaggatagtaacgtattcgcgcgggtacgagcgcggatggtttcgtcgcgtcgtcgttgtttcgcgcgtttttgagcgttcggtcggttttatacgggagcgcgtgcgcggcgggaagggcgggtagcgagcgcgcgtgcgtagtgggtttcgggttcgcgtagttttttcggtttcgtttagtaatattagagtttcgtttttattggtttcgaagacgcgtcgatgtcgtttcgggtttttattgggagaggcgggagagcgtcgttttcgataggttttgcgttgggtttgtttgagggtggcgggtttgaggcgggtaggttgtttagttgcggttcgaggcgtttaagtggggatgattaattcgtgggcgttggcgttgatttttaggcgtcgttggtggtttcgcgcgcggtttttcggttagtttcgtttttttcggggtttttttttggttttcgcgttatggcgcgttcgcgttgatcgttgttttttttttcgggttgtgttgatcgcgaacgttgcgtagttcgtggtggcgtcgaggt

SEQ ID NO: 19088 - DNA, 1297 bp, Artificial Sequence
  chemically treated genomic DNA (Homo sapiens) CpG-island No: 19088
acctcgacgccaccacgaactacgcaacgttcgcgatcaacacaacccgaaaaaaaaaacaacgatcaacgcgaacgcgccataacgcgaaaaccaaaaaaaaaccccgaaaaaaacgaaactaaccgaaaaaccgcgcgcgaaaccaccaacgacgcctaaaaatcaacgccaacgcccacgaattaatcatccccacttaaacgcctcgaaccgcaactaaacaacctacccgcctcaaacccgccaccctcaaacaaacccaacgcaaaacctatcgaaaacgacgctctcccgcctctcccaataaaaacccgaaacgacatcgacgcgtcttcgaaaccaataaaaacgaaactctaatattactaaacgaaaccgaaaaaactacgcgaacccgaaacccactacgcacgcgcgctcgctacccgcccttcccgccgcgcacgcgctcccgtataaaaccgaccgaacgctcaaaaacgcgcgaaacaacgacgacgcgacgaaaccatccgcgctcgtacccgcgcgaatacgttactatcctaaccgcgcccctatcccgccgcctcccgctcctcgcctaacgaatataaattattaacctaaaaaaaactacgtaaccgaaatttacgctaccgccgccaaacccgatccgattccaacctctacccgaacgctaaccgacctaaccataactaaccgcgaatacccgctaaaaacgacgccgctacctaccgaaatacgaaaaaacctaactaaactaaaactaaaactatcgaaaaataaaccgaaccccgccctcaacccccgcgacccgccctcaacccgatcccccgcgcaacccctcactccgaaacccccgcgcgacccctcactccaaaacccccgcccttcacccccgaaacccccacgcgacctcgcccctaaaacctctacccctcaacgaaaccccgattcctctaccctaaaacccgcccctcgccccgaaaacaccgttcctcaaccctaaaaccccgcccctcatataaaaccccaacacgacccctcgccccgaaaccccgaccccttacccccgaaaactcccgcccctcacccccgaaacctcctacccctcacccccgaaaccccgcgcgacccctcaccccgaaaaccccgcccttcaccctaaaaaccccgcgctacccctccgaactcccgaccctcaaccccgaaacacccgcgcgacccctcaaaccaaaaaccactaccccgcctctcatacaaaaacccctcccccatacaaaaactcctc

SEQ ID NO: 19089 - DNA, 866 bp, Artificial Sequence
  chemically treated genomic DNA (Homo sapiens) CpG-island No: 19089
gtttcgcgtttttttgggtcggattttaagtcgagttttttaatttcgcggttgggttgggcgattggggacgagttttatatatggagaatttggtttcgtttcgtaagatcgcgggacgcgtagatgtgaagtgcgtttgcgcggggcgtagttttagttgtagacgatttgtgagcgacgcgtcggcgtaagtcgagggcggtggtttggtttttttggaatgggggacgttttaggattgcgtttgcgcggggcgtcgggttttgggcggggttttttcggttgacggtttgcgtgtattgcgtttgcgcgggttgagggcggtggtttaggtttttggaaaggatcgtttattttttcgcgttggcggtgtggacgcggaatttagcggagaaacgcgattgaggtaggtgttttgatgggtagtttagatggttggattgtacgtaaggaaggataggttaggtgaggcgttttcgtattgcgtgtgcgtcgttggcggatagaggttttcgtttttttttgggattttcgagcgttttcgcgattttagttattttttttggcgtttaaacgggagttcggttttcgttatatttttttttgcgtgtcgtattttttttcggttattttcgtcgtttagcgttttttacggttacgtttattttattattatttttgttacgtttttcgcggttacgtttatttgtttggcggtttttgtttcgaagttcgcggcgttgttttagtttgattttttcgtgtttttgcgtttacgcgtggttttttcgttttttgttttttttttatttttttttattggttatttgttttaattttttatgattttgtttttttcgagg

SEQ ID NO: 19090 - DNA, 866 bp, Artificial Sequence
  chemically treated genomic DNA (Homo sapiens) CpG-island No: 19090
cctcgaaaaaaacaaaatcataaaaaattaaaacaaataaccaataaaaaaaaataaaaaaaaaacaaaaaacgaaaaaaccacgcgtaaacgcaaaaacacgaaaaaatcaaactaaaacaacgccgcgaacttcgaaacaaaaaccgccaaacaaataaacgtaaccgcgaaaaacgtaacaaaaataataataaaataaacgtaaccgtaaaaaacgctaaacgacgaaaataaccgaaaaaaaatacgacacgcaaaaaaaaatataacgaaaaccgaactcccgtttaaacgccaaaaaaaataactaaaatcgcgaaaacgctcgaaaatcccaaaaaaaaacgaaaacctctatccgccaacgacgcacacgcaatacgaaaacgcctcacctaacctatccttccttacgtacaatccaaccatctaaactacccatcaaaacacctacctcaatcgcgtttctccgctaaattccgcgtccacaccgccaacgcgaaaaaataaacgatcctttccaaaaacctaaaccaccgccctcaacccgcgcaaacgcaatacacgcaaaccgtcaaccgaaaaaaccccgcccaaaacccgacgccccgcgcaaacgcaatcctaaaacgtcccccattccaaaaaaaccaaaccaccgccctcgacttacgccgacgcgtcgctcacaaatcgtctacaactaaaactacgccccgcgcaaacgcacttcacatctacgcgtcccgcgatcttacgaaacgaaaccaaattctccatatataaaactcgtccccaatcgcccaacccaaccgcgaaattaaaaaactcgacttaaaatccgacccaaaaaaacgcgaaac

SEQ ID NO: 19091 - DNA, 866 bp, Artificial Sequence
  chemically treated genomic DNA (Homo sapiens) CpG-island No: 19091
tttcgggaggaataggattatggagggttggaataggtggttagtgaaggggggtgagaagggggtaggaagcgagagggttacgcgtggacgtaggggtacgagagggttaggttgggatagcgtcgcgagtttcggggtaggggtcgttaggtaggtgggcgtggtcgcgaagggcgtgatagagatggtggtggggtgggcgtggtcgtagaaggcgttggacggcgggagtggtcgggaaggggtgcggtacgtagggaagggtgtgacggggatcgagttttcgtttggacgttagggaaagtggttgagatcgcgaaggcgttcggaggttttaaaagggggcggaggtttttgttcgttagcgacgtatacgtagtgcgaggacgttttatttggtttgtttttttttacgtgtagtttagttatttgagttgtttattaggatatttattttaatcgcgttttttcgttgagtttcgcgtttatatcgttagcgcggaggggtggacggttttttttaggagtttgagttatcgtttttaattcgcgtaagcgtagtgtacgtaggtcgttagtcgggaaggtttcgtttagggttcggcgtttcgcgtaggcgtagttttaagacgttttttattttagggaagttaagttatcgttttcgatttgcgtcggcgcgtcgtttatagatcgtttgtagttggggttgcgtttcgcgtaggcgtattttatatttgcgcgtttcgcggttttgcgaggcgaggttaggttttttatgtgtggagttcgtttttaatcgtttagtttagtcgcggggttggggggttcggtttggggttcgatttagaggggcgcggggt

SEQ ID NO: 19092 - DNA, 866 bp, Artificial Sequence
  chemically treated genomic DNA (Homo sapiens) CpG-island No: 19092
accccgcgcccctctaaatcgaaccccaaaccgaaccccccaaccccgcgactaaactaaacgattaaaaacgaactccacacataaaaaacctaacctcgcctcgcaaaaccgcgaaacgcgcaaatataaaatacgcctacgcgaaacgcaaccccaactacaaacgatctataaacgacgcgccgacgcaaatcgaaaacgataacttaacttccctaaaataaaaaacgtcttaaaactacgcctacgcgaaacgccgaaccctaaacgaaaccttcccgactaacgacctacgtacactacgcttacgcgaattaaaaacgataactcaaactcctaaaaaaaaccgtccacccctccgcgctaacgatataaacgcgaaactcaacgaaaaaacgcgattaaaataaatatcctaataaacaactcaaataactaaactacacgtaaaaaaaaacaaaccaaataaaacgtcctcgcactacgtatacgtcgctaacgaacaaaaacctccgcccccttttaaaacctccgaacgccttcgcgatctcaaccactttccctaacgtccaaacgaaaactcgatccccgtcacacccttccctacgtaccgcaccccttcccgaccactcccgccgtccaacgccttctacgaccacgcccaccccaccaccatctctatcacgcccttcgcgaccacgcccacctacctaacgacccctaccccgaaactcgcgacgctatcccaacctaaccctctcgtacccctacgtccacgcgtaaccctctcgcttcctacccccttctcaccccccttcactaaccacctattccaaccctccataatcctattcctcccgaaa

SEQ ID NO: 19093 - DNA, 2476 bp, Artificial Sequence
  chemically treated genomic DNA (Homo sapiens) CpG-island No: 19093
aaatagtatacgtaagatcgggtgtgcgtgaggagatgtgaatatcgggaatagtcgagtgggtagaaatagtatacgtaagatcgggtgtgtacgaggagatgtgaatatcgggaatagtcgagtgggtagaaatagtatacgtaagatcgggtgtgtacgaggagatgtgaatatcgggaatagtcgagtggatagaaatagtatacgtaagatcgggtgtgcgtgaggagatgcgaatatcgggaatagtcgagtgggtagaaatagtatacgtaagatcgggtgtgtacgaggagatgtgaatatcgggaatagttgcgtggatagaaatagtatacgtaagatcgggtgtgcgtgaggagatgcgaatatcgggaatagtcgcgtggatagaaatagtatacgtaagatcgggtgtgtacgaggagatgtgaatatcgggaatagtcgcgtggatagaaatagtatacgtaagatcgggtgtgcgtgaggagatgcgaatatcgggaatagttaagtgggtagaaatagtatacgtaagatcgggtgtgcgtgaggagatgcgaatatcgggaatagtcgagtgggtagaaatagtatacgtaagatcgggtgtgtacgaggagatgtgaatatcgggaatagtcgagtggatagaaatagtatacgtaagatcgggtgtgcgtgaggagatgcgaatatcgggaatagtcgcgtggatagaaatagtatacgtaagatcgggtgtgtacgaggagatgtgaatatcgggaatagtcgcgtggatagaaatagtatacgtaagatcgggtgtgtacgaggagatgtgaatatcgggaatagtcgagtgggtagaaatagtatacgtaagatcgggtgtgcgtgaggagatgcgaatatcgggaatagtcgagtggatagaaatagtatacgtaagatcgggtgtgtacgaggagatgtgaatatcgggaatagtcgagtggatagaaatagtatacgtaagatcgggtgtgcgtgaggagatgtaaatatcgggaatagtcgagtggatagaaatagtatacgtaagatcgggtgtgcgtgaggagatgcgaatatcgggaatagtcgagtgggtagaaatagtatacgtaagatcgggtgtgtacgaggagatgtgaatatcgggaatagtcgcgtggatagaaatagtatacgtaagatcgggtgtgcgtgaggagatgcgaatatcgggaatagtcgagtgggtagaaatagtatacgtaagatcgggtgtgtacgaggagatgcgaatatcgggaatagtcgcgtggatagaaatagtatacgtaagatcgggtgtgcgtgaggagatgcgaatatcgggaatagtcgagtgggtagaaatagtatacgtaagatcgggtgtgtacgaggagatgcgaatatcgggaatagtcgcgtggatagaaatagtatacgtaagatcgggtgtgcgtgaggagatgcgaatatcgggaatagtcgcgtggatagaaatagtatacgtaagatcgggtgtgtacgaggagatgcgaatatcgggaatagtcgcgtggatagaaatagtatacgtaagatcgggtgtgtacgaggagatgcgaatatcgggaatagtcgcgtggatagaaatagtatacgtaagatcgggtgtgcgtgaggagatgcgaatatcgggaatagtcgcgtggatagaaatagtatacgtaagatcgggtgtgcgtgaggagatgcgaatatcgggaatagtcgagtgggtagaaatagtatacgtaagatcgggtgtgtacgaggagatgcgaatatcgggaatagtcgcgtggatagaaatagtatacgtaagatcgggtgtgtacgaggagatgcgaatatcgggaatagtcgagtggatagaaatagtatacgtaagatcgggtgtgcgtgaggagatgcgaatatcgggaatagtcgagtgggtagaaatagtatacgtaagatcgggtgtgtacgaggagatgcgaatatcgggaatagtcgcgtggatagaaatagtatacgtaagatcgggtgtgtacgaggagatgcgaatatcgggaatagtcgcgtggatagaaatagtatacgtaagatcgggtgtgcgtgaggagatgcgaatatcgggaatagtcgagtgggtagaaatagtatacgtaagatcgggtgtgtacgaggagatgcgaatatcgggaatagtcgagtgggtagaaatagtatacgtaagatcgggtgtgtacgaggagatgtaaatattgggaatagtcgagtggatagaaatagtatacgtaaggtcgggtgtgtacgaggagatgcgaatattaggaatagtcgagtgggtagaaatagtatacgtaaggtcgggtgtgcgtgaggagatgcgaatattcgtaggtttttgttttattttattagagggagaagatattgagtgtagattttt

SEQ ID NO: 19094 - DNA, 2476 bp, Artificial Sequence
  chemically treated genomic DNA (Homo sapiens) CpG-island No: 19094
aaaaatctacactcaatatcttctccctctaataaaataaaacaaaaacctacgaatattcgcatctcctcacgcacacccgaccttacgtatactatttctacccactcgactattcctaatattcgcatctcctcgtacacacccgaccttacgtatactatttctatccactcgactattcccaatatttacatctcctcgtacacacccgatcttacgtatactatttctacccactcgactattcccgatattcgcatctcctcgtacacacccgatcttacgtatactatttctacccactcgactattcccgatattcgcatctcctcacgcacacccgatcttacgtatactatttctatccacgcgactattcccgatattcgcatctcctcgtacacacccgatcttacgtatactatttctatccacgcgactattcccgatattcgcatctcctcgtacacacccgatcttacgtatactatttctacccactcgactattcccgatattcgcatctcctcacgcacacccgatcttacgtatactatttctatccactcgactattcccgatattcgcatctcctcgtacacacccgatcttacgtatactatttctatccacgcgactattcccgatattcgcatctcctcgtacacacccgatcttacgtatactatttctacccactcgactattcccgatattcgcatctcctcacgcacacccgatcttacgtatactatttctatccacgcgactattcccgatattcgcatctcctcacgcacacccgatcttacgtatactatttctatccacgcgactattcccgatattcgcatctcctcgtacacacccgatcttacgtatactatttctatccacgcgactattcccgatattcgcatctcctcgtacacacccgatcttacgtatactatttctatccacgcgactattcccgatattcgcatctcctcacgcacacccgatcttacgtatactatttctatccacgcgactattcccgatattcgcatctcctcgtacacacccgatcttacgtatactatttctacccactcgactattcccgatattcgcatctcctcacgcacacccgatcttacgtatactatttctatccacgcgactattcccgatattcgcatctcctcgtacacacccgatcttacgtatactatttctacccactcgactattcccgatattcgcatctcctcacgcacacccgatcttacgtatactatttctatccacgcgactattcccgatattcacatctcctcgtacacacccgatcttacgtatactatttctacccactcgactattcccgatattcgcatctcctcacgcacacccgatcttacgtatactatttctatccactcgactattcccgatatttacatctcctcacgcacacccgatcttacgtatactatttctatccactcgactattcccgatattcacatctcctcgtacacacccgatcttacgtatactatttctatccactcgactattcccgatattcgcatctcctcacgcacacccgatcttacgtatactatttctacccactcgactattcccgatattcacatctcctcgtacacacccgatcttacgtatactatttctatccacgcgactattcccgatattcacatctcctcgtacacacccgatcttacgtatactatttctatccacgcgactattcccgatattcgcatctcctcacgcacacccgatcttacgtatactatttctatccactcgactattcccgatattcacatctcctcgtacacacccgatcttacgtatactatttctacccactcgactattcccgatattcgcatctcctcacgcacacccgatcttacgtatactatttctacccacttaactattcccgatattcgcatctcctcacgcacacccgatcttacgtatactatttctatccacgcgactattcccgatattcacatctcctcgtacacacccgatcttacgtatactatttctatccacgcgactattcccgatattcgcatctcctcacgcacacccgatcttacgtatactatttctatccacgcaactattcccgatattcacatctcctcgtacacacccgatcttacgtatactatttctacccactcgactattcccgatattcgcatctcctcacgcacacccgatcttacgtatactatttctatccactcgactattcccgatattcacatctcctcgtacacacccgatcttacgtatactatttctacccactcgactattcccgatattcacatctcctcgtacacacccgatcttacgtatactatttctacccactcgactattcccgatattcacatctcctcacgcacacccgatcttacgtatactattt

SEQ ID NO: 19095 - DNA, 2476 bp, Artificial Sequence
  chemically treated genomic DNA (Homo sapiens) CpG-island No: 19095
gagagtttatatttagtgttttttttttttagtggaatgagatagagatttgcgggtgttcgtatttttttacgtatattcgattttacgtgtgttgtttttatttattcgattgtttttggtgttcgtattttttcgtgtatattcgattttacgtgtgttgtttttatttattcgattgtttttagtgtttgtattttttcgtgtatattcgattttacgtgtgttgtttttatttattcgattgttttcggtgttcgtattttttcgtgtatattcgattttacgtgtgttgtttttatttattcgattgttttcggtgttcgtatttttttacgtatattcgattttacgtgtgttgtttttatttacgcgattgttttcggtgttcgtattttttcgtgtatattcgattttacgtgtgttgtttttatttacgcgattgttttcggtgttcgtattttttcgtgtatattcgattttacgtgtgttgtttttatttattcgattgttttcggtgttcgtatttttttacgtatattcgattttacgtgtgttgtttttatttattcgattgttttcggtgttcgtattttttcgtgtatattcgattttacgtgtgttgtttttatttacgcgattgttttcggtgttcgtattttttcgtgtatattcgattttacgtgtgttgtttttatttattcgattgttttcggtgttcgtatttttttacgtatattcgattttacgtgtgttgtttttatttacgcgattgttttcggtgttcgtatttttttacgtatattcgattttacgtgtgttgtttttatttacgcgattgttttcggtgttcgtattttttcgtgtatattcgattttacgtgtgttgtttttatttacgcgattgttttcggtgttcgtattttttcgtgtatattcgattttacgtgtgttgtttttatttacgcgattgttttcggtgttcgtatttttttacgtatattcgattttacgtgtgttgtttttatttacgcgattgttttcggtgttcgtattttttcgtgtatattcgattttacgtgtgttgtttttatttattcgattgttttcggtgttcgtatttttttacgtatattcgattttacgtgtgttgtttttatttacgcgattgttttcggtgttcgtattttttcgtgtatattcgattttacgtgtgttgtttttatttattcgattgttttcggtgttcgtatttttttacgtatattcgattttacgtgtgttgtttttatttacgcgattgttttcggtgtttatattttttcgtgtatattcgattttacgtgtgttgtttttatttattcgattgttttcggtgttcgtatttttttacgtatattcgattttacgtgtgttgtttttatttattcgattgttttcggtgtttgtatttttttacgtatattcgattttacgtgtgttgtttttatttattcgattgttttcggtgtttatattttttcgtgtatattcgattttacgtgtgttgtttttatttattcgattgttttcggtgttcgtatttttttacgtatattcgattttacgtgtgttgtttttatttattcgattgttttcggtgtttatattttttcgtgtatattcgattttacgtgtgttgtttttatttacgcgattgttttcggtgtttatattttttcgtgtatattcgattttacgtgtgttgtttttatttacgcgattgttttcggtgttcgtatttttttacgtatattcgattttacgtgtgttgtttttatttattcgattgttttcggtgtttatattttttcgtgtatattcgattttacgtgtgttgtttttatttattcgattgttttcggtgttcgtatttttttacgtatattcgattttacgtgtgttgtttttatttatttgattgttttcggtgttcgtatttttttacgtatattcgattttacgtgtgttgtttttatttacgcgattgttttcggtgtttatattttttcgtgtatattcgattttacgtgtgttgtttttatttacgcgattgttttcggtgttcgtatttttttacgtatattcgattttacgtgtgttgtttttatttacgtaattgttttcggtgtttatattttttcgtgtatattcgattttacgtgtgttgtttttatttattcgattgttttcggtgttcgtatttttttacgtatattcgattttacgtgtgttgtttttatttattcgattgttttcggtgtttatattttttcgtgtatattcgattttacgtgtgttgtttttatttattcgattgttttcggtgtttatattttttcgtgtatattcgattttacgtgtgttgtttttatttattcgattgttttcggtgtttatatttttttacgtatattcgattttacgtgtgttgttt

SEQ ID NO: 19096 - DNA, 2476 bp, Artificial Sequence
  chemically treated genomic DNA (Homo sapiens) CpG-island No: 19096
aaacaacacacgtaaaatcgaatatacgtaaaaaaatataaacaccgaaaacaatcgaataaataaaaacaacacacgtaaaatcgaatatacacgaaaaaatataaacaccgaaaacaatcgaataaataaaaacaacacacgtaaaatcgaatatacacgaaaaaatataaacaccgaaaacaatcgaataaataaaaacaacacacgtaaaatcgaatatacgtaaaaaaatacgaacaccgaaaacaatcgaataaataaaaacaacacacgtaaaatcgaatatacacgaaaaaatataaacaccgaaaacaattacgtaaataaaaacaacacacgtaaaatcgaatatacgtaaaaaaatacgaacaccgaaaacaatcgcgtaaataaaaacaacacacgtaaaatcgaatatacacgaaaaaatataaacaccgaaaacaatcgcgtaaataaaaacaacacacgtaaaatcgaatatacgtaaaaaaatacgaacaccgaaaacaatcaaataaataaaaacaacacacgtaaaatcgaatatacgtaaaaaaatacgaacaccgaaaacaatcgaataaataaaaacaacacacgtaaaatcgaatatacacgaaaaaatataaacaccgaaaacaatcgaataaataaaaacaacacacgtaaaatcgaatatacgtaaaaaaatacgaacaccgaaaacaatcgcgtaaataaaaacaacacacgtaaaatcgaatatacacgaaaaaatataaacaccgaaaacaatcgcgtaaataaaaacaacacacgtaaaatcgaatatacacgaaaaaatataaacaccgaaaacaatcgaataaataaaaacaacacacgtaaaatcgaatatacgtaaaaaaatacgaacaccgaaaacaatcgaataaataaaaacaacacacgtaaaatcgaatatacacgaaaaaatataaacaccgaaaacaatcgaataaataaaaacaacacacgtaaaatcgaatatacgtaaaaaaatacaaacaccgaaaacaatcgaataaataaaaacaacacacgtaaaatcgaatatacgtaaaaaaatacgaacaccgaaaacaatcgaataaataaaaacaacacacgtaaaatcgaatatacacgaaaaaatataaacaccgaaaacaatcgcgtaaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgcgtaaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgcgtaaataaaaacaacacacgtaaaatcgaatatacgtaaaaaaatacgaacaccgaaaacaatcgcgtaaataaaaacaacacacgtaaaatcgaatatacacgaaaaaatacgaacaccgaaaacaatcgcgtaaataaaaacaacacacgtaaaatcgaatatacacgaaaaaatacgaacaccgaaaacaatcgcgtaaataaaaacaacacacgtaaaatcgaatatacgtaaaaaaatacgaacaccgaaaacaatcgcgtaaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgcgtaaataaaaacaacacacgtaaaatcgaatatacacgaaaaaatacgaacaccgaaaacaatcgaataaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgcgtaaataaaaacaacacacgtaaaatcgaatatacacgaaaaaatacgaacaccgaaaacaatcgcgtaaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgaataaataaaaacaacacacgtaaaatcgaatatacacgaaaaaatacaaacactaaaaacaatcgaataaataaaaacaacacacgtaaaatcgaatatacacgaaaaaatacgaacaccaaaaacaatcgaataaataaaaacaacacacgtaaaatcgaatatacgtaaaaaaatacgaacacccgcaaatctctatctcattccactaaaaaaaaaaaacactaaatataaactctc

SEQ ID NO: 19097 - DNA, 535 bp, Artificial Sequence
  chemically treated genomic DNA (Homo sapiens) CpG-island No: 19097
agtgcggacgggcgaggaggggacgcggaaaggagggagcggcgataggcgattcgttcggtacgggtttcggcggtgttcggttttttcgggttttaggtcgttcgtttttcgtttttttttttcgtttttcgtatagttttttcgtttttttttattcggtttttttaagtttttacgaacggaaatgggagttatagcgtcggggattagcggaaataaaatatagaggcggtcgcgggggggtttttgtgggggaaaaggtttcggaacgaggtcggttcgcgagggttcgcgtttttttttttttcggcggtcgtatttatttatttcggaatcggttttgtcgttttcgttcgtattttagagtcggttgagaacggtagcggcgagggttttacgtgtagcgttttttcgggtaagatttgtagttttcgcgattagaagtgtgaggttttagggtttttttcgcggaatcggcgttgagaagttttaatttttttttcgttttttaggtattttcgggtttaggatt

SEQ ID NO: 19098 - DNA, 535 bp, Artificial Sequence
  chemically treated genomic DNA (Homo sapiens) CpG-island No: 19098
aatcctaaacccgaaaatacctaaaaaacgaaaaaaaaattaaaacttctcaacgccgattccgcgaaaaaaaccctaaaacctcacacttctaatcgcgaaaactacaaatcttacccgaaaaaacgctacacgtaaaaccctcgccgctaccgttctcaaccgactctaaaatacgaacgaaaacgacaaaaccgattccgaaataaataaatacgaccgccgaaaaaaaaaaaaacgcgaaccctcgcgaaccgacctcgttccgaaaccttttcccccacaaaaacccccccgcgaccgcctctatattttatttccgctaatccccgacgctataactcccatttccgttcgtaaaaacttaaaaaaaccgaataaaaaaaaacgaaaaaactatacgaaaaacgaaaaaaaaaaacgaaaaacgaacgacctaaaacccgaaaaaaccgaacaccgccgaaacccgtaccgaacgaatcgcctatcgccgctccctcctttccgcgtcccctcctcgcccgtccgcact

SEQ ID NO: 19099 - DNA, 535 bp, Artificial Sequence
  chemically treated genomic DNA (Homo sapiens) CpG-island No: 19099
agttttggattcgaaggtgtttgggaggcgggaggggggttggggttttttagcgtcgatttcgcgggaagggttttgggattttatatttttagtcgcgggagttgtaggttttattcggagagacgttgtacgtggagttttcgtcgttgtcgtttttagtcggttttggagtgcgggcgggggcgatagggtcgatttcggagtgggtgagtgcggtcgtcggggaggaggggagcgcgggttttcgcgggtcggtttcgtttcggggtttttttttttataagggttttttcgcggtcgtttttgtgttttgttttcgttggttttcggcgttgtgatttttattttcgttcgtggagatttgagggagtcgggtggggaggggcgggagagttgtgcggggagcgaaggggaggggcggggggcgagcggtttggagttcggggggatcgggtatcgtcgggattcgtgtcggacgggtcgtttgtcgtcgttttttttttttcgcgtttttttttcgttcgttcgtatt

SEQ ID NO: 19100 - DNA, 535 bp, Artificial Sequence
  chemically treated genomic DNA (Homo sapiens) CpG-island No: 19100
aatacgaacgaacgaaaaaaaaacgcgaaaaaaaaaaaacgacgacaaacgacccgtccgacacgaatcccgacgatacccgatccccccgaactccaaaccgctcgccccccgcccctccccttcgctccccgcacaactctcccgcccctccccacccgactccctcaaatctccacgaacgaaaataaaaatcacaacgccgaaaaccaacgaaaacaaaacacaaaaacgaccgcgaaaaaacccttataaaaaaaaaaaccccgaaacgaaaccgacccgcgaaaacccgcgctcccctcctccccgacgaccgcactcacccactccgaaatcgaccctatcgcccccgcccgcactccaaaaccgactaaaaacgacaacgacgaaaactccacgtacaacgtctctccgaataaaacctacaactcccgcgactaaaaatataaaatcccaaaacccttcccgcgaaatcgacgctaaaaaaccccaacccccctcccgcctcccaaacaccttcgaatccaaaact

SEQ ID NO: 19101 - DNA, 827 bp, Artificial Sequence
  chemically treated genomic DNA (Homo sapiens) CpG-island No: 19101
ttgcgtttttgggttcgtttttagtagagtgtcggcgtttcgttcggtcgcgtttgtttcgtttcggttcgtcgcgagcgagagagcgaacgagttttcgcggttatggttcggcgttcgttttagttttattgtatagatgttacggcggagtcggcgggtaggaatttggcgggggcgggggtcgggattggggtcgggattggggtcggggttggggttgcgtaatcgtttcgttttcgttgttcgtttgggtttttattttgttggcgtttttgtttaatcgttttttggtgggttttggcggtcgtttttcgtttcggcgtattaggcgtagtaggaagttcgtgggttgtggttttttcggcgttttcgcggaggaaatcggtcggcggcggggtgttgcgtttttatgtttagggcgggttggtattcggtttagcgttaggtgggcggttaagtcggtttgggcggcggcgcgcgggggcggtaggcgttggtgaagttcgtatacgcgttagcgtatttagttttattaagtttcgggttgggagttggttcgtgggggcgtgcgttgcgcgaaagcgaaagtcgttcgttagagtaattttgcggcggaaggcgtcgacgaggagttgtgtcgtgtcgtttttggggatggtgagttggtcgttcggtcgggtgggtagcgcgttcgggcgcggtgtttcgttagttataaataggtgttgtgcggggataggaagatggttttagttttttataagtatcggttcgttatgtgcgttgggttaggattttgtttcgtagcggagtgggaggagtga

SEQ ID NO: 19102 - DNA, 827 bp, Artificial Sequence
  chemically treated genomic DNA (Homo sapiens) CpG-island No: 19102
tcactcctcccactccgctacgaaacaaaatcctaacccaacgcacataacgaaccgatacttataaaaaactaaaaccatcttcctatccccgcacaacacctatttataactaacgaaacaccgcgcccgaacgcgctacccacccgaccgaacgaccaactcaccatccccaaaaacgacacgacacaactcctcgtcgacgccttccgccgcaaaattactctaacgaacgactttcgctttcgcgcaacgcacgcccccacgaaccaactcccaacccgaaacttaataaaactaaatacgctaacgcgtatacgaacttcaccaacgcctaccgcccccgcgcgccgccgcccaaaccgacttaaccgcccacctaacgctaaaccgaataccaacccgccctaaacataaaaacgcaacaccccgccgccgaccgatttcctccgcgaaaacgccgaaaaaaccacaacccacgaacttcctactacgcctaatacgccgaaacgaaaaacgaccgccaaaacccaccaaaaaacgattaaacaaaaacgccaacaaaataaaaacccaaacgaacaacgaaaacgaaacgattacgcaaccccaaccccgaccccaatcccgaccccaatcccgacccccgcccccgccaaattcctacccgccgactccgccgtaacatctatacaataaaactaaaacgaacgccgaaccataaccgcgaaaactcgttcgctctctcgctcgcgacgaaccgaaacgaaacaaacgcgaccgaacgaaacgccgacactctactaaaaacgaacccaaaaacgcaa

SEQ ID NO: 19103 - DNA, 827 bp, Artificial Sequence
  chemically treated genomic DNA (Homo sapiens) CpG-island No: 19103
ttattttttttatttcgttgcggggtaaggttttagtttagcgtatataacgggtcggtgtttgtaaagggttggaattatttttttgttttcgtatagtatttatttatagttagcgaagtatcgcgttcggacgcgttgtttattcggtcgggcggttagtttattatttttaagagcggtacggtatagtttttcgtcggcgtttttcgtcgtaaagttgttttggcgggcggttttcgttttcgcgtagcgtacgtttttacgagttagtttttagttcggggtttggtagggttggatgcgttggcgcgtgtgcgggttttattagcgtttgtcgttttcgcgcgtcgtcgtttaagtcggtttggtcgtttatttgacgttgaatcgggtgttagttcgttttgggtatgggggcgtagtatttcgtcgtcggtcgatttttttcgcgggggcgtcggggaaattatagtttacgggttttttgttgcgtttggtgcgtcgaggcggggggcggtcgttagagtttattaggggacgattgagtaaaagcgttagtaaagtggagatttagacgggtagcggaggcgaagcggttgcgtagttttagtttcggttttagtttcggttttagtttcggttttcgttttcgttaagtttttattcgtcggtttcgtcgtggtatttgtgtagtggagttagggcgagcgtcgggttatggtcgcggaggttcgttcgttttttcgttcgcggcgggtcggggcggggtaggcgcggtcggacggggcgtcggtattttattggaagcgggtttaggagcgtaa

SEQ ID NO: 19104 - DNA, 827 bp, Artificial Sequence
  chemically treated genomic DNA (Homo sapiens) CpG-island No: 19104
ttacgctcctaaacccgcttccaataaaataccgacgccccgtccgaccgcgcctaccccgccccgacccgccgcgaacgaaaaaacgaacgaacctccgcgaccataacccgacgctcgccctaactccactacacaaataccacgacgaaaccgacgaataaaaacttaacgaaaacgaaaaccgaaactaaaaccgaaactaaaaccgaaactaaaactacgcaaccgcttcgcctccgctacccgtctaaatctccactttactaacgcttttactcaatcgtcccctaataaactctaacgaccgccccccgcctcgacgcaccaaacgcaacaaaaaacccgtaaactataatttccccgacgcccccgcgaaaaaaatcgaccgacgacgaaatactacgcccccatacccaaaacgaactaacacccgattcaacgtcaaataaacgaccaaaccgacttaaacgacgacgcgcgaaaacgacaaacgctaataaaacccgcacacgcgccaacgcatccaaccctaccaaaccccgaactaaaaactaactcgtaaaaacgtacgctacgcgaaaacgaaaaccgcccgccaaaacaactttacgacgaaaaacgccgacgaaaaactataccgtaccgctcttaaaaataataaactaaccgcccgaccgaataaacaacgcgtccgaacgcgatacttcgctaactataaataaatactatacgaaaacaaaaaaataattccaaccctttacaaacaccgacccgttatatacgctaaactaaaaccttaccccgcaacgaaataaaaaaaataa

SEQ ID NO: 19105 - DNA, 775 bp, Artificial Sequence
  chemically treated genomic DNA (Homo sapiens) CpG-island No: 19105
cggttgcgcgatttagtgtcgagacggacgcgagtcggagatgggggaaggggagggggtggtggtgggggacggcggcgtttgcgtagtgaaggaatgtaggcggggtttttacgacgtttgcgtagacggtcgtagttttgttgggcgcgaaggggttggttaagggcggggttcgcgagggaggtcgggcggttcggtaagcggcgttgcggggtaggttgtttttttgaggtcggatttaacgggtttcggttgagttatcgggtgagtttatcgtttagtttaaattaggagattgcgagggagcgatgcggtgtagcgcggtaagagtagtagtcgggttttcgtagtgttcgttggcgggttggtttatcgttttagcgtcgttcgcgttgtcgcgttcgggcgttttcgtagatttcggtaggtttagcgtttgcgtcgtttttgtttttgggtttttttagtgtgtttcgcgtttgcgttttttttttttcgcgtcgttttcgttttgggtttcggggtttttggaataattcgtaggtttcgtcgtcgagatttattggttttcgttcgttggtgttggggtttagttggttttgggatttcgtttgcggtttgattgtgtgtagataggtcgggtgcgattttcgtgtttgttttttcgtcgtttcgggagaggttggggttgtcgttttatcgttcgggttttttgtttggggcggggatagcgttgtttagtggtttcgagggcgtagagcggaggagtagg

SEQ ID NO: 19106 - DNA, 775 bp, Artificial Sequence
  chemically treated genomic DNA (Homo sapiens) CpG-island No: 19106
cctactcctccgctctacgccctcgaaaccactaaacaacgctatccccgccccaaacaaaaaacccgaacgataaaacgacaaccccaacctctcccgaaacgacgaaaaaacaaacacgaaaatcgcacccgacctatctacacacaatcaaaccgcaaacgaaatcccaaaaccaactaaaccccaacaccaacgaacgaaaaccaataaatctcgacgacgaaacctacgaattattccaaaaaccccgaaacccaaaacgaaaacgacgcgaaaaaaaaaaaacgcaaacgcgaaacacactaaaaaaacccaaaaacaaaaacgacgcaaacgctaaacctaccgaaatctacgaaaacgcccgaacgcgacaacgcgaacgacgctaaaacgataaaccaacccgccaacgaacactacgaaaacccgactactactcttaccgcgctacaccgcatcgctccctcgcaatctcctaatttaaactaaacgataaactcacccgataactcaaccgaaacccgttaaatccgacctcaaaaaaacaacctaccccgcaacgccgcttaccgaaccgcccgacctccctcgcgaaccccgcccttaaccaaccccttcgcgcccaacaaaactacgaccgtctacgcaaacgtcgtaaaaaccccgcctacattccttcactacgcaaacgccgccgtcccccaccaccaccccctccccttcccccatctccgactcgcgtccgtctcgacactaaatcgcgcaaccg

SEQ ID NO: 19107 - DNA, 775 bp, Artificial Sequence
  chemically treated genomic DNA (Homo sapiens) CpG-island No: 19107
tttgttttttcgttttgcgttttcggggttattgaataacgttgttttcgttttaggtaagggattcgggcgatggggcggtagttttagtttttttcggagcggcggaaaggtaagtacgagggtcgtattcggtttgtttgtatatagttaagtcgtaagcggggttttagaattagttgaattttaatattaacggacgaaggttagtgggtttcggcggcgaagtttgcgggttgttttagaagtttcgaagtttagaacgaggacggcgcgggaagggaaaggcgtaggcgcgggatatattggaggggtttaggagtagagacggcgtaggcgttgggtttgtcggggtttgcggggacgttcgggcgcggtagcgcgggcggcgttgaggcgataaattaattcgttagcgaatattgcgggaattcggttgttgtttttatcgcgttgtatcgtatcgttttttcgtaattttttggtttgggttgggcggtgagtttattcggtggtttagtcgagattcgttgagttcggttttaggaaagtagtttatttcgtagcgtcgtttgtcgggtcgttcggtttttttcgcgggtttcgtttttggttagttttttcgcgtttagtagggttgcggtcgtttgcgtaggcgtcgtggaggtttcgtttatatttttttattgcgtaggcgtcgtcgttttttattattatttttttttttttttttattttcggttcgcgttcgtttcggtattgggtcgcgtagtcg

SEQ ID NO: 19108 - DNA, 775 bp, Artificial Sequence
  chemically treated genomic DNA (Homo sapiens) CpG-island No: 19108
cgactacgcgacccaataccgaaacgaacgcgaaccgaaaataaaaaaaaaaaaaaaaataataataaaaaacgacgacgcctacgcaataaaaaaatataaacgaaacctccacgacgcctacgcaaacgaccgcaaccctactaaacgcgaaaaaactaaccaaaaacgaaacccgcgaaaaaaaccgaacgacccgacaaacgacgctacgaaataaactactttcctaaaaccgaactcaacgaatctcgactaaaccaccgaataaactcaccgcccaacccaaaccaaaaaattacgaaaaaacgatacgatacaacgcgataaaaacaacaaccgaattcccgcaatattcgctaacgaattaatttatcgcctcaacgccgcccgcgctaccgcgcccgaacgtccccgcaaaccccgacaaacccaacgcctacgccgtctctactcctaaacccctccaatatatcccgcgcctacgcctttcccttcccgcgccgtcctcgttctaaacttcgaaacttctaaaacaacccgcaaacttcgccgccgaaacccactaaccttcgtccgttaatattaaaattcaactaattctaaaaccccgcttacgacttaactatatacaaacaaaccgaatacgaccctcgtacttacctttccgccgctccgaaaaaaactaaaactaccgccccatcgcccgaatcccttacctaaaacgaaaacaacgttattcaataaccccgaaaacgcaaaacgaaaaaacaaa

SEQ ID NO: 19109 - DNA, 1246 bp, Artificial Sequence
  chemically treated genomic DNA (Homo sapiens) CpG-island No: 19109
ggcgggacggatgcgagttcgggaggagcgcgttggggggtcgtaggcgggggatgtggcgcggtttaggttcgtcgcggtttcgttttgatagggatatttgcgggatcgtttttttaggatcgtttgcgggtttcgcgggtcgatgtttcgggttttttttcggtttcggttttttcgcgtagcggggcggggcgggggtagcgcgggttttaaagttgtttgtagggggcgttcgtgagcggcgcggtcggagtcggagatttagcggtcgtcgagatagcgggagtcggcgtgcgagcggtaggttagtcggggtgttaggtttggcgtgcggggttttgggtgtcgggttcggggtgcggggtgtcgggggttcggggttggtggtcgggcggcgtggggtcgtcgggggtgcggggtcgggaggattgggaggttggggttttgttttttttagggtttttttttcgtcgtttcgagattagtttttcggcgcggggttcgagttttgtttcgcggcggttgtcggtattgtttgtgaagggtttaggtatagttacgttttaggcgtagttgcggcgtcgcgtgcgggatttttcgagttgttttaaattgtatcggaaggcgcgtaggggtaggcggggagggaaggtaagtgcggcggtcggcgcggcgcggggtgcggagtcgtaggtagcgggcggggagcgttcgttcgttagttcgttcgttcgtttatgcgtcgtagatcggtttcgcgcgttcgtatgaattttcgcgagtttttttagtagggatggatcgggggcgtagaggcgttttttgaggggtggcgggtcgggtttcggggcgagggagattttttaggtggaggagtcgggcggagatcggtttttcgggaaggtgaggcgcgggtagagatattcgagcgttcgggacgcgtcgagaaagggggaattaggaacgttgggtcgagcgttggcgtttttcgtggatagtggtggcgggaattgggtttgggggatttaggagacgacgggggacggatgggggtgggtgcgcgtttcggattggtttcggtcgtttgtttggttgttcggagcggaggtaggaatggcgggaatggtggcggttttcgagggatttggcgtaaggcggtttaagggtttgaggaggaggtcgcgggtcggtagagttgaggtttttgtgtttcgtatttagattttagttgtttcgattgtat

SEQ ID NO: 19110 - DNA, 1246 bp, Artificial Sequence
  chemically treated genomic DNA (Homo sapiens) CpG-island No: 19110
atacaatcgaaacaactaaaatctaaatacgaaacacaaaaacctcaactctaccgacccgcgacctcctcctcaaacccttaaaccgccttacgccaaatccctcgaaaaccgccaccattcccgccattcctacctccgctccgaacaaccaaacaaacgaccgaaaccaatccgaaacgcgcacccacccccatccgtcccccgtcgtctcctaaatcccccaaacccaattcccgccaccactatccacgaaaaacgccaacgctcgacccaacgttcctaattccccctttctcgacgcgtcccgaacgctcgaatatctctacccgcgcctcaccttcccgaaaaaccgatctccgcccgactcctccacctaaaaaatctccctcgccccgaaacccgacccgccacccctcaaaaaacgcctctacgcccccgatccatccctactaaaaaaactcgcgaaaattcatacgaacgcgcgaaaccgatctacgacgcataaacgaacgaacgaactaacgaacgaacgctccccgcccgctacctacgactccgcaccccgcgccgcgccgaccgccgcacttaccttccctccccgcctacccctacgcgccttccgatacaatttaaaacaactcgaaaaatcccgcacgcgacgccgcaactacgcctaaaacgtaactatacctaaacccttcacaaacaataccgacaaccgccgcgaaacaaaactcgaaccccgcgccgaaaaactaatctcgaaacgacgaaaaaaaaaccctaaaaaaaacaaaaccccaacctcccaatcctcccgaccccgcacccccgacgaccccacgccgcccgaccaccaaccccgaacccccgacaccccgcaccccgaacccgacacccaaaaccccgcacgccaaacctaacaccccgactaacctaccgctcgcacgccgactcccgctatctcgacgaccgctaaatctccgactccgaccgcgccgctcacgaacgccccctacaaacaactttaaaacccgcgctacccccgccccgccccgctacgcgaaaaaaccgaaaccgaaaaaaaacccgaaacatcgacccgcgaaacccgcaaacgatcctaaaaaaacgatcccgcaaatatccctatcaaaacgaaaccgcgacgaacctaaaccgcgccacatcccccgcctacgaccccccaacgcgctcctcccgaactcgcatccgtcccgcc

SEQ ID NO: 19111 - DNA, 1246 bp, Artificial Sequence
  chemically treated genomic DNA (Homo sapiens) CpG-island No: 19111
gtatagtcggggtaattaaagtttgagtgcgggatatagggattttagttttgtcggttcgcggttttttttttaagtttttgggtcgttttgcgttaaatttttcgagagtcgttattattttcgttatttttattttcgtttcgggtagttagatagacggtcggggttagttcgaggcgcgtatttatttttattcgtttttcgtcgttttttgggttttttaaatttagttttcgttattattgtttacggaagacgttagcgttcggtttagcgtttttgattttttttttttcggcgcgtttcgggcgttcgggtatttttgttcgcgttttattttttcggggaatcggttttcgttcggtttttttatttggggaatttttttcgtttcggggttcggttcgttattttttaggaagcgtttttgcgttttcggtttatttttgttggaggagttcgcgaaggtttatgcgagcgcgcggggtcggtttgcggcgtatggacggacggacggattgacggacggacgtttttcgttcgttatttgcggtttcgtatttcgcgtcgcgtcggtcgtcgtatttgtttttttttttcgtttatttttgcgcgtttttcggtgtagtttgggatagttcggagggtttcgtacgcggcgtcgtaattgcgtttgggacgtgattgtgtttgggttttttataggtagtgtcggtagtcgtcgcggggtaggattcggatttcgcgtcggggaattggtttcggggcggcgggaaaggaattttgaggggagtagaattttagttttttagttttttcggtttcgtattttcgacggttttacgtcgttcggttattagtttcggattttcggtatttcgtatttcggattcggtatttaggatttcgtacgttagatttagtatttcggttgatttgtcgttcgtacgtcggttttcgttgtttcggcggtcgttgggttttcggtttcggtcgcgtcgtttacgggcgttttttgtaggtagttttgagattcgcgttgttttcgtttcgtttcgttgcgcggagaaatcgaggtcggagggggattcgaggtatcggttcgcgaggttcgtaggcgattttggaaggacgatttcgtaggtgtttttgttaggacgaggtcgcgacgggtttggatcgcgttatatttttcgtttgcggttttttagcgcgtttttttcgggttcgtattcgtttcgtt

SEQ ID NO: 19112 - DNA, 1246 bp, Artificial Sequence
  chemically treated genomic DNA (Homo sapiens) CpG-island No: 19112
aacgaaacgaatacgaacccgaaaaaaacgcgctaaaaaaccgcaaacgaaaaatataacgcgatccaaacccgtcgcgacctcgtcctaacaaaaacacctacgaaatcgtccttccaaaatcgcctacgaacctcgcgaaccgatacctcgaatccccctccgacctcgatttctccgcgcaacgaaacgaaacgaaaacaacgcgaatctcaaaactacctacaaaaaacgcccgtaaacgacgcgaccgaaaccgaaaacccaacgaccgccgaaacaacgaaaaccgacgtacgaacgacaaatcaaccgaaatactaaatctaacgtacgaaatcctaaataccgaatccgaaatacgaaataccgaaaatccgaaactaataaccgaacgacgtaaaaccgtcgaaaatacgaaaccgaaaaaactaaaaaactaaaattctactcccctcaaaattcctttcccgccgccccgaaaccaattccccgacgcgaaatccgaatcctaccccgcgacgactaccgacactacctataaaaaacccaaacacaatcacgtcccaaacgcaattacgacgccgcgtacgaaaccctccgaactatcccaaactacaccgaaaaacgcgcaaaaataaacgaaaaaaaaaaacaaatacgacgaccgacgcgacgcgaaatacgaaaccgcaaataacgaacgaaaaacgtccgtccgtcaatccgtccgtccgtccatacgccgcaaaccgaccccgcgcgctcgcataaaccttcgcgaactcctccaacaaaaataaaccgaaaacgcaaaaacgcttcctaaaaaataacgaaccgaaccccgaaacgaaaaaaattccccaaataaaaaaaccgaacgaaaaccgattccccgaaaaaataaaacgcgaacaaaaatacccgaacgcccgaaacgcgccgaaaaaaaaaaaatcaaaaacgctaaaccgaacgctaacgtcttccgtaaacaataataacgaaaactaaatttaaaaaacccaaaaaacgacgaaaaacgaataaaaataaatacgcgcctcgaactaaccccgaccgtctatctaactacccgaaacgaaaataaaaataacgaaaataataacgactctcgaaaaatttaacgcaaaacgacccaaaaacttaaaaaaaaaaccgcgaaccgacaaaactaaaatccctatatcccgcactcaaactttaattaccccgactatac

SEQ ID NO: 19113 - DNA, 526 bp, Artificial Sequence
  chemically treated genomic DNA (Homo sapiens) CpG-island No: 19113
cgcgtcgaggatcgaaagtcgttttggggtcggcgttcgttttttcgtagttaggtttatatttaggcgtcgtcgtttcggtcgggtttggtcgcgggataacgttaggcgtgtagggcgagggcggcgcgggttttcgggaggatgaatgttttatggaattaggtggtttgatattcgaggaattcgtttagtttttttgggtcggttagggcgggtcgggggcggattcgggttgggtttcgcggtgggcggggcgtttatttgggcgtcggcgcgggcgcgggttcgggttggggttggggagtacgggtcggcgggagcgcgggcgcgaggggggcggaggggggtttttgggcggcgtagcgggtcggggcgcgttgtaggttaggtagtaggaggcgtttagttagcgtagtgtattcgcgtcgcgcgggtttagataaaggtggtgtatttttaaagaggcggcggtttttgtaggaggtcgaggggatggcggttcgggtcgtagtgggttaggttt

SEQ ID NO: 19114 - DNA, 526 bp, Artificial Sequence
  chemically treated genomic DNA (Homo sapiens) CpG-island No: 19114
aaacctaacccactacgacccgaaccgccatcccctcgacctcctacaaaaaccgccgcctctttaaaaatacaccacctttatctaaacccgcgcgacgcgaatacactacgctaactaaacgcctcctactacctaacctacaacgcgccccgacccgctacgccgcccaaaaacccccctccgcccccctcgcgcccgcgctcccgccgacccgtactccccaaccccaacccgaacccgcgcccgcgccgacgcccaaataaacgccccgcccaccgcgaaacccaacccgaatccgcccccgacccgccctaaccgacccaaaaaaactaaacgaattcctcgaatatcaaaccacctaattccataaaacattcatcctcccgaaaacccgcgccgccctcgccctacacgcctaacgttatcccgcgaccaaacccgaccgaaacgacgacgcctaaatataaacctaactacgaaaaaacgaacgccgaccccaaaacgactttcgatcctcgacgcg

SEQ ID NO: 19115 - DNA, 526 bp, Artificial Sequence
  chemically treated genomic DNA (Homo sapiens) CpG-island No: 19115
gggtttggtttattgcggttcgggtcgttattttttcggttttttgtaggggtcgtcgtttttttaggaatatattatttttgtttgggttcgcgcggcgcgggtgtattgcgttggttgagcgttttttgttgtttggtttgtagcgcgtttcggttcgttgcgtcgtttaagaattttttttcgtttttttcgcgttcgcgttttcgtcggttcgtgttttttagttttagttcgggttcgcgttcgcgtcggcgtttaggtgagcgtttcgtttatcgcgaggtttagttcgggttcgttttcggttcgttttggtcggtttaggggaattgggcggatttttcgagtgttaaattatttgattttataagatatttattttttcggaggttcgcgtcgttttcgttttgtacgtttagcgttgtttcgcggttaggttcggtcggagcggcggcgtttggatgtggatttggttgcggggagacgggcgtcggttttaaagcgattttcggttttcgacgcg

SEQ ID NO: 19116 - DNA, 526 bp, Artificial Sequence
  chemically treated genomic DNA (Homo sapiens) CpG-island No: 19116
cgcgtcgaaaaccgaaaatcgctttaaaaccgacgcccgtctccccgcaaccaaatccacatccaaacgccgccgctccgaccgaacctaaccgcgaaacaacgctaaacgtacaaaacgaaaacgacgcgaacctccgaaaaaataaatatcttataaaatcaaataatttaacactcgaaaaatccgcccaattcccctaaaccgaccaaaacgaaccgaaaacgaacccgaactaaacctcgcgataaacgaaacgctcacctaaacgccgacgcgaacgcgaacccgaactaaaactaaaaaacacgaaccgacgaaaacgcgaacgcgaaaaaaacgaaaaaaaattcttaaacgacgcaacgaaccgaaacgcgctacaaaccaaacaacaaaaaacgctcaaccaacgcaatacacccgcgccgcgcgaacccaaacaaaaataatatattcctaaaaaaacgacgacccctacaaaaaaccgaaaaaataacgacccgaaccgcaataaaccaaaccc

SEQ ID NO: 19117 - DNA, 616 bp, Artificial Sequence
  chemically treated genomic DNA (Homo sapiens) CpG-island No: 19117
tcgtttttatcgtttcggttttcgcgggttttttaggtattttcgttttttaatttcgcgtttttaagttcgttgatttttaatttttttcgggtttttagtttcggggtattacggtgaaggaggttgtagggcgtcggggtttattttatttttatcgtcgggttttcgggcgatttttggttttgtttcgagttcgcgttttcgatagcggtcgtcggtatttttgtttttcgaagtttcggcgtcggttgtcggagaagtcggcgcggaagttttagaggtcgtttagttgtttgcgttgttacgacgggttttttcggggatatagtatttcgttcggtagcgttaacgtgtagttatataatagtagtcggagagtcgtttaggttattgtcgttttttaggcgaggttttttttttttcgtttcggtcgtagtttacggggataagagttgcgcgggaggagtattgcggtaaggtcgcgtgacgcgtcggtagcgtgacgcgatttaggtcgttcgcgttatttttgttgagggcgattgttaggtttggaggggcggggcggcgtttgtggttggaattttgggttaggtttttagggaagcgggat

SEQ ID NO: 19118 - DNA, 616 bp, Artificial Sequence
  chemically treated genomic DNA (Homo sapiens) CpG-island No: 19118
atcccgcttccctaaaaacctaacccaaaattccaaccacaaacgccgccccgcccctccaaacctaacaatcgccctcaacaaaaataacgcgaacgacctaaatcgcgtcacgctaccgacgcgtcacgcgaccttaccgcaatactcctcccgcgcaactcttatccccgtaaactacgaccgaaacgaaaaaaaaaaaacctcgcctaaaaaacgacaataacctaaacgactctccgactactattatataactacacgttaacgctaccgaacgaaatactatatccccgaaaaaacccgtcgtaacaacgcaaacaactaaacgacctctaaaacttccgcgccgacttctccgacaaccgacgccgaaacttcgaaaaacaaaaataccgacgaccgctatcgaaaacgcgaactcgaaacaaaaccaaaaatcgcccgaaaacccgacgataaaaataaaataaaccccgacgccctacaacctccttcaccgtaataccccgaaactaaaaacccgaaaaaaattaaaaatcaacgaacttaaaaacgcgaaattaaaaaacgaaaatacctaaaaaacccgcgaaaaccgaaacgataaaaacga

SEQ ID NO: 19119 - DNA, 616 bp, Artificial Sequence
  chemically treated genomic DNA (Homo sapiens) CpG-island No: 19119
gtttcgtttttttaaaggtttagtttagggttttagttataggcgtcgtttcgtttttttaggtttggtaatcgtttttaataaagatggcgcggacgatttaagtcgcgttacgttatcggcgcgttacgcgattttgtcgtaatgtttttttcgcgtagtttttattttcgtagattgcggtcgagacggggagggggaagtttcgtttggggggcggtagtggtttgggcggtttttcggttgttgttgtatggttgtacgttggcgttatcggacgggatgttgtattttcgagagagttcgtcgtggtagcgtaagtagttggacggtttttgaagttttcgcgtcgattttttcgataatcgacgtcggggtttcgaggagtagaggtatcggcgatcgttgtcggaggcgcggattcggggtagggttaggagtcgttcggaagttcggcggtgggaatggggtaagtttcggcgttttgtagttttttttatcgtagtgtttcggagttgggggttcggaggaggttaaaggttaacgggtttgggggcgcgggattggagaacgggagtatttgggggattcgcgagggtcggagcggtggaggcgg

SEQ ID NO: 19120 - DNA, 616 bp, Artificial Sequence
  chemically treated genomic DNA (Homo sapiens) CpG-island No: 19120
ccgcctccaccgctccgaccctcgcgaatcccccaaatactcccgttctccaatcccgcgcccccaaacccgttaacctttaacctcctccgaacccccaactccgaaacactacgataaaaaaaactacaaaacgccgaaacttaccccattcccaccgccgaacttccgaacgactcctaaccctaccccgaatccgcgcctccgacaacgatcgccgatacctctactcctcgaaaccccgacgtcgattatcgaaaaaatcgacgcgaaaacttcaaaaaccgtccaactacttacgctaccacgacgaactctctcgaaaatacaacatcccgtccgataacgccaacgtacaaccatacaacaacaaccgaaaaaccgcccaaaccactaccgccccccaaacgaaacttccccctccccgtctcgaccgcaatctacgaaaataaaaactacgcgaaaaaaacattacgacaaaatcgcgtaacgcgccgataacgtaacgcgacttaaatcgtccgcgccatctttattaaaaacgattaccaaacctaaaaaaacgaaacgacgcctataactaaaaccctaaactaaacctttaaaaaaacgaaac

SEQ ID NO: 19121 - DNA, 1020 bp, Artificial Sequence
  chemically treated genomic DNA (Homo sapiens) CpG-island No: 19121
tagcgaagtttcggttgttttcgttttgcgggcgtatatttgtttttcgcgtcgggttgcgtcgggcgttcgcgtcgtttcggcgtgtgttcgcggttttttttcgttttcgttcgtagtttttcgatttcgatttcggatttttgggtttatagtttggttttttttcgagtcggagtcggagtcggagtcgaagtcgcggttgggttcggtcgtttcgttatagggggagggaatttatggggagggggaggggcggtgaggttagcggcggcggcgcgttcgcgggcggcgggagtttcgtatgcgcggagcgaggttcgtgagtggtagcggcggcgcgcggggggcgggcgaggggtcgagagtgggggagcgggcgggggtcgtcgaggaggcgttgtgtgggcgcgacggttgcgagttggggaggtttgtggtgcgggtcgtttcgggggattttcggcgcgggtttcgcgcgacggttacggtcgcgcggcgtgtgtggggggtttacgtatattcgtaaaattttttttttttttgtttcgggagagcgagcgagcgtgtgtgagagcgagtgtgaggagcgagtcgcggttcgacgtttagcgtcgtcgttggagtagttgttaaaatttcgtcgtcgttcgggtttcgcggttcgtttttttcgcgtcgggtttttttttttttttgttgcgggcggttcgggggaggggtcgcgggcggagatttcggaggtcggcgttttttacgtcgttcgttcgttcgtttttcgttcggtttttgcgcgcgtgcgtgttttgttcgttttatgttgtcgtttttttcggtatttgttgttgttttcggggtttcgggaaatgcgagagtttgagtcggggaggaggaattcgagtagcggcggcggcggtcgcggcggcgggagttttttaagaggaggatcgggatttatgtgttttttttggtgattaggatgtcgtcggaggagaataagtgcgtggagtagtcgtagtt

SEQ ID NO: 19122 - DNA, 1020 bp, Artificial Sequence
  chemically treated genomic DNA (Homo sapiens) CpG-island No: 19122
aactacgactactccacgcacttattctcctccgacgacatcctaatcaccaaaaaaaacacataaatcccgatcctcctcttaaaaaactcccgccgccgcgaccgccgccgccgctactcgaattcctcctccccgactcaaactctcgcatttcccgaaaccccgaaaacaacaacaaataccgaaaaaaacgacaacataaaacgaacaaaacacgcacgcgcgcaaaaaccgaacgaaaaacgaacgaacgaacgacgtaaaaaacgccgacctccgaaatctccgcccgcgacccctcccccgaaccgcccgcaacaaaaaaaaaaaaaaacccgacgcgaaaaaaacgaaccgcgaaacccgaacgacgacgaaattttaacaactactccaacgacgacgctaaacgtcgaaccgcgactcgctcctcacactcgctctcacacacgctcgctcgctctcccgaaacaaaaaaaaaaaaaattttacgaatatacgtaaaccccccacacacgccgcgcgaccgtaaccgtcgcgcgaaacccgcgccgaaaatcccccgaaacgacccgcaccacaaacctccccaactcgcaaccgtcgcgcccacacaacgcctcctcgacgacccccgcccgctcccccactctcgacccctcgcccgccccccgcgcgccgccgctaccactcacgaacctcgctccgcgcatacgaaactcccgccgcccgcgaacgcgccgccgccgctaacctcaccgcccctccccctccccataaattccctccccctataacgaaacgaccgaacccaaccgcgacttcgactccgactccgactccgactcgaaaaaaaaccaaactataaacccaaaaatccgaaatcgaaatcgaaaaactacgaacgaaaacgaaaaaaaaccgcgaacacacgccgaaacgacgcgaacgcccgacgcaacccgacgcgaaaaacaaatatacgcccgcaaaacgaaaacaaccgaaacttcgcta

SEQ ID NO: 19123 - DNA, 1020 bp, Artificial Sequence
  chemically treated genomic DNA (Homo sapiens) CpG-island No: 19123
ggttgcggttgttttacgtatttgttttttttcgacgatattttagttattaggaaagatatatggatttcggttttttttttggggggttttcgtcgtcgcggtcgtcgtcgtcgttgttcgggtttttttttttcggtttagattttcgtatttttcgaagtttcgggagtagtagtaggtatcgggagaggcggtaatatggagcgagtaggatacgtacgcgcgtaggggtcgggcggggagcgggcgggcgggcggcgtgaggggcgtcggttttcggggttttcgttcgcggtttttttttcgggtcgttcgtagtaggaagagaaaggggttcggcgcggggagggcgggtcgcggggttcgggcggcggcgaagttttgatagttgttttagcggcggcgttgggcgtcgggtcgcggttcgttttttatattcgtttttatatacgttcgttcgttttttcggagtaggggaggaggaagttttgcgggtgtgcgtggattttttatatacgtcgcgcgatcgtggtcgtcgcgcgaggttcgcgtcggggatttttcggggcgattcgtattatagatttttttaattcgtagtcgtcgcgtttatataacgttttttcgacggttttcgttcgtttttttattttcggtttttcgttcgtttttcgcgcgtcgtcgttgttatttacgggtttcgtttcgcgtatgcgaagttttcgtcgttcgcggacgcgtcgtcgtcgttgattttatcgtttttttttttttttatgggttttttttttttgtgacggggcggtcgggtttagtcgcgatttcggtttcggtttcggtttcggttcgggagggagttaagttgtggatttagagattcgggatcgggatcgggggattgcgggcgagggcgggagggagtcgcggatatacgtcgaggcggcgcgggcgttcggcgtagttcggcgcgaggagtaagtgtgcgttcgtagggcgagggtagtcggggtttcgttg

SEQ ID NO: 19124 - DNA, 1020 bp, Artificial Sequence
  chemically treated genomic DNA (Homo sapiens) CpG-island No: 19124
caacgaaaccccgactaccctcgccctacgaacgcacacttactcctcgcgccgaactacgccgaacgcccgcgccgcctcgacgtatatccgcgactccctcccgccctcgcccgcaatcccccgatcccgatcccgaatctctaaatccacaacttaactccctcccgaaccgaaaccgaaaccgaaaccgaaatcgcgactaaacccgaccgccccgtcacaaaaaaaaaaaacccataaaaaaaaaaaaaaacgataaaatcaacgacgacgacgcgtccgcgaacgacgaaaacttcgcatacgcgaaacgaaacccgtaaataacaacgacgacgcgcgaaaaacgaacgaaaaaccgaaaataaaaaaacgaacgaaaaccgtcgaaaaaacgttatataaacgcgacgactacgaattaaaaaaatctataatacgaatcgccccgaaaaatccccgacgcgaacctcgcgcgacgaccacgatcgcgcgacgtatataaaaaatccacgcacacccgcaaaacttcctcctcccctactccgaaaaaacgaacgaacgtatataaaaacgaatataaaaaacgaaccgcgacccgacgcccaacgccgccgctaaaacaactatcaaaacttcgccgccgcccgaaccccgcgacccgccctccccgcgccgaacccctttctcttcctactacgaacgacccgaaaaaaaaaccgcgaacgaaaaccccgaaaaccgacgcccctcacgccgcccgcccgcccgctccccgcccgacccctacgcgcgtacgtatcctactcgctccatattaccgcctctcccgatacctactactactcccgaaacttcgaaaaatacgaaaatctaaaccgaaaaaaaaaaacccgaacaacgacgacgacgaccgcgacgacgaaaaccccccaaaaaaaaaaccgaaatccatatatctttcctaataactaaaatatcgtcgaaaaaaaacaaatacgtaaaacaaccgcaacc

SEQ ID NO: 19125 - DNA, 806 bp, Artificial Sequence
  chemically treated genomic DNA (Homo sapiens) CpG-island No: 19125
gcgcgtgtcggggttcgcggtgaggtttagttttttcggcggttttttagacgcgttttttgttcggtcggtgtggatcgtttcggttattgtttacgggggatgttcgtttagacgtattgttttggtcgtttttaatttgtttcggtttttttcggggtatcgcgggggattttatatcgacgtttttttttcgttcgcgttttaagggttgattgggtaaattggtagattcgtttcgcggggcgatttaatttttcggaatagttttttatcgtttatttttgtagattttcggattttcgttttcggcggagatttagggaatttcgtattttaagtttttttaaatcgtgcggtttgagtgtgacggttaagagcggatgtagttcgggatcgttcgtattttttcgtgggcggaagcgtaggagtcggttggggagggggcgttttagagaagcggttagaaagttgagacggggaattgaggttattttgggggggataagataatgagagtcgggcgttttgggggcggcgcgggagttttcgtaggattaggcgggcgttttttttatttgcggtttcggcgtttcggtcgttttttcgcgcggcggcggtcgggattgagttgatattatttagtcggcggggtttgaatgaggaggagcgggcgcggaggggagggggcggggagggagggagggaggcgtcgcggagtttttttcggttttttgtgttattcgtcgaggcgttttgagtataaatttagatagtgtagtttttgttgtgtttgtgttgattaa

SEQ ID NO: 19126 - DNA, 806 bp, Artificial Sequence
  chemically treated genomic DNA (Homo sapiens) CpG-island No: 19126
ttaatcaacacaaacacaacaaaaactacactatctaaatttatactcaaaacgcctcgacgaataacacaaaaaaccgaaaaaaactccgcgacgcctccctccctccctccccgccccctcccctccgcgcccgctcctcctcattcaaaccccgccgactaaataatatcaactcaatcccgaccgccgccgcgcgaaaaaacgaccgaaacgccgaaaccgcaaataaaaaaaacgcccgcctaatcctacgaaaactcccgcgccgcccccaaaacgcccgactctcattatcttatcccccccaaaataacctcaattccccgtctcaactttctaaccgcttctctaaaacgccccctccccaaccgactcctacgcttccgcccacgaaaaaatacgaacgatcccgaactacatccgctcttaaccgtcacactcaaaccgcacgatttaaaaaaacttaaaatacgaaattccctaaatctccgccgaaaacgaaaatccgaaaatctacaaaaataaacgataaaaaactattccgaaaaattaaatcgccccgcgaaacgaatctaccaatttacccaatcaacccttaaaacgcgaacgaaaaaaaaacgtcgatataaaatcccccgcgataccccgaaaaaaaccgaaacaaattaaaaacgaccaaaacaatacgtctaaacgaacatcccccgtaaacaataaccgaaacgatccacaccgaccgaacaaaaaacgcgtctaaaaaaccgccgaaaaaactaaacctcaccgcgaaccccgacacgcgc

SEQ ID NO: 19127 - DNA, 806 bp, Artificial Sequence
  chemically treated genomic DNA (Homo sapiens) CpG-island No: 19127
ttgattagtataagtataataaaaattgtattatttggatttatatttaaggcgtttcggcggatggtataaaaggtcgagagaaatttcgcgacgttttttttttttttttttcgttttttttttttcgcgttcgtttttttttatttaaatttcgtcggttgagtggtgttagtttagtttcggtcgtcgtcgcgcgaggaaacggtcgaggcgtcggagtcgtaggtaaagggggcgttcgtttggttttgcggaggttttcgcgtcgtttttaaggcgttcggtttttattgttttgttttttttaggatgattttagtttttcgttttagttttttagtcgtttttttagggcgttttttttttagtcggtttttgcgttttcgtttacgggaaggtgcgggcgatttcgggttgtattcgtttttggtcgttatatttaggtcgtacgatttagaagggtttgggatgcggggttttttgaattttcgtcgggagcgggggttcggggatttgtaggggtgggcggtggggggttgtttcgaaaagttgggtcgtttcgcggggcggatttgttaatttgtttagttagtttttggggcgcgggcggaggggggacgtcggtgtagggtttttcgcgatgtttcggaaagggtcggggtaagttggaaacggttaaaataatgcgtttggacgggtatttttcgtaaataatggtcgggacggtttatatcggtcgggtagagggcgcgtttaagggatcgtcggaggggttgggttttatcgcggatttcgatacgcgt

SEQ ID NO: 19128 - DNA, 806 bp, Artificial Sequence
  chemically treated genomic DNA (Homo sapiens) CpG-island No: 19128
acgcgtatcgaaatccgcgataaaacccaacccctccgacgatcccttaaacgcgccctctacccgaccgatataaaccgtcccgaccattatttacgaaaaatacccgtccaaacgcattattttaaccgtttccaacttaccccgaccctttccgaaacatcgcgaaaaaccctacaccgacgtcccccctccgcccgcgccccaaaaactaactaaacaaattaacaaatccgccccgcgaaacgacccaacttttcgaaacaaccccccaccgcccacccctacaaatccccgaacccccgctcccgacgaaaattcaaaaaaccccgcatcccaaacccttctaaatcgtacgacctaaatataacgaccaaaaacgaatacaacccgaaatcgcccgcaccttcccgtaaacgaaaacgcaaaaaccgactaaaaaaaaaacgccctaaaaaaacgactaaaaaactaaaacgaaaaactaaaatcatcctaaaaaaaacaaaacaataaaaaccgaacgccttaaaaacgacgcgaaaacctccgcaaaaccaaacgaacgccccctttacctacgactccgacgcctcgaccgtttcctcgcgcgacgacgaccgaaactaaactaacaccactcaaccgacgaaatttaaataaaaaaaaacgaacgcgaaaaaaaaaaaacgaaaaaaaaaaaaaaaaaacgtcgcgaaatttctctcgaccttttataccatccgccgaaacgccttaaatataaatccaaataatacaatttttattatacttatactaatcaa

SEQ ID NO: 19129 - DNA, 579 bp, Artificial Sequence
  chemically treated genomic DNA (Homo sapiens) CpG-island No: 19129
tcgggtcgcggttgttaggagagtttagaataaaaggcggcggggggcggggtcgaggcgggtcgggggtggggcggaagttataaggggcggcggttcggagcggtttagtaagtttagtagtttcggggcggatggtttcggtcgtttggtttcgtagcgcggtcgcgcgcgtttttttgttttcgatgttgttgttgttgttttagtcgtcgtcgttgttggttcgggttttgtcgtcggtgagtgttcgttattcgtcggtcgtttttcgttgagggggcgtcgggtacgcgggttgggtttagcggcggattcggatcgaagggggcgtttcgggtggtttttagcgttcggtattcgaaacgttttttggttttttttaggcgtgatagatagcgagtttgtagtttttgggggtgtgaaggggagtcggcgtcggtatcgttcgggttggtgggacgggattttacgttggatttacgtttgtttttagcgtggggatttgtttttcgcgttttagtcgcgggtgttggagtgtgcgttgaaggaagtagtagagggagtggtaatagggtt

SEQ ID NO: 19130 - DNA, 579 bp, Artificial Sequence
  chemically treated genomic DNA (Homo sapiens) CpG-island No: 19130
aaccctattaccactccctctactacttccttcaacgcacactccaacacccgcgactaaaacgcgaaaaacaaatccccacgctaaaaacaaacgtaaatccaacgtaaaatcccgtcccaccaacccgaacgataccgacgccgactccccttcacacccccaaaaactacaaactcgctatctatcacgcctaaaaaaaaccaaaaaacgtttcgaataccgaacgctaaaaaccacccgaaacgcccccttcgatccgaatccgccgctaaacccaacccgcgtacccgacgccccctcaacgaaaaacgaccgacgaataacgaacactcaccgacgacaaaacccgaaccaacaacgacgacgactaaaacaacaacaacaacatcgaaaacaaaaaaacgcgcgcgaccgcgctacgaaaccaaacgaccgaaaccatccgccccgaaactactaaacttactaaaccgctccgaaccgccgccccttataacttccgccccacccccgacccgcctcgaccccgccccccgccgccttttattctaaactctcctaacaaccgcgacccga

SEQ ID NO: 19131 - DNA, 579 bp, Artificial Sequence
  chemically treated genomic DNA (Homo sapiens) CpG-island No: 19131
ggttttgttattattttttttgttgttttttttaacgtatattttagtattcgcggttggagcgcgagaggtaggtttttacgttgggagtaagcgtgagtttagcgtggagtttcgttttattagttcgaacgatgtcggcgtcggtttttttttatatttttagggattgtaagttcgttgtttattacgtttagagggaattagaaagcgtttcgggtatcgggcgttggaggttattcggggcgtttttttcggttcggattcgtcgttgggtttagttcgcgtgttcggcgtttttttagcgaggagcggtcggcgagtggcgggtatttatcggcggtagagttcgggttagtagcggcggcggttggagtagtagtagtagtatcgggggtaggagggcgcgcgcggtcgcgttgcggagttaggcggtcggagttattcgtttcggggttgttgggtttgttgggtcgtttcgggtcgtcgttttttatagttttcgttttattttcggttcgtttcggtttcgtttttcgtcgttttttgttttgaatttttttagtagtcgcggttcgg

SEQ ID NO: 19132 - DNA, 579 bp, Artificial Sequence
  chemically treated genomic DNA (Homo sapiens) CpG-island No: 19132
ccgaaccgcgactactaaaaaaattcaaaacaaaaaacgacgaaaaacgaaaccgaaacgaaccgaaaataaaacgaaaactataaaaaacgacgacccgaaacgacccaacaaacccaacaaccccgaaacgaataactccgaccgcctaactccgcaacgcgaccgcgcgcgccctcctacccccgatactactactactactccaaccgccgccgctactaacccgaactctaccgccgataaatacccgccactcgccgaccgctcctcgctaaaaaaacgccgaacacgcgaactaaacccaacgacgaatccgaaccgaaaaaaacgccccgaataacctccaacgcccgatacccgaaacgctttctaattccctctaaacgtaataaacaacgaacttacaatccctaaaaatataaaaaaaaaccgacgccgacatcgttcgaactaataaaacgaaactccacgctaaactcacgcttactcccaacgtaaaaacctacctctcgcgctccaaccgcgaatactaaaatatacgttaaaaaaaacaacaaaaaaaataataacaaaacc

SEQ ID NO: 19133 - DNA, 728 bp, Artificial Sequence
  chemically treated genomic DNA (Homo sapiens) CpG-island No: 19133
gttcgcggaggcgcgttcggttttttgtttgagcggcggcgcgcgcgttagcgttaacgttagcgtttgcgtattgagggcggtttggtcgtcgtttgcggcggcggcggcggttgaggagttcggttgaggcgttagtattcggttcggttcgtatttcgtttttcggtttcggtttttttcggtttagtacgtttcggtttcgttttagtttttttgatttttcgtagttcggtttcggtcgttcgtttttgtcgtcgtaatgatgatgatggcgttgagtaagattttcgggtagaagttcgtgaagttttagttggaggacgacggcgagttttatatgatcggtttcgaggtagttcggggcgcgttttcgtttttttcgggttcggtttcgcgggagtttcggggcgggtttatgcgtcgagagcgcgcgtttttatttatcggggcgggcgggcgcgcgcgcgcgcgttcggggttgtggggcgtggtttagtgggcgtgtcgggtgtggttttcgtttttttatcgatttgggatttttttatttatttcgtcgaggttcgtcgtttttagtgttgttaagattttggcgtcgcgaggggttttagtggtttcgcgttgggttggtttttagttagacgtaaagaaacgggatattgagttagtttttgcgacgtttgggggattgtattgttgtttttgattttttttagatgtcgtaa

SEQ ID NO: 19134 - DNA, 728 bp, Artificial Sequence
  chemically treated genomic DNA (Homo sapiens) CpG-island No: 19134
ttacgacatctaaaaaaaatcaaaaacaacaatacaatcccccaaacgtcgcaaaaactaactcaatatcccgtttctttacgtctaactaaaaaccaacccaacgcgaaaccactaaaacccctcgcgacgccaaaatcttaacaacactaaaaacgacgaacctcgacgaaataaataaaaaaatcccaaatcgataaaaaaacgaaaaccacacccgacacgcccactaaaccacgccccacaaccccgaacgcgcgcgcgcgcgcccgcccgccccgataaataaaaacgcgcgctctcgacgcataaacccgccccgaaactcccgcgaaaccgaacccgaaaaaaacgaaaacgcgccccgaactacctcgaaaccgatcatataaaactcgccgtcgtcctccaactaaaacttcacgaacttctacccgaaaatcttactcaacgccatcatcatcattacgacgacaaaaacgaacgaccgaaaccgaactacgaaaaatcaaaaaaactaaaacgaaaccgaaacgtactaaaccgaaaaaaaccgaaaccgaaaaacgaaatacgaaccgaaccgaatactaacgcctcaaccgaactcctcaaccgccgccgccgccgcaaacgacgaccaaaccgccctcaatacgcaaacgctaacgttaacgctaacgcgcgcgccgccgctcaaacaaaaaaccgaacgcgcctccgcgaac

SEQ ID NO: 19135 - DNA, 728 bp, Artificial Sequence
  chemically treated genomic DNA (Homo sapiens) CpG-island No: 19135
ttacgatatttaaaaagggttaaaggtagtagtgtagttttttaagcgtcgtaggggttaatttaatatttcgtttttttgcgtttgattggaaattaatttagcgcggaattattggggtttttcgcggcgttaaaattttggtagtattgaaggcggcggatttcggcgaaataagtaaggaaattttaggtcgatgagggggcgggggttatattcgatacgtttattaggttacgttttatagtttcgagcgcgcgcgcgcgcgttcgttcgtttcgatgaatggagacgcgcgttttcggcgtatgggttcgtttcggggttttcgcggggtcgagttcggggagggcgagaacgcgtttcgggttatttcggagtcgattatgtagaattcgtcgtcgttttttagttggaattttacgggtttttgttcgaaggttttgtttagcgttattattattattgcggcggtagaggcgggcggtcggagtcgggttgcgagggattaggagggttggggcggggtcggggcgtgttgggtcgagggaaatcgaagtcggaaggcgaaatgcggatcgggtcgggtattggcgttttagtcgggttttttagtcgtcgtcgtcgtcgtagacgacgattaggtcgtttttagtgcgtaggcgttggcgttgacgttgacgcgcgcgtcgtcgtttaaataaaaggtcgggcgcgttttcgcggat

SEQ ID NO: 19136 - DNA, 728 bp, Artificial Sequence
  chemically treated genomic DNA (Homo sapiens) CpG-island No: 19136
atccgcgaaaacgcgcccgaccttttatttaaacgacgacgcgcgcgtcaacgtcaacgccaacgcctacgcactaaaaacgacctaatcgtcgtctacgacgacgacgacgactaaaaaacccgactaaaacgccaatacccgacccgatccgcatttcgccttccgacttcgatttccctcgacccaacacgccccgaccccgccccaaccctcctaatccctcgcaacccgactccgaccgcccgcctctaccgccgcaataataataataacgctaaacaaaaccttcgaacaaaaacccgtaaaattccaactaaaaaacgacgacgaattctacataatcgactccgaaataacccgaaacgcgttctcgccctccccgaactcgaccccgcgaaaaccccgaaacgaacccatacgccgaaaacgcgcgtctccattcatcgaaacgaacgaacgcgcgcgcgcgcgctcgaaactataaaacgtaacctaataaacgtatcgaatataacccccgccccctcatcgacctaaaatttccttacttatttcgccgaaatccgccgccttcaatactaccaaaattttaacgccgcgaaaaaccccaataattccgcgctaaattaatttccaatcaaacgcaaaaaaacgaaatattaaattaacccctacgacgcttaaaaaactacactactacctttaaccctttttaaatatcgtaa

SEQ ID NO: 19137 - DNA, 544 bp, Artificial Sequence
  chemically treated genomic DNA (Homo sapiens) CpG-island No: 19137
ttggagtcgtttttacggtttcggacgtaggtgagtttttagcggcggcgataaatttcgcggcggtgattttaaatttttttttcgcggcggcgatttttttttaatacgttggggcgaattttttagtatttttagttttttttaaaaacgttgagttcgcgtatgcgttttaggcgtttttcgcgatattttagcggttttgcgttttattgcgtttgagtttgagttttaggttttagtttcggttatcgtttagcgttgcgcgaatttttagttggtgcggtcgtttttaatatttattgcgtttgcgttatagtttcgtttcgacgggtttgttttttttaaacgtttattgcgcgtgcgttagcgttttttttattattgggcgttgcgcgttgttttttttttcgcgtataggttgtcggtttatcgtttgttaatggtagtcggggtttttttgggatagtaagattttcgtttaggtttttttttcgaatgttttacgtttttttgcgatttagaatggtatgaatttttatat

SEQ ID NO: 19138 - DNA, 544 bp, Artificial Sequence
  chemically treated genomic DNA (Homo sapiens) CpG-island No: 19138
atataaaaattcataccattctaaatcgcaaaaaaacgtaaaacattcgaaaaaaaaacctaaacgaaaatcttactatcccaaaaaaaccccgactaccattaacaaacgataaaccgacaacctatacgcgaaaaaaaaaacaacgcgcaacgcccaataataaaaaaaacgctaacgcacgcgcaataaacgtttaaaaaaaacaaacccgtcgaaacgaaactataacgcaaacgcaataaatattaaaaacgaccgcaccaactaaaaattcgcgcaacgctaaacgataaccgaaactaaaacctaaaactcaaactcaaacgcaataaaacgcaaaaccgctaaaatatcgcgaaaaacgcctaaaacgcatacgcgaactcaacgtttttaaaaaaaactaaaaatactaaaaaattcgccccaacgtattaaaaaaaaatcgccgccgcgaaaaaaaaatttaaaatcaccgccgcgaaatttatcgccgccgctaaaaactcacctacgtccgaaaccgtaaaaacgactccaa

SEQ ID NO: 19139 - DNA, 544 bp, Artificial Sequence
  chemically treated genomic DNA (Homo sapiens) CpG-island No: 19139
gtatgagaatttatattattttagatcgtaggagggcgtggagtattcgaaagaggggtttgagcggaggttttgttgttttagggagatttcggttgttattagtaagcggtgagtcggtagtttgtgcgcggagggaagggtagcgcgtagcgtttagtggtgaaagaggcgttagcgtacgcgtagtgagcgtttgagaggagtaaattcgtcgagacgaagttgtagcgtaagcgtagtgggtattgagagcggtcgtattagttgagggttcgcgtaacgttaaacgatggtcgggattaaggtttgagatttaagtttaggcgtagtgaagcgtagagtcgttagagtgtcgcggagggcgtttgaggcgtatgcgcggatttagcgtttttaagaagggttgggggtgttggggagttcgttttagcgtgttgggggggagtcgtcgtcgcggggggggggtttggggttatcgtcgcggggtttgtcgtcgtcgttgggagtttatttgcgttcgaggtcgtaaggacggttttag

SEQ ID NO: 19140 - DNA, 544 bp, Artificial Sequence
  chemically treated genomic DNA (Homo sapiens) CpG-island No: 19140
ctaaaaccgtccttacgacctcgaacgcaaataaactcccaacgacgacgacaaaccccgcgacgataaccccaaaccccccccccgcgacgacgactcccccccaacacgctaaaacgaactccccaacacccccaacccttcttaaaaacgctaaatccgcgcatacgcctcaaacgccctccgcgacactctaacgactctacgcttcactacgcctaaacttaaatctcaaaccttaatcccgaccatcgtttaacgttacgcgaaccctcaactaatacgaccgctctcaatacccactacgcttacgctacaacttcgtctcgacgaatttactcctctcaaacgctcactacgcgtacgctaacgcctctttcaccactaaacgctacgcgctacccttccctccgcgcacaaactaccgactcaccgcttactaataacaaccgaaatctccctaaaacaacaaaacctccgctcaaacccctctttcgaatactccacgccctcctacgatctaaaataatataaattctcatac

SEQ ID NO: 19141 - DNA, 583 bp, Artificial Sequence
  chemically treated genomic DNA (Homo sapiens) CpG-island No: 19141
tggggggcggggcggggggaggacggtggttcgggttcgaagtggacgttcggggttcgacgaggtcgttggggcgggttgatcgcgtttttttttcgtagtatatcgcggtgtacgtggtttcggattagtttatggttttcggcggttttagcgagtcgtgcgcgttttgtagtttgtatagtatcggtaagatcggcggcgcgtagaatcgtttttatagtaagttgttgtgcggtttgttggtcgagcgtttgcgtattagttcggataggtacgcggagtcgcggaggggcgggggaggggcggcggcgcgcggttaggttcgggattgagttattcgttgagttcggtttttttttttcgtagggtttatattaattattacgatatgaacgcggttaatgtgggttggaataattttattttcgtttaagagtcgtagggatttacgttgtttgcgttggttttattcgggaattcgtcgtacgttgtgttttaggttcgtttattttaattttttggtggggagaaataaacggtttagagattaggagtgtttcggggttttttggtttgcggg

SEQ ID NO: 19142 - DNA, 583 bp, Artificial Sequence
  chemically treated genomic DNA (Homo sapiens) CpG-island No: 19142
cccgcaaaccaaaaaaccccgaaacactcctaatctctaaaccgtttatttctccccaccaaaaaattaaaataaacgaacctaaaacacaacgtacgacgaattcccgaataaaaccaacgcaaacaacgtaaatccctacgactcttaaacgaaaataaaattattccaacccacattaaccgcgttcatatcgtaataattaatataaaccctacgaaaaaaaaaaaccgaactcaacgaataactcaatcccgaacctaaccgcgcgccgccgcccctcccccgcccctccgcgactccgcgtacctatccgaactaatacgcaaacgctcgaccaacaaaccgcacaacaacttactataaaaacgattctacgcgccgccgatcttaccgatactatacaaactacaaaacgcgcacgactcgctaaaaccgccgaaaaccataaactaatccgaaaccacgtacaccgcgatatactacgaaaaaaaaacgcgatcaacccgccccaacgacctcgtcgaaccccgaacgtccacttcgaacccgaaccaccgtcctccccccgccccgcccccca

SEQ ID NO: 19143 - DNA, 583 bp, Artificial Sequence
  chemically treated genomic DNA (Homo sapiens) CpG-island No: 19143
ttcgtaagttaaggaatttcgaggtatttttagtttttaaatcgtttatttttttttattagaaggttggggtgggcgggtttagaatatagcgtgcggcgggttttcgggtggagttagcgtagatagcgtgggtttttgcggtttttaggcgaaggtggagttgttttagtttatattggtcgcgtttatgtcgtaatagttgatgtagattttgcggggggaggaggtcggatttagcgggtggtttagtttcgggtttggtcgcgcgtcgtcgtttttttttcgttttttcgcgatttcgcgtatttgttcgggttgatgcgtaggcgttcggttagtaggtcgtatagtagtttgttgtaggagcggttttgcgcgtcgtcgattttgtcgatgttgtgtaggttgtagagcgcgtacggttcgttggagtcgtcgaaggttatgagttggttcgggattacgtgtatcgcgatgtattgcgaggaaagggcgcggttagttcgttttagcgatttcgtcgggtttcgaacgtttatttcgggttcgagttatcgtttttttttcgtttcgtttttta

SEQ ID NO: 19144 - DNA, 583 bp, Artificial Sequence
  chemically treated genomic DNA (Homo sapiens) CpG-island No: 19144
taaaaaacgaaacgaaaaaaaaacgataactcgaacccgaaataaacgttcgaaacccgacgaaatcgctaaaacgaactaaccgcgccctttcctcgcaatacatcgcgatacacgtaatcccgaaccaactcataaccttcgacgactccaacgaaccgtacgcgctctacaacctacacaacatcgacaaaatcgacgacgcgcaaaaccgctcctacaacaaactactatacgacctactaaccgaacgcctacgcatcaacccgaacaaatacgcgaaatcgcgaaaaaacgaaaaaaaaacgacgacgcgcgaccaaacccgaaactaaaccacccgctaaatccgacctcctccccccgcaaaatctacatcaactattacgacataaacgcgaccaatataaactaaaacaactccaccttcgcctaaaaaccgcaaaaacccacgctatctacgctaactccacccgaaaacccgccgcacgctatattctaaacccgcccaccccaaccttctaataaaaaaaaataaacgatttaaaaactaaaaatacctcgaaattccttaacttacgaa

SEQ ID NO: 19145 - DNA, 1028 bp, Artificial Sequence
  chemically treated genomic DNA (Homo sapiens) CpG-island No: 19145
tcgcggtttttttattttcgtcgtttgcggttttcgtttcggggtagtagtttgtattaggttgaagggagaggtggaacggattcgtttatttacgtatttcgaggaggggtgtgtgaggagttacgttttagagaacggtaagaaatttcggttaggaaatacgggattataggagaattcgaggcgaaggtgcggcgtcggtgtaggagcggaggggcggatttatagtagttcggcgagcgcgtaggtgtgttcgcggtcgcgttatttttttcgtagtttttacgggatggagtcggcgggagagggcggggttaggcgcgcggcggtcgtttttgttgcggtcggaaataatagtggaggaattcgagtcgtacggaacggcggtggtggttcgcggagtcggacggtaaagatttcgtagttttgtttttattttatttgagtttcgatttttagttttatcgtttcgtttttttcgagtttcgagtttcgtggtttttcgcgttgttgcgcgttaggcgtttcgacggatagatcgacggaaagacggatttgggttcgcgattttttgggggcggtcgcgcgtttttaacgtcgaaggtcgggttaggattcggtttttcgagacgttgaggttgggcggatcggtcgtcgtggttttcggacgtttttttttttttgggaggaatttcggagcgatgggacgaggttttttcgttcgtcgggttttaggatgtcgcggtttttttagtttcggtttgggttttttcggcggtgttcggtcggtatcgtgaagtcgtcgttcggttttcggtgtagttgtttcggatacggcgggacgtttttttcgggtattcggtatttacgtgtattttgttgtcgtcgattttcgttcgatgcgaagttcgtaatttcgagttcgcgaggcgtatttgaggtttttttaatgaagttagtaaagtagtgtttcgtgtaggtcgttttttttgttttttatagcgttaattaggttgatagaattt

SEQ ID NO: 19146 - DNA, 1028 bp, Artificial Sequence
  chemically treated genomic DNA (Homo sapiens) CpG-island No: 19146
aaattctatcaacctaattaacgctataaaaaacaaaaaaaacgacctacacgaaacactactttactaacttcattaaaaaaacctcaaatacgcctcgcgaactcgaaattacgaacttcgcatcgaacgaaaatcgacgacaacaaaatacacgtaaataccgaatacccgaaaaaaacgtcccgccgtatccgaaacaactacaccgaaaaccgaacgacgacttcacgataccgaccgaacaccgccgaaaaaacccaaaccgaaactaaaaaaaccgcgacatcctaaaacccgacgaacgaaaaaacctcgtcccatcgctccgaaattcctcccaaaaaaaaaaaaacgtccgaaaaccacgacgaccgatccgcccaacctcaacgtctcgaaaaaccgaatcctaacccgaccttcgacgttaaaaacgcgcgaccgcccccaaaaaatcgcgaacccaaatccgtctttccgtcgatctatccgtcgaaacgcctaacgcgcaacaacgcgaaaaaccacgaaactcgaaactcgaaaaaaacgaaacgataaaactaaaaatcgaaactcaaataaaataaaaacaaaactacgaaatctttaccgtccgactccgcgaaccaccaccgccgttccgtacgactcgaattcctccactattatttccgaccgcaacaaaaacgaccgccgcgcgcctaaccccgccctctcccgccgactccatcccgtaaaaactacgaaaaaaataacgcgaccgcgaacacacctacgcgctcgccgaactactataaatccgcccctccgctcctacaccgacgccgcaccttcgcctcgaattctcctataatcccgtatttcctaaccgaaatttcttaccgttctctaaaacgtaactcctcacacacccctcctcgaaatacgtaaataaacgaatccgttccacctctcccttcaacctaatacaaactactaccccgaaacgaaaaccgcaaacgacgaaaataaaaaaaccgcga

SEQ ID NO: 19147 - DNA, 1028 bp, Artificial Sequence
  chemically treated genomic DNA (Homo sapiens) CpG-island No: 19147
aggttttgttaatttagttaacgttgtgagaaataggaaaaacgatttgtacgggatattgttttgttaattttattgggggaattttagatgcgtttcgcgaattcggagttgcgaatttcgtatcgaacggagatcggcggtagtaaaatgtacgtgggtatcgaatattcggggagggcgtttcgtcgtgttcggggtaattatatcgaaggtcgagcggcggttttacggtatcggtcgggtatcgtcggaggggtttaagtcggagttgggagagtcgcggtattttggagttcggcgggcgggagagtttcgttttatcgtttcgggattttttttagagggaagaaagcgttcgagggttacggcggtcggttcgtttagttttagcgtttcggggagtcgggttttggttcggttttcggcgttgggggcgcgcggtcgtttttagggagtcgcggatttaagttcgttttttcgtcggtttgttcgtcggggcgtttggcgcgtagtagcgcgaggggttacggggttcggaattcgaaggaggcggaacgatgggattgggggtcggggtttaggtgggatgggagtagggttgcggggtttttatcgttcggtttcgcgggttattatcgtcgtttcgtgcggttcgggtttttttattattgttttcggtcgtagtagaggcggtcgtcgcgcgtttggtttcgttttttttcgtcggttttatttcgtaaaggttgcggggagggtggcgcggtcgcgggtatatttgcgcgttcgtcgggttgttgtgggttcgttttttcgtttttgtatcgacgtcgtattttcgtttcgagtttttttgtgatttcgtgttttttggtcggagttttttatcgttttttggaacgtagttttttatatattttttttcgaggtgcgtagatagacgaattcgttttatttttttttttagtttagtgtaaattattgtttcggggcgggggtcgtaggcggcgggggtaggaaagtcgcgg

SEQ ID NO: 19148 - DNA, 1028 bp, Artificial Sequence
  chemically treated genomic DNA (Homo sapiens) CpG-island No: 19148
ccgcgactttcctacccccgccgcctacgacccccgccccgaaacaataatttacactaaactaaaaaaaaaaataaaacgaattcgtctatctacgcacctcgaaaaaaaatatataaaaaactacgttccaaaaaacgataaaaaactccgaccaaaaaacacgaaatcacaaaaaaactcgaaacgaaaatacgacgtcgatacaaaaacgaaaaaacgaacccacaacaacccgacgaacgcgcaaatatacccgcgaccgcgccaccctccccgcaacctttacgaaataaaaccgacgaaaaaaaacgaaaccaaacgcgcgacgaccgcctctactacgaccgaaaacaataataaaaaaacccgaaccgcacgaaacgacgataataacccgcgaaaccgaacgataaaaaccccgcaaccctactcccatcccacctaaaccccgacccccaatcccatcgttccgcctccttcgaattccgaaccccgtaacccctcgcgctactacgcgccaaacgccccgacgaacaaaccgacgaaaaaacgaacttaaatccgcgactccctaaaaacgaccgcgcgcccccaacgccgaaaaccgaaccaaaacccgactccccgaaacgctaaaactaaacgaaccgaccgccgtaaccctcgaacgctttcttccctctaaaaaaaatcccgaaacgataaaacgaaactctcccgcccgccgaactccaaaataccgcgactctcccaactccgacttaaacccctccgacgatacccgaccgataccgtaaaaccgccgctcgaccttcgatataattaccccgaacacgacgaaacgccctccccgaatattcgatacccacgtacattttactaccgccgatctccgttcgatacgaaattcgcaactccgaattcgcgaaacgcatctaaaattcccccaataaaattaacaaaacaatatcccgtacaaatcgtttttcctatttctcacaacgttaactaaattaacaaaacct

SEQ ID NO: 19149 - DNA, 615 bp, Artificial Sequence
  chemically treated genomic DNA (Homo sapiens) CpG-island No: 19149
gtttttcgtttagcgtttttattaatagtcgtagttcgtagtttcgttggatatcggttttttattttcgtagcgtagttcggaatatggtagttgttatttttatttgttacgttagttttttgtgcgcgtaattgtttggtttcgtttcgttttgcgcgagttgtttgtttaggtaggttcgtcggtgcgagcgtaaaggggcggagttaggattgttttgggcggtataaatagtagggaatcgcgcggtcgtttagtagtgacgtgatacgtagtttacggtttgtattgacgcgttttcgtttttttttttttttcgattttattttcgcggtagttgggatcgtcgtttaggtaagaatggggttttggttggattcgaagggtttgtagtaggttggttgcggggttagaaggcgcggggggaatcgaagaacggggtttgtttcgtggttttgttttagtttttattcgaattttttgggaggtttggtttttcgtacgtgagtcgtcgcgattattatttcgtcgcgatcgtttttggatcgttttttatttttaaattttttttattttagagtattttttggttttttttataagtcgtttttt

SEQ ID NO: 19150 - DNA, 615 bp, Artificial Sequence
  chemically treated genomic DNA (Homo sapiens) CpG-island No: 19150
aaaaaacgacttataaaaaaaaccaaaaaatactctaaaataaaaaaaatttaaaaataaaaaacgatccaaaaacgatcgcgacgaaataataatcgcgacgactcacgtacgaaaaaccaaacctcccaaaaaattcgaataaaaactaaaacaaaaccacgaaacaaaccccgttcttcgattccccccgcgccttctaaccccgcaaccaacctactacaaacccttcgaatccaaccaaaaccccattcttacctaaacgacgatcccaactaccgcgaaaataaaatcgaaaaaaaaaaaaaaacgaaaacgcgtcaatacaaaccgtaaactacgtatcacgtcactactaaacgaccgcgcgattccctactatttataccgcccaaaacaatcctaactccgcccctttacgctcgcaccgacgaacctacctaaacaaacaactcgcgcaaaacgaaacgaaaccaaacaattacgcgcacaaaaaactaacgtaacaaataaaaataacaactaccatattccgaactacgctacgaaaataaaaaaccgatatccaacgaaactacgaactacgactattaataaaaacgctaaacgaaaaac

SEQ ID NO: 19151 - DNA, 615 bp, Artificial Sequence
  chemically treated genomic DNA (Homo sapiens) CpG-island No: 19151
aaaagacggtttgtaagagaagttaagaaatgttttgggataaaggagatttgggagtggaaagcggtttagaaacgatcgcgacgggatggtggtcgcggcggtttacgtgcggaaggttaggttttttaaggagttcggatagggattggagtagggttacggagtaggtttcgtttttcggtttttttcgcgttttttgatttcgtagttaatttgttataagtttttcggatttagttaaggttttatttttatttgaacggcggttttagttatcgcgaagatggagtcgagaaagaggaagaagcgagggcgcgttagtatagatcgtgggttgcgtgttacgttattgttgagcgatcgcgcggttttttgttatttgtatcgtttaaggtagttttagtttcgtttttttacgttcgtatcggcgaatttgtttgggtaggtagttcgcgtaggacggggcgggattagatagttgcgcgtatagaaggttggcgtagtaggtaaagatggtagttattatgtttcgggttacgttgcggggatggagaatcggtgtttagcggggttgcgggttacggttgttggtgagagcgttgagcgaggagt

SEQ ID NO: 19152 - DNA, 615 bp, Artificial Sequence
  chemically treated genomic DNA (Homo sapiens) CpG-island No: 19152
actcctcgctcaacgctctcaccaacaaccgtaacccgcaaccccgctaaacaccgattctccatccccgcaacgtaacccgaaacataataactaccatctttacctactacgccaaccttctatacgcgcaactatctaatcccgccccgtcctacgcgaactacctacccaaacaaattcgccgatacgaacgtaaaaaaacgaaactaaaactaccttaaacgatacaaataacaaaaaaccgcgcgatcgctcaacaataacgtaacacgcaacccacgatctatactaacgcgccctcgcttcttcctctttctcgactccatcttcgcgataactaaaaccgccgttcaaataaaaataaaaccttaactaaatccgaaaaacttataacaaattaactacgaaatcaaaaaacgcgaaaaaaaccgaaaaacgaaacctactccgtaaccctactccaatccctatccgaactccttaaaaaacctaaccttccgcacgtaaaccgccgcgaccaccatcccgtcgcgatcgtttctaaaccgctttccactcccaaatctcctttatcccaaaacatttcttaacttctcttacaaaccgtctttt

SEQ ID NO: 19153 - DNA, 1101 bp, Artificial Sequence
  chemically treated genomic DNA (Homo sapiens) CpG-island No: 19153
tcgcgggttcgttgttttcggcgggcggttttgggttcgaggattcggtttttcggaggcgcgattttttagtaaataagcggagttttagaaaaaatatcgacgcgaagggggtggatagagggtgggaagtcgcggggttgtcgtttattcggaggcggaatgtaacgcgttgtgggaaacgtggtaggagttttgaggcggcgtttttttttttaggcgttcgtcgagggtttcgcggaaagtttcgcgggtcgttttcgcggttcgtagtttcgttttggcgtcgagtcggagtttatgtaatttggttttattttttgttttttttttgttttcggtgcgtcgttcgttagcgagttttcgacgtggtcgtaggggcgacgggattattttttttcgatatttatagtttcgttatgtttgttttttttcggttcggtttttttatcgtcgttgtcgtcgtcgtttttcggtcggagattcggcggtttagatcgtgttttggtcgggaattgagggtttcgttttaacgggttcgcgttgggtaatagggagcgtagcgagtttcgttcggcgcgtgcggttttcgcgtcgtcgggcggttaagcgcgcgttgagaggattggcgggcggacgagcgcgtatacgagtgagcgtagttttaaagcggcgcgtagggggttcgcggttcggaagaggggaggggcgatgattcgggaaagggttggcgcgcgcgggatcggttcgcgcgtttgaggggcggtgtcgggggcggggtttcgtcgcgaggttattttcgagtttcgggtttagtcgtacgggaggcgatatattttcgttttattttgagtttggcgtagattttcgatcgcgacggcgcggttcgtagaatcgcgggttttttttttcggtaaaaagcggcgttgaaggtttgtgggattttcgttcggtcgttttacgtgcgttagcgttttcgggggtcgcgcgggtttggttttttcggttgtttcggtttttttgttttttttttaggtttttttacgttgtatttgatatttttagggcggaatggcgagttttagatttagttttttagat

SEQ ID NO: 19154 - DNA, 1101 bp, Artificial Sequence
  chemically treated genomic DNA (Homo sapiens) CpG-island No: 19154
atctaaaaaactaaatctaaaactcgccattccgccctaaaaatatcaaatacaacgtaaaaaaacctaaaaaaaaaacaaaaaaaccgaaacaaccgaaaaaaccaaacccgcgcgacccccgaaaacgctaacgcacgtaaaacgaccgaacgaaaatcccacaaaccttcaacgccgctttttaccgaaaaaaaaaacccgcgattctacgaaccgcgccgtcgcgatcgaaaatctacgccaaactcaaaataaaacgaaaatatatcgcctcccgtacgactaaacccgaaactcgaaaataacctcgcgacgaaaccccgcccccgacaccgcccctcaaacgcgcgaaccgatcccgcgcgcgccaaccctttcccgaatcatcgcccctcccctcttccgaaccgcgaaccccctacgcgccgctttaaaactacgctcactcgtatacgcgctcgtccgcccgccaatcctctcaacgcgcgcttaaccgcccgacgacgcgaaaaccgcacgcgccgaacgaaactcgctacgctccctattacccaacgcgaacccgttaaaacgaaaccctcaattcccgaccaaaacacgatctaaaccgccgaatctccgaccgaaaaacgacgacgacaacgacgataaaaaaaccgaaccgaaaaaaaacaaacataacgaaactataaatatcgaaaaaaaataatcccgtcgcccctacgaccacgtcgaaaactcgctaacgaacgacgcaccgaaaacaaaaaaaaaacaaaaaataaaaccaaattacataaactccgactcgacgccaaaacgaaactacgaaccgcgaaaacgacccgcgaaactttccgcgaaaccctcgacgaacgcctaaaaaaaaaaacgccgcctcaaaactcctaccacgtttcccacaacgcgttacattccgcctccgaataaacgacaaccccgcgacttcccaccctctatccacccccttcgcgtcgatattttttctaaaactccgcttatttactaaaaaatcgcgcctccgaaaaaccgaatcctcgaacccaaaaccgcccgccgaaaacaacgaacccgcga

SEQ ID NO: 19155 - DNA, 1101 bp, Artificial Sequence
  chemically treated genomic DNA (Homo sapiens) CpG-island No: 19155
gtttagagagttgggtttagaattcgttatttcgttttgagggtgttaagtgtagcgtggagagatttgagggggaaataaaaaggtcgagatagtcgaaaggattaagttcgcgcgattttcgaaggcgttgacgtacgtagggcggtcgggcgggggttttataggtttttagcgtcgttttttgtcggggagggaagttcgcggttttgcggatcgcgtcgtcgcggtcgagggtttgcgttaggtttagggtagggcgagggtgtgtcgtttttcgtgcggttaggttcggggttcgggggtggtttcgcggcgaagtttcgttttcggtatcgttttttaggcgcgcgagtcgatttcgcgcgcgttaattttttttcgggttatcgttttttttttttttcgggtcgcgagttttttgcgcgtcgttttggggttgcgtttattcgtgtgcgcgttcgttcgttcgttagtttttttaacgcgcgtttggtcgttcgacgacgcgggagtcgtacgcgtcggacgaggttcgttgcgttttttgttgtttagcgcgggttcgttgaggcggagtttttagttttcggttaggatacggtttgggtcgtcgaattttcggtcgaagagcggcggcggtagcggcggtgaggagatcgggtcggggaaaggtagatatggcggggttgtgggtatcgggggagggtggtttcgtcgtttttgcggttacgtcgaaggttcgttggcgggcggcgtatcggggataggggaggggtaggggatggaattaggttgtatgggtttcggttcggcgttagagcggggttgcgggtcgcgagggcggttcgcgaggtttttcgcgggattttcggcgggcgtttgaggaaaaagacgtcgttttagggtttttgttacgttttttatagcgcgttatatttcgttttcgggtgggcgataatttcgcggttttttattttttgtttatttttttcgcgtcggtgttttttttggagtttcgtttgtttgttggagagtcgcgttttcgggaagtcgggttttcgaatttagggtcgttcgtcggggatagcggattcgcgg

SEQ ID NO: 19156 - DNA, 1101 bp, Artificial Sequence
  chemically treated genomic DNA (Homo sapiens) CpG-island No: 19156
ccgcgaatccgctatccccgacgaacgaccctaaattcgaaaacccgacttcccgaaaacgcgactctccaacaaacaaacgaaactccaaaaaaaacaccgacgcgaaaaaaataaacaaaaaataaaaaaccgcgaaattatcgcccacccgaaaacgaaatataacgcgctataaaaaacgtaacaaaaaccctaaaacgacgtctttttcctcaaacgcccgccgaaaatcccgcgaaaaacctcgcgaaccgccctcgcgacccgcaaccccgctctaacgccgaaccgaaacccatacaacctaattccatcccctacccctcccctatccccgatacgccgcccgccaacgaaccttcgacgtaaccgcaaaaacgacgaaaccaccctcccccgatacccacaaccccgccatatctacctttccccgacccgatctcctcaccgccgctaccgccgccgctcttcgaccgaaaattcgacgacccaaaccgtatcctaaccgaaaactaaaaactccgcctcaacgaacccgcgctaaacaacaaaaaacgcaacgaacctcgtccgacgcgtacgactcccgcgtcgtcgaacgaccaaacgcgcgttaaaaaaactaacgaacgaacgaacgcgcacacgaataaacgcaaccccaaaacgacgcgcaaaaaactcgcgacccgaaaaaaaaaaaaaacgataacccgaaaaaaaattaacgcgcgcgaaatcgactcgcgcgcctaaaaaacgataccgaaaacgaaacttcgccgcgaaaccacccccgaaccccgaacctaaccgcacgaaaaacgacacaccctcgccctaccctaaacctaacgcaaaccctcgaccgcgacgacgcgatccgcaaaaccgcgaacttccctccccgacaaaaaacgacgctaaaaacctataaaacccccgcccgaccgccctacgtacgtcaacgccttcgaaaatcgcgcgaacttaatcctttcgactatctcgacctttttatttccccctcaaatctctccacgctacacttaacaccctcaaaacgaaataacgaattctaaacccaactctctaaac

SEQ ID NO: 19157 - DNA, 1653 bp, Artificial Sequence
  chemically treated genomic DNA (Homo sapiens) CpG-island No: 19157
gtttgagcgggagaaaacggtttggttttgttcgggtggttgttgagtatcgttcggcgtcgttcgcgtttgtagggagttcggttcgttgttttggtggatataaagtttaggggtcgttcgcgcgggattagtagcgcgaattttttgtcgttcggttagtttggtaggggattttaaaatcggttaattatagcgggcgttaggttttcgtttttcgtttattggttttgtcgtaggaggcgggtacgtgagcgtattaatttgtggtcggcgagcgtaaagggcggggtttcgtttaggttgtatcgtttagagcgcgcgtgcgcgagatcggaaacgtagttttttgattggcggcgcgtgtcgggggcggggtcgcggttgcgtgatagttgtcgcggggggagggcgagtttaagcgcgggggagggagtgtaaatagagcgaaggttgttttgtgttagtttcgttatcgtcgggcggttcgcgcggagtttgagggagatggaagttgagtaagagtagcggcgtagaaaggtggaggtcgggaggacgaaggtaaatattaggggttttttttttagttgttttggcgtgaagttttaagggcggtttcggtgttcgttatcgttttttgttaggagaggacgcggttcggcggaagtcgtcgcggaggtttcgttttttttcgtcggtttcgttggaagtcgttttttggtcgtcgttattttgaattcgtcgtttttcgttaggtttcgttttcgtcgcggttatagttaattagcggtcgggacgcgcggcgtttttcgggcgggtcggggcggggttgcgtttgcgtcggggggggtggggcgcgggttgggcgcggtgtacgtcggggcggggtgtggttgtagggcggggttataggggcgtggcgtggttgtacggagggggtggggcgcggtaggcgttggattttaggttggattttttagtggttttcgcgtttttcgggatcgggtggtttggggcgggcggtcggtattcgggtggttgtttggtttagggttagttttttgcgcggtcggggtcgggggcgtggcgcgggtggtttgtagcgtttttttagggtgcgttttcgtttcgttcgtcggagatgtttttttcgcgcgtttttcgcggcgttgtagtttttattgtgtgaaaggttttcgcggcgttttcggtcgtcgtttttttttcgcgtttttgggttcgcgttttgttcgttcgggtttggcgtacgttgtcgggaatttacgcggcgttggcgtcgggcgtttttaagggacgcgttttcgtttttttttcgtttcgggttttttcgtgaaaaagcgttcggtttgatggttattgttttaggtttcgtgggaataaagcgcgtagagtttatgattcgggggtaggagaaagggagtttcgaaagcgcgaggcggaatcgcgggagtaggtcggtttttgcgaggtgcgcgtcgtttttttttaggatgttttggttggggtgttggggaagagcggggttttcgggtacggcggataggggacgcggggttaggtcggggaagggttgaggcgggtaggaggggaaggggagttcggagtttgtagggagttgcgaataggagtaga

SEQ ID NO: 19158 - DNA, 1653 bp, Artificial Sequence
  chemically treated genomic DNA (Homo sapiens) CpG-island No: 19158
tctactcctattcgcaactccctacaaactccgaactccccttcccctcctacccgcctcaacccttccccgacctaaccccgcgtcccctatccgccgtacccgaaaaccccgctcttccccaacaccccaaccaaaacatcctaaaaaaaaacgacgcgcacctcgcaaaaaccgacctactcccgcgattccgcctcgcgctttcgaaactccctttctcctacccccgaatcataaactctacgcgctttattcccacgaaacctaaaacaataaccatcaaaccgaacgctttttcacgaaaaaacccgaaacgaaaaaaaaacgaaaacgcgtcccttaaaaacgcccgacgccaacgccgcgtaaattcccgacaacgtacgccaaacccgaacgaacaaaacgcgaacccaaaaacgcgaaaaaaaaacgacgaccgaaaacgccgcgaaaacctttcacacaataaaaactacaacgccgcgaaaaacgcgcgaaaaaaacatctccgacgaacgaaacgaaaacgcaccctaaaaaaacgctacaaaccacccgcgccacgcccccgaccccgaccgcgcaaaaaactaaccctaaaccaaacaaccacccgaataccgaccgcccgccccaaaccacccgatcccgaaaaacgcgaaaaccactaaaaaatccaacctaaaatccaacgcctaccgcgccccaccccctccgtacaaccacgccacgcccctataaccccgccctacaaccacaccccgccccgacgtacaccgcgcccaacccgcgccccaccccccccgacgcaaacgcaaccccgccccgacccgcccgaaaaacgccgcgcgtcccgaccgctaattaactataaccgcgacgaaaacgaaacctaacgaaaaacgacgaattcaaaataacgacgaccaaaaaacgacttccaacgaaaccgacgaaaaaaaacgaaacctccgcgacgacttccgccgaaccgcgtcctctcctaacaaaaaacgataacgaacaccgaaaccgcccttaaaacttcacgccaaaacaactaaaaaaaaaacccctaatatttaccttcgtcctcccgacctccacctttctacgccgctactcttactcaacttccatctccctcaaactccgcgcgaaccgcccgacgataacgaaactaacacaaaacaaccttcgctctatttacactccctcccccgcgcttaaactcgccctccccccgcgacaactatcacgcaaccgcgaccccgcccccgacacgcgccgccaatcaaaaaactacgtttccgatctcgcgcacgcgcgctctaaacgatacaacctaaacgaaaccccgccctttacgctcgccgaccacaaattaatacgctcacgtacccgcctcctacgacaaaaccaataaacgaaaaacgaaaacctaacgcccgctataattaaccgattttaaaatcccctaccaaactaaccgaacgacaaaaaattcgcgctactaatcccgcgcgaacgacccctaaactttatatccaccaaaacaacgaaccgaactccctacaaacgcgaacgacgccgaacgatactcaacaaccacccgaacaaaaccaaaccgttttctcccgctcaaac

SEQ ID NO: 19159 - DNA, 1653 bp, Artificial Sequence
  chemically treated genomic DNA (Homo sapiens) CpG-island No: 19159
tttgtttttgttcgtagttttttgtaggtttcgggttttttttttttttttgttcgttttagttttttttcggtttagtttcgcgttttttgttcgtcgtgttcgggagtttcgtttttttttagtattttagttagaatattttgggggggagcggcgcgtatttcgtagaggtcggtttgttttcgcggtttcgtttcgcgttttcgggatttttttttttttgttttcgagttatgggttttgcgcgttttatttttacgaaatttaggatagtggttattaaatcgagcgtttttttacggagaaattcggggcgggagaaagacgggagcgcgttttttgaaggcgttcggcgttagcgtcgcgtgggttttcggtagcgtacgttaggttcggacgggtaggacgcgagtttaagggcgcgggaagaagacggcggtcgggagcgtcgcgggggttttttatatagtaaggattgtaacgtcgcgagaaacgcgcggggaaagtattttcgacggacgaggcgaaggcgtattttggggaggcgttgtaggttattcgcgttacgttttcggtttcggtcgcgtaggaaattggttttagattaagtagttattcgaatatcggtcgttcgttttaggttattcggtttcggaggacgcgggagttattggaagatttagtttggggtttagcgtttgtcgcgttttatttttttcgtgtagttacgttacgtttttgtagtttcgttttgtagttatatttcgtttcggcgtgtatcgcgtttagttcgcgttttatttttttcgacgtaggcgtagtttcgtttcggttcgttcgagaggcgtcgcgcgtttcggtcgttgattggttgtggtcgcggcgggggcgggatttggcggagagcggcggatttaagatggcggcggttaggaggcggtttttagcggagtcggcgggaaaaagcgagattttcgcggcggttttcgtcggatcgcgtttttttttggtagggggcggtggcgggtatcggagtcgtttttaggattttacgttagagtagttagagaagaagtttttaatgtttattttcgttttttcggtttttatttttttgcgtcgttgtttttgtttaatttttattttttttagatttcgcgcgggtcgttcggcggtgacggggttgatatagagtagttttcgttttatttatattttttttttcgcgtttgggttcgtttttttttcgcgataattgttacgtagtcgcggtttcgttttcgatacgcgtcgttaattagggggttgcgttttcggtttcgcgtacgcgcgttttgggcggtgtagtttgggcggagtttcgttttttacgttcgtcggttatagattggtgcgtttacgtattcgttttttacggtaggattagtaagcggaaagcggaggtttggcgttcgttgtgattggtcgattttaaaattttttgttaggttggtcgagcggtaaaaagttcgcgttgttggtttcgcgcgggcggtttttgggttttgtgtttattaggatagcgggtcgggttttttgtaggcgcgggcggcgtcgaacggtgtttagtaattattcggatagggttaggtcgttttttttcgtttaggt

SEQ ID NO: 19160 - DNA, 1653 bp, Artificial Sequence
  chemically treated genomic DNA (Homo sapiens) CpG-island No: 19160
acctaaacgaaaaaaaacgacctaaccctatccgaataattactaaacaccgttcgacgccgcccgcgcctacaaaaaacccgacccgctatcctaataaacacaaaacccaaaaaccgcccgcgcgaaaccaacaacgcgaactttttaccgctcgaccaacctaacaaaaaattttaaaatcgaccaatcacaacgaacgccaaacctccgctttccgcttactaatcctaccgtaaaaaacgaatacgtaaacgcaccaatctataaccgacgaacgtaaaaaacgaaactccgcccaaactacaccgcccaaaacgcgcgtacgcgaaaccgaaaacgcaaccccctaattaacgacgcgtatcgaaaacgaaaccgcgactacgtaacaattatcgcgaaaaaaaaacgaacccaaacgcgaaaaaaaaaatataaataaaacgaaaactactctatatcaaccccgtcaccgccgaacgacccgcgcgaaatctaaaaaaaataaaaattaaacaaaaacaacgacgcaaaaaaataaaaaccgaaaaaacgaaaataaacattaaaaacttcttctctaactactctaacgtaaaatcctaaaaacgactccgatacccgccaccgccccctaccaaaaaaaaacgcgatccgacgaaaaccgccgcgaaaatctcgctttttcccgccgactccgctaaaaaccgcctcctaaccgccgccatcttaaatccgccgctctccgccaaatcccgcccccgccgcgaccacaaccaatcaacgaccgaaacgcgcgacgcctctcgaacgaaccgaaacgaaactacgcctacgtcgaaaaaaataaaacgcgaactaaacgcgatacacgccgaaacgaaatataactacaaaacgaaactacaaaaacgtaacgtaactacacgaaaaaaataaaacgcgacaaacgctaaaccccaaactaaatcttccaataactcccgcgtcctccgaaaccgaataacctaaaacgaacgaccgatattcgaataactacttaatctaaaaccaatttcctacgcgaccgaaaccgaaaacgtaacgcgaataacctacaacgcctccccaaaatacgccttcgcctcgtccgtcgaaaatactttccccgcgcgtttctcgcgacgttacaatccttactatataaaaaacccccgcgacgctcccgaccgccgtcttcttcccgcgcccttaaactcgcgtcctacccgtccgaacctaacgtacgctaccgaaaacccacgcgacgctaacgccgaacgccttcaaaaaacgcgctcccgtctttctcccgccccgaatttctccgtaaaaaaacgctcgatttaataaccactatcctaaatttcgtaaaaataaaacgcgcaaaacccataactcgaaaacaaaaaaaaaaaaatcccgaaaacgcgaaacgaaaccgcgaaaacaaaccgacctctacgaaatacgcgccgctcccccccaaaatattctaactaaaatactaaaaaaaaacgaaactcccgaacacgacgaacaaaaaacgcgaaactaaaccgaaaaaaaactaaaacgaacaaaaaaaaaaaaaaaacccgaaacctacaaaaaactacgaacaaaaacaaa

SEQ ID NO: 19161 - DNA, 707 bp, Artificial Sequence
  chemically treated genomic DNA (Homo sapiens) CpG-island No: 19161
  misc_feature (274)..(275): n is either a, c, g or t
  misc_feature (295)..(296): n is either a, c, g or t
  misc_feature (312)..(314): n is either a, c, g or t
ttttcgcgtatttttttattttttttaatcgcgtagtgatcgattttcgggtaaggggcgtggttaataggtagagtgtttcgagcgcgttttcgttttcgagcgcgttttcgcgttattttttattacgttatattcgatgacgcgttcgcggcgttcgaagaggttgcgtagtttttggttcgtgtatgtagtcgatatattgtttacgaaaattttttaagtattaagaggttttgggcgcgatatttttattacgagcgcgcgtttcggnngtagttcgtggtcgtgtagnntttcgatggcgcgtannncgttcgcgttttcgcgtatgtgtacgaaggcgaattgttttatgacggcgtagtttatgatcgtgtcgtagggcgtaaagagggttgttagttttttcggagtcgtattcgtttcgtcgacgttgtttacgaatatttttattttgtcgtcgtagttatttttttggagagttcggattttttttttagcgataggtaagacgttcgaacgatcggtagttttttttaggaatggttggcgatcgagaatttcgtcgcgtaggcgttttggtttagttaatggggattcgtatttcgcgcgtttagcgattaattagaaacgttgagggaagatgtgtttaggtatagttaattttagagggtttagagttcgttcgttagttgagggggtgg

SEQ ID NO: 19162 - DNA, 707 bp, Artificial Sequence
  chemically treated genomic DNA (Homo sapiens) CpG-island No: 19162
  misc_feature (394)..(396): n is either a, c, g or t
  misc_feature (412)..(413): n is either a, c, g or t
  misc_feature (433)..(434): n is either a, c, g or t
ccaccccctcaactaacgaacgaactctaaaccctctaaaattaactatacctaaacacatcttccctcaacgtttctaattaatcgctaaacgcgcgaaatacgaatccccattaactaaaccaaaacgcctacgcgacgaaattctcgatcgccaaccattcctaaaaaaaactaccgatcgttcgaacgtcttacctatcgctaaaaaaaaaatccgaactctccaaaaaaataactacgacgacaaaataaaaatattcgtaaacaacgtcgacgaaacgaatacgactccgaaaaaactaacaaccctctttacgccctacgacacgatcataaactacgccgtcataaaacaattcgccttcgtacacatacgcgaaaacgcgaacgnnntacgcgccatcgaaannctacacgaccacgaactacnnccgaaacgcgcgctcgtaataaaaatatcgcgcccaaaacctcttaatacttaaaaaattttcgtaaacaatatatcgactacatacacgaaccaaaaactacgcaacctcttcgaacgccgcgaacgcgtcatcgaatataacgtaataaaaaataacgcgaaaacgcgctcgaaaacgaaaacgcgctcgaaacactctacctattaaccacgccccttacccgaaaatcgatcactacgcgattaaaaaaaataaaaaaatacgcgaaaa

SEQ ID NO: 19163 - DNA, 707 bp, Artificial Sequence
  chemically treated genomic DNA (Homo sapiens) CpG-island No: 19163
  misc_feature (394)..(396): n is either a, c, g or t
  misc_feature (412)..(413): n is either a, c, g or t
  misc_feature (433)..(434): n is either a, c, g or t
ttatttttttagttaacgagcgggttttaggttttttgggattggttgtgtttgagtatatttttttttagcgtttttgattggtcgttggacgcgcgggatgcgagtttttattggttaggttagggcgtttgcgcggcggggttttcggtcgttagttatttttgaggaggattgtcggtcgttcggacgttttgtttgtcgttggaggagaggttcgggttttttaggaaggtggttgcggcgataaaatgaagatattcgtgggtaacgtcgacggggcggatacgatttcggaggagttggtagttttttttgcgttttacggtacggttatgagttgcgtcgttatgaaatagttcgttttcgtgtatatgcgcgagaacgcgggcgnnntgcgcgttatcgaagnnttgtacggttacgagttgtnntcggggcgcgcgttcgtggtggagatgtcgcgtttaaggttttttaatatttggaagattttcgtgggtaatgtgtcggttgtatgtacgagttaggaattgcgtagttttttcgagcgtcgcggacgcgttatcgagtgtgacgtggtgaaaggtaacgcggaggcgcgttcgggggcgggggcgcgttcggggtattttgtttgttagttacgttttttattcgggggtcggttattgcgcggttgggaggggtggggaagtgcgcgggag

SEQ ID NO: 19164 - DNA, 707 bp, Artificial Sequence
  chemically treated genomic DNA (Homo sapiens) CpG-island No: 19164
  misc_feature (274)..(275): n is either a, c, g or t
  misc_feature (295)..(296): n is either a, c, g or t
  misc_feature (312)..(314): n is either a, c, g or t
ctcccgcgcacttccccacccctcccaaccgcgcaataaccgacccccgaataaaaaacgtaactaacaaacaaaataccccgaacgcgcccccgcccccgaacgcgcctccgcgttacctttcaccacgtcacactcgataacgcgtccgcgacgctcgaaaaaactacgcaattcctaactcgtacatacaaccgacacattacccacgaaaatcttccaaatattaaaaaaccttaaacgcgacatctccaccacgaacgcgcgccccgannacaactcgtaaccgtacaanncttcgataacgcgcannncgcccgcgttctcgcgcatatacacgaaaacgaactatttcataacgacgcaactcataaccgtaccgtaaaacgcaaaaaaaactaccaactcctccgaaatcgtatccgccccgtcgacgttacccacgaatatcttcattttatcgccgcaaccaccttcctaaaaaacccgaacctctcctccaacgacaaacaaaacgtccgaacgaccgacaatcctcctcaaaaataactaacgaccgaaaaccccgccgcgcaaacgccctaacctaaccaataaaaactcgcatcccgcgcgtccaacgaccaatcaaaaacgctaaaaaaaaatatactcaaacacaaccaatcccaaaaaacctaaaacccgctcgttaactaaaaaaataa

SEQ ID NO: 19165 - DNA, 1006 bp, Artificial Sequence
  chemically treated genomic DNA (Homo sapiens) CpG-island No: 19165
ggtcgaggcggatttcgaggcggagtcgttgtttgtttgcgtttcgtttgttcggtttatttaatagtttcgttttagattcgtagttgcggaagcggtgggtcgggtggtgattataattttgagcgttgtttttttggaatttgattttcgatttcgtttagtaatcgggaggttgcgattttaaagttttttgtgtttttttatcgatatcgggtcgtttttttcgtttgtagcgtacgttttcgtttttaggggtagcgtagcgaggcggagatttttttgtatttcgagcgtgcggggtagtttttagattgaggatttgcgatttcgtgggacgtcggtgttcgttattgcgtttttttagggagtagaggcggttttggaagtcggtttagggcggagatcgcgattggaggggcgtagaacgttttttttagcgtttcgggttttatcggtataattttaaaattaggggcgaaattcgagttttgtcgttacgcgggggtggagcgtgatcgtttcgtcgcgcgttgttttaggtttcgtcggttttagcgtcgcgaggttgttaggtgagttttagggttttgtggtttttagagcgttttcgggagttttttggttgtagcgggaatcgagttggatgttcggatagcgtcggggtcgtttttttgtttttgtttcgtggtcggagtcgtaggtttgtcgttatttttattcgggttacgtttttttttttcgcggtcggatcgcgttagagtttcgggttttggttggaaattcgtaggtttcgggtagtttgggtcgtaagtgcgatgaagaagcggggttcggcgcgtatatgtggtttcgggtaggagtttcggtcgtttcgtgttttttttttcgtttacgacggtggtcggcggcggtttttgtttttcggatttatgaataaagttggagatgcggttttggagtcggttttgggatttgtttttttttttggtttcggggatcgtag

SEQ ID NO: 19166 - DNA, 1006 bp, Artificial Sequence
  chemically treated genomic DNA (Homo sapiens) CpG-island No: 19166
ctacgatccccgaaaccaaaaaaaaaaacaaatcccaaaaccgactccaaaaccgcatctccaactttattcataaatccgaaaaacaaaaaccgccgccgaccaccgtcgtaaacgaaaaaaaaaacacgaaacgaccgaaactcctacccgaaaccacatatacgcgccgaaccccgcttcttcatcgcacttacgacccaaactacccgaaacctacgaatttccaaccaaaacccgaaactctaacgcgatccgaccgcgaaaaaaaaaaacgtaacccgaataaaaataacgacaaacctacgactccgaccacgaaacaaaaacaaaaaaacgaccccgacgctatccgaacatccaactcgattcccgctacaaccaaaaaactcccgaaaacgctctaaaaaccacaaaaccctaaaactcacctaacaacctcgcgacgctaaaaccgacgaaacctaaaacaacgcgcgacgaaacgatcacgctccacccccgcgtaacgacaaaactcgaatttcgcccctaattttaaaattataccgataaaacccgaaacgctaaaaaaaacgttctacgcccctccaatcgcgatctccgccctaaaccgacttccaaaaccgcctctactccctaaaaaaacgcaataacgaacaccgacgtcccacgaaatcgcaaatcctcaatctaaaaactaccccgcacgctcgaaatacaaaaaaatctccgcctcgctacgctacccctaaaaacgaaaacgtacgctacaaacgaaaaaaacgacccgatatcgataaaaaaacacaaaaaactttaaaatcgcaacctcccgattactaaacgaaatcgaaaatcaaattccaaaaaaacaacgctcaaaattataatcaccacccgacccaccgcttccgcaactacgaatctaaaacgaaactattaaataaaccgaacaaacgaaacgcaaacaaacaacgactccgcctcgaaatccgcctcgacc

SEQ ID NO: 19167 - DNA, 1006 bp, Artificial Sequence
  chemically treated genomic DNA (Homo sapiens) CpG-island No: 19167
ttgcggttttcgaagttaagagaagaagtaggttttagggtcgattttaaagtcgtatttttagttttgtttatgggttcgggaagtagaggtcgtcgtcggttatcgtcgtgggcgagaagaagggtacgaggcggtcggggtttttgttcggaattatatgtgcgcgtcgggtttcgtttttttatcgtatttgcggtttaggttgttcggggtttgcgagtttttagttagggttcgggattttggcgcggttcggtcgcgaggaaggaaggcgtggttcgggtgggggtagcggtaggtttgcggtttcggttacggggtaggggtagaaaaacgatttcggcgttgttcgggtatttagttcggttttcgttgtagttaggagattttcgggagcgttttaggaattatagagttttggaatttatttggtagtttcgcggcgttaaagtcggcggagtttgagatagcgcgcggcgaggcggttacgttttattttcgcgtggcggtaggattcggatttcgtttttggttttaaaattgtgtcggtggagttcgggacgttgggaagagcgttttgcgtttttttagtcgcggttttcgttttaaatcgatttttagagtcgtttttgttttttggaggggcgtagtggcggatatcggcgttttacgaagtcgtaggtttttagtttgagggttgtttcgtacgttcggaatgtaggagggttttcgtttcgttgcgttgtttttgggggcggaggcgtgcgttgtaggcgagagaggcggttcggtatcgatggagaagtatagagggttttgaggtcgtaatttttcggttgttgagcggagtcgggagttaggttttaaagggatagcgtttagggttgtaattattattcggtttatcgttttcgtagttgcgagtttagggcggagttgttgggtggatcgagtaggcgaggcgtaggtaggtagcggtttcgtttcggaattcgtttcgatt

SEQ ID NO: 19168 - DNA, 1006 bp, Artificial Sequence
  chemically treated genomic DNA (Homo sapiens) CpG-island No: 19168
aatcgaaacgaattccgaaacgaaaccgctacctacctacgcctcgcctactcgatccacccaacaactccgccctaaactcgcaactacgaaaacgataaaccgaataataattacaaccctaaacgctatccctttaaaacctaactcccgactccgctcaacaaccgaaaaattacgacctcaaaaccctctatacttctccatcgataccgaaccgcctctctcgcctacaacgcacgcctccgcccccaaaaacaacgcaacgaaacgaaaaccctcctacattccgaacgtacgaaacaaccctcaaactaaaaacctacgacttcgtaaaacgccgatatccgccactacgcccctccaaaaaacaaaaacgactctaaaaatcgatttaaaacgaaaaccgcgactaaaaaaacgcaaaacgctcttcccaacgtcccgaactccaccgacacaattttaaaaccaaaaacgaaatccgaatcctaccgccacgcgaaaataaaacgtaaccgcctcgccgcgcgctatctcaaactccgccgactttaacgccgcgaaactaccaaataaattccaaaactctataattcctaaaacgctcccgaaaatctcctaactacaacgaaaaccgaactaaatacccgaacaacgccgaaatcgtttttctacccctaccccgtaaccgaaaccgcaaacctaccgctacccccacccgaaccacgccttccttcctcgcgaccgaaccgcgccaaaatcccgaaccctaactaaaaactcgcaaaccccgaacaacctaaaccgcaaatacgataaaaaaacgaaacccgacgcgcacatataattccgaacaaaaaccccgaccgcctcgtacccttcttctcgcccacgacgataaccgacgacgacctctacttcccgaacccataaacaaaactaaaaatacgactttaaaatcgaccctaaaacctacttcttctcttaacttcgaaaaccgcaa

SEQ ID NO: 19169 - DNA, 1024 bp, Artificial Sequence
  chemically treated genomic DNA (Homo sapiens) CpG-island No: 19169
  misc_feature (932)..(932): n is either a, c, g or t
cgtcggcgggaagggggtagttcggggcgttcggcggttttaggggttgattttcgttcggaagtgcgcgtagggtttacggcgtaagggcgtttgtcgcgtttagtcgtcgtcgttcgggtcgtttatttcgcggggcgtttttcgtagattagcgtcgttcgttcggattcgttcgcgtagatttttcgggcggattgaggatcgttcgttcggggtcgtttttgtgttcgtttttagcgttcgtttagttcgtcgttcgcgtttcggtggcgggttcgacgttcgtatttcgttcgtgtttaggcgtagagttttcgtttcggggagttttttggtcgtcggcgggtttcgcggttcgcgcgttgggcgttttgtttgtcgggtagaggggaaggcggcggtcggttggggatgggcggttcggttgcgtcgaggggcgtcgggaggtttcgcgcgttgttgttggcgttggtggtcgcggggattttcgcgggcgtttataattttgattcgtagcgtttcgtgtatttttagggtttcgttgattcgtttttcggttacgtagttttggagtatttttacgataatacgcgttggtgagtgttcgttcgatttcgcgattttggttcgcgcggttatcgtttcggtttttaggttagcgtcgtcgtcgttttttcggttttttttacgtcgtcgtttcgagggggcgatttaaatgtttttcgttgcgcgcggttcggtcgtcgggggacggcgggagaagggaggacgtcgttcggggttcgttaaggtcggggtcggcgtttggaggcgggcgggggcgttcgggtgtttttttggggttttagtttagagcgtggggggagagtcgttaaagttgtttttttcgtcgtttagttaaattcggttttattttttgaatcgaaaantaatttggtttttttgttttcgggcggtcgtcgttggtttagcgagttttttgaatttcgtagggtttggaggagtcggggtattggagttg

SEQ ID NO: 19170 - DNA, 1024 bp, Artificial Sequence
  chemically treated genomic DNA (Homo sapiens) CpG-island No: 19170
  misc_feature (93)..(93): n is either a, c, g or t
caactccaataccccgactcctccaaaccctacgaaattcaaaaaactcgctaaaccaacgacgaccgcccgaaaacaaaaaaaccaaattanttttcgattcaaaaaataaaaccgaatttaactaaacgacgaaaaaaacaactttaacgactctccccccacgctctaaactaaaaccccaaaaaaacacccgaacgcccccgcccgcctccaaacgccgaccccgaccttaacgaaccccgaacgacgtcctcccttctcccgccgtcccccgacgaccgaaccgcgcgcaacgaaaaacatttaaatcgccccctcgaaacgacgacgtaaaaaaaaccgaaaaaacgacgacgacgctaacctaaaaaccgaaacgataaccgcgcgaaccaaaatcgcgaaatcgaacgaacactcaccaacgcgtattatcgtaaaaatactccaaaactacgtaaccgaaaaacgaatcaacgaaaccctaaaaatacacgaaacgctacgaatcaaaattataaacgcccgcgaaaatccccgcgaccaccaacgccaacaacaacgcgcgaaacctcccgacgcccctcgacgcaaccgaaccgcccatccccaaccgaccgccgccttcccctctacccgacaaacaaaacgcccaacgcgcgaaccgcgaaacccgccgacgaccaaaaaactccccgaaacgaaaactctacgcctaaacacgaacgaaatacgaacgtcgaacccgccaccgaaacgcgaacgacgaactaaacgaacgctaaaaacgaacacaaaaacgaccccgaacgaacgatcctcaatccgcccgaaaaatctacgcgaacgaatccgaacgaacgacgctaatctacgaaaaacgccccgcgaaataaacgacccgaacgacgacgactaaacgcgacaaacgcccttacgccgtaaaccctacgcgcacttccgaacgaaaatcaacccctaaaaccgccgaacgccccgaactacccccttcccgccgacg

SEQ ID NO: 19171 - DNA, 1024 bp, Artificial Sequence
  chemically treated genomic DNA (Homo sapiens) CpG-island No: 19171
  misc_feature (93)..(93): n is either a, c, g or t
tagttttagtgtttcgatttttttaggttttgcgaggtttaggaggttcgttgggttagcggcggtcgttcggaggtagaggagttaagttanttttcgatttagagagtgaagtcgagtttagttgggcggcggaggagataattttagcggttttttttttacgttttgggttgggattttagggaggtattcggacgttttcgttcgtttttaggcgtcgatttcgattttagcgggtttcggacggcgtttttttttttttcgtcgtttttcggcggtcgagtcgcgcgtaacggagaatatttaaatcgttttttcgggacggcggcgtggaagagatcggaaaggcggcggcggcgttggtttgggggtcggggcggtggtcgcgcgggttagggtcgcggagtcgggcgggtatttattagcgcgtgttgtcgtggaaatgttttagaattgcgtagtcgaagaacgagttagcggggttttggaagtgtacggggcgttgcgggttaaggttgtaggcgttcgcggggattttcgcgattattagcgttagtagtagcgcgcggagtttttcggcgtttttcggcgtagtcgggtcgtttatttttagtcggtcgtcgtttttttttttgttcggtaagtagggcgtttagcgcgcgggtcgcggggttcgtcgacggttaggaagtttttcggggcgggagttttgcgtttggatacgggcggaatgcgggcgtcgggttcgttatcggggcgcggacggcgggttgagcgggcgttgaaggcgagtataggggcggtttcgagcgggcggtttttagttcgttcgagaagtttgcgcgagcgggttcgggcgggcggcgttggtttgcggagggcgtttcgcgaggtgggcggttcgggcggcggcggttggacgcggtaggcgtttttgcgtcgtgagttttgcgcgtattttcgggcgggagttagtttttgggatcgtcgggcgtttcgaattgtttttttttcgtcgacg

SEQ ID NO: 19172 - DNA, 1024 bp, Artificial Sequence
  chemically treated genomic DNA (Homo sapiens) CpG-island No: 19172
  misc_feature (932)..(932): n is either a, c, g or t
cgtcgacgaaaaaaaaacaattcgaaacgcccgacgatcccaaaaactaactcccgcccgaaaatacgcgcaaaactcacgacgcaaaaacgcctaccgcgtccaaccgccgccgcccgaaccgcccacctcgcgaaacgccctccgcaaaccaacgccgcccgcccgaacccgctcgcgcaaacttctcgaacgaactaaaaaccgcccgctcgaaaccgcccctatactcgccttcaacgcccgctcaacccgccgtccgcgccccgataacgaacccgacgcccgcattccgcccgtatccaaacgcaaaactcccgccccgaaaaacttcctaaccgtcgacgaaccccgcgacccgcgcgctaaacgccctacttaccgaacaaaaaaaaaaacgacgaccgactaaaaataaacgacccgactacgccgaaaaacgccgaaaaactccgcgcgctactactaacgctaataatcgcgaaaatccccgcgaacgcctacaaccttaacccgcaacgccccgtacacttccaaaaccccgctaactcgttcttcgactacgcaattctaaaacatttccacgacaacacgcgctaataaatacccgcccgactccgcgaccctaacccgcgcgaccaccgccccgacccccaaaccaacgccgccgccgcctttccgatctcttccacgccgccgtcccgaaaaaacgatttaaatattctccgttacgcgcgactcgaccgccgaaaaacgacgaaaaaaaaaaaaacgccgtccgaaacccgctaaaatcgaaatcgacgcctaaaaacgaacgaaaacgtccgaatacctccctaaaatcccaacccaaaacgtaaaaaaaaaaccgctaaaattatctcctccgccgcccaactaaactcgacttcactctctaaatcgaaaantaacttaactcctctacctccgaacgaccgccgctaacccaacgaacctcctaaacctcgcaaaacctaaaaaaatcgaaacactaaaacta

SEQ ID NO: 19173 - DNA, 856 bp, Artificial Sequence
  chemically treated genomic DNA (Homo sapiens) CpG-island No: 19173
tcgtcgcggttttttgtttgtttcggttttttgtttcgtcgtcgtcgcggttttttgttttttattttcgtcgttgcggttttttattcgtcgcggttttttgttttttcgtcgtcgtggttttttttttttattttattttcgttttttgttcgtcgcggttttttgtttttatttcgtttcggttttttgttagttacggttttttgtttttcgtcgttgcggttttttttttatcgcggttttttgtttttcgttatcgcggttttttgtttttcgtcgtcgcgattttttttttgtcgcggttttttattttttgtcgtcgtggttttttgtttttatttcgtttcggttttttgtttttatttcgtttcggttttttgtttttatttcgtttcggttttttgttcgtttcggtttttggtttttcgtcgtcgttgttttttgtttttcgtcgacgcggttttttgttggttacggttttttatttttcgtcgcggttttttgttttttattacgtcgcggttttttataatttttttatttttcgttttcgcggttttttgcgttttcgttattttcgttttttgttttttcgtcgtcgcggttttttgtcgtcgcggatttttgtatattcgtcgtcgtggttttttgcgttttcgtcgttgcggttttttggtcgttttaggtttttgttatttcgtcgttgcggtttttttttcgcggtggttttttattttttgttttcgcggttttttattcgtttcggttgtttgtttttatttcgtttcggttttttgttcgatacggttttttgtattttttttttttttgtaattttaattttatttgaaat

SEQ ID NO: 19174 - DNA, 856 bp, Artificial Sequence
  chemically treated genomic DNA (Homo sapiens) CpG-island No: 19174
atttcaaataaaattaaaattacaaaaaaaaaaaaaatacaaaaaaccgtatcgaacaaaaaaccgaaacgaaataaaaacaaacaaccgaaacgaataaaaaaccgcgaaaacaaaaaataaaaaaccaccgcgaaaaaaaaaccgcaacgacgaaataacaaaaacctaaaacgaccaaaaaaccgcaacgacgaaaacgcaaaaaaccacgacgacgaatatacaaaaatccgcgacgacaaaaaaccgcgacgacgaaaaaacaaaaaacgaaaataacgaaaacgcaaaaaaccgcgaaaacgaaaaataaaaaaattataaaaaaccgcgacgtaataaaaaacaaaaaaccgcgacgaaaaataaaaaaccgtaaccaacaaaaaaccgcgtcgacgaaaaacaaaaaacaacgacgacgaaaaaccaaaaaccgaaacgaacaaaaaaccgaaacgaaataaaaacaaaaaaccgaaacgaaataaaaacaaaaaaccgaaacgaaataaaaacaaaaaaccacgacgacaaaaaataaaaaaccgcgacaaaaaaaaaatcgcgacgacgaaaaacaaaaaaccgcgataacgaaaaacaaaaaaccgcgataaaaaaaaaaccgcaacgacgaaaaacaaaaaaccgtaactaacaaaaaaccgaaacgaaataaaaacaaaaaaccgcgacgaacaaaaaacgaaaataaaataaaaaaaaaaaaccacgacgacgaaaaaacaaaaaaccgcgacgaataaaaaaccgcaacgacgaaaataaaaaacaaaaaaccgcgacgacgacgaaacaaaaaaccgaaacaaacaaaaaaccgcgacga

SEQ ID NO: 19175 - DNA, 856 bp, Artificial Sequence
  chemically treated genomic DNA (Homo sapiens) CpG-island No: 19175
attttaagtgaaattaaggttgtaaaggaggggggggtgtaaaaagtcgtgtcgggtaaaaagtcgaggcggggtgggggtaaatagtcgaggcgggtaaaaagtcgcgggggtagggggtaaaaagttatcgcggggaaaaagtcgtagcggcggggtggtaaaaatttggggcggttaaaaagtcgtagcggcgggggcgtaaaaagttacggcggcgggtgtgtaaaaattcgcggcgataaaaagtcgcggcggcggaggggtaaaaagcggaggtggcggggacgtaaaaagtcgcgggagcggggggtgggggggttgtaaaaagtcgcggcgtggtggggggtaaaaagtcgcggcggggggtaaaaagtcgtggttagtaaaaagtcgcgtcggcgggggataaaaagtagcggcggcggggggttaaaagtcgaggcgggtaaaaagtcgaggcggggtgggggtaaaaagtcgaggcggggtgggggtaaaaagtcgaggcggggtgggggtaaaaagttacggcggtagggggtaaaaagtcgcggtaggaaaaaagtcgcggcggcgggggataaaaagtcgcggtggcgggggataaaaagtcgcggtggggaaaaagtcgtagcggcggggggtaaaaagtcgtggttggtaaaaagtcgaggcggggtgggggtaaaaagtcgcggcgggtaaaaagcggaggtgagatggggggaaaaaattacggcggcgggggggtaaaaagtcgcggcgggtaaaaagtcgtagcggcgggggtggggggtaaaaagtcgcggcggcggcggagtaaaaagtcggggtaggtaaaaagtcgcggcgg

SEQ ID NO: 19176 - DNA, 856 bp, Artificial Sequence
  chemically treated genomic DNA (Homo sapiens) CpG-island No: 19176
ccgccgcgactttttacctaccccgactttttactccgccgccgccgcgactttttaccccccacccccgccgctacgactttttacccgccgcgactttttacccccccgccgccgtaattttttccccccatctcacctccgctttttacccgccgcgactttttacccccaccccgcctcgactttttaccaaccacgactttttaccccccgccgctacgactttttccccaccgcgactttttatcccccgccaccgcgactttttatcccccgccgccgcgacttttttcctaccgcgactttttaccccctaccgccgtaactttttacccccaccccgcctcgactttttacccccaccccgcctcgactttttacccccaccccgcctcgactttttacccgcctcgacttttaaccccccgccgccgctactttttatcccccgccgacgcgactttttactaaccacgactttttaccccccgccgcgactttttaccccccaccacgccgcgactttttacaacccccccaccccccgctcccgcgactttttacgtccccgccacctccgctttttacccctccgccgccgcgactttttatcgccgcgaatttttacacacccgccgccgtaactttttacgcccccgccgctacgactttttaaccgccccaaatttttaccaccccgccgctacgactttttccccgcgataactttttaccccctacccccgcgactttttacccgcctcgactatttacccccaccccgcctcgactttttacccgacacgactttttacacccccccctcctttacaaccttaatttcacttaaaat

SEQ ID NO: 19177 - DNA, 765 bp, Artificial Sequence
  chemically treated genomic DNA (Homo sapiens) CpG-island No: 19177
tcgtcgcggttttttgtttgtttcggttttttgttttttcgtcgtcgcggttttttgttttttattttcgtcgttgcggttttttattcgtcgcggttttttgttttttcgtcgtcgtggttttttttttttattttattttcgttttttgttcgtcgtggttttttgtttttattttatttcggttttttgttagttacggttttttttttatcgcggttttttatttttcgttatcgcggttttttattttttgtcgtcgtggttttttgtttttatttcgtttcggttttttgttcgtttcggtttttggttttttttcgtcgttgttttttgtttttcgtcgacgcggttttttgttggtcgcggttttttatttttcgtcgcggttttttgttttttattacgtcgcggttttttataatttttttatttttcgttttcgcggttttttgcgttttcgttatttcggttttttgttttttcgtcgtcgcggttttttgtcgtcgcggatttttgtatattcgtcgtcgtggttttttgcgttttcgtcgttgcggttttttggtcgttttaggtttttgttatttcgtcgttgcggtttttttttcgcggtggttttttattttttgttttcgcggttttttattcgtcgtggttgtttgtttttatttcgtttcggttttttgttcgatacggttttttgtttcgtcgcggttttttgtatttttttttttttttgtaattttaattttatttgaaatt

SEQ ID NO: 19178 - DNA, 765 bp, Artificial Sequence
  chemically treated genomic DNA (Homo sapiens) CpG-island No: 19178
aatttcaaataaaattaaaattacaaaaaaaaaaaaaaatacaaaaaaccgcgacgaaacaaaaaaccgtatcgaacaaaaaaccgaaacgaaataaaaacaaacaaccacgacgaataaaaaaccgcgaaaacaaaaaataaaaaaccaccgcgaaaaaaaaaccgcaacgacgaaataacaaaaacctaaaacgaccaaaaaaccgcaacgacgaaaacgcaaaaaaccacgacgacgaatatacaaaaatccgcgacgacaaaaaaccgcgacgacgaaaaaacaaaaaaccgaaataacgaaaacgcaaaaaaccgcgaaaacgaaaaataaaaaaattataaaaaaccgcgacgtaataaaaaacaaaaaaccgcgacgaaaaataaaaaaccgcgaccaacaaaaaaccgcgtcgacgaaaaacaaaaaacaacgacgaaaaaaaaccaaaaaccgaaacgaacaaaaaaccgaaacgaaataaaaacaaaaaaccacgacgacaaaaaataaaaaaccgcgataacgaaaaataaaaaaccgcgataaaaaaaaaaccgtaactaacaaaaaaccgaaataaaataaaaacaaaaaaccacgacgaacaaaaaacgaaaataaaataaaaaaaaaaaaccacgacgacgaaaaaacaaaaaaccgcgacgaataaaaaaccgcaacgacgaaaataaaaaacaaaaaaccgcgacgacgaaaaaacaaaaaaccgaaacaaacaaaaaaccgcgacga

SEQ ID NO: 19179 - DNA, 765 bp, Artificial Sequence
  chemically treated genomic DNA (Homo sapiens) CpG-island No: 19179
gattttaagtgaaattaaggttgtaaaggagggggggggtgtaaaaagtcgcggcggggtaaaaagtcgtgtcgggtaaaaagtcgaggcggggtgggggtaaatagttacggcgggtaaaaagtcgcgggggtagggggtaaaaagttatcgcggggaaaaagtcgtagcggcggggtggtaaaaatttggggcggttaaaaagtcgtagcggcgggggcgtaaaaagttacggcggcgggtgtgtaaaaattcgcggcgataaaaagtcgcggcggcggaggggtaaaaagtcgaggtggcggggacgtaaagagtcgcgggagcggggggtgggggggttgtaaaaagtcgcggcgtggtggggggtaaaaagtcgcggcggggggtaaaaagtcgcggttagtaaaaagtcgcgtcggcgggggataaaaagtagcggcgggggggggttaaaagtcgaggcgggtaaaaagtcgaggcggggtgggggtaaaaagttacggcggtagggggtaaaaagtcgcggtggcgggggataaaaagtcgcggtggggaaaaagtcgtggttggtaaaaagtcgaggtggggtgggggtaaaaagttacggcgggtaaaaagcggaggtgagatggggggaaaaaattacggcggcgggggggtaaaaagtcgcggcgggtaaaaagtcgtagcggcgggggtggggggtaaaaagtcgcggcggcgggggagtaaaaagtcggggtaggtaaaaagtcgcggcgg

SEQ ID NO: 19180 - DNA, 765 bp, Artificial Sequence
  chemically treated genomic DNA (Homo sapiens) CpG-island No: 19180
ccgccgcgactttttacctaccccgactttttactcccccgccgccgcgactttttaccccccacccccgccgctacgactttttacccgccgcgactttttacccccccgccgccgtaattttttccccccatctcacctccgctttttacccgccgtaactttttacccccaccccacctcgactttttaccaaccacgactttttccccaccgcgactttttatcccccgccaccgcgactttttaccccctaccgccgtaactttttacccccaccccgcctcgactttttacccgcctcgacttttaacccccccccgccgctactttttatcccccgccgacgcgactttttactaaccgcgactttttaccccccgccgcgactttttaccccccaccacgccgcgactttttacaacccccccaccccccgctcccgcgactctttacgtccccgccacctcgactttttacccctccgccgccgcgactttttatcgccgcgaatttttacacacccgccgccgtaactttttacgcccccgccgctacgactttttaaccgccccaaatttttaccaccccgccgctacgactttttccccgcgataactttttaccccctacccccgcgactttttacccgccgtaactatttacccccaccccgcctcgactttttacccgacacgactttttaccccgccgcgactttttacaccccccccctcctttacaaccttaatttcacttaaaatc

SEQ ID NO: 19181 - DNA, 955 bp, Artificial Sequence
  chemically treated genomic DNA (Homo sapiens) CpG-island No: 19181
  misc_feature (223)..(223): n is either a, c, g or t
  misc_feature (235)..(235): n is either a, c, g or t
  misc_feature (243)..(243): n is either a, c, g or t
  misc_feature (384)..(384): n is either a, c, g or t
  misc_feature (396)..(397): n is either a, c, g or t
  misc_feature (403)..(403): n is either a, c, g or t
  misc_feature (413)..(413): n is either a, c, g or t
  misc_feature (449)..(449): n is either a, c, g or t
  misc_feature (494)..(495): n is either a, c, g or t
  misc_feature (901)..(903): n is either a, c, g or t
  misc_feature (911)..(911): n is either a, c, g or t
  misc_feature (944)..(944): n is either a, c, g or t
tttatttaattgtttcgggttttcgcgcgcgcggtcgttttttttcgttttttatttattttgtgtyggtttcgtttttyttttttttattaggcgagtaggcgagcgggtagagttcgcggcggaggtcggttttcgggtcgggatatatttattcgttcgtttttttttttttttttttttttttttttttttttttttttttttttcgttttttcgttynttcgttyatgtntgtttttntttttttgttcgttcgttttcgtttttagcggcgtcgggtttttcgtttcgtttttttcgtgcgcggttttttcgggcgcggtttcggggtttatggtgacgaggcggcggtcgttcgagtttagcggcggcgggcggcgngarttggggcgnngggttngggtcgtttnttttarartacgcggggtcgggcggygggcgcgttnaggtagcggttgtragcgttttttcgygtcgcgttttcgcgtttnncgcgtcgcgttttcgcgcgtttggtttgcggggggtcgggtttgcgggcggtcgtcgcgtcgcgtatttatggacggttcggttattattatttaggtgattaatttttcggaggacgagggtcggttgtcgggcgcgggcgagaaaggtgaggaggggcgtaggcggtcgcgggttgggggcgagcgtatatttcgcgtcgttggagtttattgtcgggcgtcggtatgggtttgggggaggggtgtatagggttcggagggtgcgtgggtgtgggtgcgttcggaggagagcgaggttgttagagtgcgtgtgtcgattgagttagtgtgagtgtgtaggggttcgcgaagagattgggagcgagtgtgtgtgtatttaatcgggaggttgtgagtttgtgtgnnnacgttcgnagagaagttgtgagtttgtgtgtgtatttaatntagaggtttta

SEQ ID NO: 19182 - DNA, 955 bp, Artificial Sequence
  chemically treated genomic DNA (Homo sapiens) CpG-island No: 19182
  misc_feature (12)..(12): n is either a, c, g or t
  misc_feature (45)..(45): n is either a, c, g or t
  misc_feature (53)..(55): n is either a, c, g or t
  misc_feature (461)..(462): n is either a, c, g or t
  misc_feature (507)..(507): n is either a, c, g or t
  misc_feature (543)..(543): n is either a, c, g or t
  misc_feature (553)..(553): n is either a, c, g or t
  misc_feature (559)..(560): n is either a, c, g or t
  misc_feature (572)..(572): n is either a, c, g or t
  misc_feature (713)..(713): n is either a, c, g or t
  misc_feature (721)..(721): n is either a, c, g or t
  misc_feature (733)..(733): n is either a, c, g or t
taaaacctctanattaaatacacacacaaactcacaacttctctncgaacgtnnncacacaaactcacaacctcccgattaaatacacacacactcgctcccaatctcttcgcgaacccctacacactcacactaactcaatcgacacacgcactctaacaacctcgctctcctccgaacgcacccacacccacgcaccctccgaaccctatacacccctcccccaaacccataccgacgcccgacaataaactccaacgacgcgaaatatacgctcgcccccaacccgcgaccgcctacgcccctcctcacctttctcgcccgcgcccgacaaccgaccctcgtcctccgaaaaattaatcacctaaataataataaccgaaccgtccataaatacgcgacgcgacgaccgcccgcaaacccgaccccccgcaaaccaaacgcgcgaaaacgcgacgcgnnaaacgcgaaaacgcgacrcgaaaaaacgctyacaaccgctacctnaacgcgcccrccgcccgaccccgcgtaytytaaaanaaacgacccnaacccnncgccccaaytcncgccgcccgccgccgctaaactcgaacgaccgccgcctcgtcaccataaaccccgaaaccgcgcccgaaaaaaccgcgcacgaaaaaaacgaaacgaaaaacccgacgccgctaaaaacgaaaacgaacgaacaaaaaaanaaaaacanacatraacgaanraacgaaaaaacgaaaaaaaaaaaaaaaaaaaaaaaaaaaaaaaaaaaaaaaaaaaaaaacgaacgaataaatatatcccgacccgaaaaccgacctccgccgcgaactctacccgctcgcctactcgcctaataaaaaaaaraaaaacgaaaccracacaaaataaataaaaaacgaaaaaaaacgaccgcgcgcgcgaaaacccgaaacaattaaataaa

SEQ ID NO: 19183 - DNA, 955 bp, Artificial Sequence
  chemically treated genomic DNA (Homo sapiens) CpG-island No: 19183
  misc_feature (12)..(12): n is either a, c, g or t
  misc_feature (45)..(45): n is either a, c, g or t
  misc_feature (53)..(55): n is either a, c, g or t
  misc_feature (461)..(462): n is either a, c, g or t
  misc_feature (507)..(507): n is either a, c, g or t
  misc_feature (543)..(543): n is either a, c, g or t
  misc_feature (553)..(553): n is either a, c, g or t
  misc_feature (559)..(560): n is either a, c, g or t
  misc_feature (572)..(572): n is either a, c, g or t
  misc_feature (713)..(713): n is either a, c, g or t
  misc_feature (721)..(721): n is either a, c, g or t
  misc_feature (733)..(733): n is either a, c, g or t
tagaatttttgngttaggtgtatatataggtttataatttttttncgggcgtnnntatataaatttataatttttcggttagatgtatatatattcgtttttagttttttcgcgagtttttgtatatttatattggtttagtcggtatacgtattttggtagtttcgttttttttcgggcgtatttatatttacgtatttttcgggttttgtgtattttttttttaggtttatgtcggcgttcggtagtgaattttagcggcgcggggtgtgcgttcgtttttagttcgcggtcgtttgcgtttttttttatttttttcgttcgcgttcggtaatcggttttcgtttttcggggggttggttatttgggtgatgatggtcgggtcgtttatgggtgcgcggcgcggcggtcgttcgtaggttcggtttttcgtaagttaagcgcgcgggggcgcggcgcgnngggcgcgggggcgcggtrcgggggggcgttygtagtcgttgtttnggcgcgtttrtcgttcggtttcgcgtaytytggganaggcggtttnggtttnncgttttagyttncgtcgttcgtcgtcgttgggttcgagcggtcgtcgtttcgttattatgaatttcggagtcgcgttcgggagagtcgcgtacgggggaggcggagcgggaggttcggcgtcgttggaaacgggagcgggcgggtagaggggnagggatanatatrggcgggnrggcgggaaggcggggagagagggagggaaggagaaaggaagggagggaaagaagaagggcgggcgggtgggtgtgtttcggttcggggatcggttttcgtcgcgggttttgttcgttcgtttgttcgtttggtgggggagargggagcggggttratatagggtgagtggagggcgggagggggcggtcgcgcgcgcgggggttcggggtagttgagtggg

SEQ ID NO: 19184 - DNA, 955 bp, Artificial Sequence
  chemically treated genomic DNA (Homo sapiens) CpG-island No: 19184
  misc_feature (223)..(223): n is either a, c, g or t
  misc_feature (235)..(235): n is either a, c, g or t
  misc_feature (243)..(243): n is either a, c, g or t
  misc_feature (384)..(384): n is either a, c, g or t
  misc_feature (396)..(397): n is either a, c, g or t
  misc_feature (403)..(403): n is either a, c, g or t
  misc_feature (413)..(413): n is either a, c, g or t
  misc_feature (449)..(449): n is either a, c, g or t
  misc_feature (494)..(495): n is either a, c, g or t
  misc_feature (901)..(903): n is either a, c, g or t
  misc_feature (911)..(911): n is either a, c, g or t
  misc_feature (944)..(944): n is either a, c, g or t
cccactcaactaccccgaacccccgcgcgcgcgaccgccccctcccgccctccactcaccctatatyaaccccgctcccytctcccccaccaaacgaacaaacgaacgaacaaaacccgcgacgaaaaccgatccccgaaccgaaacacacccacccgcccgcccttcttctttccctcccttcctttctccttccctccctctctccccgccttcccgccyncccgccyatatntatccctncccctctacccgcccgctcccgtttccaacgacgccgaacctcccgctccgcctcccccgtacgcgactctcccgaacgcgactccgaaattcataataacgaaacgacgaccgctcgaacccaacgacgacgaacgacgnaarctaaaacgnnaaaccnaaaccgcctntcccarartacgcgaaaccgaacgayaaacgcgccnaaacaacgactacraacgcccccccgyaccgcgcccccgcgcccnncgcgccgcgcccccgcgcgcttaacttacgaaaaaccgaacctacgaacgaccgccgcgccgcgcacccataaacgacccgaccatcatcacccaaataaccaaccccccgaaaaacgaaaaccgattaccgaacgcgaacgaaaaaaataaaaaaaaacgcaaacgaccgcgaactaaaaacgaacgcacaccccgcgccgctaaaattcactaccgaacgccgacataaacctaaaaaaaaaatacacaaaacccgaaaaatacgtaaatataaatacgcccgaaaaaaaacgaaactaccaaaatacgtataccgactaaaccaatataaatatacaaaaactcgcgaaaaaactaaaaacgaatatatatacatctaaccgaaaaattataaatttatatannnacgcccgnaaaaaaattataaacctatatatacacctaacncaaaaattcta

SEQ ID NO: 19185 - DNA, 599 bp, Artificial Sequence
  chemically treated genomic DNA (Homo sapiens) CpG-island No: 19185
  misc_feature (371)..(371): n is either a, c, g or t
  misc_feature (387)..(388): n is either a, c, g or t
  misc_feature (460)..(460): n is either a, c, g or t
aggtcgaggataggacgtgggttgggcgggtagtgcggattcggaggagtaggaggcgaggttcgcggagttttgagttttcgttgttttgtcgcgcggtgatttcgtttcgcgtcgtttcgattcgtggttgtttcgagacgattggtgggggcgcggcgggcggcgcggttgttgggggtgggagacgcggcgaggagacgagcgaggttagcgagtttgagggaggatcgcgagtttgtcgtcgttatgttcgaggattcgagcgttttgttttggtttattaatagggacgattacgagttgtaggaggtratcggtgagagtaggcgttgcggaggggggagrcgcggcgttgggaggcggggranacgggaacgtgggganncgcgggagttcggggagcgtagtttttataggaattcgtggggcgtttgtggggttgggggtttgtaggatntttgtgtcgaggagcgcgtgtgagacgggaagggggttttgaggcgcgcgtttgtgaggtggcgtggggtggggtgaggtttgagggggtttaggagagatttgtgtataggatttttaaatgtgtggataggagcggt

SEQ ID NO: 19186 - DNA, 599 bp, Artificial Sequence
  chemically treated genomic DNA (Homo sapiens) CpG-island No: 19186
  misc_feature (140)..(140): n is either a, c, g or t
  misc_feature (212)..(213): n is either a, c, g or t
  misc_feature (229)..(229): n is either a, c, g or t
accgctcctatccacacatttaaaaatcctatacacaaatctctcctaaaccccctcaaacctcaccccaccccacgccacctcacaaacgcgcgcctcaaaacccccttcccgtctcacacgcgctcctcgacacaaanatcctacaaacccccaaccccacaaacgccccacgaattcctataaaaactacgctccccgaactcccgcgnntccccacgttcccgtntyccccgcctcccaacgccgcgyctcccccctccgcaacgcctactctcaccgatyacctcctacaactcgtaatcgtccctattaataaaccaaaacaaaacgctcgaatcctcgaacataacgacgacaaactcgcgatcctccctcaaactcgctaacctcgctcgtctcctcgccgcgtctcccacccccaacaaccgcgccgcccgccgcgcccccaccaatcgtctcgaaacaaccacgaatcgaaacgacgcgaaacgaaatcaccgcgcgacaaaacaacgaaaactcaaaactccgcgaacctcgcctcctactcctccgaatccgcactacccgcccaacccacgtcctatcctcgacct

SEQ ID NO: 19187 - DNA, 599 bp, Artificial Sequence
  chemically treated genomic DNA (Homo sapiens) CpG-island No: 19187
  misc_feature (140)..(140): n is either a, c, g or t
  misc_feature (212)..(213): n is either a, c, g or t
  misc_feature (229)..(229): n is either a, c, g or t
gtcgtttttgtttatatatttgagaattttgtatataaattttttttgagtttttttaagttttattttattttacgttattttataggcgcgcgttttaaaatttttttttcgttttatacgcgtttttcgatataagngttttataagtttttagttttataagcgttttacgaatttttatgagggttgcgtttttcgagttttcgcgnntttttacgttttcgtntytttcgttttttagcgtcgcgyttttttttttcgtagcgtttgtttttatcgatyattttttgtagttcgtaatcgtttttgttgatggattagggtagggcgttcgagttttcggatatgacggcggtaggttcgcggtttttttttaaattcgttgatttcgttcgttttttcgtcgcgttttttatttttaatagtcgcgtcgttcgtcgcgtttttattaatcgtttcggaatagttacgggtcggaacggcgcggggcggggttatcgcgcggtagagtagcgggggtttagagtttcgcggatttcgttttttgttttttcgagttcgtattgttcgtttagtttacgttttgttttcggttt

SEQ ID NO: 19188 - DNA, 599 bp, Artificial Sequence
  chemically treated genomic DNA (Homo sapiens) CpG-island No: 19188
  misc_feature (371)..(371): n is either a, c, g or t
  misc_feature (387)..(388): n is either a, c, g or t
  misc_feature (460)..(460): n is either a, c, g or t
aaaccgaaaacaaaacgtaaactaaacgaacaatacgaactcgaaaaaacaaaaaacgaaatccgcgaaactctaaacccccgctactctaccgcgcgataaccccgccccgcgccgttccgacccgtaactattccgaaacgattaataaaaacgcgacgaacgacgcgactattaaaaataaaaaacgcgacgaaaaaacgaacgaaatcaacgaatttaaaaaaaaaccgcgaacctaccgccgtcatatccgaaaactcgaacgccctaccctaatccatcaacaaaaacgattacgaactacaaaaaatratcgataaaaacaaacgctacgaaaaaaaaaarcgcgacgctaaaaaacgaaaranacgaaaacgtaaaaanncgcgaaaactcgaaaaacgcaaccctcataaaaattcgtaaaacgcttataaaactaaaaacttataaaacncttatatcgaaaaacgcgtataaaacgaaaaaaaaattttaaaacgcgcgcctataaaataacgtaaaataaaataaaacttaaaaaaactcaaaaaaaatttatatacaaaattctcaaatatataaacaaaaacgac

SEQ ID NO: 19189 - DNA, 1051 bp, Artificial Sequence
  chemically treated genomic DNA (Homo sapiens) CpG-island No: 19189
attttcgttcgcgcgtttcgttttgttttttagtaagttggtgtacgcgcgtttttttatagggcgcgggatgggggcggggttttcgtgttgttgtttttttggggtttcgttttttaggggggcgcggattacgcggtcggagggttcgtttttttttttttttttcgtttagttcgttcgtttttttgtatttaatattcgggttttttcgttggttcggtttcgtggtcgtcgtttaggatttattttggattcggtttagttttttttttttttattttttttttcgtttatggttttttcggattcggtttttgcgttcggggttcgggtttagtttcgtcgcgttatgtttgagtcgggcgcgtttcggttttcgcgtcgtttcggagttcgggtcgtagtttgcgtcgttcgtagcggttttgagttcggtttcgtcgatcggtttttggagttcgaacgttgttcggggacgaaggcgtaggaagcgcgtagggaacgagatcgaaggaaggagcgggaaggagagcgtagtcgtcgtttggttttgcgcgtttcgggagcgtcgtgcggttttgttcgcgggtttcgggtgtgcgcggggcggcgtcgcggaatatgacggcgttttgggtggttttcgtttttttttggggatcgttgtgcgtcggtaagaattgggcgcggcgtggggacgtcgagagggcgcgcggggttggtttttggcgtcgcgcggtgtttattaataaagggcgggttcggggttttgtcgtcgtattatttgtatttagtttttattttcgggggcgtgggttgggggcgcggtgggcgttcggttcgtcgaatttgggggtacgattttgtttgtgtagttatttgcgggattttggtttttagaggcgtttttgcgatgggggtcgggacgcggagttttagggtcggagttcgggttacgcgggcgcgtggaatttagggaaagagtgaggaaaatttgagtttggggaaggcggttaagaggggtgggtagattttattgggggtggta

SEQ ID NO: 19190 - DNA, 1051 bp, Artificial Sequence
  chemically treated genomic DNA (Homo sapiens) CpG-island No: 19190
taccacccccaataaaatctacccacccctcttaaccgccttccccaaactcaaattttcctcactctttccctaaattccacgcgcccgcgtaacccgaactccgaccctaaaactccgcgtcccgacccccatcgcaaaaacgcctctaaaaaccaaaatcccgcaaataactacacaaacaaaatcgtacccccaaattcgacgaaccgaacgcccaccgcgcccccaacccacgcccccgaaaataaaaactaaatacaaataatacgacgacaaaaccccgaacccgccctttattaataaacaccgcgcgacgccaaaaaccaaccccgcgcgccctctcgacgtccccacgccgcgcccaattcttaccgacgcacaacgatccccaaaaaaaaacgaaaaccacccaaaacgccgtcatattccgcgacgccgccccgcgcacacccgaaacccgcgaacaaaaccgcacgacgctcccgaaacgcgcaaaaccaaacgacgactacgctctccttcccgctccttccttcgatctcgttccctacgcgcttcctacgccttcgtccccgaacaacgttcgaactccaaaaaccgatcgacgaaaccgaactcaaaaccgctacgaacgacgcaaactacgacccgaactccgaaacgacgcgaaaaccgaaacgcgcccgactcaaacataacgcgacgaaactaaacccgaaccccgaacgcaaaaaccgaatccgaaaaaaccataaacgaaaaaaaaaataaaaaaaaaaaaaactaaaccgaatccaaaataaatcctaaacgacgaccacgaaaccgaaccaacgaaaaaacccgaatattaaatacaaaaaaacgaacgaactaaacgaaaaaaaaaaaaaaaaacgaaccctccgaccgcgtaatccgcgcccccctaaaaaacgaaaccccaaaaaaacaacaacacgaaaaccccgcccccatcccgcgccctataaaaaaacgcgcgtacaccaacttactaaaaaacaaaacgaaacgcgcgaacgaaaat

SEQ ID NO: 19191 - DNA, 1051 bp, Artificial Sequence
  chemically treated genomic DNA (Homo sapiens) CpG-island No: 19191
tgttatttttaatgagatttgtttattttttttggtcgttttttttaggtttaggttttttttattttttttttgggttttacgcgttcgcgtagttcgaatttcgattttgaggtttcgcgtttcggtttttatcgtaggggcgtttttaggaattagaatttcgtagatgattatatagataagatcgtgtttttaagttcggcgagtcgggcgtttatcgcgtttttagtttacgttttcggaggtgagggttgaatataggtggtgcggcgataaggtttcgggttcgttttttgttggtaaatatcgcgcggcgttagaggttagtttcgcgcgttttttcggcgtttttacgtcgcgtttagtttttatcggcgtatagcgatttttagaggagggcgagggttatttagggcgtcgttatgtttcgcggcgtcgtttcgcgtatattcggagttcgcgggtagggtcgtacggcgttttcggggcgcgtagggttaggcggcggttgcgttttttttttcgttttttttttcggtttcgttttttgcgcgttttttgcgttttcgttttcgagtagcgttcgggttttaagggtcggtcggcggggtcgggtttagggtcgttgcgggcggcgtaggttgcggttcgggtttcggggcgacgcgggggtcggggcgcgttcgatttaggtatagcgcggcggggttgggttcgggtttcgggcgtaggggtcgagttcggaggggttatgaacggggggaggggtgggggggaggggagttgaatcgagtttaaaatggattttgagcggcggttacggagtcgagttagcggggaaattcggatgttggatataaagaggcgggcgggttgggcggggagggggaggggaggcgggtttttcggtcgcgtggttcgcgtttttttgaggggcggggttttagagaaataataatacggaggtttcgtttttatttcgcgttttgtgggaggacgcgcgtgtattaatttgttggaggatagggcggggcgcgcggacggaggt

SEQ ID NO: 19192 - DNA, 1051 bp, Artificial Sequence
  chemically treated genomic DNA (Homo sapiens) CpG-island No: 19192
acctccgtccgcgcgccccgccctatcctccaacaaattaatacacgcgcgtcctcccacaaaacgcgaaataaaaacgaaacctccgtattattatttctctaaaaccccgcccctcaaaaaaacgcgaaccacgcgaccgaaaaacccgcctcccctccccctccccgcccaacccgcccgcctctttatatccaacatccgaatttccccgctaactcgactccgtaaccgccgctcaaaatccattttaaactcgattcaactcccctcccccccacccctccccccgttcataacccctccgaactcgacccctacgcccgaaacccgaacccaaccccgccgcgctatacctaaatcgaacgcgccccgacccccgcgtcgccccgaaacccgaaccgcaacctacgccgcccgcaacgaccctaaacccgaccccgccgaccgacccttaaaacccgaacgctactcgaaaacgaaaacgcaaaaaacgcgcaaaaaacgaaaccgaaaaaaaaaacgaaaaaaaaaacgcaaccgccgcctaaccctacgcgccccgaaaacgccgtacgaccctacccgcgaactccgaatatacgcgaaacgacgccgcgaaacataacgacgccctaaataaccctcgccctcctctaaaaatcgctatacgccgataaaaactaaacgcgacgtaaaaacgccgaaaaaacgcgcgaaactaacctctaacgccgcgcgatatttaccaacaaaaaacgaacccgaaaccttatcgccgcaccacctatattcaaccctcacctccgaaaacgtaaactaaaaacgcgataaacgcccgactcgccgaacttaaaaacacgatcttatctatataatcatctacgaaattctaattcctaaaaacgcccctacgataaaaaccgaaacgcgaaacctcaaaatcgaaattcgaactacgcgaacgcgtaaaacccaaaaaaaaaataaaaaaaacctaaacctaaaaaaaacgaccaaaaaaaataaacaaatctcattaaaaataaca

SEQ ID NO: 19193 - DNA, 696 bp, Artificial Sequence
  chemically treated genomic DNA (Homo sapiens) CpG-island No: 19193
gcggttgcgggcgtgtggttggaggtgttcggttagcgtaagagagtttgggggtaagtgggcgcgggcgtaaataagcggagtttcgtttggaaagtttgttttttttacggtttaagtatcgattttttttttttagtggtgtcggggtgcgtttaatttcggcgggcgcgtcgggacgttttttggttagttttgggaaacgtggggagttgggtattgaagttttggcgagaaggtcggggcggttggtattcggtcgtcgggttttgcgcgtttttgtttttagtttttattatatatgtagcgcgggtttttcgtcgttttcggtggtattcgtttggagtttgggaaattttcgaggggcggggtcgggcgtgtaggggcggggtcggagtttttacgttgttgcgggggtggggatttgggatttgcgttttatttttattttggttttatttttttttgtgcgtcgtcgtgaggtttagtttatatcgaaagcgagtgagttttgtagggtagtagcgcgcgcgcgcgtagtttgagttcggaaatcgaagggtaaagattagttggtatttgagtatcgtatggaagagggcgttgtagtttttttggagtcgttttttggaggcgaagtggtggtcgtgttggattttttgtttttttttgtttcgtttttttgggatgtttttt

SEQ ID NO: 19194 - DNA, 696 bp, Artificial Sequence
  chemically treated genomic DNA (Homo sapiens) CpG-island No: 19194
aaaaaacatcccaaaaaaacgaaacaaaaaaaaacaaaaaatccaacacgaccaccacttcgcctccaaaaaacgactccaaaaaaactacaacgccctcttccatacgatactcaaataccaactaatctttacccttcgatttccgaactcaaactacgcgcgcgcgcgctactaccctacaaaactcactcgctttcgatataaactaaacctcacgacgacgcacaaaaaaaaataaaaccaaaataaaaataaaacgcaaatcccaaatccccacccccgcaacaacgtaaaaactccgaccccgcccctacacgcccgaccccgcccctcgaaaatttcccaaactccaaacgaataccaccgaaaacgacgaaaaacccgcgctacatatataataaaaactaaaaacaaaaacgcgcaaaacccgacgaccgaataccaaccgccccgaccttctcgccaaaacttcaatacccaactccccacgtttcccaaaactaaccaaaaaacgtcccgacgcgcccgccgaaattaaacgcaccccgacaccactaaaaaaaaaaaatcgatacttaaaccgtaaaaaaaacaaactttccaaacgaaactccgcttatttacgcccgcgcccacttacccccaaactctcttacgctaaccgaacacctccaaccacacgcccgcaaccgc

SEQ ID NO: 19195 - DNA, 696 bp, Artificial Sequence
  chemically treated genomic DNA (Homo sapiens) CpG-island No: 19195
aaaaggtattttaagggagcggggtaaaaaaaagtagaaagtttaatacgattattatttcgtttttaaaaagcggttttaggagagttgtaacgtttttttttatacggtatttaggtgttagttggtttttgtttttcggttttcggatttaggttgcgcgcgcgcgcgttattattttatagaatttattcgttttcggtgtaaattaagttttacgacgacgtataggagaaggtagaattagggtgggaatgggacgtaaattttaaatttttattttcgtagtagcgtggggatttcggtttcgtttttgtacgttcggtttcgtttttcgagggttttttagattttaggcgggtgttatcgagggcggcgggggattcgcgttgtatgtgtaatgggggttgggaataaagacgcgtaggattcggcggtcgggtattagtcgtttcgattttttcgttagagttttaatgtttagttttttacgttttttaggattggttaggggacgtttcggcgcgttcgtcggggttaggcgtatttcggtattattgagagagggaaatcggtgtttggatcgtaggagaaataagttttttaggcggaatttcgtttgtttacgttcgcgtttatttatttttaaatttttttgcgttggtcgaatatttttagttatacgttcgtagtcgt

SEQ ID NO: 19196 - DNA, 696 bp, Artificial Sequence
  chemically treated genomic DNA (Homo sapiens) CpG-island No: 19196
acgactacgaacgtataactaaaaatattcgaccaacgcaaaaaaatttaaaaataaataaacgcgaacgtaaacaaacgaaattccgcctaaaaaacttatttctcctacgatccaaacaccgatttccctctctcaataataccgaaatacgcctaaccccgacgaacgcgccgaaacgtcccctaaccaatcctaaaaaacgtaaaaaactaaacattaaaactctaacgaaaaaatcgaaacgactaatacccgaccgccgaatcctacgcgtctttattcccaacccccattacacatacaacgcgaatcccccgccgccctcgataacacccgcctaaaatctaaaaaaccctcgaaaaacgaaaccgaacgtacaaaaacgaaaccgaaatccccacgctactacgaaaataaaaatttaaaatttacgtcccattcccaccctaattctaccttctcctatacgtcgtcgtaaaacttaatttacaccgaaaacgaataaattctataaaataataacgcgcgcgcgcgcaacctaaatccgaaaaccgaaaaacaaaaaccaactaacacctaaataccgtataaaaaaaaacgttacaactctcctaaaaccgctttttaaaaacgaaataataatcgtattaaactttctacttttttttaccccgctcccttaaaatacctttt

SEQ ID NO: 19197 - DNA, 664 bp, Artificial Sequence
  chemically treated genomic DNA (Homo sapiens) CpG-island No: 19197
aggtttcgcgtcgtgggggaagcgaaaggggtagtgtggggaagtggtcgaggggtcgggtgcgggatggtttgtagagaggtaggcggcggtgcggagtcgggaattacgcgtttattttttaagtcggacgggttcggcgggggtgggcgagatattgggaatagcggttagttttagagggcgcgaggcgggtcgcgcggggaggggtggcgcgcgcggttggggggtagtgagggtcgtcgcggcggcgcgtagtacggcgggaatatggcgcgcgaaattggcgcgcgcgtttagttggcgggatttttagttttaggtggacgcggttcggatttcgtggatatggagtagtcgtcgttttcggcgttcgagtcgatttaagggtcgattttcgtaaggagtcgaaggcggcgggagttcgagtcgtcgttagcgtcggcgtaggtgagtgggtgaggggttcgggtcgggagattttttttgtgaaatttcggcggtgggagtcgggttaggttttagcggttgaggagcgtttgtgaggcgtaaggcgtttcgtagttcgggttcgattttagtcgttagtcgttaggaggcgggaattggttcgtagtttgtttgttttagtttttacgggagtgtgtgtgggtgtgtgagggtg

SEQ ID NO: 19198 - DNA, 664 bp, Artificial Sequence
  chemically treated genomic DNA (Homo sapiens) CpG-island No: 19198
caccctcacacacccacacacactcccgtaaaaactaaaacaaacaaactacgaaccaattcccgcctcctaacgactaacgactaaaatcgaacccgaactacgaaacgccttacgcctcacaaacgctcctcaaccgctaaaacctaacccgactcccaccgccgaaatttcacaaaaaaaatctcccgacccgaacccctcacccactcacctacgccgacgctaacgacgactcgaactcccgccgccttcgactccttacgaaaatcgacccttaaatcgactcgaacgccgaaaacgacgactactccatatccacgaaatccgaaccgcgtccacctaaaactaaaaatcccgccaactaaacgcgcgcgccaatttcgcgcgccatattcccgccgtactacgcgccgccgcgacgaccctcactaccccccaaccgcgcgcgccacccctccccgcgcgacccgcctcgcgccctctaaaactaaccgctattcccaatatctcgcccacccccgccgaacccgtccgacttaaaaaataaacgcgtaattcccgactccgcaccgccgcctacctctctacaaaccatcccgcacccgacccctcgaccacttccccacactacccctttcgcttcccccacgacgcgaaacct

SEQ ID NO: 19199 - DNA, 664 bp, Artificial Sequence
  chemically treated genomic DNA (Homo sapiens) CpG-island No: 19199
tatttttatatatttatatatattttcgtggaaattgaggtaggtaggttgcggattagttttcgttttttgacggttggcggttgggatcgaattcggattgcgagacgttttacgttttataggcgttttttagtcgttgaggtttggttcggtttttatcgtcggagttttataaagaaagtttttcggttcgagttttttatttatttatttgcgtcgacgttggcggcgattcgggttttcgtcgttttcggttttttgcgggggtcggtttttgggtcggttcgggcgtcgggggcggcgattgttttatatttacggggttcgggtcgcgtttatttggagttaagggtttcgttagttaggcgcgcgcgttagtttcgcgcgttatgttttcgtcgtgttgcgcgtcgtcgcggcgatttttattgttttttaatcgcgcgcgttattttttttcgcgcggttcgtttcgcgttttttggagttggtcgttgtttttagtgtttcgtttattttcgtcgggttcgttcgatttggagggtgagcgcgtggttttcggtttcgtatcgtcgtttgtttttttgtagattatttcgtattcgatttttcggttatttttttatattgtttttttcgttttttttacgacgcggggttt

SEQ ID NO: 19200 - DNA, 664 bp, Artificial Sequence
  chemically treated genomic DNA (Homo sapiens) CpG-island No: 19200
aaaccccgcgtcgtaaaaaaaacgaaaaaaacaatataaaaaaataaccgaaaaatcgaatacgaaataatctacaaaaaaacaaacgacgatacgaaaccgaaaaccacgcgctcaccctccaaatcgaacgaacccgacgaaaataaacgaaacactaaaaacaacgaccaactccaaaaaacgcgaaacgaaccgcgcgaaaaaaaataacgcgcgcgattaaaaaacaataaaaatcgccgcgacgacgcgcaacacgacgaaaacataacgcgcgaaactaacgcgcgcgcctaactaacgaaacccttaactccaaataaacgcgacccgaaccccgtaaatataaaacaatcgccgcccccgacgcccgaaccgacccaaaaaccgacccccgcaaaaaaccgaaaacgacgaaaacccgaatcgccgccaacgtcgacgcaaataaataaataaaaaactcgaaccgaaaaactttctttataaaactccgacgataaaaaccgaaccaaacctcaacgactaaaaaacgcctataaaacgtaaaacgtctcgcaatccgaattcgatcccaaccgccaaccgtcaaaaaacgaaaactaatccgcaacctacctacctcaatttccacgaaaatatatataaatatataaaaata

SEQ ID NO: 19201 - DNA, 962 bp, Artificial Sequence
  chemically treated genomic DNA (Homo sapiens) CpG-island No: 19201
gtaacggtgtcgttaggtagaaggtcgggttcgggaggtttcgggaggttttcgtcgttgtatattatttttcgtcgagtcgggttagggacgtcgtcgtttagttttttgggtcgttttttcgagtatttgtagttgcggatggatagcgggtagtcgggcgcgtttcgagtttcgggcgttaggagtagtaggagttacggtagtagcggtagtagtaggcgcgcgggcgtttttcgtattttgcgtttttcggcgtttattaatttatcgtttcgcggggatttatagcgttggggtcgggttgcgcgtcggtcggagggatttaggcgtgcgggaggagtgtttagcgggggttcggggttttcgagggcgtggaggggggttttgggcggaggcgagtttcggggttttcgtcgtcgcgtttcgggggtatgttttgcgagcgtttcggcggggaggacgtcggcgcggttgttagcgtagcgcgggtagtttttagttgcgcgatcggagttttagcgttcggttttcgggatattggaggttcggttttttcgcgtcgtttgttcgttgggcgttgggttgggatttagcggatcgcgtcgggtttttgttgtcgtcgtcgtcgtcgtttcgtgttatggatggaggtagtttcgcgtcgcgtcgttttcgtcgtcggttttcgttcgttcgggtttttcgcggggttttagcgtcgatcgatacgcggttaggtttagattttttgtcgagtgggggcgggttagttggttcgaggattttgcgttttcgcgttcgttttgtattaatatttttttttcgtttgttttcgcgtttcgggttaggatttttttttttcgtaatttattttagatttttgagtcgattattattattttttataaaatttttttcgttcgtgtcggtgtagtttgcgtttttaggttgttggggtt

SEQ ID NO: 19202 - DNA, 962 bp, Artificial Sequence
  chemically treated genomic DNA (Homo sapiens) CpG-island No: 19202
aaccccaacaacctaaaaacgcaaactacaccgacacgaacgaaaaaaattttataaaaaataataataatcgactcaaaaatctaaaataaattacgaaaaaaaaaaatcctaacccgaaacgcgaaaacaaacgaaaaaaaaatattaatacaaaacgaacgcgaaaacgcaaaatcctcgaaccaactaacccgcccccactcgacaaaaaatctaaacctaaccgcgtatcgatcgacgctaaaaccccgcgaaaaacccgaacgaacgaaaaccgacgacgaaaacgacgcgacgcgaaactacctccatccataacacgaaacgacgacgacgacgacaacaaaaacccgacgcgatccgctaaatcccaacccaacgcccaacgaacaaacgacgcgaaaaaaccgaacctccaatatcccgaaaaccgaacgctaaaactccgatcgcgcaactaaaaactacccgcgctacgctaacaaccgcgccgacgtcctccccgccgaaacgctcgcaaaacatacccccgaaacgcgacgacgaaaaccccgaaactcgcctccgcccaaaacccccctccacgccctcgaaaaccccgaacccccgctaaacactcctcccgcacgcctaaatccctccgaccgacgcgcaacccgaccccaacgctataaatccccgcgaaacgataaattaataaacgccgaaaaacgcaaaatacgaaaaacgcccgcgcgcctactactaccgctactaccgtaactcctactactcctaacgcccgaaactcgaaacgcgcccgactacccgctatccatccgcaactacaaatactcgaaaaaacgacccaaaaaactaaacgacgacgtccctaacccgactcgacgaaaaataatatacaacgacgaaaacctcccgaaacctcccgaacccgaccttctacctaacgacaccgttac

SEQ ID NO: 19203 - DNA, 962 bp, Artificial Sequence
  chemically treated genomic DNA (Homo sapiens) CpG-island No: 19203
ggttttagtagtttggagacgtaagttgtatcggtacggacgagggaaattttgtggaaggtggtggtggtcggtttagaggtttgagatgggttgcggaaaggaagggttttggttcggggcgcggggataagcgggagaggagtgttggtgtagggcgggcgcggggacgtagggttttcgaattagttggttcgtttttattcggtagagggtttaggtttggtcgcgtgtcggtcggcgttagggtttcgcggaaggttcgggcggacggggatcggcggcgggagcggcgcggcgcggagttgtttttatttatggtacggagcggcggcggcggcggtagtaggagttcggcgcgattcgttaggttttagtttagcgtttagcgagtaggcgacgcggaggggtcgggtttttagtgtttcgagggtcgggcgttgagatttcggtcgcgtagttgggagttgttcgcgttgcgttgatagtcgcgtcgacgtttttttcgtcggggcgttcgtaggatatgttttcggggcgcggcggcggggatttcggggttcgttttcgtttagggtttttttttacgttttcgggagtttcgggttttcgttgagtatttttttcgtacgtttgggttttttcggtcggcgcgtagttcggttttagcgttgtgggttttcgcggggcgatgggttgatgggcgtcgggggacgtaggatgcggggggcgttcgcgcgtttgttgttgtcgttgttgtcgtggtttttgttgtttttggcgttcgaggttcggggcgcgttcggttgttcgttatttattcgtagttgtaagtgttcgggggagcggtttaaggggttgagcggcggcgtttttggttcggttcggcggagggtggtgtgtagcggcggggatttttcggagtttttcgagttcggttttttgtttaacggtatcgttat

SEQ ID NO: 19204 - DNA, 962 bp, Artificial Sequence
  chemically treated genomic DNA (Homo sapiens) CpG-island No: 19204
ataacgataccgttaaacaaaaaaccgaactcgaaaaactccgaaaaatccccgccgctacacaccaccctccgccgaaccgaaccaaaaacgccgccgctcaaccccttaaaccgctcccccgaacacttacaactacgaataaataacgaacaaccgaacgcgccccgaacctcgaacgccaaaaacaacaaaaaccacgacaacaacgacaacaacaaacgcgcgaacgccccccgcatcctacgtcccccgacgcccatcaacccatcgccccgcgaaaacccacaacgctaaaaccgaactacgcgccgaccgaaaaaacccaaacgtacgaaaaaaatactcaacgaaaacccgaaactcccgaaaacgtaaaaaaaaaccctaaacgaaaacgaaccccgaaatccccgccgccgcgccccgaaaacatatcctacgaacgccccgacgaaaaaaacgtcgacgcgactatcaacgcaacgcgaacaactcccaactacgcgaccgaaatctcaacgcccgaccctcgaaacactaaaaacccgacccctccgcgtcgcctactcgctaaacgctaaactaaaacctaacgaatcgcgccgaactcctactaccgccgccgccgccgctccgtaccataaataaaaacaactccgcgccgcgccgctcccgccgccgatccccgtccgcccgaaccttccgcgaaaccctaacgccgaccgacacgcgaccaaacctaaaccctctaccgaataaaaacgaaccaactaattcgaaaaccctacgtccccgcgcccgccctacaccaacactcctctcccgcttatccccgcgccccgaaccaaaacccttcctttccgcaacccatctcaaacctctaaaccgaccaccaccaccttccacaaaatttccctcgtccgtaccgatacaacttacgtctccaaactactaaaacc

SEQ ID NO: 19205 - DNA, 1137 bp, Artificial Sequence
  chemically treated genomic DNA (Homo sapiens) CpG-island No: 19205
cgttatatacgatatcgttaacgaggatattgtatacgatatcgttaacgaggtcgtcgataagggtatcgttaacgaggatgtcgtttacggtatcgttaacgagtacgtcgtttacggtatcgttagcgaggacgtcgtttacggtatcgttagcgaggacgtcgtttagggtatcgttagcgaggacgtcgtttagggtatcgttaacgaggatattatttagggtatcgttaaggagtacgtcgtttacggtatcgttaacgaggacgtcgtttagggtatcgttaacgaggacgtcgtttagggtatcgttaacgaggacgtcgtttagggtatcgttaaggaggacgtcgtttagggtatcgttaacgagggcgtcgtttagggtatcgttaaagaggacgtcgtttagggtatcgttaacgaggtcgtcgataagggtatcgttaacgaggatgtcgtttacggtatcgttaacgaggacgtcgtttacggtatcgttagcgaggacgtcgtttacggtatcgttagcgaggacgtcgtttacggtatcgttagcgaggacgtcgtttagggtatcgttaacgaggacgttatttagggtatcgttaaggagtacgtcgtttacggtatcgttaacgaggacgtcgtttagggtatcgttaacgaggacgtcgtttagggtatcgttaacgaggacgtcgtttagggtatcgttaaggaggacgtcgtttagggtatcgttaaggaggacgtcgtttagggtatcgttaacgagggcgtcgtttagggtatcgttaaagaggacgtcgtttacggtatcgttaacgaggacgtcgtttagggtatcgttaacgaggacgtcgtttacggaatcgttagtgaggacgtcgtttacggtatcgttagcgaggacgtcgtttagggtatcgataaggaggatgtcgtttagggtatcgttaacgaggacgtcgtttagggtatcgttaacgaggacgtcgtttagggtatcgttaaagaggacgtcgtttacggtatcgttaacgagttgtatacgatatcgttaacgaggatattttataagtcgtcgttaataagtatattgtatataatatcgttaatgagggtattgta

SEQ ID NO: 19206 - DNA, 1137 bp, Artificial Sequence
  chemically treated genomic DNA (Homo sapiens) CpG-island No: 19206
tacaataccctcattaacgatattatatacaatatacttattaacgacgacttataaaatatcctcgttaacgatatcgtatacaactcgttaacgataccgtaaacgacgtcctctttaacgataccctaaacgacgtcctcgttaacgataccctaaacgacgtcctcgttaacgataccctaaacgacatcctccttatcgataccctaaacgacgtcctcgctaacgataccgtaaacgacgtcctcactaacgattccgtaaacgacgtcctcgttaacgataccctaaacgacgtcctcgttaacgataccgtaaacgacgtcctctttaacgataccctaaacgacgccctcgttaacgataccctaaacgacgtcctccttaacgataccctaaacgacgtcctccttaacgataccctaaacgacgtcctcgttaacgataccctaaacgacgtcctcgttaacgataccctaaacgacgtcctcgttaacgataccgtaaacgacgtactccttaacgataccctaaataacgtcctcgttaacgataccctaaacgacgtcctcgctaacgataccgtaaacgacgtcctcgctaacgataccgtaaacgacgtcctcgctaacgataccgtaaacgacgtcctcgttaacgataccgtaaacgacatcctcgttaacgatacccttatcgacgacctcgttaacgataccctaaacgacgtcctctttaacgataccctaaacgacgccctcgttaacgataccctaaacgacgtcctccttaacgataccctaaacgacgtcctcgttaacgataccctaaacgacgtcctcgttaacgataccctaaacgacgtcctcgttaacgataccgtaaacgacgtactccttaacgataccctaaataatatcctcgttaacgataccctaaacgacgtcctcgctaacgataccctaaacgacgtcctcgctaacgataccgtaaacgacgtcctcgctaacgataccgtaaacgacgtactcgttaacgataccgtaaacgacatcctcgttaacgatacccttatcgacgacctcgttaacgatatcgtatacaatatcctcgttaacgatatcgtatataacg

SEQ ID NO: 19207 - DNA, 1137 bp, Artificial Sequence
  chemically treated genomic DNA (Homo sapiens) CpG-island No: 19207
tatagtgtttttattagcgatgttgtgtatagtgtatttgttagcgacggtttgtagggtgttttcgttagcgatgtcgtatatagttcgttggcgatgtcgtgggcggcgttttttttggcgatgttttgggcggcgttttcgttggcgatgttttgggcggcgttttcgttggcgatgttttgggcggtattttttttgtcgatgttttggacggcgttttcgttggcgatgtcgtgggcggcgtttttattggcgatttcgtgggcggcgttttcgttggcgatgttttgggcggcgttttcgttggcgatgtcgtgggcggcgttttttttggcgatgttttgggcggcgttttcgttggcgatgttttgggcggcgttttttttggcgatgttttgggcggcgttttttttggcgatgttttgggcggcgttttcgttggcgatgttttgggcggcgttttcgttggcgatgttttgggcggcgttttcgttggcgatgtcgtggacggcgtattttttggcgatgttttggatggcgttttcgttggcgatgttttgggcggcgttttcgttggcgatgtcgtgggcggcgttttcgttggcgatgtcgtgggcggcgttttcgttggcgatgtcgtgggcggcgttttcgttggcgatgtcgtgggcggtattttcgttggcgatgtttttgtcggcggtttcgttagcgatgttttgggcggcgttttttttggcgatgttttgggcggcgttttcgttggcgatgttttgggcggcgttttttttggcgatgttttgggcggcgttttcgttggcgatgttttgggcggcgttttcgttggcgatgttttgggcggcgttttcgttggcgatgtcgtggacggcgtattttttggcgatgttttggatggtgttttcgttggcgatgttttgggcggcgttttcgttggcgatgttttgggcggcgttttcgttggcgatgtcgtgggcggcgttttcgttggcgatgtcgtgggcggcgtattcgttggcgatgtcgtgggcggtattttcgttggcgatgtttttgtcggcggtttcgttagcgatgtcgtgtatagtattttcgttagcgatgtcgtgtgtggcg

SEQ ID NO: 19208 - DNA, 1137 bp, Artificial Sequence
  chemically treated genomic DNA (Homo sapiens) CpG-island No: 19208
cgccacacacgacatcgctaacgaaaatactatacacgacatcgctaacgaaaccgccgacaaaaacatcgccaacgaaaataccgcccacgacatcgccaacgaatacgccgcccacgacatcgccaacgaaaacgccgcccacgacatcgccaacgaaaacgccgcccaaaacatcgccaacgaaaacgccgcccaaaacatcgccaacgaaaacaccatccaaaacatcgccaaaaaatacgccgtccacgacatcgccaacgaaaacgccgcccaaaacatcgccaacgaaaacgccgcccaaaacatcgccaacgaaaacgccgcccaaaacatcgccaaaaaaaacgccgcccaaaacatcgccaacgaaaacgccgcccaaaacatcgccaaaaaaaacgccgcccaaaacatcgctaacgaaaccgccgacaaaaacatcgccaacgaaaataccgcccacgacatcgccaacgaaaacgccgcccacgacatcgccaacgaaaacgccgcccacgacatcgccaacgaaaacgccgcccacgacatcgccaacgaaaacgccgcccaaaacatcgccaacgaaaacgccatccaaaacatcgccaaaaaatacgccgtccacgacatcgccaacgaaaacgccgcccaaaacatcgccaacgaaaacgccgcccaaaacatcgccaacgaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccacgacatcgccaacgaaaacgccgcccaaaacatcgccaacgaaaacgccgcccacgaaatcgccaataaaaacgccgcccacgacatcgccaacgaaaacgccgtccaaaacatcgacaaaaaaaataccgcccaaaacatcgccaacgaaaacgccgcccaaaacatcgccaacgaaaacgccgcccaaaacatcgccaaaaaaaacgccgcccacgacatcgccaacgaactatatacgacatcgctaacgaaaacaccctacaaaccgtcgctaacaaatacactatacacaacatcgctaataaaaacactata

SEQ ID NO: 19209 - DNA, 785 bp, Artificial Sequence
  chemically treated genomic DNA (Homo sapiens) CpG-island No: 19209
ggcgatgtcgtgggcggcgttttttttggcgatgttttgggcggcgttttcgttggcgatgttttgggcggcgttttcgttggcgatgttttgggcggtattttttttggcgatgttttggacggcgttttcgttggcgatgtcgtgggcggcgttttcgttggcgatttcgtgggcggcgttttcgttggcgatgttttgggcggcgttttcgttggcgatgttatgggcggcgttttttttggcgatgttttgggcggcgttttcgttggcgatgttttgggcggcgttttttttggcgatgttttgggcggcgttttttttggcgatgttttgggcggcgttttcgttggcgatgttttgggcggcgttttttttggcgatgttttgggcggcgttttcgttggcgatgttttgggcggcgttttcgttggcgatgtcgtggacggcgttttttttggcgatgttttgggcggcgttttcgttggcgatgttttgggcggcgttttcgttggcgatgtcgtgggcggcgttttcgttggcgatttcgtgggcggcgttttcgttggcgatgtcgtgggcggcgttttcgttggcgatgtcgtgggcggcgttttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 19210 - DNA, 785 bp, Artificial Sequence
  chemically treated genomic DNA (Homo sapiens) CpG-island No: 19210
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaacgccgcccacgacatcgccaacgaaaacgccgcccacgacatcgccaacgaaaacgccgcccacgaaatcgccaacgaaaacgccgcccacgacatcgccaacgaaaacgccgcccaaaacatcgccaacgaaaacgccgcccaaaacatcgccaaaaaaaacgccgtccacgacatcgccaacgaaaacgccgcccaaaacatcgccaacgaaaacgccgcccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgccaacgaaaacgccgcccaaaacatcgccaaaaaaaacgccgcccataacatcgccaacgaaaacgccgcccaaaacatcgccaacgaaaacgccgcccacgaaatcgccaacgaaaacgccgcccacgacatcgccaacgaaaacgccgtccaaaacatcgccaaaaaaaataccgcccaaaacatcgccaacgaaaacgccgcccaaaacatcgccaacgaaaacgccgcccaaaacatcgccaaaaaaaacgccgcccacgacatcgcc

SEQ ID NO: 19211 - DNA, 785 bp, Artificial Sequence
  chemically treated genomic DNA (Homo sapiens) CpG-island No: 19211
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttaacgaggacgtcgtttacggtatcgttaacgaggacgtcgtttacggtatcgttagcgaggacgtcgtttacggaatcgttagcgaggacgtcgtttacggtatcgttagcgaggacgtcgtttagggtatcgttaacgaggacgtcgtttagggtatcgttaaggaggacgtcgtttacggtatcgttaacgaggacgtcgtttagggtatcgttaacgaggacgtcgtttagggtatcgttaaggaggacgtcgtttagggtatcgttaacgaggacgtcgtttagggtatcgttaaagaggacgtcgtttagggtatcgttaaggaggacgtcgtttagggtatcgttaacgagggcgtcgtttagggtatcgttaaagaggacgtcgtttatggtatcgttaacgaggacgtcgtttagggtatcgttaacgaggacgtcgtttacggaatcgttagcgaggacgtcgtttacggtatcgttagcgaggacgtcgtttagggtatcgttaaggaggatgtcgtttagggtatcgttaacgaggacgtcgtttagggtatcgttaacgaggacgtcgtttagggtatcgttaaagaggacgtcgtttacggtatcgtt

SEQ ID NO: 19212 - DNA, 785 bp, Artificial Sequence
  chemically treated genomic DNA (Homo sapiens) CpG-island No: 19212
aacgataccgtaaacgacgtcctctttaacgataccctaaacgacgtcctcgttaacgataccctaaacgacgtcctcgttaacgataccctaaacgacatcctccttaacgataccctaaacgacgtcctcgctaacgataccgtaaacgacgtcctcgctaacgattccgtaaacgacgtcctcgttaacgataccctaaacgacgtcctcgttaacgataccataaacgacgtcctctttaacgataccctaaacgacgccctcgttaacgataccctaaacgacgtcctccttaacgataccctaaacgacgtcctctttaacgataccctaaacgacgtcctcgttaacgataccctaaacgacgtcctccttaacgataccctaaacgacgtcctcgttaacgataccctaaacgacgtcctcgttaacgataccgtaaacgacgtcctccttaacgataccctaaacgacgtcctcgttaacgataccctaaacgacgtcctcgctaacgataccgtaaacgacgtcctcgctaacgattccgtaaacgacgtcctcgctaacgataccgtaaacgacgtcctcgttaacgataccgtaaacgacgtcctcgttaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 19213 - DNA, 816 bp, Artificial Sequence
  chemically treated genomic DNA (Homo sapiens) CpG-island No: 19213
gttcggtgcgtttcgtattttgttgggtcgttcggggcgtcgtttgcgggtttggaggcggcgattagggcgtttacggtgtcgagcgttcgtagtagggtcgggtcgcggggcgtggcgcgggggacggcgcggggttcgcggcgggtaggcggggacggcggcggcggcggtagtagcgcgcgtagagcgtttagtttcgttcgaagtttcgcgcgtagcgttttaatttcggcgtttagtttttcgcgtattgtcgcgagttttttttgtagtcgtcgttcgttgatttttaggattttcgtcgggtaggtggttttgtcgcggggtttttcgtatattgagtatacggagtcgcggttgtgcgcgtcggttttttcgttcgcgttcgtcgtttcggttttcgtacgttttattagttttagtagtcgcggtatttcggatcgcgaagtcgtttcggttcggagttggtcgagtaggcgagttagtcggttcggggttcgggcgtttttttggttcggtttattggattgcggtttcgggtttcgtcggcggttcgtgacgcgtcgtagtatttcgttggttttgtacgtattacgcgtttgggtttacgggcggtcgggcgtcgttattcgttttgttgtttttatcgtcgttagcgttcgggatggtcgggagttttaggttgtagtttagttatcgttggggtttaggcgacgtatcgtggagggggttcgcgggacggttttgggaacgattaaagttttgggggtttcggtttggggcgtagggaattttggtagggttgggtttcgg

SEQ ID NO: 19214 - DNA, 816 bp, Artificial Sequence
  chemically treated genomic DNA (Homo sapiens) CpG-island No: 19214
ccgaaacccaaccctaccaaaattccctacgccccaaaccgaaacccccaaaactttaatcgttcccaaaaccgtcccgcgaaccccctccacgatacgtcgcctaaaccccaacgataactaaactacaacctaaaactcccgaccatcccgaacgctaacgacgataaaaacaacaaaacgaataacgacgcccgaccgcccgtaaacccaaacgcgtaatacgtacaaaaccaacgaaatactacgacgcgtcacgaaccgccgacgaaacccgaaaccgcaatccaataaaccgaaccaaaaaaacgcccgaaccccgaaccgactaactcgcctactcgaccaactccgaaccgaaacgacttcgcgatccgaaataccgcgactactaaaactaataaaacgtacgaaaaccgaaacgacgaacgcgaacgaaaaaaccgacgcgcacaaccgcgactccgtatactcaatatacgaaaaaccccgcgacaaaaccacctacccgacgaaaatcctaaaaatcaacgaacgacgactacaaaaaaaactcgcgacaatacgcgaaaaactaaacgccgaaattaaaacgctacgcgcgaaacttcgaacgaaactaaacgctctacgcgcgctactaccgccgccgccgccgtccccgcctacccgccgcgaaccccgcgccgtcccccgcgccacgccccgcgacccgaccctactacgaacgctcgacaccgtaaacgccctaatcgccgcctccaaacccgcaaacgacgccccgaacgacccaacaaaatacgaaacgcaccgaac

SEQ ID NO: 19215 - DNA, 816 bp, Artificial Sequence
  chemically treated genomic DNA (Homo sapiens) CpG-island No: 19215
tcgggatttagttttgttagggttttttgcgttttaggtcggaatttttagggttttggtcgtttttaaagtcgtttcgcgggttttttttacggtgcgtcgtttgggttttagcgatggttaggttgtagtttggggttttcggttatttcgggcgttggcggcggtggaggtagtagggcggatggcgacgttcggtcgttcgtgggtttaggcgcgtagtgcgtatagagttagcgaggtgttgcggcgcgttacgggtcgtcggcgggattcggggtcgtaatttaatgggtcgggttaggaagacgttcgagtttcgggtcggttggttcgtttgttcggttagtttcgggtcgaagcggtttcgcggttcgaggtgtcgcggttgttgaagttggtggagcgtgcgggggtcggggcggcgggcgcgggcgagaggatcggcgcgtatagtcgcggtttcgtgtgtttagtatgcggggagtttcgcggtagggttatttattcggcgggggttttggaggttagcgagcggcggttgtaggagggattcgcggtagtgcgcgaggagttgggcgtcgagattgaggcgttgcgcgcggagtttcgagcggagttggacgttttgcgcgcgttgttgtcgtcgtcgtcgtcgttttcgtttgttcgtcgcgagtttcgcgtcgtttttcgcgttacgtttcgcggttcgattttgttgcggacgttcggtatcgtgagcgttttggtcgtcgtttttaggttcgtagacgacgtttcggacggtttagtagaatgcggagcgtatcgagt

SEQ ID NO: 19216 - DNA, 816 bp, Artificial Sequence
  chemically treated genomic DNA (Homo sapiens) CpG-island No: 19216
actcgatacgctccgcattctactaaaccgtccgaaacgtcgtctacgaacctaaaaacgacgaccaaaacgctcacgataccgaacgtccgcaacaaaatcgaaccgcgaaacgtaacgcgaaaaacgacgcgaaactcgcgacgaacaaacgaaaacgacgacgacgacgacaacaacgcgcgcaaaacgtccaactccgctcgaaactccgcgcgcaacgcctcaatctcgacgcccaactcctcgcgcactaccgcgaatccctcctacaaccgccgctcgctaacctccaaaacccccgccgaataaataaccctaccgcgaaactccccgcatactaaacacacgaaaccgcgactatacgcgccgatcctctcgcccgcgcccgccgccccgacccccgcacgctccaccaacttcaacaaccgcgacacctcgaaccgcgaaaccgcttcgacccgaaactaaccgaacaaacgaaccaaccgacccgaaactcgaacgtcttcctaacccgacccattaaattacgaccccgaatcccgccgacgacccgtaacgcgccgcaacacctcgctaactctatacgcactacgcgcctaaacccacgaacgaccgaacgtcgccatccgccctactacctccaccgccgccaacgcccgaaataaccgaaaaccccaaactacaacctaaccatcgctaaaacccaaacgacgcaccgtaaaaaaaacccgcgaaacgactttaaaaacgaccaaaaccctaaaaattccgacctaaaacgcaaaaaaccctaacaaaactaaatcccga

SEQ ID NO: 19217 - DNA, 843 bp, Artificial Sequence
  chemically treated genomic DNA (Homo sapiens) CpG-island No: 19217
gggcgtcggaaggggcgcgtcgggcggtcggcggcggtcgttggcgagttgaggtttgttaggcgaagtttggagattagtcgggtcgcggtcgtaatggttaaggattcgtttagttttttgggcgcgtcgtttaagaagtcgggttgttttagttcggcggcggtagtgttggagaattagaggcgggagttggagaagttacgggcggagttggaggcggagcgggtaggttggcgggcggaacggcggcgtttcgttgttcgggagcgttagttgcgtgaggaggtcgagcgggagcggcggtagttggttgatcgtttgcgttttaagtgggaggtatagcgtagtcgggagttgcggtagttgtaagaggagatgtagcgggaacgcgaggtcgagattcggtagttgttgcgttggaaggaggtcgagtagcggtagttgtagtagttgttgtatcgggagcgcgatggcgtggtgcgttaagttcgggagttgtagcgttagttggtcgaggagttggtgaatcgcggttattgtagtcgttcgggggcgttcgaggttttcgcggcgtagtgtcgttgtcgtttgtaggaagtgttggcgtagtttcgttggtagattgacggcgagtaggcggcgcgtattcgttatttgtaggcggcgttggaggtggagcgttagtttttttttaagtatattttggcgtattttcgcgggtattcggttttgtcgggattatcggatttttaagttgtgtattttttggaagaatcgttgttttagatttttagcggtttttgttacgtttttaaattcgtttgttaattcggattttta

SEQ ID NO: 19218 - DNA, 843 bp, Artificial Sequence
  chemically treated genomic DNA (Homo sapiens) CpG-island No: 19218
taaaaatccgaattaacaaacgaatttaaaaacgtaacaaaaaccgctaaaaatctaaaacaacgattcttccaaaaaatacacaacttaaaaatccgataatcccgacaaaaccgaatacccgcgaaaatacgccaaaatatacttaaaaaaaaactaacgctccacctccaacgccgcctacaaataacgaatacgcgccgcctactcgccgtcaatctaccaacgaaactacgccaacacttcctacaaacgacaacgacactacgccgcgaaaacctcgaacgcccccgaacgactacaataaccgcgattcaccaactcctcgaccaactaacgctacaactcccgaacttaacgcaccacgccatcgcgctcccgatacaacaactactacaactaccgctactcgacctccttccaacgcaacaactaccgaatctcgacctcgcgttcccgctacatctcctcttacaactaccgcaactcccgactacgctatacctcccacttaaaacgcaaacgatcaaccaactaccgccgctcccgctcgacctcctcacgcaactaacgctcccgaacaacgaaacgccgccgttccgcccgccaacctacccgctccgcctccaactccgcccgtaacttctccaactcccgcctctaattctccaacactaccgccgccgaactaaaacaacccgacttcttaaacgacgcgcccaaaaaactaaacgaatccttaaccattacgaccgcgacccgactaatctccaaacttcgcctaacaaacctcaactcgccaacgaccgccgccgaccgcccgacgcgccccttccgacgccc

SEQ ID NO: 19219 - DNA, 843 bp, Artificial Sequence
  chemically treated genomic DNA (Homo sapiens) CpG-island No: 19219
tagagattcgagttggtaggcgggtttgggggcgtggtaagagtcgttggaggtttggggtagcggtttttttaaggaatgtatagtttgggggttcggtgatttcgataaagtcgggtgttcgcggaagtgcgttaggatgtatttgaggaagagttggcgttttatttttagcgtcgtttgtagatagcggatgcgcgtcgtttgttcgtcgttagtttgttagcgaagttgcgttaatattttttgtaggcgatagcggtattgcgtcgcggaaatttcggacgttttcgggcggttatagtggtcgcggtttattagtttttcggttagttggcgttgtagttttcgggtttggcgtattacgttatcgcgttttcggtgtagtagttgttgtagttgtcgttgttcggtttttttttagcgtagtagttgtcggatttcggtttcgcgttttcgttgtatttttttttgtagttgtcgtaattttcggttgcgttgtgttttttatttggagcgtagacggttagttagttgtcgtcgttttcgttcggtttttttacgtagttggcgttttcgggtagcgaagcgtcgtcgtttcgttcgttagtttgttcgtttcgtttttagtttcgttcgtagtttttttagttttcgtttttggttttttagtattgtcgtcgtcgggttggagtagttcggttttttgggcgacgcgtttaaggggttgggcgagtttttggttattgcggtcgcggttcggttggtttttagatttcgtttggtaggttttagttcgttaacggtcgtcgtcgatcgttcggcgcgtttttttcggcgttt

SEQ ID NO: 19220 - DNA, 843 bp, Artificial Sequence
  chemically treated genomic DNA (Homo sapiens) CpG-island No: 19220
aaacgccgaaaaaaacgcgccgaacgatcgacgacgaccgttaacgaactaaaacctaccaaacgaaatctaaaaaccaaccgaaccgcgaccgcaataaccaaaaactcgcccaaccccttaaacgcgtcgcccaaaaaaccgaactactccaacccgacgacgacaatactaaaaaaccaaaaacgaaaactaaaaaaactacgaacgaaactaaaaacgaaacgaacaaactaacgaacgaaacgacgacgcttcgctacccgaaaacgccaactacgtaaaaaaaccgaacgaaaacgacgacaactaactaaccgtctacgctccaaataaaaaacacaacgcaaccgaaaattacgacaactacaaaaaaaaatacaacgaaaacgcgaaaccgaaatccgacaactactacgctaaaaaaaaaccgaacaacgacaactacaacaactactacaccgaaaacgcgataacgtaatacgccaaacccgaaaactacaacgccaactaaccgaaaaactaataaaccgcgaccactataaccgcccgaaaacgtccgaaatttccgcgacgcaataccgctatcgcctacaaaaaatattaacgcaacttcgctaacaaactaacgacgaacaaacgacgcgcatccgctatctacaaacgacgctaaaaataaaacgccaactcttcctcaaatacatcctaacgcacttccgcgaacacccgactttatcgaaatcaccgaacccccaaactatacattccttaaaaaaaccgctaccccaaacctccaacgactcttaccacgcccccaaacccgcctaccaactcgaatctcta

SEQ ID NO: 19221 - DNA, 937 bp, Artificial Sequence
  chemically treated genomic DNA (Homo sapiens) CpG-island No: 19221
cgtgttggtgttcgttcgcgtgcgtgggggttttgtttagtagttttcggaagtagtttagttgggtttcgagtttttttcgtatttagagggcgagcgagagatattttgagcgatcgggagtagttgtcgaggatatttttttcgtgttttcgtgtgatggttttagtgtttgaatgcggaagttatttatcgttagtttttaacggttttatagtatttttcgggcggagttttgggggttttcgcgagtatttttttgtagttgcggtttcgtatttgaggtaaatttacgttttcggtcgttatcgtttttcggaattttattttgttaaggaagaagtttttcgggtcgagtagcgatgaggcgttacggcgggtcggatttacggggcggttttcggataggttggcgtggaggttcgtggggatgttgtgtttgagggcggagcgcgagttggagtattagcggtcgcggagtcgcgcgttttaagtcgatcgtcgttttgttagaggttttttttttatttgcgggttagtttcgtcgcgtttttcgtggtcgtatcgttgattagtagggatacgttggttatagtttcggttagaaaggtttttacgatatttttatcgcgtcgcgggtagtaattaaagtcgttcgcggtgattattaggcgtatgcgagggcgggatatggtcgtttgggtttatcgttcgcgtttttaggggagtgggtcggatagtttaggtttcgttttcggacgttgttcgggtttcgtttcgacgtatacgtttaggtgcggttgtatttcgtttttgttttcgttatttagcggttcggcgtgtttttgtaaggattcggtaattgttttcgcgttaattagattagtgatggatttattgtaatgcggaattttttttgattgtaaaagtgatattt

SEQ ID NO: 19222 - DNA, 937 bp, Artificial Sequence
  chemically treated genomic DNA (Homo sapiens) CpG-island No: 19222
aaatatcacttttacaatcaaaaaaaattccgcattacaataaatccatcactaatctaattaacgcgaaaacaattaccgaatccttacaaaaacacgccgaaccgctaaataacgaaaacaaaaacgaaatacaaccgcacctaaacgtatacgtcgaaacgaaacccgaacaacgtccgaaaacgaaacctaaactatccgacccactcccctaaaaacgcgaacgataaacccaaacgaccatatcccgccctcgcatacgcctaataatcaccgcgaacgactttaattactacccgcgacgcgataaaaatatcgtaaaaacctttctaaccgaaactataaccaacgtatccctactaatcaacgatacgaccacgaaaaacgcgacgaaactaacccgcaaataaaaaaaaaacctctaacaaaacgacgatcgacttaaaacgcgcgactccgcgaccgctaatactccaactcgcgctccgccctcaaacacaacatccccacgaacctccacgccaacctatccgaaaaccgccccgtaaatccgacccgccgtaacgcctcatcgctactcgacccgaaaaacttcttccttaacaaaataaaattccgaaaaacgataacgaccgaaaacgtaaatttacctcaaatacgaaaccgcaactacaaaaaaatactcgcgaaaacccccaaaactccgcccgaaaaatactataaaaccgttaaaaactaacgataaataacttccgcattcaaacactaaaaccatcacacgaaaacacgaaaaaaatatcctcgacaactactcccgatcgctcaaaatatctctcgctcgccctctaaatacgaaaaaaactcgaaacccaactaaactacttccgaaaactactaaacaaaacccccacgcacgcgaacgaacaccaacacg

SEQ ID NO: 19223 - DNA, 937 bp, Artificial Sequence
  chemically treated genomic DNA (Homo sapiens) CpG-island No: 19223
aaatattatttttgtagttaaggaaagtttcgtattgtaatgaatttattattggtttggttagcgcgggagtagttgtcgggtttttgtaggggtacgtcggatcgttaggtggcgagaataaaggcgaagtgtagtcgtatttgggcgtgtgcgtcggggcggggttcgggtagcgttcgggggcggggtttgggttgttcggtttatttttttgggagcgcgagcggtggatttaggcggttatgtttcgttttcgtatgcgtttggtggttatcgcggacgattttggttattgttcgcgacgcgatgagggtatcgtggaggtttttttggtcggggttgtgattagcgtgtttttgttggttaacggtgcggttacggagagcgcggcggagttggttcgtaggtgaggggagggtttttagtagggcggcgatcggtttggggcgcgcggtttcgcggtcgttagtgttttagttcgcgtttcgtttttaggtatagtatttttacgggtttttacgttaatttgttcgagggtcgtttcgtgggttcggttcgtcgtggcgttttatcgttgttcggttcggaaggttttttttttggtaagatgggatttcgggaggcggtggcggtcggagacgtggatttgttttaggtgcggagtcgtagttataggaggatgttcgcgaggatttttagagtttcgttcggagggtattgtgaggtcgttaggagttggcggtggatgattttcgtatttaaatattggagttattatacggaagtacgaggagggtattttcggtagttattttcggtcgtttaaggtgtttttcgttcgttttttaggtgcgggaggagttcgaggtttaattaagttgttttcgggagttgttgggtagggtttttacgtacgcggacgggtattagtacg

SEQ ID NO: 19224 - DNA, 937 bp, Artificial Sequence
  chemically treated genomic DNA (Homo sapiens) CpG-island No: 19224
cgtactaatacccgtccgcgtacgtaaaaaccctacccaacaactcccgaaaacaacttaattaaacctcgaactcctcccgcacctaaaaaacgaacgaaaaacaccttaaacgaccgaaaataactaccgaaaataccctcctcgtacttccgtataataactccaatatttaaatacgaaaatcatccaccgccaactcctaacgacctcacaataccctccgaacgaaactctaaaaatcctcgcgaacatcctcctataactacgactccgcacctaaaacaaatccacgtctccgaccgccaccgcctcccgaaatcccatcttaccaaaaaaaaaaccttccgaaccgaacaacgataaaacgccacgacgaaccgaacccacgaaacgaccctcgaacaaattaacgtaaaaacccgtaaaaatactatacctaaaaacgaaacgcgaactaaaacactaacgaccgcgaaaccgcgcgccccaaaccgatcgccgccctactaaaaaccctcccctcacctacgaaccaactccgccgcgctctccgtaaccgcaccgttaaccaacaaaaacacgctaatcacaaccccgaccaaaaaaacctccacgataccctcatcgcgtcgcgaacaataaccaaaatcgtccgcgataaccaccaaacgcatacgaaaacgaaacataaccgcctaaatccaccgctcgcgctcccaaaaaaataaaccgaacaacccaaaccccgcccccgaacgctacccgaaccccgccccgacgcacacgcccaaatacgactacacttcgcctttattctcgccacctaacgatccgacgtacccctacaaaaacccgacaactactcccgcgctaaccaaaccaataataaattcattacaatacgaaactttccttaactacaaaaataatattt

SEQ ID NO: 19225 - DNA, 759 bp, Artificial Sequence
  chemically treated genomic DNA (Homo sapiens) CpG-island No: 19225
cgaggagtcgcgtttttattaattgtttacgtttatttttcgcggttcggagatttagtcgtttttttttgggtatttattggtaagttttcggaagcgtggattaattaaaatttttttcgtgtttttagttttcgtttagttacggttttcgcgaatcgggggcgggtttttttcgcgttgatttagtggtagtgtaagcggagtgtcgcgcgggtcgattattggttgtcgtaagcgggcgttgttagaatcggattgggtcgcggcggggacggaagcggtttttgggttcgaggggttggagtcgggtcggggcgatgtggagcgcgggtcgcggcggggttgtttggtcggtgttgttggggttgttgttggcgttgttagtgtcgggcggtggtgtcgttaagatcggtgcggagttcgtgatttgcgggtcggtgttgaagttgtttaatacgtattatcgcgtgcggttgtattcgtacgatattaaatacggattcggtgcgtggggttagcgattgggagagcgcggggaatcggggttcggggttgggagtgtggagatagggtggttatgggggtttgtgggtcgtttggaagtcgggcggcgggggttttagagtcgttgggaggtcgaggggttaaagttttgagggtgtcgaggatattgagggtggggacggtcgtcggggaattgcgggtttaaagattgagggggtgttaggcgggggttgggggtgagtttttggggtt

SEQ ID NO: 19226 - DNA, 759 bp, Artificial Sequence
  chemically treated genomic DNA (Homo sapiens) CpG-island No: 19226
aaccccaaaaactcacccccaacccccgcctaacaccccctcaatctttaaacccgcaattccccgacgaccgtccccaccctcaatatcctcgacaccctcaaaactttaacccctcgacctcccaacgactctaaaacccccgccgcccgacttccaaacgacccacaaacccccataaccaccctatctccacactcccaaccccgaaccccgattccccgcgctctcccaatcgctaaccccacgcaccgaatccgtatttaatatcgtacgaatacaaccgcacgcgataatacgtattaaacaacttcaacaccgacccgcaaatcacgaactccgcaccgatcttaacgacaccaccgcccgacactaacaacgccaacaacaaccccaacaacaccgaccaaacaaccccgccgcgacccgcgctccacatcgccccgacccgactccaacccctcgaacccaaaaaccgcttccgtccccgccgcgacccaatccgattctaacaacgcccgcttacgacaaccaataatcgacccgcgcgacactccgcttacactaccactaaatcaacgcgaaaaaaacccgcccccgattcgcgaaaaccgtaactaaacgaaaactaaaaacacgaaaaaaattttaattaatccacgcttccgaaaacttaccaataaatacccaaaaaaaaacgactaaatctccgaaccgcgaaaaataaacgtaaacaattaataaaaacgcgactcctcg

SEQ ID NO: 19227 - DNA, 759 bp, Artificial Sequence
  chemically treated genomic DNA (Homo sapiens) CpG-island No: 19227
gattttaagggtttatttttagttttcgtttgatatttttttagtttttgggttcgtagtttttcgacgatcgtttttatttttaatattttcgatatttttaaagttttggtttttcgattttttaacgattttagagttttcgtcgttcggtttttagacggtttatagatttttatgattattttgtttttatatttttaatttcgagtttcggtttttcgcgtttttttagtcgttggttttacgtatcggattcgtatttgatgtcgtgcgagtgtagtcgtacgcggtggtgcgtattgagtagttttagtatcgattcgtaggttacgagtttcgtatcggttttggcggtattatcgttcggtattaatagcgttagtagtagttttaatagtatcggttaggtagtttcgtcgcggttcgcgttttatatcgtttcggttcggttttagtttttcgggtttaggggtcgttttcgttttcgtcgcggtttaattcggttttgatagcgttcgtttgcggtagttaatagtcggttcgcgcggtatttcgtttgtattgttattgggttagcgcggggagggttcgttttcggttcgcgagagtcgtagttgggcggggattggagatacgaggagggttttgattggtttacgttttcgaggatttattaatgagtgtttagggaagggcggttgagttttcgagtcgcggagagtgagcgtgaatagttggtgaagacgcggtttttcg

SEQ ID NO: 19228 - DNA, 759 bp, Artificial Sequence
  chemically treated genomic DNA (Homo sapiens) CpG-island No: 19228
cgaaaaaccgcgtcttcaccaactattcacgctcactctccgcgactcgaaaactcaaccgcccttccctaaacactcattaataaatcctcgaaaacgtaaaccaatcaaaaccctcctcgtatctccaatccccgcccaactacgactctcgcgaaccgaaaacgaaccctccccgcgctaacccaataacaatacaaacgaaataccgcgcgaaccgactattaactaccgcaaacgaacgctatcaaaaccgaattaaaccgcgacgaaaacgaaaacgacccctaaacccgaaaaactaaaaccgaaccgaaacgatataaaacgcgaaccgcgacgaaactacctaaccgatactattaaaactactactaacgctattaataccgaacgataataccgccaaaaccgatacgaaactcgtaacctacgaatcgatactaaaactactcaatacgcaccaccgcgtacgactacactcgcacgacatcaaatacgaatccgatacgtaaaaccaacgactaaaaaaacgcgaaaaaccgaaactcgaaattaaaaatataaaaacaaaataatcataaaaatctataaaccgtctaaaaaccgaacgacgaaaactctaaaatcgttaaaaaatcgaaaaaccaaaactttaaaaatatcgaaaatattaaaaataaaaacgatcgtcgaaaaactacgaacccaaaaactaaaaaaatatcaaacgaaaactaaaaataaacccttaaaatc

SEQ ID NO: 19229 - DNA, 889 bp, Artificial Sequence
  chemically treated genomic DNA (Homo sapiens) CpG-island No: 19229
gttcgggaggttatagatagcgaggaggggcgttcgtcggaggggattaggggtttgtcgagaggtggggattttaaagaagttgttgattaattacgttttcggcgtagttaagagttcgattcgggttaaaggttcgatggtttttgcggaattgggttaggattcgcgtagtcgcgttcgttttttcgaggtcgtgagcgcgcgtgtttagagtaacgggtattgtcgtttgaggtaggcgattggggattggtttcgttttcggttttcgcgcggattggttggggcggggcggcgcggttgtagtaggttagagagttcgtatttgcgtcgcggtcgtggggagagagggtgcgtttcggtagtttcgtacgacgggtttcgttttttttggtgattttacgtttcggtttcggggggagtggcggtcggcgcgtcgagattttcgggagtttcgtttagacgtttgtttcgtttttaggttattcgggttttttagtcgcgttcgttcgtagagattttagataagttcgatagcgaggtttcgtagagtaagatttgttagtagattttcgaggaggatttggagaggtaggcggatatttatattgggcgcgcgttgcgttttttttttcgtagtttcgttcgtaattcgtcgttggcggagagggtggtataattggaatagcgcgggttttttttttttcggatgcggtcgcggggtatgggatcggttgggcgggaattgttattattcgggttcgtcgttttttaggaaagagtttcgacgattggagttttgggggtcggggatgggggtggggtggagaggtcgtcgtcggtttagttggggttgtagggtaggatttattagaaagtcgaggtt

SEQ ID NO: 19230 - DNA, 889 bp, Artificial Sequence
  chemically treated genomic DNA (Homo sapiens) CpG-island No: 19230
aacctcgactttctaataaatcctaccctacaaccccaactaaaccgacgacgacctctccaccccacccccatccccgacccccaaaactccaatcgtcgaaactctttcctaaaaaacgacgaacccgaataataacaattcccgcccaaccgatcccataccccgcgaccgcatccgaaaaaaaaaaaacccgcgctattccaattataccaccctctccgccaacgacgaattacgaacgaaactacgaaaaaaaaaacgcaacgcgcgcccaatataaatatccgcctacctctccaaatcctcctcgaaaatctactaacaaatcttactctacgaaacctcgctatcgaacttatctaaaatctctacgaacgaacgcgactaaaaaacccgaataacctaaaaacgaaacaaacgtctaaacgaaactcccgaaaatctcgacgcgccgaccgccactccccccgaaaccgaaacgtaaaatcaccaaaaaaaacgaaacccgtcgtacgaaactaccgaaacgcaccctctctccccacgaccgcgacgcaaatacgaactctctaacctactacaaccgcgccgccccgccccaaccaatccgcgcgaaaaccgaaaacgaaaccaatccccaatcgcctacctcaaacgacaatacccgttactctaaacacgcgcgctcacgacctcgaaaaaacgaacgcgactacgcgaatcctaacccaattccgcaaaaaccatcgaacctttaacccgaatcgaactcttaactacgccgaaaacgtaattaatcaacaacttctttaaaatccccacctctcgacaaacccctaatcccctccgacgaacgcccctcctcgctatctataacctcccgaac

SEQ ID NO: 19231 - DNA, 889 bp, Artificial Sequence
  chemically treated genomic DNA (Homo sapiens) CpG-island No: 19231
agtttcggttttttgatagattttattttgtagttttagttaggtcgacggcgatttttttattttatttttattttcggtttttaaagttttaatcgtcggagtttttttttaggggacggcggattcgggtagtgatagttttcgtttagtcggttttatgtttcgcggtcgtattcggaaaaaagagagttcgcgttgttttaattgtattatttttttcgttagcgacgggttgcggacggggttgcggaagaggaggcgtagcgcgcgtttagtgtaggtgttcgtttgtttttttaagtttttttcggagatttgttggtaggttttgttttgcgggatttcgttgtcgaatttgtttaggatttttacgagcgagcgcggttggagagttcgggtggtttggaagcggagtaggcgtttgggcggggttttcgagggtttcggcgcgtcgatcgttatttttttcgaggtcggagcgtggggttattaggggaggcggggttcgtcgtgcgggattgtcgggacgtattttttttttttacggtcgcggcgtaggtgcggattttttagtttattgtagtcgcgtcgtttcgttttagttaattcgcgcggaagtcgggggcggggttaatttttagtcgtttgttttaggcgataatgttcgttgttttgggtacgcgcgtttacgatttcgagggggcgaacgcggttgcgcgggttttggtttagtttcgtaggggttatcgggtttttgattcgggtcgggtttttggttgcgtcgaggacgtggttggttagtaatttttttaaggtttttatttttcggtaggtttttagtttttttcgacgggcgttttttttcgttgtttgtagtttttcgggt

SEQ ID NO: 19232 - DNA, 889 bp, Artificial Sequence
  chemically treated genomic DNA (Homo sapiens) CpG-island No: 19232
acccgaaaaactacaaacaacgaaaaaaaacgcccgtcgaaaaaaactaaaaacctaccgaaaaataaaaaccttaaaaaaattactaaccaaccacgtcctcgacgcaaccaaaaacccgacccgaatcaaaaacccgataacccctacgaaactaaaccaaaacccgcgcaaccgcgttcgccccctcgaaatcgtaaacgcgcgtacccaaaacaacgaacattatcgcctaaaacaaacgactaaaaattaaccccgcccccgacttccgcgcgaattaactaaaacgaaacgacgcgactacaataaactaaaaaatccgcacctacgccgcgaccgtaaaaaaaaaaaatacgtcccgacaatcccgcacgacgaaccccgcctcccctaataaccccacgctccgacctcgaaaaaaataacgatcgacgcgccgaaaccctcgaaaaccccgcccaaacgcctactccgcttccaaaccacccgaactctccaaccgcgctcgctcgtaaaaatcctaaacaaattcgacaacgaaatcccgcaaaacaaaacctaccaacaaatctccgaaaaaaacttaaaaaaacaaacgaacacctacactaaacgcgcgctacgcctcctcttccgcaaccccgtccgcaacccgtcgctaacgaaaaaaataatacaattaaaacaacgcgaactctcttttttccgaatacgaccgcgaaacataaaaccgactaaacgaaaactatcactacccgaatccgccgtcccctaaaaaaaaactccgacgattaaaactttaaaaaccgaaaataaaaataaaataaaaaaatcgccgtcgacctaactaaaactacaaaataaaatctatcaaaaaaccgaaact

SEQ ID NO: 19233 - DNA, 1028 bp, Artificial Sequence
  chemically treated genomic DNA (Homo sapiens) CpG-island No: 19233
gttttcgttcgttcggacgtttaataggtgtttttcgggttcgttcgtagttatagtatttttgggtggttataaagtaatcgttcgcgtagttgtagttaggttcgttcgtatttacggtcgtttcgcggttcgcgtttcggttcgtagcgtttattcggttcgggtttcggttagcgcgggttcggtttttaggcgttttcggcgcggttcgggacgcgttgaggtcgttaacgtttaggtagggcgcgaggtattttttcgtcgtcgtttcgcgggtcgtttgttttttgttttggagtcgtagttcggtttagacgtcgttaatagttttggagcgcggcgtcggttaattagcgcgttatgtcgttagcgtttcgtttttattttgttttcgtttcgtttcgcgtttcgtttgtttcgcgcgttttcgtttcgcgcgtttcgggttaaggagtttcgttagttcgtattcggtcgggacgggtaggagtttacgtgtcgcggggcgcgtcgtatttttattggttgattcgtcgggcgcggtttcggagttagtttgtaagggtcgagggatacgggggcggggtcgcgcggggcggggcgagagtaggggcgggtttcgcgaggagcgtcgcgttcggacgtaggttggttgggtagggatattcggtcggcggggttggcggtggtggttattcgttttttcggttcgcggggatgggtcgagggcgtgtagggttcgtagttttagaggttgaggcgagtttgcgcgtagttttttcgtttagcgtcgtgtacgtatcgttcgttcgcgcggtcggtcgcgttgtaggggacggacgtggaggtcgaggcgagtttgtgtgcgtttgattagggttcgttttggtcggattttttcgcggtcgggtttttagaatgcggtcgttcgtgttgtttcgtttttattattttttttgaatttaaggatttaattttttaggattttttcgttacggaggatttttcgggtttgcgtttggttt

SEQ ID NO: 19234 - DNA, 1028 bp, Artificial Sequence
  chemically treated genomic DNA (Homo sapiens) CpG-island No: 19234
aaaccaaacgcaaacccgaaaaatcctccgtaacgaaaaaatcctaaaaaattaaatccttaaattcaaaaaaaataataaaaacgaaacaacacgaacgaccgcattctaaaaacccgaccgcgaaaaaatccgaccaaaacgaaccctaatcaaacgcacacaaactcgcctcgacctccacgtccgtcccctacaacgcgaccgaccgcgcgaacgaacgatacgtacacgacgctaaacgaaaaaactacgcgcaaactcgcctcaacctctaaaactacgaaccctacacgccctcgacccatccccgcgaaccgaaaaaacgaataaccaccaccgccaaccccgccgaccgaatatccctacccaaccaacctacgtccgaacgcgacgctcctcgcgaaacccgcccctactctcgccccgccccgcgcgaccccgcccccgtatccctcgacccttacaaactaactccgaaaccgcgcccgacgaatcaaccaataaaaatacgacgcgccccgcgacacgtaaactcctacccgtcccgaccgaatacgaactaacgaaactccttaacccgaaacgcgcgaaacgaaaacgcgcgaaacaaacgaaacgcgaaacgaaacgaaaacaaaataaaaacgaaacgctaacgacataacgcgctaattaaccgacgccgcgctccaaaactattaacgacgtctaaaccgaactacgactccaaaacaaaaaacaaacgacccgcgaaacgacgacgaaaaaatacctcgcgccctacctaaacgttaacgacctcaacgcgtcccgaaccgcgccgaaaacgcctaaaaaccgaacccgcgctaaccgaaacccgaaccgaataaacgctacgaaccgaaacgcgaaccgcgaaacgaccgtaaatacgaacgaacctaactacaactacgcgaacgattactttataaccacccaaaaatactataactacgaacgaacccgaaaaacacctattaaacgtccgaacgaacgaaaac

SEQ ID NO: 19235 - DNA, 1028 bp, Artificial Sequence
  chemically treated genomic DNA (Homo sapiens) CpG-island No: 19235
gggttagacgtagattcggggggtttttcgtggcgagggggttttagggggttaggtttttgggtttagagagggtggtggggacgggatagtacggacgatcgtattttggggattcggtcgcggaggggttcggttaaggcgggttttggttaggcgtatataagttcgtttcggtttttacgttcgttttttataacgcggtcgatcgcgcggacgggcggtacgtgtacggcgttggacgaggaggttgcgcgtaagttcgttttagtttttggagttgcgggttttgtacgttttcggtttattttcgcgagtcggaggaacgagtgattattatcgttagtttcgtcggtcgagtgtttttgtttagttagtttgcgttcgagcgcggcgtttttcgcggaattcgtttttgttttcgtttcgtttcgcgcggtttcgttttcgtgtttttcggtttttataggttggtttcgaggtcgcgttcggcgggttagttaatgggagtgcggcgcgtttcgcggtacgtgggtttttgttcgtttcggtcgggtgcgagttggcggagttttttggttcggagcgcgcggggcgggggcgcgcggggtaggcgggacgcggggcggaacggaggtaggatgggggcggggcgttggcgatatggcgcgttgattggtcggcgtcgcgttttaaggttgttaacggcgtttgggtcgggttacggttttaaaataaagggtaggcggttcgcggggcggcggcgggaggatgtttcgcgttttgtttaggcgttaacggttttagcgcgtttcgggtcgcgtcgggaacgtttgagagtcgagttcgcgttgatcggggttcgggtcggatgggcgttgcgggtcggggcgcggatcgcggagcggtcgtgagtacgggcgggtttggttgtagttgcgcgggcggttattttgtggttatttaaggatattgtggttgcgggcgggttcgggaagtatttgttgggcgttcgggcgggcgggggt

SEQ ID NO: 19236 - DNA, 1028 bp, Artificial Sequence
  chemically treated genomic DNA (Homo sapiens) CpG-island No: 19236
acccccgcccgcccgaacgcccaacaaatacttcccgaacccgcccgcaaccacaatatccttaaataaccacaaaataaccgcccgcgcaactacaaccaaacccgcccgtactcacgaccgctccgcgatccgcgccccgacccgcaacgcccatccgacccgaaccccgatcaacgcgaactcgactctcaaacgttcccgacgcgacccgaaacgcgctaaaaccgttaacgcctaaacaaaacgcgaaacatcctcccgccgccgccccgcgaaccgcctaccctttattttaaaaccgtaacccgacccaaacgccgttaacaaccttaaaacgcgacgccgaccaatcaacgcgccatatcgccaacgccccgcccccatcctacctccgttccgccccgcgtcccgcctaccccgcgcgcccccgccccgcgcgctccgaaccaaaaaactccgccaactcgcacccgaccgaaacgaacaaaaacccacgtaccgcgaaacgcgccgcactcccattaactaacccgccgaacgcgacctcgaaaccaacctataaaaaccgaaaaacacgaaaacgaaaccgcgcgaaacgaaacgaaaacaaaaacgaattccgcgaaaaacgccgcgctcgaacgcaaactaactaaacaaaaacactcgaccgacgaaactaacgataataatcactcgttcctccgactcgcgaaaataaaccgaaaacgtacaaaacccgcaactccaaaaactaaaacgaacttacgcgcaacctcctcgtccaacgccgtacacgtaccgcccgtccgcgcgatcgaccgcgttataaaaaacgaacgtaaaaaccgaaacgaacttatatacgcctaaccaaaacccgccttaaccgaacccctccgcgaccgaatccccaaaatacgatcgtccgtactatcccgtccccaccaccctctctaaacccaaaaacctaaccccctaaaaccccctcgccacgaaaaaccccccgaatctacgtctaaccc

SEQ ID NO: 19237 - DNA, 939 bp, Artificial Sequence
  chemically treated genomic DNA (Homo sapiens) CpG-island No: 19237
gtcgcgttgcgttcggggttaagggtttattagtatcggtttacgtttttcgcgttattttttgagttttttttcgagcgatcgaaggttcgggaatcgcgagtaataatatttaaattttaatcggttcggggtcgcgttcgagttttggcgcgcggatcgcggtgaagttcgggttcgaggtcgtcgcggcgtttgaggtcgaggcgcgggcgaggtcgaggttgcgttcgttgcggtttcgggcggtgggggggtcgggcgtggtcggtcgcggatatttattatattatgtcgtaggcgttttcgtcgatgtacgagaggttggtgtagcgcggttttacgtcgaatatttgttcgcggattattttcgggttcgcgttcgtcgtcgtcgtcgtcgttatgttggttgtcgggtcgtcgtcgttttcgtcgcgttgagttcgacgttcggcggtcgtcgtttagtttttgtcgtttttttcgtagggattgcgtcgtcgtcggtgtagtcgtcgacgttgatcgggaggaggaaggaagacgtcgagcgggagagttgaagagtcgatagttattcggatcgattgtttgtttgtttgttagattgacgggcgggtcggcgggcgggcggagggaggggcgcgcgtcgaggagggtgtcggggcggggataagaagtgtgtatgcggattggtttttcgcggttgggggcggggtcgcgcgggtcggcggaagcggcgggtttcgggaggggtattgcgacggcgttgattgagggggcgttattaggcgcggttacgtgtattcgcggtgtattcgcgggggcgtcggtgcgggtcgcgttttttaagatatttagggagatagacgtggggtagaatttatgggttgaagtgagagatggttggggtttaggcgagcgatcgagtagggttcg

SEQ ID NO: 19238 - DNA, 939 bp, Artificial Sequence
  chemically treated genomic DNA (Homo sapiens) CpG-island No: 19238
cgaaccctactcgatcgctcgcctaaaccccaaccatctctcacttcaacccataaattctaccccacgtctatctccctaaatatcttaaaaaacgcgacccgcaccgacgcccccgcgaatacaccgcgaatacacgtaaccgcgcctaataacgccccctcaatcaacgccgtcgcaatacccctcccgaaacccgccgcttccgccgacccgcgcgaccccgcccccaaccgcgaaaaaccaatccgcatacacacttcttatccccgccccgacaccctcctcgacgcgcgcccctccctccgcccgcccgccgacccgcccgtcaatctaacaaacaaacaaacaatcgatccgaataactatcgactcttcaactctcccgctcgacgtcttccttcctcctcccgatcaacgtcgacgactacaccgacgacgacgcaatccctacgaaaaaaacgacaaaaactaaacgacgaccgccgaacgtcgaactcaacgcgacgaaaacgacgacgacccgacaaccaacataacgacgacgacgacgacgaacgcgaacccgaaaataatccgcgaacaaatattcgacgtaaaaccgcgctacaccaacctctcgtacatcgacgaaaacgcctacgacataatataataaatatccgcgaccgaccacgcccgacccccccaccgcccgaaaccgcaacgaacgcaacctcgacctcgcccgcgcctcgacctcaaacgccgcgacgacctcgaacccgaacttcaccgcgatccgcgcgccaaaactcgaacgcgaccccgaaccgattaaaatttaaatattattactcgcgattcccgaaccttcgatcgctcgaaaaaaaactcaaaaaataacgcgaaaaacgtaaaccgatactaataaacccttaaccccgaacgcaacgcgac

SEQ ID NO: 19239 - DNA, 939 bp, Artificial Sequence
  chemically treated genomic DNA (Homo sapiens) CpG-island No: 19239
cggattttgttcggtcgttcgtttgggttttagttattttttattttagtttatgagttttgttttacgtttgtttttttgggtgttttaagagacgcgattcgtatcgacgttttcgcgaatgtatcgcgaatgtacgtgatcgcgtttagtggcgtttttttagttaacgtcgtcgtagtgtttttttcgaagttcgtcgttttcgtcggttcgcgcggtttcgtttttagtcgcgaggaattaattcgtatgtatattttttgttttcgtttcggtatttttttcggcgcgcgttttttttttcgttcgttcgtcggttcgttcgttagtttggtaggtaggtaggtaatcggttcgagtggttgtcggttttttagttttttcgttcggcgttttttttttttttttcggttagcgtcggcggttgtatcggcggcggcgtagtttttgcgggaggggcgataagagttgagcggcggtcgtcgagcgtcgagtttagcgcggcggaggcggcggcggttcggtagttaatatggcggcggcggcggcggcgggcgcgggttcggagatggttcgcgggtaggtgttcgacgtggggtcgcgttatattaatttttcgtatatcggcgagggcgtttacggtatggtgtggtgagtgttcgcgatcggttacgttcggtttttttatcgttcggggtcgtagcggacgtagtttcggtttcgttcgcgtttcggttttaggcgtcgcggcgatttcgaattcggattttatcgcggttcgcgcgttagggttcgggcgcggtttcgggtcggttgaggtttaggtgttgttgttcgcggttttcgggttttcggtcgttcgggaaggggtttagggagtggcgcggggggcgtaggtcggtattagtggatttttggtttcgggcgtagcgcggt

SEQ ID NO: 19240 - DNA, 939 bp, Artificial Sequence
  chemically treated genomic DNA (Homo sapiens) CpG-island No: 19240
accgcgctacgcccgaaaccaaaaatccactaataccgacctacgccccccgcgccactccctaaaccccttcccgaacgaccgaaaacccgaaaaccgcgaacaacaacacctaaacctcaaccgacccgaaaccgcgcccgaaccctaacgcgcgaaccgcgataaaatccgaattcgaaatcgccgcgacgcctaaaaccgaaacgcgaacgaaaccgaaactacgtccgctacgaccccgaacgataaaaaaaccgaacgtaaccgatcgcgaacactcaccacaccataccgtaaacgccctcgccgatatacgaaaaattaatataacgcgaccccacgtcgaacacctacccgcgaaccatctccgaacccgcgcccgccgccgccgccgccgccatattaactaccgaaccgccgccgcctccgccgcgctaaactcgacgctcgacgaccgccgctcaactcttatcgcccctcccgcaaaaactacgccgccgccgatacaaccgccgacgctaaccgaaaaaaaaaaaaaaaacgccgaacgaaaaaactaaaaaaccgacaaccactcgaaccgattacctacctacctaccaaactaacgaacgaaccgacgaacgaacgaaaaaaaaaacgcgcgccgaaaaaaataccgaaacgaaaacaaaaaatatacatacgaattaattcctcgcgactaaaaacgaaaccgcgcgaaccgacgaaaacgacgaacttcgaaaaaaacactacgacgacgttaactaaaaaaacgccactaaacgcgatcacgtacattcgcgatacattcgcgaaaacgtcgatacgaatcgcgtctcttaaaacacccaaaaaaacaaacgtaaaacaaaactcataaactaaaataaaaaataactaaaacccaaacgaacgaccgaacaaaatccg

SEQ ID NO: 19241 - DNA, 1005 bp, Artificial Sequence
  chemically treated genomic DNA (Homo sapiens) CpG-island No: 19241
aatcgtaaaattttttagcgagggggcgaacgcgggcgtagggtcgtttgtataatgggagttttttcgtttgttaggtagcgtagttcgttcgacgttgttcggattagattgttaatgaaaaggtataaagagtcggcgttcgttcgttcgtcgattttcgtttcgtagattcgcgtcgtttgggtttggcgcggttcggtgggttttgtgtttcgggtgttttatcgttcgcgttttttcgggtatttggtttataaagttcgggtttgttaggggtttcgcgtgcgttttagtttaggttcgttagacgttagcgcgttttttacgcgcgtagttttacgtcgttcgggcgcgcgcgcgtttacgttttttttttcggggacgcgtttagttcgcggtttcggttttcgttcgtttttcgcgtttttcgttttataaggtcgttttttatttcgtgtgcgtcggcggcggcgtttcgttcgtcggtcggtcggttttattagcggtttttgtttttagcgttcggttcgcgtcgtacgcgttcgtttcgttcgtttgtcgttagttcggttcggtttttcgtttagcgcgtttcgagcgtcgtttatagtcgttcgtttagcgttattttggaagtttgtgacgtcggcgtcgttcgtttatttttgatttatatttgaatgggcgagcggcggggcggggatagggggtagttgggggcgtggtttgtgaataggggcggggtttgcgggggcggggtcgggtcggatagcggttttagtattaggcggggcgggttgtcggggttcggcgtcgtgggggaggggtgcgcgggaggagtcggggatttagatttcggatatttaatcggatttcgattttaagcgttagggtaggatcgcgatttcgtttttgaaatattcggatcgtatatcggttttcgggatagggattttggtttttttcgataggttgacgtttatttttttaaattttggtgga

SEQ ID NO: 19242 - DNA, 1005 bp, Artificial Sequence
  chemically treated genomic DNA (Homo sapiens) CpG-island No: 19242
tccaccaaaatttaaaaaaataaacgtcaacctatcgaaaaaaaccaaaatccctatcccgaaaaccgatatacgatccgaatatttcaaaaacgaaatcgcgatcctaccctaacgcttaaaatcgaaatccgattaaatatccgaaatctaaatccccgactcctcccgcgcacccctcccccacgacgccgaaccccgacaacccgccccgcctaatactaaaaccgctatccgacccgaccccgcccccgcaaaccccgcccctattcacaaaccacgcccccaactaccccctatccccgccccgccgctcgcccattcaaatataaatcaaaaataaacgaacgacgccgacgtcacaaacttccaaaataacgctaaacgaacgactataaacgacgctcgaaacgcgctaaacgaaaaaccgaaccgaactaacgacaaacgaacgaaacgaacgcgtacgacgcgaaccgaacgctaaaaacaaaaaccgctaataaaaccgaccgaccgacgaacgaaacgccgccgccgacgcacacgaaataaaaaacgaccttataaaacgaaaaacgcgaaaaacgaacgaaaaccgaaaccgcgaactaaacgcgtccccgaaaaaaaaaacgtaaacgcgcgcgcgcccgaacgacgtaaaactacgcgcgtaaaaaacgcgctaacgtctaacgaacctaaactaaaacgcacgcgaaacccctaacaaacccgaactttataaaccaaatacccgaaaaaacgcgaacgataaaacacccgaaacacaaaacccaccgaaccgcgccaaacccaaacgacgcgaatctacgaaacgaaaatcgacgaacgaacgaacgccgactctttataccttttcattaacaatctaatccgaacaacgtcgaacgaactacgctacctaacaaacgaaaaaactcccattatacaaacgaccctacgcccgcgttcgccccctcgctaaaaaattttacgatt

SEQ ID NO: 19243 - DNA, 1005 bp, Artificial Sequence
  chemically treated genomic DNA (Homo sapiens) CpG-island No: 19243
tttattagagtttgagggggtgggcgttagtttgtcggggggggttagggtttttgtttcgggggtcggtatgcggttcgggtattttaggggcgaggtcgcggttttgttttggcgtttgaggtcggagttcggttagatgttcggggtttgggttttcggtttttttcgcgtattttttttttacggcgtcggatttcggtagttcgtttcgtttagtgttgggatcgttgttcggttcggtttcgttttcgtaggtttcgtttttgtttataggttacgtttttagttgttttttgttttcgtttcgtcgttcgtttatttagatgtgggttaggggtgagcgggcggcgtcgacgttataagtttttaagatggcgttgggcgggcggttgtgagcggcgttcggggcgcgttaggcggggagtcgagtcgggttggcggtaggcggacggggcgggcgcgtgcggcgcgagtcgggcgttgaggataagggtcgttggtagggtcggtcggtcggcgggcggagcgtcgtcgtcgacgtatacgaggtgaggggcggttttgtggggcggggggcgcggggagcgggcgggggtcggggtcgcgggttgggcgcgttttcggggagaggggcgtggacgcgcgcgcgttcgggcgacgtgggattgcgcgcgtgggggacgcgttagcgtttggcgggtttgggttggggcgtacgcgggatttttggtaggttcgggttttgtgggttagatgttcggaggggcgcgggcggtggggtattcggggtataaagtttatcgggtcgcgttaggtttaggcggcgcgggtttgcggagcgggggtcggcgggcgagcgggcgtcggttttttgtgtttttttattagtaatttaattcgaatagcgtcgggcgagttgcgttgtttgataggcgggagggtttttattatgtaaacggttttgcgttcgcgttcgttttttcgttagaggattttgcgatt

SEQ ID NO: 19244 - DNA, 1005 bp, Artificial Sequence
  chemically treated genomic DNA (Homo sapiens) CpG-island No: 19244
aatcgcaaaatcctctaacgaaaaaacgaacgcgaacgcaaaaccgtttacataataaaaaccctcccgcctatcaaacaacgcaactcgcccgacgctattcgaattaaattactaataaaaaaacacaaaaaaccgacgcccgctcgcccgccgacccccgctccgcaaacccgcgccgcctaaacctaacgcgacccgataaactttataccccgaataccccaccgcccgcgcccctccgaacatctaacccacaaaacccgaacctaccaaaaatcccgcgtacgccccaacccaaacccgccaaacgctaacgcgtcccccacgcgcgcaatcccacgtcgcccgaacgcgcgcgcgtccacgcccctctccccgaaaacgcgcccaacccgcgaccccgacccccgcccgctccccgcgccccccgccccacaaaaccgcccctcacctcgtatacgtcgacgacgacgctccgcccgccgaccgaccgaccctaccaacgacccttatcctcaacgcccgactcgcgccgcacgcgcccgccccgtccgcctaccgccaacccgactcgactccccgcctaacgcgccccgaacgccgctcacaaccgcccgcccaacgccatcttaaaaacttataacgtcgacgccgcccgctcacccctaacccacatctaaataaacgaacgacgaaacgaaaacaaaaaacaactaaaaacgtaacctataaacaaaaacgaaacctacgaaaacgaaaccgaaccgaacaacgatcccaacactaaacgaaacgaactaccgaaatccgacgccgtaaaaaaaaaatacgcgaaaaaaaccgaaaacccaaaccccgaacatctaaccgaactccgacctcaaacgccaaaacaaaaccgcgacctcgcccctaaaatacccgaaccgcataccgacccccgaaacaaaaaccctaaccccccccgacaaactaacgcccaccccctcaaactctaataaa

SEQ ID NO: 19245 - DNA, 752 bp, Artificial Sequence
  chemically treated genomic DNA (Homo sapiens) CpG-island No: 19245
gggcggcgtcgacgttataagtttttaagatggcgttgggcgggcggttgtgagcggcgttcggggcgcgttaggcggggagtcgagtcgggttggcggtaggcggacggggcgggcgcgtgcggcgcgagtcgggcgttgaggataagggtcgttggtagggtcggtcggtcggcgggcggagcgtcgtcgtcgacgtatacgaggtgaggggcggttttgtggggcgggggtcgcggggagcgggcgggggtcggggtcgcgggttgggcgcgttttcggggagaggggcgtggacgcgcgcgcgttcgggcgacgtgggattgcgcgcgtgggggacgcgttagcgtttggcgggtttgggttggggcgtacgcgggatttttggtaggttcgggttttgtgggttagatgttcggaggggcgcgggcggtggggtattcggggtataaagtttatcgggtcgcgttaggtttaggcggcgcgggtttgcggagcgggggtcggcgggcgagcgggcgtcggttttttgtgtttttttattagtaatttaattcgaatagcgtcgggcgagttgcgttgtttgataggcgggagggtttttattatgtaaacggttttgcgttcgcggtcgttttttcgttagaggattttgcgatttttaggattgcggttttgtatcgtttgcggtttttttttttgtttttttttcgcgggaagattggttacggtaggggtaggggcgggtttgg

SEQ ID NO: 19246 - DNA, 752 bp, Artificial Sequence
  chemically treated genomic DNA (Homo sapiens) CpG-island No: 19246
ccaaacccgcccctacccctaccgtaaccaatcttcccgcgaaaaaaaaacaaaaaaaaaaaccgcaaacgatacaaaaccgcaatcctaaaaatcgcaaaatcctctaacgaaaaaacgaccgcgaacgcaaaaccgtttacataataaaaaccctcccgcctatcaaacaacgcaactcgcccgacgctattcgaattaaattactaataaaaaaacacaaaaaaccgacgcccgctcgcccgccgacccccgctccgcaaacccgcgccgcctaaacctaacgcgacccgataaactttataccccgaataccccaccgcccgcgcccctccgaacatctaacccacaaaacccgaacctaccaaaaatcccgcgtacgccccaacccaaacccgccaaacgctaacgcgtcccccacgcgcgcaatcccacgtcgcccgaacgcgcgcgcgtccacgcccctctccccgaaaacgcgcccaacccgcgaccccgacccccgcccgctccccgcgacccccgccccacaaaaccgcccctcacctcgtatacgtcgacgacgacgctccgcccgccgaccgaccgaccctaccaacgacccttatcctcaacgcccgactcgcgccgcacgcgcccgccccgtccgcctaccgccaacccgactcgactccccgcctaacgcgccccgaacgccgctcacaaccgcccgcccaacgccatcttaaaaacttataacgtcgacgccgccc

SEQ ID NO: 19247 - DNA, 752 bp, Artificial Sequence
  chemically treated genomic DNA (Homo sapiens) CpG-island No: 19247
ttaggttcgtttttgtttttgtcgtggttagttttttcgcggggaggaggtaagagaggagatcgtagacggtgtaggatcgtagttttggaaatcgtaaaattttttagcgagggggcggtcgcgggcgtagggtcgtttgtataatgggagttttttcgtttgttaggtagcgtagttcgttcgacgttgttcggattagattgttaatgaaaaggtataaagagtcggcgttcgttcgttcgtcgattttcgtttcgtagattcgcgtcgtttgggtttggcgcggttcggtgggttttgtgtttcgggtgttttatcgttcgcgttttttcgggtatttggtttataaagttcgggtttgttaggggtttcgcgtgcgttttagtttaggttcgttagacgttagcgcgttttttacgcgcgtagttttacgtcgttcgggcgcgcgcgcgtttacgttttttttttcggggacgcgtttagttcgcggtttcggttttcgttcgtttttcgcgattttcgttttataaggtcgttttttatttcgtgtgcgtcggcggcggcgtttcgttcgtcggtcggtcggttttattagcggtttttgtttttagcgttcggttcgcgtcgtacgcgttcgtttcgttcgtttgtcgttagttcggttcggtttttcgtttagcgcgtttcgagcgtcgtttatagtcgttcgtttagcgttattttggaagtttgtgacgtcggcgtcgttt

SEQ ID NO: 19248 - DNA, 752 bp, Artificial Sequence
  chemically treated genomic DNA (Homo sapiens) CpG-island No: 19248
aaacgacgccgacgtcacaaacttccaaaataacgctaaacgaacgactataaacgacgctcgaaacgcgctaaacgaaaaaccgaaccgaactaacgacaaacgaacgaaacgaacgcgtacgacgcgaaccgaacgctaaaaacaaaaaccgctaataaaaccgaccgaccgacgaacgaaacgccgccgccgacgcacacgaaataaaaaacgaccttataaaacgaaaatcgcgaaaaacgaacgaaaaccgaaaccgcgaactaaacgcgtccccgaaaaaaaaaacgtaaacgcgcgcgcgcccgaacgacgtaaaactacgcgcgtaaaaaacgcgctaacgtctaacgaacctaaactaaaacgcacgcgaaacccctaacaaacccgaactttataaaccaaatacccgaaaaaacgcgaacgataaaacacccgaaacacaaaacccaccgaaccgcgccaaacccaaacgacgcgaatctacgaaacgaaaatcgacgaacgaacgaacgccgactctttataccttttcattaacaatctaatccgaacaacgtcgaacgaactacgctacctaacaaacgaaaaaactcccattatacaaacgaccctacgcccgcgaccgccccctcgctaaaaaattttacgatttccaaaactacgatcctacaccgtctacgatctcctctcttacctcctccccgcgaaaaaactaaccacgacaaaaacaaaaacgaacctaa

SEQ ID NO: 19249 - DNA, 603 bp, Artificial Sequence
  chemically treated genomic DNA (Homo sapiens) CpG-island No: 19249
tagtagcggggatagcgtgtagcgtaggcggcgtagcgtcgttttcgaggtgaggttttagagttacgcggagacggcgtcggggtttaatagtatcgtttagagtagcgatagttttaggaagaggagcggtagcgttagtagtatttgtagcgcgtttagtacgtatcgtttgcggggcgaaaggcgggtaggtgggcggtaattcgggcgggtatttgggggatcgcggtcgcgtttatcgttcggtttatttgatggttagcgcgcgagggtcgtcgaatagtcgcgttttttgcggggagagagggtcgtatttagttattttcgcgttcgcggcgtcggttcggtttttaggaggagggggaggcggtatcgcgggggggacggggagggttgtttcgttttagtttatttcgttcggattcgcgtaggcgtttattcggttcgttttggttattttttttatgagcgattcggtgttgtattgtatttcgcgaagttgttcgttatatttgcggggataggtatgtaggtgggagtttatttcggttttatagtgtttcgtcgcgttcgtaggtttaatttttttatagttttcgg

SEQ ID NO: 19250 - DNA, 603 bp, Artificial Sequence
  chemically treated genomic DNA (Homo sapiens) CpG-island No: 19250
ccgaaaactataaaaaaattaaacctacgaacgcgacgaaacactataaaaccgaaataaactcccacctacatacctatccccgcaaatataacgaacaacttcgcgaaatacaatacaacaccgaatcgctcataaaaaaaataaccaaaacgaaccgaataaacgcctacgcgaatccgaacgaaataaactaaaacgaaacaaccctccccgtcccccccgcgataccgcctccccctcctcctaaaaaccgaaccgacgccgcgaacgcgaaaataactaaatacgaccctctctccccgcaaaaaacgcgactattcgacgaccctcgcgcgctaaccatcaaataaaccgaacgataaacgcgaccgcgatcccccaaatacccgcccgaattaccgcccacctacccgcctttcgccccgcaaacgatacgtactaaacgcgctacaaatactactaacgctaccgctcctcttcctaaaactatcgctactctaaacgatactattaaaccccgacgccgtctccgcgtaactctaaaacctcacctcgaaaacgacgctacgccgcctacgctacacgctatccccgctacta

SEQ ID NO: 19251 - DNA, 603 bp, Artificial Sequence
  chemically treated genomic DNA (Homo sapiens) CpG-island No: 19251
tcgggaattgtaagggagttgggtttgcgggcgcggcggggtattgtggggtcgggatgggtttttatttgtatgtttgttttcgtaggtgtgacgggtagtttcgcggagtgtagtatagtatcgaatcgtttatggaggagatggttagggcggatcgagtgagcgtttgcgcgggttcgggcggggtgggttggagcgggataatttttttcgtttttttcgcggtatcgtttttttttttttttggaaatcgggtcggcgtcgcgggcgcggaggtagttggatgcggtttttttttttcgtaggagacgcggttgttcggcggttttcgcgcgttggttattaggtgagtcgggcggtgggcgcggtcgcggttttttaggtgttcgttcgagttgtcgtttatttgttcgtttttcgtttcgtaggcggtgcgtgttgggcgcgttgtaggtgttgttgacgttgtcgtttttttttttggggttgtcgttgttttggacggtgttgttggatttcggcgtcgttttcgcgtggttttggagttttatttcggagacgacgttgcgtcgtttgcgttatacgttgttttcgttgttg

SEQ ID NO: 19252 - DNA, 603 bp, Artificial Sequence
  chemically treated genomic DNA (Homo sapiens) CpG-island No: 19252
caacaacgaaaacaacgtataacgcaaacgacgcaacgtcgtctccgaaataaaactccaaaaccacgcgaaaacgacgccgaaatccaacaacaccgtccaaaacaacgacaaccccaaaaaaaaaaacgacaacgtcaacaacacctacaacgcgcccaacacgcaccgcctacgaaacgaaaaacgaacaaataaacgacaactcgaacgaacacctaaaaaaccgcgaccgcgcccaccgcccgactcacctaataaccaacgcgcgaaaaccgccgaacaaccgcgtctcctacgaaaaaaaaaaaccgcatccaactacctccgcgcccgcgacgccgacccgatttccaaaaaaaaaaaaaaacgataccgcgaaaaaaacgaaaaaaattatcccgctccaacccaccccgcccgaacccgcgcaaacgctcactcgatccgccctaaccatctcctccataaacgattcgatactatactacactccgcgaaactacccgtcacacctacgaaaacaaacatacaaataaaaacccatcccgaccccacaataccccgccgcgcccgcaaacccaactcccttacaattcccga

SEQ ID NO: 19253 - DNA, 553 bp, Artificial Sequence
  chemically treated genomic DNA (Homo sapiens) CpG-island No: 19253
tttcgcgttattaggttcgtgaattttatttttattagagaattagcgcgggcggacgagtaaagtgaaatttagtagttcggaatttcgcgtgtcgggttttcgtagtaatacgtatcgggaagcgtttgggcgttgtatcgcgttgcgtcgtgttcgtgagttcggcgcgtagaggaggaggagaaagttgatcgtttaggttcgggtagtggtcgtcgtggttttttttgtagttcgtggtttgagattaggttttaagtggaaacggcgttattatgatcgtacggcggaatttagaatttttacggtttttgtcggatgaggttcggagtttgttttcgtttaagttgatcgattcgcggtttttttatatcggttttttgggttattgtttcggtttgattgataacgtgattcggcggaggtcgatcgcgacggttggtgagtgttgcgcggtcgggatcggttgggaggagaaggggtcgtagggttgtagattggttcggtcgtaggtttttttgaggtgttttgttttttcgtgtttttttgt

SEQ ID NO: 19254 - DNA, 553 bp, Artificial Sequence
  chemically treated genomic DNA (Homo sapiens) CpG-island No: 19254
acaaaaaaacacgaaaaaacaaaacacctcaaaaaaacctacgaccgaaccaatctacaaccctacgaccccttctcctcccaaccgatcccgaccgcgcaacactcaccaaccgtcgcgatcgacctccgccgaatcacgttatcaatcaaaccgaaacaataacccaaaaaaccgatataaaaaaaccgcgaatcgatcaacttaaacgaaaacaaactccgaacctcatccgacaaaaaccgtaaaaattctaaattccgccgtacgatcataataacgccgtttccacttaaaacctaatctcaaaccacgaactacaaaaaaaaccacgacgaccactacccgaacctaaacgatcaactttctcctcctcctctacgcgccgaactcacgaacacgacgcaacgcgatacaacgcccaaacgcttcccgatacgtattactacgaaaacccgacacgcgaaattccgaactactaaatttcactttactcgtccgcccgcgctaattctctaataaaaataaaattcacgaacctaataacgcgaaa

SEQ ID NO: 19255 - DNA, 553 bp, Artificial Sequence
  chemically treated genomic DNA (Homo sapiens) CpG-island No: 19255
gtaaaaaggtacggaaaagtagagtattttaggggggtttacggtcgggttagtttgtagttttacgattttttttttttttagtcgatttcggtcgcgtagtatttattagtcgtcgcgatcggttttcgtcggattacgttattaattaggtcggagtagtagtttaagaagtcgatgtagaggagtcgcgggtcggttagtttgggcgggggtaggtttcgggttttattcggtagaaatcgtaagggttttgggtttcgtcgtgcgattatggtgacgtcgtttttatttgaggtttggttttagattacgaattataaggaaaattacgacgattattattcgggtttaagcggttagtttttttttttttttttgcgcgtcggatttacgggtacggcgtagcgcggtgtagcgtttaaacgtttttcggtacgtgttgttgcgggaattcggtacgcgaagtttcgggttattaagttttattttgttcgttcgttcgcgttaattttttggtgggagtgggatttacgggtttggtaacgcgggg

SEQ ID NO: 19256 - DNA, 553 bp, Artificial Sequence
  chemically treated genomic DNA (Homo sapiens) CpG-island No: 19256
ccccgcgttaccaaacccgtaaatcccactcccaccaaaaaattaacgcgaacgaacgaacaaaataaaacttaataacccgaaacttcgcgtaccgaattcccgcaacaacacgtaccgaaaaacgtttaaacgctacaccgcgctacgccgtacccgtaaatccgacgcgcaaaaaaaaaaaaaaaaactaaccgcttaaacccgaataataatcgtcgtaattttccttataattcgtaatctaaaaccaaacctcaaataaaaacgacgtcaccataatcgcacgacgaaacccaaaacccttacgatttctaccgaataaaacccgaaacctacccccgcccaaactaaccgacccgcgactcctctacatcgacttcttaaactactactccgacctaattaataacgtaatccgacgaaaaccgatcgcgacgactaataaatactacgcgaccgaaatcgactaaaaaaaaaaaaaatcgtaaaactacaaactaacccgaccgtaaacccccctaaaatactctacttttccgtacctttttac

SEQ ID NO: 19257 - DNA, 674 bp, Artificial Sequence
  chemically treated genomic DNA (Homo sapiens) CpG-island No: 19257
ttagtcgttcggtcggtcgcgatgtattttggggaaggagtagtattaaatttaagatggcggttagtaggaggttgatgaaggtaaaagttattttttggtagcggtcgggcgtggggcggcgttttaggtttcggattttcgaggtaggcggcggttttttagggcgttgtcgtttggttttttgttttatacggtttcgtcggttttttgggtcgcgcgtaggtttaaggtgttaacggggttggtttaggtcgtagtttgggcgggagcgtaaggtcgcgttgggagtcgttgtcggttttttagttcggttcggggcgtttacgttatttttcgttcggagtttggtcgcgtttttttgtcgcggaggtcgcggttcgatttgagggcgtcgttaatgtgagagttcggttgggaggttttaaatcgggcgttttcggggaaggttcgagcgtcggagtttttgttcggagttcgcgtcgcggaatcgtttcgttttgggtcgtagcgcgtcgggtttgtagtttcgtttggttcggtcgtagttcgggagtttgggaggttcgggttaggaaagagagaaggaggttaggcggttaaagttaggttagtttgttggtgggtcgtttggaattgcgttgggttttagtaaattgtcgttttgtgattgt

SEQ ID NO: 19258 - DNA, 674 bp, Artificial Sequence
  chemically treated genomic DNA (Homo sapiens) CpG-island No: 19258
acaatcacaaaacgacaatttactaaaacccaacgcaattccaaacgacccaccaacaaactaacctaactttaaccgcctaacctccttctctctttcctaacccgaacctcccaaactcccgaactacgaccgaaccaaacgaaactacaaacccgacgcgctacgacccaaaacgaaacgattccgcgacgcgaactccgaacaaaaactccgacgctcgaaccttccccgaaaacgcccgatttaaaacctcccaaccgaactctcacattaacgacgccctcaaatcgaaccgcgacctccgcgacaaaaaaacgcgaccaaactccgaacgaaaaataacgtaaacgccccgaaccgaactaaaaaaccgacaacgactcccaacgcgaccttacgctcccgcccaaactacgacctaaaccaaccccgttaacaccttaaacctacgcgcgacccaaaaaaccgacgaaaccgtataaaacaaaaaaccaaacgacaacgccctaaaaaaccgccgcctacctcgaaaatccgaaacctaaaacgccgccccacgcccgaccgctaccaaaaaataacttttaccttcatcaacctcctactaaccgccatcttaaatttaatactactccttccccaaaatacatcgcgaccgaccgaacgactaa

SEQ ID NO: 19259 - DNA, 674 bp, Artificial Sequence
  chemically treated genomic DNA (Homo sapiens) CpG-island No: 19259
gtagttataaggcgatagtttgttaggatttagcgtaattttaaacgatttattaataaattgatttaattttggtcgtttggttttttttttttttttttagttcgaattttttagattttcgagttgcggtcgggttaagcggagttgtaagttcggcgcgttgcggtttagggcggggcggtttcgcggcgcgggtttcgggtaggggtttcggcgttcgggtttttttcgaaggcgttcggtttggagttttttaatcgggtttttatattaacgacgtttttagatcggatcgcggttttcgcgatagggggacgcggttaagtttcgggcggagagtggcgtgaacgtttcgggtcgggttgaggggtcgatagcggtttttagcgcggttttgcgttttcgtttaggttgcggtttaggttagtttcgttagtattttgagtttgcgcgcggtttagggaatcgacgaggtcgtgtagggtaggaagttagacggtagcgttttgagaagtcgtcgtttgtttcggggattcggagtttaggacgtcgttttacgttcggtcgttgttagagaatggtttttatttttattagttttttgttggtcgttattttggatttggtgttgttttttttttagaatgtatcgcggtcggtcgggcggttgg

SEQ ID NO: 19260 - DNA, 674 bp, Artificial Sequence
  chemically treated genomic DNA (Homo sapiens) CpG-island No: 19260
ccaaccgcccgaccgaccgcgatacattctaaaaaaaaaacaacaccaaatccaaaataacgaccaacaaaaaactaataaaaataaaaaccattctctaacaacgaccgaacgtaaaacgacgtcctaaactccgaatccccgaaacaaacgacgacttctcaaaacgctaccgtctaacttcctaccctacacgacctcgtcgattccctaaaccgcgcgcaaactcaaaatactaacgaaactaacctaaaccgcaacctaaacgaaaacgcaaaaccgcgctaaaaaccgctatcgacccctcaacccgacccgaaacgttcacgccactctccgcccgaaacttaaccgcgtccccctatcgcgaaaaccgcgatccgatctaaaaacgtcgttaatataaaaacccgattaaaaaactccaaaccgaacgccttcgaaaaaaacccgaacgccgaaacccctacccgaaacccgcgccgcgaaaccgccccgccctaaaccgcaacgcgccgaacttacaactccgcttaacccgaccgcaactcgaaaatctaaaaaattcgaactaaaaaaaaaaaaaaaaaaccaaacgaccaaaattaaatcaatttattaataaatcgtttaaaattacgctaaatcctaacaaactatcgccttataactac

SEQ ID NO: 19261 - DNA, 712 bp, Artificial Sequence
  chemically treated genomic DNA (Homo sapiens) CpG-island No: 19261
  misc_feature (224)..(224): n is either a, c, g or t
  misc_feature (515)..(515): n is either a, c, g or t
  misc_feature (593)..(593): n is either a, c, g or t
  misc_feature (595)..(596): n is either a, c, g or t
cgtttgtcgaatttttgaattgtattgtttattttcgtggcgttcgggtattgatgggggggcgggcgtgtcgggcgggggcgcgcgcgcgcgtcggcggcgcggcgcgggcggggcgggcgcgttcgcgcgggcgggtcgttcgttcgataattcggtcgttcggtcggtcggacggtcggtcgttcggtcggtcggttcgggcgggcgggcgcgcgcgcgtngggtcgttttttcgataattcggtcgtacggtcggtcggtcgggacggtcgttcggtcgttcgttcgttcgttaattcggtcggtcggtcgggacggcggtacgagtgataagtggttatcgagcgttagcggggagagaattaggaaagggggatttgtatgtggggattttgtgagaagagacgatttgatagagtgcggttattgcggagtgtgggaaatagttcgtgcgggtagttaagtattaattaagttcgaattttatcgttcgcggcgtacgtcgtacgttntaggatttagacgttaattaaaaggcgttcgtcggggagaataggggaggcgaattttacgaggaaatgtggtttatntnnagagtaggggggtgaacgagattatgaaggtacggtcgttagagattcggagagggaatagatatggagggttataaaaaaggggttacgggtatatgtttattttgtttatttat

SEQ ID NO: 19262 - DNA, 712 bp, Artificial Sequence
  chemically treated genomic DNA (Homo sapiens) CpG-island No: 19262
  misc_feature (117)..(118): n is either a, c, g or t
  misc_feature (120)..(120): n is either a, c, g or t
  misc_feature (198)..(198): n is either a, c, g or t
  misc_feature (489)..(489): n is either a, c, g or t
ataaataaacaaaataaacatatacccgtaaccccttttttataaccctccatatctattccctctccgaatctctaacgaccgtaccttcataatctcgttcacccccctactctnnanataaaccacatttcctcgtaaaattcgcctcccctattctccccgacgaacgccttttaattaacgtctaaatcctanaacgtacgacgtacgccgcgaacgataaaattcgaacttaattaatacttaactacccgcacgaactatttcccacactccgcaataaccgcactctatcaaatcgtctcttctcacaaaatccccacatacaaatccccctttcctaattctctccccgctaacgctcgataaccacttatcactcgtaccgccgtcccgaccgaccgaccgaattaacgaacgaacgaacgaccgaacgaccgtcccgaccgaccgaccgtacgaccgaattatcgaaaaaacgacccnacgcgcgcgcgcccgcccgcccgaaccgaccgaccgaacgaccgaccgtccgaccgaccgaacgaccgaattatcgaacgaacgacccgcccgcgcgaacgcgcccgccccgcccgcgccgcgccgccgacgcgcgcgcgcgcccccgcccgacacgcccgcccccccatcaatacccgaacgccacgaaaataaacaatacaattcaaaaattcgacaaacg

SEQ ID NO: 19263 - DNA, 712 bp, Artificial Sequence
  chemically treated genomic DNA (Homo sapiens) CpG-island No: 19263
  misc_feature (117)..(118): n is either a, c, g or t
  misc_feature (120)..(120): n is either a, c, g or t
  misc_feature (198)..(198): n is either a, c, g or t
  misc_feature (489)..(489): n is either a, c, g or t
ataggtggatagggtaggtatatgttcgtaattttttttttgtagttttttatatttatttttttttcgggtttttggcgatcgtgtttttatagtttcgtttatttttttattttnngngtaaattatattttttcgtgaagttcgttttttttatttttttcggcgggcgttttttgattggcgtttgggttttanaacgtgcggcgtgcgtcgcgggcgatggggttcgggtttagttggtgtttggttgttcgtacgggttgttttttatatttcgtaatggtcgtattttgttaaatcgtttttttttataaagtttttatatgtaagttttttttttttagtttttttttcgttaacgttcggtgattatttgttattcgtatcgtcgtttcggtcggtcggtcgggttggcgggcgggcgggcgatcgggcggtcgtttcggtcggtcggtcgtgcggtcgggttgtcggggggacggtttnacgcgcgcgcgttcgttcgttcgggtcggtcggtcgggcggtcggtcgttcggtcggtcgggcggtcgggttgtcgggcgggcggttcgttcgcgcgggcgcgttcgtttcgttcgcgtcgcgtcgtcggcgcgcgcgcgcgttttcgttcggtacgttcgtttttttattaatattcgagcgttacgggggtaagtaatatagtttaagagttcgataagcg

SEQ ID NO: 19264 - DNA, 712 bp, Artificial Sequence
  chemically treated genomic DNA (Homo sapiens) CpG-island No: 19264
  misc_feature (224)..(224): n is either a, c, g or t
  misc_feature (515)..(515): n is either a, c, g or t
  misc_feature (593)..(593): n is either a, c, g or t
  misc_feature (595)..(596): n is either a, c, g or t
cgcttatcgaactcttaaactatattacttacccccgtaacgctcgaatattaataaaaaaacgaacgtaccgaacgaaaacgcgcgcgcgcgccgacgacgcgacgcgaacgaaacgaacgcgcccgcgcgaacgaaccgcccgcccgacaacccgaccgcccgaccgaccgaacgaccgaccgcccgaccgaccgacccgaacgaacgaacgcgcgcgcgtnaaaccgtccccccgacaacccgaccgcacgaccgaccgaccgaaacgaccgcccgatcgcccgcccgcccgccaacccgaccgaccgaccgaaacgacgatacgaataacaaataatcaccgaacgttaacgaaaaaaaaactaaaaaaaaaaaacttacatataaaaactttataaaaaaaaacgatttaacaaaatacgaccattacgaaatataaaaaacaacccgtacgaacaaccaaacaccaactaaacccgaaccccatcgcccgcgacgcacgccgcacgttntaaaacccaaacgccaatcaaaaaacgcccgccgaaaaaaataaaaaaaacgaacttcacgaaaaaatataatttacncnnaaaataaaaaaataaacgaaactataaaaacacgatcgccaaaaacccgaaaaaaaaataaatataaaaaactacaaaaaaaaaattacgaacatatacctaccctatccacctat

SEQ ID NO: 19265 - DNA, 714 bp, Artificial Sequence
  chemically treated genomic DNA (Homo sapiens) CpG-island No: 19265
gtcgagtagaattttatcgatattttatttttgtttatatggagatagatttttttcgtcgagtcgtttttttttagtaggttttgtttttgtttttttatcggtagagcgtagtcgtggttatcggcgggcgagtttttgaagagcgaggtggttagtcgtagttttacgtcgtttagtcggtttagtaagcgagttagtttagtttcgttggttaagattgttcgtaggtagcgattttttttttgtagtgtttgtacgcgtttgtttagttttcgattttcggttcgtagtttttggttttcggttgttagatttcggattcgattttttagttttattacgtatttttttttttttagtcgattaaggcgggtagcggtcgtcgtcgtttttcggggattttttgtcgtcgtttggttgttgtcgttatcgttgtcgttatcgtcgtttttttttggggatttttttcgttttttttcggcgttgttattgttattgttgttgttgtagttttcgatatcgtttaatagtttttgtagtaggttagagaagcgttgtattttagtagtcgcggttttatcgttatcgttttttttttataggtcgtcgttattcgagttttcgttagacgaggagagaggtttcggcgagttaagttcggggtttaggtgttagttcggttgtttggggtttaggagattcgttagtttt

SEQ ID NO: 19266 - DNA, 714 bp, Artificial Sequence
  chemically treated genomic DNA (Homo sapiens) CpG-island No: 19266
aaaactaacgaatctcctaaaccccaaacaaccgaactaacacctaaaccccgaacttaactcgccgaaacctctctcctcgtctaacgaaaactcgaataacgacgacctataaaaaaaaaacgataacgataaaaccgcgactactaaaatacaacgcttctctaacctactacaaaaactattaaacgatatcgaaaactacaacaacaacaataacaataacaacgccgaaaaaaaacgaaaaaaatccccaaaaaaaaacgacgataacgacaacgataacgacaacaaccaaacgacgacaaaaaatccccgaaaaacgacgacgaccgctacccgccttaatcgactaaaaaaaaaaaaatacgtaataaaactaaaaaatcgaatccgaaatctaacaaccgaaaaccaaaaactacgaaccgaaaatcgaaaactaaacaaacgcgtacaaacactacaaaaaaaaaatcgctacctacgaacaatcttaaccaacgaaactaaactaactcgcttactaaaccgactaaacgacgtaaaactacgactaaccacctcgctcttcaaaaactcgcccgccgataaccacgactacgctctaccgataaaaaaacaaaaacaaaacctactaaaaaaaaacgactcgacgaaaaaaatctatctccatataaacaaaaataaaatatcgataaaattctactcgac

SEQ ID NO: 19267 - DNA, 714 bp, Artificial Sequence
  chemically treated genomic DNA (Homo sapiens) CpG-island No: 19267
ggaattggcggattttttggattttaggtaatcggattggtatttggatttcgggtttagttcgtcggggttttttttttcgtttggcggaggttcggatagcggcggtttgtggagaggggacgatgacgatgaggtcgcggttgttgaaatgtagcgtttttttgatttgttgtaaaggttgttaaacggtatcggaggttgtagtagtagtagtgatagtggtagcgtcgaaaagaggcggagaaagtttttaggaggaggcggcggtggcggtagcggtaacgataataattaggcggcgataaagagttttcggaaggcggcggcggtcgttgttcgttttaatcgattgaagaagaaggagtacgtgatggggttggagagtcgagttcggggtttggtagtcgagaattaggagttgcgggtcgagaatcgggagttgggtaaacgcgtataggtattgtaggaggagagtcgttatttacgggtagttttagttaacgagattggattggttcgtttgttgagtcggttgagcggcgtgggattgcggttgattatttcgttttttagagattcgttcgtcggtgattacgattacgttttgtcggtgggaaagtagaagtaggatttgttggaagaggacgattcggcgggaggagtttgtttttatgtggataaggataaggtgtcggtggagttttgttcggt

SEQ ID NO: 19268 - DNA, 714 bp, Artificial Sequence
  chemically treated genomic DNA (Homo sapiens) CpG-island No: 19268
accgaacaaaactccaccgacaccttatccttatccacataaaaacaaactcctcccgccgaatcgtcctcttccaacaaatcctacttctactttcccaccgacaaaacgtaatcgtaatcaccgacgaacgaatctctaaaaaacgaaataatcaaccgcaatcccacgccgctcaaccgactcaacaaacgaaccaatccaatctcgttaactaaaactacccgtaaataacgactctcctcctacaatacctatacgcgtttacccaactcccgattctcgacccgcaactcctaattctcgactaccaaaccccgaactcgactctccaaccccatcacgtactccttcttcttcaatcgattaaaacgaacaacgaccgccgccgccttccgaaaactctttatcgccgcctaattattatcgttaccgctaccgccaccgccgcctcctcctaaaaactttctccgcctcttttcgacgctaccactatcactactactactacaacctccgataccgtttaacaacctttacaacaaatcaaaaaaacgctacatttcaacaaccgcgacctcatcgtcatcgtcccctctccacaaaccgccgctatccgaacctccgccaaacgaaaaaaaaaaccccgacgaactaaacccgaaatccaaataccaatccgattacctaaaatccaaaaaatccgccaattcc

SEQ ID NO: 19269 - DNA, 556 bp, Artificial Sequence
  chemically treated genomic DNA (Homo sapiens) CpG-island No: 19269
tagggatatatggggatacgacgtgtgtatggggatggttcgtatcggcgatgtggggtcgaaaaacgttcgcgttcgggggtgagatgcggttaatgttgtaaagatcgacggtttggaagagtgatttttcgtggttgagtttacgcgcgtttatgtagttaacggcgtgggttttgagggagttaatagaatcggtttggtgtttcggtgcggggttcgagttggtttcggcggataaagaaaggtgggtttagtagttttttttttgtcggtaataatttagggcgggtttgcggttaatgttgcgttttaggggggtttcgattacgtaagttcggttttttttatttagatgagcgtaagggaggacgaagtgtgaacggggggtaggacggtttttacgatgtaatgggtgtttaggtacgacgggatcgttttttcggataaaatggggacggttttgggattagtaataatgtacgaatgtttttaatgggggacgtcgatcgattagaaggtatgggtcgagaaagtgattaattaagatagatgg

SEQ ID NO: 19270 - DNA, 556 bp, Artificial Sequence
  chemically treated genomic DNA (Homo sapiens) CpG-island No: 19270
ccatctatcttaattaatcactttctcgacccataccttctaatcgatcgacgtcccccattaaaaacattcgtacattattactaatcccaaaaccgtccccattttatccgaaaaaacgatcccgtcgtacctaaacacccattacatcgtaaaaaccgtcctaccccccgttcacacttcgtcctcccttacgctcatctaaataaaaaaaaccgaacttacgtaatcgaaacccccctaaaacgcaacattaaccgcaaacccgccctaaattattaccgacaaaaaaaaaactactaaacccacctttctttatccgccgaaaccaactcgaaccccgcaccgaaacaccaaaccgattctattaactccctcaaaacccacgccgttaactacataaacgcgcgtaaactcaaccacgaaaaatcactcttccaaaccgtcgatctttacaacattaaccgcatctcacccccgaacgcgaacgtttttcgaccccacatcgccgatacgaaccatccccatacacacgtcgtatccccatatatcccta

SEQ ID NO: 19271 - DNA, 556 bp, Artificial Sequence
  chemically treated genomic DNA (Homo sapiens) CpG-island No: 19271
ttatttgttttggttagttattttttcgatttatattttttggtcgatcgacgttttttattggagatattcgtatattgttattggttttaggatcgtttttattttgttcgagagagcgatttcgtcgtatttggatatttattatatcgtagaagtcgttttgtttttcgtttatatttcgtttttttttgcgtttatttggataaagaggatcgagtttgcgtagtcgagatttttttagagcgtagtattagtcgtaagttcgttttgaattattatcgataggaggaggattattgagtttatttttttttattcgtcgaggttaattcggatttcgtatcgggatattaagtcgattttgttaatttttttaaggtttacgtcgttgattatataaacgcgcgtagatttaattacgaggaattatttttttaggtcgtcgatttttgtagtattgatcgtattttattttcggacgcggacgtttttcgattttatatcgtcggtgcggattatttttatatatacgtcgtatttttatgtgtttttg

SEQ ID NO: 19272 - DNA, 556 bp, Artificial Sequence
  chemically treated genomic DNA (Homo sapiens) CpG-island No: 19272
caaaaacacataaaaatacgacgtatatataaaaataatccgcaccgacgatataaaatcgaaaaacgtccgcgtccgaaaataaaatacgatcaatactacaaaaatcgacgacctaaaaaaataattcctcgtaattaaatctacgcgcgtttatataatcaacgacgtaaaccttaaaaaaattaacaaaatcgacttaatatcccgatacgaaatccgaattaacctcgacgaataaaaaaaaataaactcaataatcctcctcctatcgataataattcaaaacgaacttacgactaatactacgctctaaaaaaatctcgactacgcaaactcgatcctctttatccaaataaacgcaaaaaaaaacgaaatataaacgaaaaacaaaacgacttctacgatataataaatatccaaatacgacgaaatcgctctctcgaacaaaataaaaacgatcctaaaaccaataacaatatacgaatatctccaataaaaaacgtcgatcgaccaaaaaatataaatcgaaaaaataactaaccaaaacaaataa

SEQ ID NO: 19273 - DNA, 643 bp, Artificial Sequence
  chemically treated genomic DNA (Homo sapiens) CpG-island No: 19273
  misc_feature (583)..(585): n is either a, c, g or t
gcggaattaacggttttcggttatcgttaataggacgtttggcgatttgttgtattgtattgttgatttacgtgtgtacgcgtattgatatgggggtggggtggggtggggtggggtggggataggacgattgataaggtggcggggttggcgttggtttgggagtggggaagtaggggcggggcgggtggagggcgatgcgttgcgggtgggacgggaaggggacggggtggagtggggcgatggacgggtgggtgttattttaaaaatacggggtaagggtggggatcgtgggttaaagattgcgtaggcgggggggcgcgcggcgattgggagggaggggatgcgggacggggacgcgtgaagtggtacgagtattgcgggaatggatcgatgaagtatttagtagacgtaggtagagagttggagggaatcggggatagcggcgggagggaattagcgtgtgggtggttagttggcgaacggttgtcggcgggtttgggttaacggtgcgttggaggacgtaggacgagatgggtttgaggagggggtatatttgtaagggggggggggggggtttttnnnttcgtatagcgtcgatttttttagttcgttatcggaattaggatgattatgagttata

SEQ ID NO: 19274 - DNA, 643 bp, Artificial Sequence
  chemically treated genomic DNA (Homo sapiens) CpG-island No: 19274
  misc_feature (59)..(61): n is either a, c, g or t
tataactcataatcatcctaattccgataacgaactaaaaaaatcgacgctatacgaannnaaaaacccccccccccccccttacaaatataccccctcctcaaacccatctcgtcctacgtcctccaacgcaccgttaacccaaacccgccgacaaccgttcgccaactaaccacccacacgctaattccctcccgccgctatccccgattccctccaactctctacctacgtctactaaatacttcatcgatccattcccgcaatactcgtaccacttcacgcgtccccgtcccgcatcccctccctcccaatcgccgcgcgcccccccgcctacgcaatctttaacccacgatccccacccttaccccgtatttttaaaataacacccacccgtccatcgccccactccaccccgtccccttcccgtcccacccgcaacgcatcgccctccacccgccccgcccctacttccccactcccaaaccaacgccaaccccgccaccttatcaatcgtcctatccccaccccaccccaccccaccccacccccatatcaatacgcgtacacacgtaaatcaacaatacaatacaacaaatcgccaaacgtcctattaacgataaccgaaaaccgttaattccgc

SEQ ID NO: 19275 - DNA, 643 bp, Artificial Sequence
  chemically treated genomic DNA (Homo sapiens) CpG-island No: 19275
  misc_feature (59)..(61): n is either a, c, g or t
tgtagtttatggttattttgatttcgatagcgaattgggaaaatcggcgttatacgaannnaaaaatttttttttttttttttgtaaatatgttttttttttaagtttatttcgttttgcgttttttaacgtatcgttagtttaaattcgtcggtaatcgttcgttaattaattatttatacgttaattttttttcgtcgttattttcggttttttttaattttttatttgcgtttattaggtgttttatcggtttattttcgtagtattcgtattattttacgcgttttcgtttcgtatttttttttttttaatcgtcgcgcgttttttcgtttacgtaatttttaatttacggtttttatttttgtttcgtatttttagggtagtatttattcgtttatcgttttattttatttcgtttttttttcgttttattcgtagcgtatcgttttttattcgtttcgtttttgtttttttatttttaagttagcgttaatttcgttattttattagtcgttttatttttattttattttattttattttatttttatattaatacgcgtgtatacgtgggttagtaatatagtataataggtcgttaagcgttttgttggcggtggtcggaaatcgttagtttcgt

SEQ ID NO: 19276 - DNA, 643 bp, Artificial Sequence
  chemically treated genomic DNA (Homo sapiens) CpG-island No: 19276
  misc_feature (583)..(585): n is either a, c, g or t
acgaaactaacgatttccgaccaccgccaacaaaacgcttaacgacctattatactatattactaacccacgtatacacgcgtattaatataaaaataaaataaaataaaataaaataaaaataaaacgactaataaaataacgaaattaacgctaacttaaaaataaaaaaacaaaaacgaaacgaataaaaaacgatacgctacgaataaaacgaaaaaaaaacgaaataaaataaaacgataaacgaataaatactaccctaaaaatacgaaacaaaaataaaaaccgtaaattaaaaattacgtaaacgaaaaaacgcgcgacgattaaaaaaaaaaaaatacgaaacgaaaacgcgtaaaataatacgaatactacgaaaataaaccgataaaacacctaataaacgcaaataaaaaattaaaaaaaaccgaaaataacgacgaaaaaaaattaacgtataaataattaattaacgaacgattaccgacgaatttaaactaacgatacgttaaaaaacgcaaaacgaaataaacttaaaaaaaaaacatatttacaaaaaaaaaaaaaaaaatttttnnnttcgtataacgccgattttcccaattcgctatcgaaatcaaaataaccataaactaca

SEQ ID NO: 19277 - DNA, 510 bp, Artificial Sequence
  chemically treated genomic DNA (Homo sapiens) CpG-island No: 19277
cgttttacgatttttgcgttttttgcgttggggtcgggttcgttacgttcgtcgggtggtcggggtcgtgtgggtgttggtgttggtttgttaggttttcgtgttttattttgttattattagcgcgcgcgggggtcgcgtaatttgttacgatatttcggtattcgagttttttagtcgtttcgtggtttatagtttagttatgttgggtttgtttttcgcggtgttttttgtcgttatttttgtttgttacgtgtttatggttcggcgattgttaaagttagtttacgggatttcgggcggtttgtttagggttaagcgtaagttcgtgcgtattatcgtcgtggtgttggttgttttcgttttttgttttttgttattttacgttattcgtattttttattatttttttcgttcgttggattttagttgttatatttttaacgttattaatatggtttataaggttattcggtcgttggttagtgttaatagttgttttgatttcgt

SEQ ID NO: 19278 - DNA, 510 bp, Artificial Sequence
  chemically treated genomic DNA (Homo sapiens) CpG-island No: 19278
acgaaatcaaaacaactattaacactaaccaacgaccgaataaccttataaaccatattaataacgttaaaaatataacaactaaaatccaacgaacgaaaaaaataataaaaaatacgaataacgtaaaataacaaaaaacaaaaaacgaaaacaaccaacaccacgacgataatacgcacgaacttacgcttaaccctaaacaaaccgcccgaaatcccgtaaactaactttaacaatcgccgaaccataaacacgtaacaaacaaaaataacgacaaaaaacaccgcgaaaaacaaacccaacataactaaactataaaccacgaaacgactaaaaaactcgaataccgaaatatcgtaacaaattacgcgacccccgcgcgcgctaataataacaaaataaaacacgaaaacctaacaaaccaacaccaacacccacacgaccccgaccacccgacgaacgtaacgaacccgaccccaacgcaaaaaacgcaaaaatcgtaaaacg

SEQ ID NO: 19279 - DNA, 510 bp, Artificial Sequence
  chemically treated genomic DNA (Homo sapiens) CpG-island No: 19279
acggggttaaggtaattgttagtattggttagcggtcgggtaattttgtaggttatgttgatggcgttgagggtgtggtagttgaggtttagcgaacggaaggagtagtagagggtgcgggtgacgtggaatggtaggaagtagagggcgaagatagttagtattacggcgatggtgcgtacggatttgcgtttggttttaggtaggtcgttcgaggtttcgtaggttggttttagtagtcgtcgagttatgagtacgtaatagataaggatgacggtaaagggtatcgcgaagagtaggtttagtatgattgagttgtaggttacgaagcggttgaagagttcgggtgtcgaggtgtcgtggtaggttacgcggttttcgcgcgcgttggtggtgataaagtagagtacgggggtttggtaggttagtattaatatttatacggtttcggttattcggcgagcgtagcgggttcggttttagcgtagggagcgtagaggtcgtaagacg

SEQ ID NO: 19280 - DNA, 510 bp, Artificial Sequence
  chemically treated genomic DNA (Homo sapiens) CpG-island No: 19280
cgtcttacgacctctacgctccctacgctaaaaccgaacccgctacgctcgccgaataaccgaaaccgtataaatattaatactaacctaccaaacccccgtactctactttatcaccaccaacgcgcgcgaaaaccgcgtaacctaccacgacacctcgacacccgaactcttcaaccgcttcgtaacctacaactcaatcatactaaacctactcttcgcgataccctttaccgtcatccttatctattacgtactcataactcgacgactactaaaaccaacctacgaaacctcgaacgacctacctaaaaccaaacgcaaatccgtacgcaccatcgccgtaatactaactatcttcgccctctacttcctaccattccacgtcacccgcaccctctactactccttccgttcgctaaacctcaactaccacaccctcaacgccatcaacataacctacaaaattacccgaccgctaaccaatactaacaattaccttaaccccgt

SEQ ID NO: 19281 - DNA, 506 bp, Artificial Sequence
  chemically treated genomic DNA (Homo sapiens) CpG-island No: 19281
  misc_feature (286)..(287): n is either a, c, g or t
gggaacgtttcgtagtgcgtatttcgcgtcgtatgcgttttacgcgtcgcgtcgtttagtattttttattatacgttttttatttttttattattttttaaatcgtcgtcgttattttcgcgggtgcgttaaaggtgttgtgtgttttgtttgggtttttcgtaatttatggtcgtacgggtttttgtttgttagtaatttgttattttacgtcgcgtttgtcgttttgtaggtgaagtggtgaatttttttttttgataaatttttgtcgtttcggcgcgatgtnngttaggttacgagggagtatgttcggtcgggagtattttatttcgtttttttgtttttgtgttttttatcgttattataggttcggaggtatttttaggaaatagcgttttttttttggatgtgtatgtcgatcgtttttttttaaaacgtacgtattttttttttttttttattggatcgcgttttaacgttttagggatgttgttgtaatttttttg

SEQ ID NO: 19282 - DNA, 506 bp, Artificial Sequence
  chemically treated genomic DNA (Homo sapiens) CpG-island No: 19282
  misc_feature (220)..(221): n is either a, c, g or t
caaaaaaattacaacaacatccctaaaacgttaaaacgcgatccaataaaaaaaaaaaaaaaatacgtacgttttaaaaaaaaacgatcgacatacacatccaaaaaaaaaacgctatttcctaaaaatacctccgaacctataataacgataaaaaacacaaaaacaaaaaaacgaaataaaatactcccgaccgaacatactccctcgtaacctaacnnacatcgcgccgaaacgacaaaaatttatcaaaaaaaaaaattcaccacttcacctacaaaacgacaaacgcgacgtaaaataacaaattactaacaaacaaaaacccgtacgaccataaattacgaaaaacccaaacaaaacacacaacacctttaacgcacccgcgaaaataacgacgacgatttaaaaaataataaaaaaataaaaaacgtataataaaaaatactaaacgacgcgacgcgtaaaacgcatacgacgcgaaatacgcactacgaaacgttccc

SEQ ID NO: 19283 - DNA, 506 bp, Artificial Sequence
  chemically treated genomic DNA (Homo sapiens) CpG-island No: 19283
  misc_feature (220)..(221): n is either a, c, g or t
taaagaaattataatagtatttttgaagcgttgaggcgcgatttagtagggaaagggagggggtgcgtacgttttaggagagggcggtcggtatgtatatttaaagagaagacgttattttttgaaggtgttttcgagtttataataacggtaagaggtataaaggtaggggggcgaggtaggatattttcggtcgggtatgttttttcgtagtttagtnngtatcgcgtcgagacggtagaaatttattaaaagaagggatttattattttatttgtagagcggtaggcgcggcgtaaagtagtaaattgttagtaggtaggggttcgtacggttataaattgcgaggggtttaggtaaggtatataatatttttagcgtattcgcgaaagtggcggcggcggtttggggaatggtaggagggtagaggacgtatagtaggggatgttaggcggcgcggcgcgtaggacgtatgcggcgcggggtacgtattacggggcgttttt

SEQ ID NO: 19284 - DNA, 506 bp, Artificial Sequence
  chemically treated genomic DNA (Homo sapiens) CpG-island No: 19284
  misc_feature (286)..(287): n is either a, c, g or t
aaaaacgccccgtaatacgtaccccgcgccgcatacgtcctacgcgccgcgccgcctaacatcccctactatacgtcctctaccctcctaccattccccaaaccgccgccgccactttcgcgaatacgctaaaaatattatataccttacctaaacccctcgcaatttataaccgtacgaacccctacctactaacaatttactactttacgccgcgcctaccgctctacaaataaaataataaatcccttcttttaataaatttctaccgtctcgacgcgatacnnactaaactacgaaaaaacatacccgaccgaaaatatcctacctcgcccccctacctttatacctcttaccgttattataaactcgaaaacaccttcaaaaaataacgtcttctctttaaatatacataccgaccgccctctcctaaaacgtacgcaccccctccctttccctactaaatcgcgcctcaacgcttcaaaaatactattataatttcttta

SEQ ID NO: 19285 - DNA, 796 bp, Artificial Sequence
  chemically treated genomic DNA (Homo sapiens) CpG-island No: 19285
  misc_feature (701)..(703): n is either a, c, g or t
  misc_feature (731)..(731): n is either a, c, g or t
  misc_feature (740)..(743): n is either a, c, g or t
  misc_feature (767)..(769): n is either a, c, g or t
  misc_feature (780)..(784): n is either a, c, g or t
gtgcggttggggggcgtatacggtgtttggatcggattagggtgggggcggtggatttgcgtatgatgtgaagtttcgttatgggtagtgtttagggttagtgtagttggggtgttgataaggattagtggcggtgcgtgtgagttttgtatcggtgcggagggcggtatgcgggagggtttgtgagttattgtttaatacgataaacgtgggtattgttgggggtggttggatcgcgggtcgtaattagaatggagggagtattatttgagttatttagttagagattgcggcggacggttagcgttttagttaaatgatgagtgtgggggaaggtagggcgacggaagggcgaaaggtataggcgttatgggaagcgagggggattagcggcggggttggtcgggtgttgaaaagcgtgaattttaatttaggcggaaagacgtaggtattatggggtaggaattgttgggggtgggggagcgtggcgttcgttaggaagggttgggcgtaaatattgtgttggggcgtgtagtggtgcgtagggtgcgtggttagtgcggattcgcggggagaagttgggtagattgattggtgggttataggagattacggatagaggtcggtaaggaatggacggtggggggttggaggatttgaaggcgggtgtttggggcgtgacggtgtttgtaatatggggnnncgtgtgtggtattttggtgggtgagatnggggattannnngatgtaggacgatgcgcgggattnnnatgggggttgnnnnngcgatttgatat

SEQ ID NO: 19286 - DNA, 796 bp, Artificial Sequence
  chemically treated genomic DNA (Homo sapiens) CpG-island No: 19286
  misc_feature (13)..(17): n is either a, c, g or t
  misc_feature (28)..(30): n is either a, c, g or t
  misc_feature (54)..(57): n is either a, c, g or t
  misc_feature (66)..(66): n is either a, c, g or t
  misc_feature (94)..(96): n is either a, c, g or t
atatcaaatcgcnnnnncaacccccatnnnaatcccgcgcatcgtcctacatcnnnntaatccccnatctcacccaccaaaataccacacacgnnnccccatattacaaacaccgtcacgccccaaacacccgccttcaaatcctccaaccccccaccgtccattccttaccgacctctatccgtaatctcctataacccaccaatcaatctacccaacttctccccgcgaatccgcactaaccacgcaccctacgcaccactacacgccccaacacaatatttacgcccaacccttcctaacgaacgccacgctcccccacccccaacaattcctaccccataatacctacgtctttccgcctaaattaaaattcacgcttttcaacacccgaccaaccccgccgctaatccccctcgcttcccataacgcctatacctttcgcccttccgtcgccctaccttcccccacactcatcatttaactaaaacgctaaccgtccgccgcaatctctaactaaataactcaaataatactccctccattctaattacgacccgcgatccaaccacccccaacaatacccacgtttatcgtattaaacaataactcacaaaccctcccgcataccgccctccgcaccgatacaaaactcacacgcaccgccactaatccttatcaacaccccaactacactaaccctaaacactacccataacgaaacttcacatcatacgcaaatccaccgcccccaccctaatccgatccaaacaccgtatacgccccccaaccgcac

SEQ ID NO: 19287 - DNA, 796 bp, Artificial Sequence
  chemically treated genomic DNA (Homo sapiens) CpG-island No: 19287
  misc_feature (13)..(17): n is either a, c, g or t
  misc_feature (28)..(30): n is either a, c, g or t
  misc_feature (54)..(57): n is either a, c, g or t
  misc_feature (66)..(66): n is either a, c, g or t
  misc_feature (94)..(96): n is either a, c, g or t
atattaagtcgtnnnnntaatttttatnnnagtttcgcgtatcgttttatattnnnntagtttttngttttatttattaaggtgttatatacgnnnttttatattataggtatcgttacgttttaggtattcgtttttaaattttttaattttttatcgtttattttttatcggtttttattcgtaattttttatggtttattaattagtttatttagttttttttcgcgggttcgtattaattacgtattttgcgtattattatacgttttagtatagtatttgcgtttaattttttttaacgggcgttacgtttttttatttttagtagtttttgttttataatgtttacgttttttcgtttgggttaaggtttacgttttttaatattcggttaatttcgtcgttaatttttttcgttttttataacgtttgtgtttttcgttttttcgtcgttttatttttttttatatttattatttaattaaaacgttaatcgttcgtcgtagtttttagttaggtagtttaggtagtgttttttttattttaattacggttcgcggtttagttatttttagtaatgtttacgtttatcgtattaagtagtaatttataagttttttcgtatatcgtttttcgtatcggtataaggtttatacgtatcgttattggtttttgttagtattttaattgtattagttttaaatattatttataacgaaattttatattatgcgtaagtttatcgtttttattttaattcggtttaagtatcgtatgcgttttttaatcgtat

SEQ ID NO: 19288 - DNA, 796 bp, Artificial Sequence
  chemically treated genomic DNA (Homo sapiens) CpG-island No: 19288
  misc_feature (701)..(703): n is either a, c, g or t
  misc_feature (731)..(731): n is either a, c, g or t
  misc_feature (740)..(743): n is either a, c, g or t
  misc_feature (767)..(769): n is either a, c, g or t
  misc_feature (780)..(784): n is either a, c, g or t
atacgattaaaaaacgcatacgatacttaaaccgaattaaaataaaaacgataaacttacgcataatataaaatttcgttataaataatatttaaaactaatacaattaaaatactaacaaaaaccaataacgatacgtataaaccttataccgatacgaaaaacgatatacgaaaaaacttataaattactacttaatacgataaacgtaaacattactaaaaataactaaaccgcgaaccgtaattaaaataaaaaaaacactacctaaactacctaactaaaaactacgacgaacgattaacgttttaattaaataataaatataaaaaaaaataaaacgacgaaaaaacgaaaaacacaaacgttataaaaaacgaaaaaaattaacgacgaaattaaccgaatattaaaaaacgtaaaccttaacccaaacgaaaaaacgtaaacattataaaacaaaaactactaaaaataaaaaaacgtaacgcccgttaaaaaaaattaaacgcaaatactatactaaaacgtataataatacgcaaaatacgtaattaatacgaacccgcgaaaaaaaactaaataaactaattaataaaccataaaaaattacgaataaaaaccgataaaaaataaacgataaaaaattaaaaaatttaaaaacgaatacctaaaacgtaacgatacctataatataaaannncgtatataacaccttaataaataaaacnaaaaactannnnaatataaaacgatacgcgaaactnnnataaaaattannnnnacgacttaatat

SEQ ID NO: 19289 - DNA, 786 bp, Artificial Sequence
  chemically treated genomic DNA (Homo sapiens) CpG-island No: 19289
ttatggcgttatattaggtattttcgggttcgatttttcgagtagttttatacgttgaggtttcgcggtattttgcggtcgagggtatttttcggggttggcgggttttgggaattgcgtttcgggcgggttttcgtatcgttttcgtttcgatggtttcgtttcgtttttttttcgttggagtcggttcggttcgcgtttttttaaggtagcgaacgggttaagagaagcgtgtttcgtttttttcgacgttatcgaggtagcggttttatttttaaggcggcgcgggggttgttgggaaggtcggcgggatggaggcggcgggatcggttcgcgggtgcgggttcgggtgaagcgggaggtagttagagtcggagtcgggttcgagtattaggcgtaggtcggcgcgggtcgattgggtcgggagacggggttaggttttaaagcgggggaggagatttcgggtcggtttaggggagggggtcgttatgggcgcggtttgtgggaggatcgggttagttttggtagggggcgcggtttcgggtggttcggggcgggggcgcggtttttttagggaaggttttagggcgttgcgttggtttaggggaggggtcgtcgtgggcgtagtttggaaggattgggggtcgcgtatttagtttttttagtgggagcgttttcgtagggtcggttcgtcgggaggatgggtttcgcggtttggtttgttttttggggatggggttgttcgaggggttgggttcggatcgtcggaggggttagggttttttg

SEQ ID NO: 19290 - DNA, 786 bp, Artificial Sequence
  chemically treated genomic DNA (Homo sapiens) CpG-island No: 19290
caaaaaaccctaacccctccgacgatccgaacccaacccctcgaacaaccccatccccaaaaaacaaaccaaaccgcgaaacccatcctcccgacgaaccgaccctacgaaaacgctcccactaaaaaaactaaatacgcgacccccaatccttccaaactacgcccacgacgacccctcccctaaaccaacgcaacgccctaaaaccttccctaaaaaaaccgcgcccccgccccgaaccacccgaaaccgcgccccctaccaaaactaacccgatcctcccacaaaccgcgcccataacgaccccctcccctaaaccgacccgaaatctcctcccccgctttaaaacctaaccccgtctcccgacccaatcgacccgcgccgacctacgcctaatactcgaacccgactccgactctaactacctcccgcttcacccgaacccgcacccgcgaaccgatcccgccgcctccatcccgccgaccttcccaacaacccccgcgccgccttaaaaataaaaccgctacctcgataacgtcgaaaaaaacgaaacacgcttctcttaacccgttcgctaccttaaaaaaacgcgaaccgaaccgactccaacgaaaaaaaaacgaaacgaaaccatcgaaacgaaaacgatacgaaaacccgcccgaaacgcaattcccaaaacccgccaaccccgaaaaataccctcgaccgcaaaataccgcgaaacctcaacgtataaaactactcgaaaaatcgaacccgaaaatacctaatataacgccataa

SEQ ID NO: 19291 - DNA, 786 bp, Artificial Sequence
  chemically treated genomic DNA (Homo sapiens) CpG-island No: 19291
taggagattttggttttttcggcgattcgggtttagtttttcggatagttttatttttaaaaggtaggttaagtcgcggagtttattttttcgacgagtcgattttgcggaggcgtttttattagaggggttgagtacgcggtttttagtttttttaggttacgtttacgacgattttttttttaggttagcgtaacgttttgaggttttttttgaaaaggtcgcgttttcgtttcgggttattcgggatcgcgttttttattagggttggttcgatttttttataggtcgcgtttatgacgatttttttttttaggtcgattcggagttttttttttcgttttagggtttgatttcgtttttcggtttaatcggttcgcgtcgatttgcgtttggtgttcgggttcggtttcgattttggttgtttttcgttttattcggattcgtattcgcgagtcggtttcgtcgtttttatttcgtcggtttttttagtagttttcgcgtcgttttaaaggtgaagtcgttatttcggtggcgtcggagggggcgaaatacgttttttttggttcgttcgttgttttaaaggagcgcgggtcgggtcggttttagcgggagggggacggggcggggttatcgaggcgggggcggtgcgaggattcgttcggggcgtagtttttagggttcgttagtttcgaggggtgttttcggtcgtaaaatgtcgcggggttttagcgtgtggagttgttcgggaggtcgaattcgaaggtatttagtgtggcgttatgg

SEQ ID NO: 19292 - DNA, 786 bp, Artificial Sequence
  chemically treated genomic DNA (Homo sapiens) CpG-island No: 19292
ccataacgccacactaaataccttcgaattcgacctcccgaacaactccacacgctaaaaccccgcgacattttacgaccgaaaacacccctcgaaactaacgaaccctaaaaactacgccccgaacgaatcctcgcaccgcccccgcctcgataaccccgccccgtccccctcccgctaaaaccgacccgacccgcgctcctttaaaacaacgaacgaaccaaaaaaaacgtatttcgccccctccgacgccaccgaaataacgacttcacctttaaaacgacgcgaaaactactaaaaaaaccgacgaaataaaaacgacgaaaccgactcgcgaatacgaatccgaataaaacgaaaaacaaccaaaatcgaaaccgaacccgaacaccaaacgcaaatcgacgcgaaccgattaaaccgaaaaacgaaatcaaaccctaaaacgaaaaaaaaaactccgaatcgacctaaaaaaaaaaatcgtcataaacgcgacctataaaaaaatcgaaccaaccctaataaaaaacgcgatcccgaataacccgaaacgaaaacgcgaccttttcaaaaaaaacctcaaaacgttacgctaacctaaaaaaaaaatcgtcgtaaacgtaacctaaaaaaactaaaaaccgcgtactcaacccctctaataaaaacgcctccgcaaaatcgactcgtcgaaaaaataaactccgcgacttaacctaccttttaaaaataaaactatccgaaaaactaaacccgaatcgccgaaaaaaccaaaatctccta

SEQ ID NO: 19293 - DNA, 560 bp, Artificial Sequence
  chemically treated genomic DNA (Homo sapiens) CpG-island No: 19293
ttttcgaaaggtttttcgtatcgcggagtttttttatatagttcgaggattcgttttcgagttgcgattggttcgcggaaggtcggggcggagtttcgcggattcggcgttgagcggaagtacggatcgtgaattggagtggaatcgcgattatgggagtttcggggggaaagattaatcggtttcgaacggtgattgtgtgggggtcgcgattttgtttttttaagcgtttttgagtttttttatttcgtacgagatgggattagtgaggggtcggggttgtttggtggaggggtttcgggtcgcggcgagtttattttatttgattcgtattttttttttcggtaggagttgaagaagaagttgtttaaacgtcggcgggtgttgaatcgggagcggcgtttgaggtatcgggtggtcggggttgtgatagattaagggttgattacgcggtattattttaagaagcgggcgtaagtattagattttttttttgttggtcgtttttatcgagtttttttttttttttgtagagtttcggagtagttttattttttagt

SEQ ID NO: 19294 - DNA, 560 bp, Artificial Sequence
  chemically treated genomic DNA (Homo sapiens) CpG-island No: 19294
actaaaaaataaaactactccgaaactctacaaaaaaaaaaaaaaactcgataaaaacgaccaacaaaaaaaaaatctaatacttacgcccgcttcttaaaataataccgcgtaatcaacccttaatctatcacaaccccgaccacccgatacctcaaacgccgctcccgattcaacacccgccgacgtttaaacaacttcttcttcaactcctaccgaaaaaaaaaatacgaatcaaataaaataaactcgccgcgacccgaaacccctccaccaaacaaccccgacccctcactaatcccatctcgtacgaaataaaaaaactcaaaaacgcttaaaaaaacaaaatcgcgacccccacacaatcaccgttcgaaaccgattaatctttccccccgaaactcccataatcgcgattccactccaattcacgatccgtacttccgctcaacgccgaatccgcgaaactccgccccgaccttccgcgaaccaatcgcaactcgaaaacgaatcctcgaactatataaaaaaactccgcgatacgaaaaacctttcgaaaa

SEQ ID NO: 19295 - DNA, 560 bp, Artificial Sequence
  chemically treated genomic DNA (Homo sapiens) CpG-island No: 19295
gttgagaggtgaagttgtttcggagttttgtagggaggaaggaagattcggtggggacgattaataggaagagggtttagtatttacgttcgttttttgaggtggtgtcgcgtgattagtttttggtttattatagtttcgattattcggtgttttagacgtcgttttcgatttaatattcgtcggcgtttgaatagttttttttttagtttttgtcggggagaaagatgcgaattagatggagtgggttcgtcgcgattcggggtttttttattaggtagtttcggttttttattgattttatttcgtgcgagataaaagggtttaggaacgtttgaggaaataaagtcgcggtttttatatagttatcgttcggggtcggttgattttttttttcggagtttttatagtcgcgattttattttagtttacggttcgtattttcgtttagcgtcggattcgcggggtttcgtttcggtttttcgcgggttaatcgtaattcgggggcgggttttcgggttatataaaggagtttcgcggtgcgggaggtttttcggagg

SEQ ID NO: 19296 - DNA, 560 bp, Artificial Sequence
  chemically treated genomic DNA (Homo sapiens) CpG-island No: 19296
cctccgaaaaacctcccgcaccgcgaaactcctttatataacccgaaaacccgcccccgaattacgattaacccgcgaaaaaccgaaacgaaaccccgcgaatccgacgctaaacgaaaatacgaaccgtaaactaaaataaaatcgcgactataaaaactccgaaaaaaaaaatcaaccgaccccgaacgataactatataaaaaccgcgactttatttcctcaaacgttcctaaacccttttatctcgcacgaaataaaatcaataaaaaaccgaaactacctaataaaaaaaccccgaatcgcgacgaacccactccatctaattcgcatctttctccccgacaaaaactaaaaaaaaaactattcaaacgccgacgaatattaaatcgaaaacgacgtctaaaacaccgaataatcgaaactataataaaccaaaaactaatcacgcgacaccacctcaaaaaacgaacgtaaatactaaaccctcttcctattaatcgtccccaccgaatcttccttcctccctacaaaactccgaaacaacttcacctctcaac

SEQ ID NO: 19297 - DNA, 564 bp, Artificial Sequence
  chemically treated genomic DNA (Homo sapiens) CpG-island No: 19297
agcgggtcggaatattattggttcgttcgtagtttagtacgcgttaggtcggttaaatttttgtttcggtttcggaggaggaggttgtgtcggttttgttcgattaatcggagagggcgaattaaaagttatgtatgacgatacgtatcgcggggattggagtttttggttttacgacggagattttttgagagttgttcgtggttgtcggtatcggttgttgtcgtcggattttcgtaggcgttgcgcggttttttttttttcgggaggtagagtttagcggtgttttcgtgtgcgttattaggaggcgatcgtcggggatgtttatagttggatagtttggtttcgaggtatgttgggatatcgcgggtcggtttttatagtaattggtcgatattcgcgtaggttttcggtttgtagggaaggttttgatggtttagtgttttgtagacggtgtttttcgttcgcggttatttttttacggcgtgtaaggggagaagtcggtttcgatttttttatttttagtttaggagagtaacggagttagttgtgggtgtgaatacg

SEQ ID NO: 19298 - DNA, 564 bp, Artificial Sequence
  chemically treated genomic DNA (Homo sapiens) CpG-island No: 19298
cgtattcacacccacaactaactccgttactctcctaaactaaaaataaaaaaatcgaaaccgacttctccccttacacgccgtaaaaaaataaccgcgaacgaaaaacaccgtctacaaaacactaaaccatcaaaaccttccctacaaaccgaaaacctacgcgaatatcgaccaattactataaaaaccgacccgcgatatcccaacatacctcgaaaccaaactatccaactataaacatccccgacgatcgcctcctaataacgcacacgaaaacaccgctaaactctacctcccgaaaaaaaaaaaaccgcgcaacgcctacgaaaatccgacgacaacaaccgataccgacaaccacgaacaactctcaaaaaatctccgtcgtaaaaccaaaaactccaatccccgcgatacgtatcgtcatacataacttttaattcgccctctccgattaatcgaacaaaaccgacacaacctcctcctccgaaaccgaaacaaaaatttaaccgacctaacgcgtactaaactacgaacgaaccaataatattccgacccgct

SEQ ID NO: 19299 - DNA, 564 bp, Artificial Sequence
  chemically treated genomic DNA (Homo sapiens) CpG-island No: 19299
cgtgtttatatttatagttggtttcgttatttttttgagttgggggtggggggatcggggtcggtttttttttttgtacgtcgtggggagatggtcgcggacgaagggtatcgtttgtaaagtattgaattattagggttttttttgtaggtcgaaggtttgcgcgaatgtcggttagttattatggagatcggttcgcggtattttagtatgtttcgggattaaattgtttaattgtgagtattttcgacggtcgttttttgatgacgtatacggaagtatcgttaggttttgtttttcgaagaaaagggagtcgcgtagcgtttacgggagttcggcggtagtagtcggtatcggtaattacgggtagtttttagggaattttcgtcgtgaggttagaggttttagttttcgcggtgcgtatcgttatgtatggtttttggttcgtttttttcggttagtcgagtagggtcggtataattttttttttcgaggtcgaagtagagatttaatcggtttgacgcgtgttgggttgcgggcgagttagtgatatttcggttcgtt

SEQ ID NO: 19300 - DNA, 564 bp, Artificial Sequence
  chemically treated genomic DNA (Homo sapiens) CpG-island No: 19300
aacgaaccgaaatatcactaactcgcccgcaacccaacacgcgtcaaaccgattaaatctctacttcgacctcgaaaaaaaaaattataccgaccctactcgactaaccgaaaaaaacgaaccaaaaaccatacataacgatacgcaccgcgaaaactaaaacctctaacctcacgacgaaaattccctaaaaactacccgtaattaccgataccgactactaccgccgaactcccgtaaacgctacgcgactcccttttcttcgaaaaacaaaacctaacgatacttccgtatacgtcatcaaaaaacgaccgtcgaaaatactcacaattaaacaatttaatcccgaaacatactaaaataccgcgaaccgatctccataataactaaccgacattcgcgcaaaccttcgacctacaaaaaaaaccctaataattcaatactttacaaacgatacccttcgtccgcgaccatctccccacgacgtacaaaaaaaaaaaccgaccccgatccccccacccccaactcaaaaaaataacgaaaccaactataaatataaacacg

SEQ ID NO: 19301 - DNA, 579 bp, Artificial Sequence
  chemically treated genomic DNA (Homo sapiens) CpG-island No: 19301
tggtttgagaaaggtgagagcgggtcgaggtcggaatgtggggtagcgtacgggaaggggagatagtagtcgttgtaggcggtattaggcggagtcgcgaggtttggagagttcgagtggggaggggttcgcgcgtttagcgtgcgaaataaatcggggattcggattttcgttgttatgtaatcgggggcgtcgtttttaggtaattcgggaggcgtacgttttcggggagaagagggttgcggcgaggtttcgaggttcggtagaggtggagcggttttcgggcgtggggattaggttagcgttaagttcgagttttcgaatttcgatttacggtttagttttttgtagtttcggttcgagtttttcggggggttttaaatttatgggtcgcgttacgttttttgttagcgacgttattttttagcgtttggtaggggacgcgtcgttcgaaatagtatatgttattgatattttgttttcgggaggttgcgtttcggttagggcgcggagcggtagggaagttgtttttttgtcgtcgttttgtttttaaatagttgttgggtagtagttgttagg

SEQ ID NO: 19302 - DNA, 579 bp, Artificial Sequence
  chemically treated genomic DNA (Homo sapiens) CpG-island No: 19302
cctaacaactactacccaacaactatttaaaaacaaaacgacgacaaaaaaacaacttccctaccgctccgcgccctaaccgaaacgcaacctcccgaaaacaaaatatcaataacatatactatttcgaacgacgcgtcccctaccaaacgctaaaaaataacgtcgctaacaaaaaacgtaacgcgacccataaatttaaaaccccccgaaaaactcgaaccgaaactacaaaaaactaaaccgtaaatcgaaattcgaaaactcgaacttaacgctaacctaatccccacgcccgaaaaccgctccacctctaccgaacctcgaaacctcgccgcaaccctcttctccccgaaaacgtacgcctcccgaattacctaaaaacgacgcccccgattacataacaacgaaaatccgaatccccgatttatttcgcacgctaaacgcgcgaacccctccccactcgaactctccaaacctcgcgactccgcctaataccgcctacaacgactactatctccccttcccgtacgctaccccacattccgacctcgacccgctctcacctttctcaaacca

SEQ ID NO: 19303 - DNA, 579 bp, Artificial Sequence
  chemically treated genomic DNA (Homo sapiens) CpG-island No: 19303
tttgatagttgttgtttagtaattgtttgggggtagggcgacggtaaaggggtagtttttttgtcgtttcgcgttttaatcggggcgtagtttttcggagatagggtgttagtggtatgtgttatttcgaacggcgcgttttttgttaagcgttgaggggtagcgtcgttggtaaggaacgtggcgcgatttatgagtttggggtttttcgaagggttcgagtcgaggttgtaggaggttgggtcgtgggtcggggttcgggggttcgggtttggcgttggtttggtttttacgttcgggagtcgttttatttttgtcggatttcggaatttcgtcgtaattttttttttttcggaaacgtgcgtttttcgggttgtttggaaacgacgttttcggttgtatagtaacggggattcgggttttcggtttgtttcgtacgttgggcgcgcggatttttttttattcggattttttaggtttcgcggtttcgtttggtgtcgtttgtagcggttgttgtttttttttttcgtgcgttgttttatatttcgatttcggttcgtttttattttttttaggtta

SEQ ID NO: 19304 - DNA, 579 bp, Artificial Sequence
  chemically treated genomic DNA (Homo sapiens) CpG-island No: 19304
taacctaaaaaaaataaaaacgaaccgaaatcgaaatataaaacaacgcacgaaaaaaaaaaacaacaaccgctacaaacgacaccaaacgaaaccgcgaaacctaaaaaatccgaataaaaaaaaatccgcgcgcccaacgtacgaaacaaaccgaaaacccgaatccccgttactatacaaccgaaaacgtcgtttccaaacaacccgaaaaacgcacgtttccgaaaaaaaaaaaattacgacgaaattccgaaatccgacaaaaataaaacgactcccgaacgtaaaaaccaaaccaacgccaaacccgaacccccgaaccccgacccacgacccaacctcctacaacctcgactcgaacccttcgaaaaaccccaaactcataaatcgcgccacgttccttaccaacgacgctacccctcaacgcttaacaaaaaacgcgccgttcgaaataacacataccactaacaccctatctccgaaaaactacgccccgattaaaacgcgaaacgacaaaaaaactacccctttaccgtcgccctacccccaaacaattactaaacaacaactatcaaa

SEQ ID NO: 19305 - DNA, 534 bp, Artificial Sequence
  chemically treated genomic DNA (Homo sapiens) CpG-island No: 19305
ttttcgttttcgtttcgtagagaaagagcgtgcgtgtcgcgtatttttggtttggggagcgggtggagtaaatttgcgggaattattttacgataacgtgcggttgtgcggtgtggttgacggtaacgtcgttgtttttggagaggttatttcggagacggcgttggttttggggtgtggggggttggtggtattatgtggcgcgtttgtgcgcgacgggtttagaatgtagttttatgggcgggattcgaggttcggtggacggttttgtaggaggtattcggaattttacgagtgatttcgcgatttggttcggttttcgttcgtcgtaatagcgtgattatagggtatggcggggttcgggtattgtgcggttggatttttagttttggggttacgtcgcggaatcgtttattgttgtagtttttggggtcgttcggtcgtcgttattatagttttttttcgtattagaaggtgagttttagattttttttttcgggatttcgttgttttttagagttgattggatgtttg

SEQ ID NO: 19306 - DNA, 534 bp, Artificial Sequence
  chemically treated genomic DNA (Homo sapiens) CpG-island No: 19306
caaacatccaatcaactctaaaaaacaacgaaatcccgaaaaaaaaaatctaaaactcaccttctaatacgaaaaaaaactataataacgacgaccgaacgaccccaaaaactacaacaataaacgattccgcgacgtaaccccaaaactaaaaatccaaccgcacaatacccgaaccccgccataccctataatcacgctattacgacgaacgaaaaccgaaccaaatcgcgaaatcactcgtaaaattccgaatacctcctacaaaaccgtccaccgaacctcgaatcccgcccataaaactacattctaaacccgtcgcgcacaaacgcgccacataataccaccaaccccccacaccccaaaaccaacgccgtctccgaaataacctctccaaaaacaacgacgttaccgtcaaccacaccgcacaaccgcacgttatcgtaaaataattcccgcaaatttactccacccgctccccaaaccaaaaatacgcgacacgcacgctctttctctacgaaacgaaaacgaaaa

SEQ ID NO: 19307 - DNA, 534 bp, Artificial Sequence
  chemically treated genomic DNA (Homo sapiens) CpG-island No: 19307
taggtatttagttagttttgaaggataacggggtttcgagaaggggggtttagggtttattttttgatgcgggggaagattgtaatagcggcggtcgggcgattttaaaagttgtagtagtaagcggtttcgcggcgtggttttagaattgggggtttagtcgtatagtgttcggatttcgttatattttgtagttacgttgttgcgacgagcgggagtcgggttagatcgcgaggttattcgtggagtttcgggtattttttgtaaggtcgtttatcgagtttcgagtttcgtttatggggttatattttgagttcgtcgcgtatagacgcgttatatagtgttattaattttttatattttaaaattaacgtcgttttcggagtgatttttttaagagtagcggcgttgtcgttagttatatcgtatagtcgtacgttgtcgtaaaatggttttcgtaggtttattttattcgttttttaggttagaaatgcgcggtacgtacgttttttttttacggagcggggacgaggg

SEQ ID NO: 19308 - DNA, 534 bp, Artificial Sequence
  chemically treated genomic DNA (Homo sapiens) CpG-island No: 19308
ccctcgtccccgctccgtaaaaaaaaaacgtacgtaccgcgcatttctaacctaaaaaacgaataaaataaacctacgaaaaccattttacgacaacgtacgactatacgatataactaacgacaacgccgctactcttaaaaaaatcactccgaaaacgacgttaattttaaaatataaaaaattaataacactatataacgcgtctatacgcgacgaactcaaaatataaccccataaacgaaactcgaaactcgataaacgaccttacaaaaaatacccgaaactccacgaataacctcgcgatctaacccgactcccgctcgtcgcaacaacgtaactacaaaatataacgaaatccgaacactatacgactaaacccccaattctaaaaccacgccgcgaaaccgcttactactacaacttttaaaatcgcccgaccgccgctattacaatcttcccccgcatcaaaaaataaaccctaaaccccccttctcgaaaccccgttatccttcaaaactaactaaataccta

SEQ ID NO: 19309 - DNA, 686 bp, Artificial Sequence
  chemically treated genomic DNA (Homo sapiens) CpG-island No: 19309
gatttaggtatatacgtggcgagatcgtagggagtagcgttcgttttgcgtttttttttttttttatattttaggttttatttgtttcgggtttcgaaggttttaggatgttgtggttgtacgcggacgttagtcgttttaaggtgatcgttagggaagatgttgttatggtcgtagtttcggtcggaaacggaaacgacgcgaatcgcgtgcgtaacgtacgggttcggcggggaatatcggttcgttgtaatatcggttcggcgtagaagcgggacgtcggtttttaggggtttaggtcggcggcggcgatggtttcggtagttgtggagagtttcgtgattaagtaattggatttgttggagtttgagagagacgcggaggtggaggagcgtaggtacgggaggtcgtcggcgtcgttttttcgcggtcggtttcgtcgtgtttcgggtagagttttcgaggggttcggttttatagtttggggcgggaatttcgttttcgatttttcgagttaggggtagggatcgttcgttttttgtttggttatttttcgagttgttagttttattattttttgggtagcgcgtttcgtttggggatttttaagaagtattttgatttttcgattcgagattttttattaagtttatatttttgggttttggtttcgattttagttttat

SEQ ID NO: 19310 - DNA, 686 bp, Artificial Sequence
  chemically treated genomic DNA (Homo sapiens) CpG-island No: 19310
ataaaactaaaatcgaaaccaaaacccaaaaatataaacttaataaaaaatctcgaatcgaaaaatcaaaatacttcttaaaaatccccaaacgaaacgcgctacccaaaaaataataaaactaacaactcgaaaaataaccaaacaaaaaacgaacgatccctacccctaactcgaaaaatcgaaaacgaaattcccgccccaaactataaaaccgaacccctcgaaaactctacccgaaacacgacgaaaccgaccgcgaaaaaacgacgccgacgacctcccgtacctacgctcctccacctccgcgtctctctcaaactccaacaaatccaattacttaatcacgaaactctccacaactaccgaaaccatcgccgccgccgacctaaacccctaaaaaccgacgtcccgcttctacgccgaaccgatattacaacgaaccgatattccccgccgaacccgtacgttacgcacgcgattcgcgtcgtttccgtttccgaccgaaactacgaccataacaacatcttccctaacgatcaccttaaaacgactaacgtccgcgtacaaccacaacatcctaaaaccttcgaaacccgaaacaaataaaacctaaaatataaaaaaaaaaaaaaacgcaaaacgaacgctactccctacgatctcgccacgtatatacctaaatc

SEQ ID NO: 19311 - DNA, 686 bp, Artificial Sequence
  chemically treated genomic DNA (Homo sapiens) CpG-island No: 19311
gtggaattggggtcggggttagggtttaggagtgtaagtttagtggggggtttcgggtcgggaaattaaagtgttttttaagggtttttaaacggaacgcgttgtttaggaagtgatgagattgataattcgggaggtggttaagtaggggacggacgatttttgtttttgattcgaagggtcggagacgaaattttcgttttagattatgaggtcgagtttttcggagattttgttcgggatacggcgggatcgatcgcgagggagcggcgtcggcggtttttcgtatttgcgtttttttattttcgcgttttttttaagttttagtaggtttagttgtttggttacgaagttttttatagttgtcgaggttatcgtcgtcgtcggtttgggtttttagaagtcgacgtttcgtttttgcgtcgggtcggtgttatagcggatcggtgtttttcgtcgggttcgtgcgttacgtacgcggttcgcgtcgttttcgttttcggtcgaggttgcggttatggtagtattttttttgacggttattttagggcggttggcgttcgcgtgtagttatagtattttgagattttcggggttcggagtaggtgagatttgggatatgggaggaagggaggacgtagagcgagcgttgttttttgcggtttcgttacgtatgtgtttgggtt

SEQ ID NO: 19312 - DNA, 686 bp, Artificial Sequence
  chemically treated genomic DNA (Homo sapiens) CpG-island No: 19312
aacccaaacacatacgtaacgaaaccgcaaaaaacaacgctcgctctacgtcctcccttcctcccatatcccaaatctcacctactccgaaccccgaaaatctcaaaatactataactacacgcgaacgccaaccgccctaaaataaccgtcaaaaaaaatactaccataaccgcaacctcgaccgaaaacgaaaacgacgcgaaccgcgtacgtaacgcacgaacccgacgaaaaacaccgatccgctataacaccgacccgacgcaaaaacgaaacgtcgacttctaaaaacccaaaccgacgacgacgataacctcgacaactataaaaaacttcgtaaccaaacaactaaacctactaaaacttaaaaaaaacgcgaaaataaaaaaacgcaaatacgaaaaaccgccgacgccgctccctcgcgatcgatcccgccgtatcccgaacaaaatctccgaaaaactcgacctcataatctaaaacgaaaatttcgtctccgacccttcgaatcaaaaacaaaaatcgtccgtcccctacttaaccacctcccgaattatcaatctcatcacttcctaaacaacgcgttccgtttaaaaacccttaaaaaacactttaatttcccgacccgaaaccccccactaaacttacactcctaaaccctaaccccgaccccaattccac

SEQ ID NO: 19313 - DNA, 520 bp, Artificial Sequence
  chemically treated genomic DNA (Homo sapiens) CpG-island No: 19313
  misc_feature (60)..(60): n is either a, c, g or t
ggtgtttgaggtgagggtttcgttagcggaaaacgttcgataacggaggggtaggtaggntcgggggcgtggttaacgcgggtttcgtttttcgggttttattttcgagcgtacgcgcgcgtttgaagtagttaattaggaagcgtagagtaggtttaaatatagacggcgggtgaatatggcgttttcgatttggtttgagacgtgataggtttgttttttggttgaagatgtggcgagtgaaaaaattgagttttagtttgtcgttttcgttttagacggtaagcgggagatttttggcggagagaattgggtcgggttgttgtcgcgggggtatcggtcgtgtttattgttttggaaagttgggtcgagttcggggttgggggtttgtggagtttttgttcgttttgttgtttttgcgcgattagggtgcgagcgtatttttttaatcgtattttgggttttttagggagggaggaggggcgggttggtagaatttaggtttttttatattcgtttt

SEQ ID NO: 19314 - DNA, 520 bp, Artificial Sequence
  chemically treated genomic DNA (Homo sapiens) CpG-island No: 19314
  misc_feature (461)..(461): n is either a, c, g or t
aaaacgaatataaaaaaacctaaattctaccaacccgcccctcctccctccctaaaaaacccaaaatacgattaaaaaaatacgctcgcaccctaatcgcgcaaaaacaacaaaacgaacaaaaactccacaaacccccaaccccgaactcgacccaactttccaaaacaataaacacgaccgatacccccgcgacaacaacccgacccaattctctccgccaaaaatctcccgcttaccgtctaaaacgaaaacgacaaactaaaactcaattttttcactcgccacatcttcaaccaaaaaacaaacctatcacgtctcaaaccaaatcgaaaacgccatattcacccgccgtctatatttaaacctactctacgcttcctaattaactacttcaaacgcgcgcgtacgctcgaaaataaaacccgaaaaacgaaacccgcgttaaccacgcccccgancctacctacccctccgttatcgaacgttttccgctaacgaaaccctcacctcaaacacc

SEQ ID NO: 19315 - DNA, 520 bp, Artificial Sequence
  chemically treated genomic DNA (Homo sapiens) CpG-island No: 19315
  misc_feature (461)..(461): n is either a, c, g or t
agggcgagtgtgaggaagtttgggttttgttagttcgttttttttttttttttaagaagtttaaaatgcgattagaagagtacgttcgtattttagtcgcgtaggagtagtaaggcgaataaagattttataagtttttaatttcgggttcgatttaattttttaggatagtagatacggtcggtgttttcgcgatagtagttcggtttagtttttttcgttagagatttttcgtttatcgtttggggcgaaggcgataggttgaggtttagtttttttattcgttatatttttaattagaaggtaggtttattacgttttagattaagtcgaggacgttatgtttattcgtcgtttgtgtttgaatttgttttgcgttttttggttggttgttttaggcgcgcgcgtacgttcgggggtagagttcggggggcggggttcgcgttgattacgttttcggntttgtttgttttttcgttgtcgagcgtttttcgttgacggagtttttattttagatatt

SEQ ID NO: 19316 - DNA, 520 bp, Artificial Sequence
  chemically treated genomic DNA (Homo sapiens) CpG-island No: 19316
  misc_feature (60)..(60): n is either a, c, g or t
aatatctaaaataaaaactccgtcaacgaaaaacgctcgacaacgaaaaaacaaacaaanccgaaaacgtaatcaacgcgaaccccgccccccgaactctacccccgaacgtacgcgcgcgcctaaaacaaccaaccaaaaaacgcaaaacaaattcaaacacaaacgacgaataaacataacgtcctcgacttaatctaaaacgtaataaacctaccttctaattaaaaatataacgaataaaaaaactaaacctcaacctatcgccttcgccccaaacgataaacgaaaaatctctaacgaaaaaaactaaaccgaactactatcgcgaaaacaccgaccgtatctactatcctaaaaaattaaatcgaacccgaaattaaaaacttataaaatctttattcgccttactactcctacgcgactaaaatacgaacgtactcttctaatcgcattttaaacttcttaaaaaaaaaaaaaaaacgaactaacaaaacccaaacttcctcacactcgccct

SEQ ID NO: 19317 - DNA, 551 bp, Artificial Sequence
  chemically treated genomic DNA (Homo sapiens) CpG-island No: 19317
tttagttgttttttttttttcggtgtttacgatcgtatcgtttagattattttattttttttgtttcggaagttatatattgtcgatatcgggacgtaattttcgggaagggtttatttttaagatagatacggaagtgttgggagtcgtcgggagttcgttcggttgcgggtgtttttggttttgcggttagttttgggaacgtttcggagagttagatttttagaggttcgatttcgttagttcggaatagataaagttagcgttttcgttcgtttttcgatttaggattcgatgtcggtagcgttttggggttttcgtagcggggttggattatgagtttgttggacggtttcgttttttcgtcgcgggtttcgttgtagtttagtaaggttaggatgaaaaagttttcgaagaagagttagaatgagaagtatcggttgaagtatttgcggttgcgtaaagcggttaaggttacggtgtttgtgagtttgatttacgtttagtcggtttttttttggagatttttttataaaatttttttttaagtt

SEQ ID NO: 19318 - DNA, 551 bp, Artificial Sequence
  chemically treated genomic DNA (Homo sapiens) CpG-island No: 19318
aacttaaaaaaaaattttataaaaaaatctccaaaaaaaaaccgactaaacgtaaatcaaactcacaaacaccgtaaccttaaccgctttacgcaaccgcaaatacttcaaccgatacttctcattctaactcttcttcgaaaactttttcatcctaaccttactaaactacaacgaaacccgcgacgaaaaaacgaaaccgtccaacaaactcataatccaaccccgctacgaaaaccccaaaacgctaccgacatcgaatcctaaatcgaaaaacgaacgaaaacgctaactttatctattccgaactaacgaaatcgaacctctaaaaatctaactctccgaaacgttcccaaaactaaccgcaaaaccaaaaacacccgcaaccgaacgaactcccgacgactcccaacacttccgtatctatcttaaaaataaacccttcccgaaaattacgtcccgatatcgacaatatataacttccgaaacaaaaaaaataaaataatctaaacgatacgatcgtaaacaccgaaaaaaaaaaaacaactaaa

SEQ ID NO: 19319 - DNA, 551 bp, Artificial Sequence
  chemically treated genomic DNA (Homo sapiens) CpG-island No: 19319
agtttggggaaagattttgtgagggagtttttaggaggggatcggttgaacgtgggttagatttataaatatcgtggttttggtcgttttgcgtagtcgtaggtattttagtcggtattttttattttggttttttttcgggagtttttttattttggttttgttggattgtagcggagttcgcggcgaggaagcgaggtcgtttagtaggtttatggtttagtttcgttacgggggttttaggacgttgtcggtatcggattttaagtcggggagcgggcgggagcgttggttttgtttgtttcgggttagcggaatcgggtttttaggaatttagtttttcgggacgtttttagggttgatcgtagggttagagatattcgtaatcgaacgggttttcggcgatttttagtattttcgtgtttgttttggaagtaagtttttttcggaagttacgtttcggtgtcggtagtgtgtaattttcggggtagggagagtagggtggtttgggcggtgcgatcgtgggtatcgggaggaaagagatagttggg

SEQ ID NO: 19320 - DNA, 551 bp, Artificial Sequence
  chemically treated genomic DNA (Homo sapiens) CpG-island No: 19320
cccaactatctctttcctcccgatacccacgatcgcaccgcccaaaccaccctactctccctaccccgaaaattacacactaccgacaccgaaacgtaacttccgaaaaaaacttacttccaaaacaaacacgaaaatactaaaaatcgccgaaaacccgttcgattacgaatatctctaaccctacgatcaaccctaaaaacgtcccgaaaaactaaattcctaaaaacccgattccgctaacccgaaacaaacaaaaccaacgctcccgcccgctccccgacttaaaatccgataccgacaacgtcctaaaacccccgtaacgaaactaaaccataaacctactaaacgacctcgcttcctcgccgcgaactccgctacaatccaacaaaaccaaaataaaaaaactcccgaaaaaaaaccaaaataaaaaataccgactaaaatacctacgactacgcaaaacgaccaaaaccacgatatttataaatctaacccacgttcaaccgatcccctcctaaaaactccctcacaaaatctttccccaaact

SEQ ID NO: 19321 - DNA, 573 bp, Artificial Sequence
  chemically treated genomic DNA (Homo sapiens) CpG-island No: 19321
  misc_feature (272)..(274): n is either a, c, g or t
  misc_feature (295)..(297): n is either a, c, g or t
tttcgagttaatttattgttatagtttttagtcggcgatttattggtttttgttggaggcgggattttcggttgttaggcggtatttttttcggaagtgtttgttgcgcgttgtagggtaatatttcggcgtttttggaagttgggggagcgggtgggtgttgggtggcgttgggggagttgcgtttcgtttagagtttcgttcggagtttcgttcggagtttttcggggtgggggatagttgaggattttatcgagggaggggttgggcgnnngggaagggagcgagcgtggtnnngattcgaggtacgttttcgagttaacgagcgtgatgcgttcgagtgtgggcggggattgagggaagaagtgaaaatcggattgttaggcgatagttttttcgtttgaaatttcgtcggtttttgagcgggttatcgggttcgggttgggggtttggcgggtgagtgagtagcgggtcgggacgcgggagaggggtattgggtacggggttttggtttgtttgttttgtttatcgttggcgagtgaggttaggtttttcgaagtttgttgggatatt

SEQ ID NO: 19322 - DNA, 573 bp, Artificial Sequence
  chemically treated genomic DNA (Homo sapiens) CpG-island No: 19322
  misc_feature (277)..(279): n is either a, c, g or t
  misc_feature (300)..(302): n is either a, c, g or t
aatatcccaacaaacttcgaaaaacctaacctcactcgccaacgataaacaaaacaaacaaaccaaaaccccgtacccaatacccctctcccgcgtcccgacccgctactcactcacccgccaaacccccaacccgaacccgataacccgctcaaaaaccgacgaaatttcaaacgaaaaaactatcgcctaacaatccgattttcacttcttccctcaatccccgcccacactcgaacgcatcacgctcgttaactcgaaaacgtacctcgaatcnnnaccacgctcgctcccttcccnnncgcccaacccctccctcgataaaatcctcaactatcccccaccccgaaaaactccgaacgaaactccgaacgaaactctaaacgaaacgcaactcccccaacgccacccaacacccacccgctcccccaacttccaaaaacgccgaaatattaccctacaacgcgcaacaaacacttccgaaaaaaataccgcctaacaaccgaaaatcccgcctccaacaaaaaccaataaatcgccgactaaaaactataacaataaattaactcgaaa

SEQ ID NO: 19323 - DNA, 573 bp, Artificial Sequence
  chemically treated genomic DNA (Homo sapiens) CpG-island No: 19323
  misc_feature (277)..(279): n is either a, c, g or t
  misc_feature (300)..(302): n is either a, c, g or t
agtattttagtaagtttcggaaggtttggttttattcgttaacgatgaatagagtaagtaaattagggtttcgtgtttagtgtttttttttcgcgtttcgattcgttgtttatttattcgttagatttttagttcgggttcggtggttcgtttaggagtcggcgagattttaaacggaggaattgtcgtttggtagttcgatttttatttttttttttagttttcgtttatattcgagcgtattacgttcgttggttcgagagcgtgtttcgggttnnngttacgttcgttttttttttnnncgtttaatttttttttcgatgaggtttttaattattttttatttcggaaggtttcgggcgaggtttcgggcgaggttttgggcgaggcgtagtttttttaacgttatttaatatttattcgtttttttagtttttagggacgtcggggtgttgttttgtagcgcgtaataaatattttcggaaaaggtatcgtttagtaatcgggagtttcgtttttagtaggagttaataggtcgtcggttgagagttgtgataatggattggttcgaag

SEQ ID NO: 19324 - DNA, 573 bp, Artificial Sequence
  chemically treated genomic DNA (Homo sapiens) CpG-island No: 19324
  misc_feature (272)..(274): n is either a, c, g or t
  misc_feature (295)..(297): n is either a, c, g or t
cttcgaaccaatccattatcacaactctcaaccgacgacctattaactcctactaaaaacgaaactcccgattactaaacgataccttttccgaaaatatttattacgcgctacaaaacaacaccccgacgtccctaaaaactaaaaaaacgaataaatattaaataacgttaaaaaaactacgcctcgcccaaaacctcgcccgaaacctcgcccgaaaccttccgaaataaaaaataattaaaaacctcatcgaaaaaaaaattaaacgnnnaaaaaaaaaacgaacgtaacnnnaacccgaaacacgctctcgaaccaacgaacgtaatacgctcgaatataaacgaaaactaaaaaaaaaaataaaaatcgaactaccaaacgacaattcctccgtttaaaatctcgccgactcctaaacgaaccaccgaacccgaactaaaaatctaacgaataaataaacaacgaatcgaaacgcgaaaaaaaaacactaaacacgaaaccctaatttacttactctattcatcgttaacgaataaaaccaaaccttccgaaacttactaaaatact

SEQ ID NO: 19325 - DNA, 639 bp, Artificial Sequence
  chemically treated genomic DNA (Homo sapiens) CpG-island No: 19325
  misc_feature (159)..(161): n is either a, c, g or t
  misc_feature (183)..(184): n is either a, c, g or t
  misc_feature (208)..(209): n is either a, c, g or t
ttataagatttaattataagttcggttttatttttcgggtttcgttttttttcgtatttattttatcgcgtttcgttttacgataacgtatttatcgtagcgttttggaatttttaagttcgttttcgtttttcggacggtttcggggaaagggagggnnnggcgtagcgagttcgcgcgcgnnagtttttagttatttcgggcgggnnaggggagcgtttatttttacgtatgcgtttttagttttcgcgggagggagggggcggaaaaaggaggaggaagaggggcgggtaaatttggaattaattaatgatagcggcgttagtcgggattttggtcggtatagaattgggggcggaatcgcgcggggtttgaagggaggggtttgggcgcgggagtcgggtaggagaagacggaagtggagcgaggataaaatggttgcgaaggttgttgttttttttttttatttacgttcgaatttttttttttatgttttattttcgtgttttagacgggtttttaagtgtttcgggtttcgcgaatttgtattttatagcgtggttttggataagggttgatttcgaggggttggggcgaaggtttcggttttagggtgttattagggttgttcgtttacgg

SEQ ID NO: 19326 - DNA, 639 bp, Artificial Sequence
  chemically treated genomic DNA (Homo sapiens) CpG-island No: 19326
  misc_feature (431)..(432): n is either a, c, g or t
  misc_feature (456)..(457): n is either a, c, g or t
  misc_feature (479)..(481): n is either a, c, g or t
ccgtaaacgaacaaccctaataacaccctaaaaccgaaaccttcgccccaacccctcgaaatcaacccttatccaaaaccacgctataaaatacaaattcgcgaaacccgaaacacttaaaaacccgtctaaaacacgaaaataaaacataaaaaaaaaaattcgaacgtaaataaaaaaaaaaaacaacaaccttcgcaaccattttatcctcgctccacttccgtcttctcctacccgactcccgcgcccaaacccctcccttcaaaccccgcgcgattccgcccccaattctataccgaccaaaatcccgactaacgccgctatcattaattaattccaaatttacccgcccctcttcctcctcctttttccgccccctccctcccgcgaaaactaaaaacgcatacgtaaaaataaacgctcccctnncccgcccgaaataactaaaaactnncgcgcgcgaactcgctacgccnnnccctccctttccccgaaaccgtccgaaaaacgaaaacgaacttaaaaattccaaaacgctacgataaatacgttatcgtaaaacgaaacgcgataaaataaatacgaaaaaaaacgaaacccgaaaaataaaaccgaacttataattaaatcttataa

SEQ ID NO: 19327 - DNA, 639 bp, Artificial Sequence
  chemically treated genomic DNA (Homo sapiens) CpG-island No: 19327
  misc_feature (431)..(432): n is either a, c, g or t
  misc_feature (456)..(457): n is either a, c, g or t
  misc_feature (479)..(481): n is either a, c, g or t
tcgtgagcgagtagttttagtggtattttgaagtcggaattttcgttttagtttttcggggttagtttttgtttaaagttacgttatgaaatatagattcgcgaaattcggggtatttagaggttcgtttggaatacgaaggtggggtatggaaaggaggattcggacgtgggtgggggaggggagtaataattttcgtagttattttgttttcgttttattttcgtttttttttgttcggttttcgcgtttaaatttttttttttaggtttcgcgcgatttcgtttttagttttgtgtcggttaagatttcggttagcgtcgttattattggttagttttaagtttgttcgttttttttttttttttttttttcgttttttttttttcgcggaagttgggggcgtatgcgtagaggtggacgtttttttnnttcgttcggggtaattgaggattnncgcgcgcggattcgttgcgttnnntttttttttttttcggggtcgttcggagagcgggggcgagtttgaaagttttagaacgttgcggtgagtgcgttatcgtgaggcggagcgcggtggggtgggtgcggaagggggcgaggttcgaggagtggagtcgggtttgtgattgggttttgtaa

SEQ ID NO: 19328 - DNA, 639 bp, Artificial Sequence
  chemically treated genomic DNA (Homo sapiens) CpG-island No: 19328
  misc_feature (159)..(161): n is either a, c, g or t
  misc_feature (183)..(184): n is either a, c, g or t
  misc_feature (208)..(209): n is either a, c, g or t
ttacaaaacccaatcacaaacccgactccactcctcgaacctcgcccccttccgcacccaccccaccgcgctccgcctcacgataacgcactcaccgcaacgttctaaaactttcaaactcgcccccgctctccgaacgaccccgaaaaaaaaaaaaannnaacgcaacgaatccgcgcgcgnnaatcctcaattaccccgaacgaannaaaaaaacgtccacctctacgcatacgcccccaacttccgcgaaaaaaaaaaaacgaaaaaaaaaaaaaaaaaaaaaacgaacaaacttaaaactaaccaataataacgacgctaaccgaaatcttaaccgacacaaaactaaaaacgaaatcgcgcgaaacctaaaaaaaaaaatttaaacgcgaaaaccgaacaaaaaaaaacgaaaataaaacgaaaacaaaataactacgaaaattattactcccctcccccacccacgtccgaatcctcctttccataccccaccttcgtattccaaacgaacctctaaataccccgaatttcgcgaatctatatttcataacgtaactttaaacaaaaactaaccccgaaaaactaaaacgaaaattccgacttcaaaataccactaaaactactcgctcacga

SEQ ID NO: 19329 - DNA, 518 bp, Artificial Sequence
  chemically treated genomic DNA (Homo sapiens) CpG-island No: 19329
tcgtgtttcgttttaaaggagggcgttaacgtaattttagtatgtgggagacgggttgttttattttcgcgcgtaaaattttggtttagtttaagggatggaggcggggatttttgcgtaggtttgcggcgtgggaggcggtcgttcgcgatttacgacgtcgcgcgtcgggaggttgagagttcggcgtcgggagggtttcggggatagaagagcgtttcgttcggttgttaaggtaattttacgcggttggagaagtcggcgttcgtagttcggttcgggtcgttgtcggaagtgacgcgagtttatttgtcgagcgggggttgggaggaggggcggagggtgtagaggtgtcgtcgtcgtcgcgagttagtcgggagcgcgcgaggcgcggggagtttgggattaggagcgagagtcgtttatttgtagtcgtcgtttacggtacggtagttattatggcgtttttgttgtgtttcgtgtttttgtgcggagtagtgggtgagtaggggttatgg

SEQ ID NO: 19330 - DNA, 518 bp, Artificial Sequence
  chemically treated genomic DNA (Homo sapiens) CpG-island No: 19330
ccataacccctactcacccactactccgcacaaaaacacgaaacacaacaaaaacgccataataactaccgtaccgtaaacgacgactacaaataaacgactctcgctcctaatcccaaactccccgcgcctcgcgcgctcccgactaactcgcgacgacgacgacacctctacaccctccgcccctcctcccaacccccgctcgacaaataaactcgcgtcacttccgacaacgacccgaaccgaactacgaacgccgacttctccaaccgcgtaaaattaccttaacaaccgaacgaaacgctcttctatccccgaaaccctcccgacgccgaactctcaacctcccgacgcgcgacgtcgtaaatcgcgaacgaccgcctcccacgccgcaaacctacgcaaaaatccccgcctccatcccttaaactaaaccaaaattttacgcgcgaaaataaaacaacccgtctcccacatactaaaattacgttaacgccctcctttaaaacgaaacacga

SEQ ID NO: 19331 - DNA, 518 bp, Artificial Sequence
  chemically treated genomic DNA (Homo sapiens) CpG-island No: 19331
ttatggtttttatttatttattatttcgtataggagtacgaagtatagtaggagcgttatggtggttgtcgtgtcgtgggcggcggttgtaggtaggcggttttcgtttttggttttaggtttttcgcgtttcgcgcgttttcgattggttcgcggcggcggcggtatttttgtatttttcgtttttttttttagttttcgttcggtaggtgaattcgcgttattttcggtagcggttcgggtcgggttgcgagcgtcggtttttttagtcgcgtggggttgttttggtaatcgggcgaggcgtttttttgttttcgggattttttcggcgtcgaatttttagtttttcggcgcgcggcgtcgtaggtcgcgggcggtcgttttttacgtcgtaagtttgcgtaggggttttcgtttttattttttaagttaaattagggttttgcgcgcgggggtggggtagttcgttttttatatattgaaattgcgttggcgtttttttttaaggcgaggtacgg

SEQ ID NO: 19332 - DNA, 518 bp, Artificial Sequence
  chemically treated genomic DNA (Homo sapiens) CpG-island No: 19332
ccgtacctcgccttaaaaaaaaacgccaacgcaatttcaatatataaaaaacgaactaccccacccccgcgcgcaaaaccctaatttaacttaaaaaataaaaacgaaaacccctacgcaaacttacgacgtaaaaaacgaccgcccgcgacctacgacgccgcgcgccgaaaaactaaaaattcgacgccgaaaaaatcccgaaaacaaaaaaacgcctcgcccgattaccaaaacaaccccacgcgactaaaaaaaccgacgctcgcaacccgacccgaaccgctaccgaaaataacgcgaattcacctaccgaacgaaaactaaaaaaaaaaacgaaaaatacaaaaataccgccgccgccgcgaaccaatcgaaaacgcgcgaaacgcgaaaaacctaaaaccaaaaacgaaaaccgcctacctacaaccgccgcccacgacacgacaaccaccataacgctcctactatacttcgtactcctatacgaaataataaataaataaaaaccataa

SEQ ID NO: 19333 - DNA, 509 bp, Artificial Sequence
  chemically treated genomic DNA (Homo sapiens) CpG-island No: 19333
  misc_feature (72)..(77): n is either a, c, g or t
agtatagttttttttcggatttggttgtagatgaattagttgttgcgttcggtgcgggatagatgtggcgtnnnnnnggggttagcgttttcgtcgttcgttagagggggtcgtttcgttatttcgtttgaagggttgtttgtggttgggattggtggtttttattcgttggggagtcgggagcggagggaggagagacgtagggaggaggagtcgggggttgggcgacgttgcgatttcgcggtttgagtggtaggagtttcgtttggaatcgggcggttattggggagacgttttgtttgttaatttcgaaagcggtttcggttgtttcggtcgttttcgaagttattttataaaatacgttttcggtcggtttaattttattttttttttcgttcgttttagttagttcgagataaaaatgtttttttttttttcgtggttttttttggttacgcggtggtttttattatgtatataaaggtagttttgttttcgtttaagtggat

SEQ ID NO: 19334 - DNA, 509 bp, Artificial Sequence
  chemically treated genomic DNA (Homo sapiens) CpG-island No: 19334
  misc_feature (433)..(438): n is either a, c, g or t
atccacttaaacgaaaacaaaactacctttatatacataataaaaaccaccgcgtaaccaaaaaaaaccacgaaaaaaaaaaaaacatttttatctcgaactaactaaaacgaacgaaaaaaaaaataaaattaaaccgaccgaaaacgtattttataaaataacttcgaaaacgaccgaaacaaccgaaaccgctttcgaaattaacaaacaaaacgtctccccaataaccgcccgattccaaacgaaactcctaccactcaaaccgcgaaatcgcaacgtcgcccaacccccgactcctcctccctacgtctctcctccctccgctcccgactccccaacgaataaaaaccaccaatcccaaccacaaacaacccttcaaacgaaataacgaaacgaccccctctaacgaacgacgaaaacgctaaccccnnnnnnacgccacatctatcccgcaccgaacgcaacaactaattcatctacaaccaaatccgaaaaaaaactatact

SEQ ID NO: 19335 - DNA, 509 bp, Artificial Sequence
  chemically treated genomic DNA (Homo sapiens) CpG-island No: 19335
  misc_feature (433)..(438): n is either a, c, g or t
gtttatttggacgaaagtaaagttatttttgtgtatataatgagagttatcgcgtggttaaggagaattacggggaagagggaaatatttttgtttcgagttggttaaagcgggcggggggggaggtagggttaaatcgatcgaaggcgtgttttgtggagtggtttcgaaagcggtcgaggtagtcgaagtcgttttcgaagttagtaaataaagcgtttttttagtaatcgttcggttttagacgaggtttttgttatttaggtcgcggagtcgtagcgtcgtttagttttcggttttttttttttgcgtttttttttttttcgttttcggttttttagcggataggagttattaattttagttatagataattttttaaacgaaatagcgaggcggttttttttaacgggcggcgggggcgttggttttnnnnnngcgttatatttgtttcgtatcgggcgtagtagttgatttatttgtagttaggttcgggaaggaattgtgtt

SEQ ID NO: 19336 - DNA, 509 bp, Artificial Sequence
  chemically treated genomic DNA (Homo sapiens) CpG-island No: 19336
  misc_feature (72)..(77): n is either a, c, g or t
aacacaattccttcccgaacctaactacaaataaatcaactactacgcccgatacgaaacaaatataacgcnnnnnnaaaaccaacgcccccgccgcccgttaaaaaaaaccgcctcgctatttcgtttaaaaaattatctataactaaaattaataactcctatccgctaaaaaaccgaaaacgaaaaaaaaaaaaacgcaaaaaaaaaaaaccgaaaactaaacgacgctacgactccgcgacctaaataacaaaaacctcgtctaaaaccgaacgattactaaaaaaacgctttatttactaacttcgaaaacgacttcgactacctcgaccgctttcgaaaccactccacaaaacacgccttcgatcgatttaaccctacctccccccccgcccgctttaaccaactcgaaacaaaaatatttccctcttccccgtaattctccttaaccacgcgataactctcattatatacacaaaaataactttactttcgtccaaataaac

SEQ ID NO: 19337 - DNA, 558 bp, Artificial Sequence
  chemically treated genomic DNA (Homo sapiens) CpG-island No: 19337
gttcgcggttcggcggggagcgtcggagttttttgtggtcgacgtgtattaaggtaggtttcgtttgggacgcgcggagggttcgggtagagggcggtaacgagcgggttatagcggagtacggtcggtttacgcggtttaagtcgttgttcgttttcgttcgtgtcgcgcggcgtcggttttacgtgaagttcggaggtaggaaggcgcggtgcgggttcgcgatttttcggtttcgcggggcgttttagcggcggttggcgtcgtttcgttcggagttagggtcgcgcggttttgcgcgcgcgtttttacggcgtcgcgtacgcgtcgtagcgacgatttaaattgcgcgagcgcgcgggtcgggttgcgcgcggtcgttcgggcgggggatgggtttttgtcgcgaggaggatggttttgttcggtatgcgtttggagaaggcggtttgtagatcggggagggagtttttgttcgggaagagggtgggtcgtaggagttcgagggtttttcgttgtgtatttttgggagtcgtgtgttttgaattatcgtagtag

SEQ ID NO: 19338 - DNA, 558 bp, Artificial Sequence
  chemically treated genomic DNA (Homo sapiens) CpG-island No: 19338
ctactacgataattcaaaacacacgactcccaaaaatacacaacgaaaaaccctcgaactcctacgacccaccctcttcccgaacaaaaactccctccccgatctacaaaccgccttctccaaacgcataccgaacaaaaccatcctcctcgcgacaaaaacccatcccccgcccgaacgaccgcgcgcaacccgacccgcgcgctcgcgcaatttaaatcgtcgctacgacgcgtacgcgacgccgtaaaaacgcgcgcgcaaaaccgcgcgaccctaactccgaacgaaacgacgccaaccgccgctaaaacgccccgcgaaaccgaaaaatcgcgaacccgcaccgcgccttcctacctccgaacttcacgtaaaaccgacgccgcgcgacacgaacgaaaacgaacaacgacttaaaccgcgtaaaccgaccgtactccgctataacccgctcgttaccgccctctacccgaaccctccgcgcgtcccaaacgaaacctaccttaatacacgtcgaccacaaaaaactccgacgctccccgccgaaccgcgaac

SEQ ID NO: 19339 - DNA, 558 bp, Artificial Sequence
  chemically treated genomic DNA (Homo sapiens) CpG-island No: 19339
ttgttgcggtagtttaagatatacggtttttaaaggtgtatagcgggagattttcgagtttttacgatttatttttttttcgggtaagggtttttttttcgatttgtaaatcgttttttttaagcgtatgtcggataaaattatttttttcgcggtagagatttatttttcgttcgggcggtcgcgcgtaattcggttcgcgcgttcgcgtagtttgaatcgtcgttgcggcgcgtgcgcggcgtcgtgagagcgcgcgcgtagggtcgcgcggttttagtttcgagcgaggcggcgttagtcgtcgttggagcgtttcgcggggtcggggaatcgcgagttcgtatcgcgtttttttgttttcgggttttacgtggggtcggcgtcgcgcgatacgggcgagagcgggtagcgatttaggtcgcgtggatcggtcgtgtttcgttgtggttcgttcgttatcgttttttgttcggatttttcgcgcgttttaggcgagatttattttggtgtacgtcggttataaggaatttcggcgtttttcgtcgggtcgcgaat

SEQ ID NO: 19340 - DNA, 558 bp, Artificial Sequence
  chemically treated genomic DNA (Homo sapiens) CpG-island No: 19340
attcgcgacccgacgaaaaacgccgaaattccttataaccgacgtacaccaaaataaatctcgcctaaaacgcgcgaaaaatccgaacaaaaaacgataacgaacgaaccacaacgaaacacgaccgatccacgcgacctaaatcgctacccgctctcgcccgtatcgcgcgacgccgaccccacgtaaaacccgaaaacaaaaaaacgcgatacgaactcgcgattccccgaccccgcgaaacgctccaacgacgactaacgccgcctcgctcgaaactaaaaccgcgcgaccctacgcgcgcgctctcacgacgccgcgcacgcgccgcaacgacgattcaaactacgcgaacgcgcgaaccgaattacgcgcgaccgcccgaacgaaaaataaatctctaccgcgaaaaaaataattttatccgacatacgcttaaaaaaaacgatttacaaatcgaaaaaaaaacccttacccgaaaaaaaaataaatcgtaaaaactcgaaaatctcccgctatacacctttaaaaaccgtatatcttaaactaccgcaacaa

SEQ ID NO: 19341 - DNA, 1174 bp, Artificial Sequence
  chemically treated genomic DNA (Homo sapiens) CpG-island No: 19341
tatttagagaagttaattagcgtcgtcggggttttagttttaaagtttttacgtatttattcggatttagagtttttttagacgtcgagatgttggttatggcgtttcgaatcgtttttttgttgttttcggcggttttggttttgatcgagatttgggtcggtgagtgcgggtcgggagggaaatggtttttgtcgggaggagcgaggggatcgtaggcgggggcgtaggatttgaggagtcgcgtcgggaggagggtcgggcgggttttagttttttttcgtttttaggtttttattttatgaggtatttcgatatcgttatgtttcggttcggtcgcggggagtttcgttttattttagtgggttacgtggacgatacgtagttcgtgaggttcgatagcgacgtcgcgagttcgagagaggagtcgcgggcgtcgtggatagagtaggaggggtcggagtattgggatcggaatatatagatttttaagattaatatatagattgatcgagagagtttgcggaatttgcgcggttattataattagagcgaggtcggtgagtgatttcggttcggggcgtaggttacgattttttattttttacggacggttcgggtcgtttcgagttttcgggttcgagattcgtttttttgaggtcgcgggattcgtttagattttcgatcggcgagagttttaggcgcgtttattcggttttatttttagttgaggttaaaattttcgcgggttggtcggggcggggcggggttcggggggacggggttgatcgcggggtcggggttagggttttatattttttagagtatgtacggttgcgacgtggggtcggacgggcgtttttttcgcgggtataattagtacgtttacgacggtaaggattatatcgttttgaacgaggatttgcgtttttggatcgcggcggatatcgcggtttagattatttagcgtaagtgggaggcggttcgtgtggcggagtaggatagagtttatttggagggtacgtgcgtggagtggtttcgtagatatttggagaacgggaaggatacgttggagcgcgcgggtattaggggtagtggggagttttttttattttttataggtcgtcggggatggttttttacgagaagaggaggaaaatgggattagcgttag

SEQ ID NO: 19342 - DNA, 1174 bp, Artificial Sequence
  chemically treated genomic DNA (Homo sapiens) CpG-island No: 19342
ctaacgctaatcccattttcctcctcttctcgtaaaaaaccatccccgacgacctataaaaaataaaaaaaactccccactacccctaatacccgcgcgctccaacgtatccttcccgttctccaaatatctacgaaaccactccacgcacgtaccctccaaataaactctatcctactccgccacacgaaccgcctcccacttacgctaaataatctaaaccgcgatatccgccgcgatccaaaaacgcaaatcctcgttcaaaacgatataatccttaccgtcgtaaacgtactaattatacccgcgaaaaaaacgcccgtccgaccccacgtcgcaaccgtacatactctaaaaaatataaaaccctaaccccgaccccgcgatcaaccccgtccccccgaaccccgccccgccccgaccaacccgcgaaaattttaacctcaactaaaaataaaaccgaataaacgcgcctaaaactctcgccgatcgaaaatctaaacgaatcccgcgacctcaaaaaaacgaatctcgaacccgaaaactcgaaacgacccgaaccgtccgtaaaaaataaaaaatcgtaacctacgccccgaaccgaaatcactcaccgacctcgctctaattataataaccgcgcaaattccgcaaactctctcgatcaatctatatattaatcttaaaaatctatatattccgatcccaatactccgacccctcctactctatccacgacgcccgcgactcctctctcgaactcgcgacgtcgctatcgaacctcacgaactacgtatcgtccacgtaacccactaaaataaaacgaaactccccgcgaccgaaccgaaacataacgatatcgaaatacctcataaaataaaaacctaaaaacgaaaaaaaactaaaacccgcccgaccctcctcccgacgcgactcctcaaatcctacgcccccgcctacgatcccctcgctcctcccgacaaaaaccatttccctcccgacccgcactcaccgacccaaatctcgatcaaaaccaaaaccgccgaaaacaacaaaaaaacgattcgaaacgccataaccaacatctcgacgtctaaaaaaactctaaatccgaataaatacgtaaaaactttaaaactaaaaccccgacgacgctaattaacttctctaaata

SEQ ID NO: 19343 - DNA, 1174 bp, Artificial Sequence
  chemically treated genomic DNA (Homo sapiens) CpG-island No: 19343
ttagcgttgattttatttttttttttttttcgtgggaggttattttcggcgatttataggagatggggaaggttttttattgtttttggtattcgcgcgttttagcgtgtttttttcgttttttaggtatttgcggagttattttacgtacgtgttttttaggtaggttttgttttgtttcgttatacgggtcgttttttatttgcgttgggtgatttgagtcgcggtgttcgtcgcggtttaggagcgtaggttttcgtttagggcgatgtaatttttgtcgtcgtaggcgtattggttatgttcgcggaggaggcgttcgttcggttttacgtcgtagtcgtatatgttttggagggtgtgagattttggtttcggtttcgcggttagtttcgttttttcgagtttcgtttcgtttcgattaattcgcggggattttggttttaattgaaaatgaaatcgggtaaacgcgtttggggttttcgtcggtcgagggtttgggcgggtttcgcggttttagggaggcggatttcggattcggagattcggggcgattcgggtcgttcgtgggggatggggagtcgtgatttgcgtttcgggtcggggttatttatcggtttcgttttggttgtagtagtcgcgtaggtttcgtaggttttttcggttagtttgtgtgttggttttgaagatttgtgtgtttcggttttaatatttcggttttttttgttttatttacggcgttcgcggtttttttttcggattcgcggcgtcgttgtcgaattttacgaattgcgtgtcgtttacgtagtttattgagatgaagcggggtttttcgcggtcgggtcgggatatggcggtgtcgaaatattttatggagtgggagtttgggggcgaggaggggttgagattcgttcgatttttttttcggcgcggttttttaggttttgcgttttcgtttgcggttttttcgtttttttcggtagaggttatttttttttcgattcgtatttatcggtttaggtttcggttagggttagggtcgtcgagagtagtaggaggacggttcggggcgttatgattagtatttcggcgtttgaggagattttgagttcgggtgggtgcgtggggattttagaattgggatttcggcgacgttgattggtttttttagata

SEQ ID NO: 19344 - DNA, 1174 bp, Artificial Sequence
  chemically treated genomic DNA (Homo sapiens) CpG-island No: 19344
tatctaaaaaaaccaatcaacgtcgccgaaatcccaattctaaaatccccacgcacccacccgaactcaaaatctcctcaaacgccgaaatactaatcataacgccccgaaccgtcctcctactactctcgacgaccctaaccctaaccgaaacctaaaccgataaatacgaatcgaaaaaaaaataacctctaccgaaaaaaacgaaaaaaccgcaaacgaaaacgcaaaacctaaaaaaccgcgccgaaaaaaaaatcgaacgaatctcaacccctcctcgcccccaaactcccactccataaaatatttcgacaccgccatatcccgacccgaccgcgaaaaaccccgcttcatctcaataaactacgtaaacgacacgcaattcgtaaaattcgacaacgacgccgcgaatccgaaaaaaaaaccgcgaacgccgtaaataaaacaaaaaaaaccgaaatattaaaaccgaaacacacaaatcttcaaaaccaacacacaaactaaccgaaaaaacctacgaaacctacgcgactactacaaccaaaacgaaaccgataaataaccccgacccgaaacgcaaatcacgactccccatcccccacgaacgacccgaatcgccccgaatctccgaatccgaaatccgcctccctaaaaccgcgaaacccgcccaaaccctcgaccgacgaaaaccccaaacgcgtttacccgatttcattttcaattaaaaccaaaatccccgcgaattaatcgaaacgaaacgaaactcgaaaaaacgaaactaaccgcgaaaccgaaaccaaaatctcacaccctccaaaacatatacgactacgacgtaaaaccgaacgaacgcctcctccgcgaacataaccaatacgcctacgacgacaaaaattacatcgccctaaacgaaaacctacgctcctaaaccgcgacgaacaccgcgactcaaatcacccaacgcaaataaaaaacgacccgtataacgaaacaaaacaaaacctacctaaaaaacacgtacgtaaaataactccgcaaatacctaaaaaacgaaaaaaacacgctaaaacgcgcgaataccaaaaacaataaaaaaccttccccatctcctataaatcgccgaaaataacctcccacgaaaaaaaaaaaaaaataaaatcaacgctaa

SEQ ID NO: 19345 - DNA, 914 bp, Artificial Sequence
  chemically treated genomic DNA (Homo sapiens) CpG-island No: 19345
gttcggcgagggcgtaggattcggggagtcgcgtagggaggtgggtcgggcgggttttagttttttttcgtttttaggtttttattttatgaggtatttcgatatcgtcgtgtttcggttcggtcgcggagagtttcgttttattttagtgggttacgtggacgatacgtagttcgtgcggttcgatagcgacgtcgcgagttcgagaggggagtcgcgggcgtcgtgggtggagtaggaggggtcggagtattgggatcgggagatatagaattataagcgttaggtataggttgatcgagtgagtttgcggaatttgcgcggttattataattagagcgaggacggtgagtgatttcggttcggggcgtaggttacgatttttttttattttttacggacggttcgggtcgtttcgagttttttcgtttgagatttattttaaggtggatttgcggaattcgtttagattttcgatcggagagagttttagtcgtttttattcggttttattttcggtttaggttaaaattttcgcgggttggtcggggcggggcggggttcgggggattgggttgatcgcgggggcggggttagggttttatattttttagaggatgtatggttgcgatttggggttcgacgggcgtttttttcgcgggtatgattagttcgtttacgacggtaaggattatatcgttttgaacgaggatttgcgtttttggatcgtcgcggatatcgcggtttagattatttagcgtaagttggaggcggttcgtgcggcggagtagttgagagtttatttggagggtacgtgcgtggagtggtttcgtagatatttggagaacgggaaggagacgttgtagcgcgtaggtattaggggtagtggggagttttttttattttttatagat

SEQ ID NO: 19346 - DNA, 914 bp, Artificial Sequence
  chemically treated genomic DNA (Homo sapiens) CpG-island No: 19346
atctataaaaaataaaaaaaactccccactacccctaatacctacgcgctacaacgtctccttcccgttctccaaatatctacgaaaccactccacgcacgtaccctccaaataaactctcaactactccgccgcacgaaccgcctccaacttacgctaaataatctaaaccgcgatatccgcgacgatccaaaaacgcaaatcctcgttcaaaacgatataatccttaccgtcgtaaacgaactaatcatacccgcgaaaaaaacgcccgtcgaaccccaaatcgcaaccatacatcctctaaaaaatataaaaccctaaccccgcccccgcgatcaacccaatcccccgaaccccgccccgccccgaccaacccgcgaaaattttaacctaaaccgaaaataaaaccgaataaaaacgactaaaactctctccgatcgaaaatctaaacgaattccgcaaatccaccttaaaataaatctcaaacgaaaaaactcgaaacgacccgaaccgtccgtaaaaaataaaaaaaaatcgtaacctacgccccgaaccgaaatcactcaccgtcctcgctctaattataataaccgcgcaaattccgcaaactcactcgatcaacctatacctaacgcttataattctatatctcccgatcccaatactccgacccctcctactccacccacgacgcccgcgactcccctctcgaactcgcgacgtcgctatcgaaccgcacgaactacgtatcgtccacgtaacccactaaaataaaacgaaactctccgcgaccgaaccgaaacacgacgatatcgaaatacctcataaaataaaaacctaaaaacgaaaaaaaactaaaacccgcccgacccacctccctacgcgactccccgaatcctacgccctcgccgaac

SEQ ID NO: 19347 - DNA, 914 bp, Artificial Sequence
  chemically treated genomic DNA (Homo sapiens) CpG-island No: 19347
atttataggagatggggaaggttttttattgtttttggtatttgcgcgttgtagcgtttttttttcgttttttaggtatttgcggagttattttacgtacgtgttttttaggtaggtttttagttgtttcgtcgtacgggtcgtttttaatttgcgttgggtgatttgagtcgcggtgttcgcggcggtttaggagcgtaggttttcgtttagggcgatgtaatttttgtcgtcgtaggcggattggttatattcgcggaggaggcgttcgtcgggttttaggtcgtagttatatattttttggagggtgtgagattttggtttcgttttcgcggttagtttagtttttcgagtttcgtttcgtttcgattaattcgcggggattttggtttaaatcgaaaatgaaatcgggtaaaggcgattggggtttttttcggtcgagggtttgggcgggtttcgtagatttattttggggtggattttagacggggagattcggggcgattcgggtcgttcgtgggggatggggaggggtcgtgatttgcgtttcgggtcggggttatttatcgttttcgttttggttgtagtagtcgcgtaggtttcgtaggtttattcggttagtttgtgtttggcgtttgtagttttgtgtttttcggttttaatatttcggttttttttgttttatttacggcgttcgcggtttttttttcggattcgcggcgtcgttgtcgaatcgtacgaattgcgtgtcgtttacgtagtttattgagatgaagcggggtttttcgcggtcgggtcgggatacggcggtgtcgaaatattttatggagtgggagtttgggggcgaggaggggttgagattcgttcgatttatttttttgcgcggtttttcgggttttgcgttttcgtcgggt

SEQ ID NO: 19348 - DNA, 914 bp, Artificial Sequence
  chemically treated genomic DNA (Homo sapiens) CpG-island No: 19348
acccgacgaaaacgcaaaacccgaaaaaccgcgcaaaaaaataaatcgaacgaatctcaacccctcctcgcccccaaactcccactccataaaatatttcgacaccgccgtatcccgacccgaccgcgaaaaaccccgcttcatctcaataaactacgtaaacgacacgcaattcgtacgattcgacaacgacgccgcgaatccgaaaaaaaaaccgcgaacgccgtaaataaaacaaaaaaaaccgaaatattaaaaccgaaaaacacaaaactacaaacgccaaacacaaactaaccgaataaacctacgaaacctacgcgactactacaaccaaaacgaaaacgataaataaccccgacccgaaacgcaaatcacgacccctccccatcccccacgaacgacccgaatcgccccgaatctccccgtctaaaatccaccccaaaataaatctacgaaacccgcccaaaccctcgaccgaaaaaaaccccaatcgcctttacccgatttcattttcgatttaaaccaaaatccccgcgaattaatcgaaacgaaacgaaactcgaaaaactaaactaaccgcgaaaacgaaaccaaaatctcacaccctccaaaaaatatataactacgacctaaaacccgacgaacgcctcctccgcgaatataaccaatccgcctacgacgacaaaaattacatcgccctaaacgaaaacctacgctcctaaaccgccgcgaacaccgcgactcaaatcacccaacgcaaattaaaaacgacccgtacgacgaaacaactaaaaacctacctaaaaaacacgtacgtaaaataactccgcaaatacctaaaaaacgaaaaaaaaacgctacaacgcgcaaataccaaaaacaataaaaaaccttccccatctcctataaat

SEQ ID NO: 19349 - DNA, 921 bp, Artificial Sequence
  chemically treated genomic DNA (Homo sapiens) CpG-island No: 19349
atttcggagttattcgcgtcgtttttacgtgtgtgtgtaatggggggaggggggttttcggtttttttttttttagtttttggatttgtaatatcgggagggcgaggacgcgggattagcgtattttcggaaggttcgatttttttcggtagggcgtttggttaacgagtcgcgtcgttttttttcggtcgcgtttgttggtgattttttcgagagttttaggggcggtttcggtatttttttttttttcgttttttttgtcgtttattttagtttcggggttcggcgatcggcgtttaggagcgggttttcgcggcgcgtcgtatgtatttatcgcgattttttcgaattcgggagcgcgcgggtttttttcgggagagtttttggaggtagcgacgcggaggcgcgtttgtgattttagggtcgcggcggggtcggaggtaagattcgtcggtttcgtattcgtcgcggattttttttttttttcgtttttttttcgggatttaggcggttagtgtttcgttcgaaggcgggtttgttataaataaacgcggttcggtcgtacgtggatagcggaggtgttgcgtttagttatatatcgcgggtttcggcgttgcgtttttaggtatagggagtcgttaggaagggtaggagagcgcgttcgggttagggttcggttttagtcgtttgcgattcgttttttttcgttgggttttcgttttatggtttcgcggttatcgtcgtttttgtcgtttttcggttcggagggttttgtcgtagtcggttcgaatattcgacgaaggagtaagtagcgttttcgttttcgcgtcggtcgtttttattttttaggaaggtcgaggtaggagaggtaggagggaggaaataggagcgagtaggaacggggtttcggttgttgtagga

SEQ ID NO: 19350 - DNA, 921 bp, Artificial Sequence
  chemically treated genomic DNA (Homo sapiens) CpG-island No: 19350
tcctacaacaaccgaaaccccgttcctactcgctcctatttcctccctcctacctctcctacctcgaccttcctaaaaaataaaaacgaccgacgcgaaaacgaaaacgctacttactccttcgtcgaatattcgaaccgactacgacaaaaccctccgaaccgaaaaacgacaaaaacgacgataaccgcgaaaccataaaacgaaaacccaacgaaaaaaaacgaatcgcaaacgactaaaaccgaaccctaacccgaacgcgctctcctacccttcctaacgactccctatacctaaaaacgcaacgccgaaacccgcgatatataactaaacgcaacacctccgctatccacgtacgaccgaaccgcgtttatttataacaaacccgccttcgaacgaaacactaaccgcctaaatcccgaaaaaaaaacgaaaaaaaaaaaaaatccgcgacgaatacgaaaccgacgaatcttacctccgaccccgccgcgaccctaaaatcacaaacgcgcctccgcgtcgctacctccaaaaactctcccgaaaaaaacccgcgcgctcccgaattcgaaaaaatcgcgataaatacatacgacgcgccgcgaaaacccgctcctaaacgccgatcgccgaaccccgaaactaaaataaacgacaaaaaaaacgaaaaaaaaaaaaataccgaaaccgcccctaaaactctcgaaaaaatcaccaacaaacgcgaccgaaaaaaaacgacgcgactcgttaaccaaacgccctaccgaaaaaaatcgaaccttccgaaaatacgctaatcccgcgtcctcgccctcccgatattacaaatccaaaaactaaaaaaaaaaaaaccgaaaacccccctccccccattacacacacacgtaaaaacgacgcgaataactccgaaat

SEQ ID NO: 19351 - DNA, 921 bp, Artificial Sequence
  chemically treated genomic DNA (Homo sapiens) CpG-island No: 19351
ttttgtagtaatcggagtttcgtttttgttcgtttttgtttttttttttttgttttttttgtttcggtttttttggggggtgggggcggtcggcgcggaggcggaggcgttgtttattttttcgtcgagtgttcgaatcggttgcggtaaggtttttcggatcggagggcgataggggcggcggtggtcgcggagttatggagcgggagtttagcggaggggagcgagtcgtaggcggttggggtcgggttttggttcgggcgcgtttttttgttttttttggcggttttttgtgtttggagacgtagcgtcggagttcgcgatgtgtggttaggcgtagtattttcgttgtttacgtgcggtcgagtcgcgtttgtttatggtagattcgttttcgggcggagtattggtcgtttgggtttcggagggggggcgggaggggggagggattcgcggcgggtgcggggtcggcgaattttgttttcgatttcgtcgcggttttggagttataggcgcgttttcgcgtcgttgtttttagggattttttcgggagagattcgcgcgttttcgggttcggggaagtcgcggtgagtgtatacggcgcgtcgcggggattcgtttttgagcgtcggtcgtcggatttcggagttaggatgggcggtagggagggcgagggaaggaggggtgtcgaggtcgtttttgaggttttcgggaaggttattagtaggcgcggtcgagaggaggcggcgcgattcgttggttaggcgttttgtcggggaggatcgagtttttcgagggtgcgttggtttcgcgttttcgttttttcggtgttgtaggtttaagagttgaaaaggggaaagtcgggagtttttttttttttattatatatatacgtgaaaacggcgcgagtggtttcgaagt

SEQ ID NO: 19352 - DNA, 921 bp, Artificial Sequence
  chemically treated genomic DNA (Homo sapiens) CpG-island No: 19352
acttcgaaaccactcgcgccgttttcacgtatatatataataaaaaaaaaaaaactcccgactttccccttttcaactcttaaacctacaacaccgaaaaaacgaaaacgcgaaaccaacgcaccctcgaaaaactcgatcctccccgacaaaacgcctaaccaacgaatcgcgccgcctcctctcgaccgcgcctactaataaccttcccgaaaacctcaaaaacgacctcgacacccctccttccctcgccctccctaccgcccatcctaactccgaaatccgacgaccgacgctcaaaaacgaatccccgcgacgcgccgtatacactcaccgcgacttccccgaacccgaaaacgcgcgaatctctcccgaaaaaatccctaaaaacaacgacgcgaaaacgcgcctataactccaaaaccgcgacgaaatcgaaaacaaaattcgccgaccccgcacccgccgcgaatccctcccccctcccgccccccctccgaaacccaaacgaccaatactccgcccgaaaacgaatctaccataaacaaacgcgactcgaccgcacgtaaacaacgaaaatactacgcctaaccacacatcgcgaactccgacgctacgtctccaaacacaaaaaaccgccaaaaaaaacaaaaaaacgcgcccgaaccaaaacccgaccccaaccgcctacgactcgctcccctccgctaaactcccgctccataactccgcgaccaccgccgcccctatcgccctccgatccgaaaaaccttaccgcaaccgattcgaacactcgacgaaaaaataaacaacgcctccgcctccgcgccgaccgcccccaccccccaaaaaaaccgaaacaaaaaaaacaaaaaaaaaaaaacaaaaacgaacaaaaacgaaactccgattactacaaaa

SEQ ID NO: 19353 - DNA, 621 bp, Artificial Sequence
  chemically treated genomic DNA (Homo sapiens) CpG-island No: 19353
ttgcgtttcgggtagcggcgggcggcgtcgtcgggttgttcggagtttaggttcggcggttgcggggaggcgtttcggaatttcgggaggtttttcgtatttgttcgcggtttatttcgcggatttatttggttttcggtttttttttttttattttcgtcgtcgtagttcgagcggggtttcgcgggtttggagtacggtcgggtttaatatgttcggagtcgaggcgcgatgaaggagaagtttaagaatgcggttaagattaggagggagaaggaaaatggcgagttttacgagtttgttaagttgttttcgttgtcgtcggttattatttcgtagttggataaagcgtttattattcgttttattacgagttatttgaagatgcgcgtcgtttttttcgaaggtaggttttaggtgggcggtcggggacgttggggagttcggcggtttcggtttaggcgggaagcgtaagttagttcgtttagaggggttgtcgcggtttggcgtttagagttggggcgtttgagggaggttgcgtgagggttttcggtttcggcgttggtttggggcgaggggttagggttttggcggtttaggcgattaaatttttttttggtt

SEQ ID NO: 19354 - DNA, 621 bp, Artificial Sequence
  chemically treated genomic DNA (Homo sapiens) CpG-island No: 19354
aaccaaaaaaaaatttaatcgcctaaaccgccaaaaccctaacccctcgccccaaaccaacgccgaaaccgaaaaccctcacgcaacctccctcaaacgccccaactctaaacgccaaaccgcgacaacccctctaaacgaactaacttacgcttcccgcctaaaccgaaaccgccgaactccccaacgtccccgaccgcccacctaaaacctaccttcgaaaaaaacgacgcgcatcttcaaataactcgtaataaaacgaataataaacgctttatccaactacgaaataataaccgacgacaacgaaaacaacttaacaaactcgtaaaactcgccattttccttctccctcctaatcttaaccgcattcttaaacttctccttcatcgcgcctcgactccgaacatattaaacccgaccgtactccaaacccgcgaaaccccgctcgaactacgacgacgaaaataaaaaaaaaaaaaccgaaaaccaaataaatccgcgaaataaaccgcgaacaaatacgaaaaacctcccgaaattccgaaacgcctccccgcaaccgccgaacctaaactccgaacaacccgacgacgccgcccgccgctacccgaaacgcaa

SEQ ID NO: 19355 - DNA, 621 bp, Artificial Sequence
  chemically treated genomic DNA (Homo sapiens) CpG-island No: 19355
gattaggagagggtttggtcgtttgggtcgttaaggttttggtttttcgttttaagttagcgtcgaagtcgaagatttttacgtaattttttttagacgttttagttttggacgttaggtcgcggtaatttttttgggcgggttggtttgcgtttttcgtttgggtcggggtcgtcgggttttttagcgttttcggtcgtttatttgaggtttattttcggggaagacggcgcgtatttttaggtagttcgtggtgaggcggatgatggacgttttgtttagttgcgaagtgatggtcgacggtagcgggagtagtttggtaagttcgtaaaattcgttatttttttttttttttttggttttggtcgtatttttggattttttttttatcgcgtttcggtttcgggtatattagattcggtcgtgttttaggttcgcggagtttcgttcgggttgcggcggcggggatggggaagggggagtcgggagttaggtgagttcgcggagtgggtcgcgggtaggtgcggggggtttttcggggtttcgagacgttttttcgtagtcgtcgggtttgagtttcgagtaattcggcggcgtcgttcgtcgttgttcggagcgtag

SEQ ID NO: 19356 - DNA, 621 bp, Artificial Sequence
  chemically treated genomic DNA (Homo sapiens) CpG-island No: 19356
ctacgctccgaacaacgacgaacgacgccgccgaattactcgaaactcaaacccgacgactacgaaaaaacgtctcgaaaccccgaaaaaccccccgcacctacccgcgacccactccgcgaactcacctaactcccgactcccccttccccatccccgccgccgcaacccgaacgaaactccgcgaacctaaaacacgaccgaatctaatatacccgaaaccgaaacgcgataaaaaaaaaatccaaaaatacgaccaaaaccaaaaaaaaaaaaaaaaataacgaattttacgaacttaccaaactactcccgctaccgtcgaccatcacttcgcaactaaacaaaacgtccatcatccgcctcaccacgaactacctaaaaatacgcgccgtcttccccgaaaataaacctcaaataaacgaccgaaaacgctaaaaaacccgacgaccccgacccaaacgaaaaacgcaaaccaacccgcccaaaaaaattaccgcgacctaacgtccaaaactaaaacgtctaaaaaaaattacgtaaaaatcttcgacttcgacgctaacttaaaacgaaaaaccaaaaccttaacgacccaaacgaccaaaccctctcctaatc

SEQ ID NO: 19357 - DNA, 507 bp, Artificial Sequence
  chemically treated genomic DNA (Homo sapiens) CpG-island No: 19357
cgcgtggggtgtaggcggcgttaagggcgcgtgtatttgtgggcgcggggcgcgagggtttttttcggcgcgagcgggcgtagtttttcggcggcgtcgttaggggtttttttcgggtgtcgagcggggtgggtcggattagttgattcgtttggttttgagtttcgtcgtcgcgttcgggtttcgttagttttttcggtagcggtaggcgagagtacgcggaggagcgtgcgcgggggtttcgggagacggcggcggtggcggcgcgggtagagtaaggacgcggcggattttattcgtatagtagcgtattcggtgtttcgcgtagggtcgcgatgttgttcggtttggtattgtttttgttggtcgtttggacggttcgggcgttggaggtgggtgtcgcgtttcggaaggcggggggaggttgtacggtggggacgcgatattttttaagattttaatttaagtttttaatgtagagaagtcgggggttcgttaatgggattt

SEQ ID NO: 19358 - DNA, 507 bp, Artificial Sequence
  chemically treated genomic DNA (Homo sapiens) CpG-island No: 19358
aaatcccattaacgaacccccgacttctctacattaaaaacttaaattaaaatcttaaaaaatatcgcgtccccaccgtacaacctccccccgccttccgaaacgcgacacccacctccaacgcccgaaccgtccaaacgaccaacaaaaacaataccaaaccgaacaacatcgcgaccctacgcgaaacaccgaatacgctactatacgaataaaatccgccgcgtccttactctacccgcgccgccaccgccgccgtctcccgaaacccccgcgcacgctcctccgcgtactctcgcctaccgctaccgaaaaaactaacgaaacccgaacgcgacgacgaaactcaaaaccaaacgaatcaactaatccgacccaccccgctcgacacccgaaaaaaacccctaacgacgccgccgaaaaactacgcccgctcgcgccgaaaaaaaccctcgcgccccgcgcccacaaatacacgcgcccttaacgccgcctacaccccacgcg

SEQ ID NO: 19359 - DNA, 507 bp, Artificial Sequence
  chemically treated genomic DNA (Homo sapiens) CpG-island No: 19359
gggttttattgacggattttcggtttttttgtattaaagatttgggttaaggttttggggggtatcgcgtttttatcgtgtagttttttttcgtttttcgaggcgcggtatttatttttagcgttcgagtcgtttaggcggttagtaggagtagtgttaaatcgggtagtatcgcgattttgcgcggggtatcgagtgcgttgttgtgcgagtgggattcgtcgcgtttttgttttgttcgcgtcgttatcgtcgtcgtttttcggggttttcgcgtacgttttttcgcgtgttttcgtttatcgttgtcgaggaaattgacggagttcgagcgcggcggcggggtttagagttaggcgagttagttgattcggtttatttcgttcggtattcgagagagatttttagcggcgtcgtcggggaattgcgttcgttcgcgtcgggaggggttttcgcgtttcgcgtttataggtgtacgcgtttttggcgtcgtttgtattttacgcg

SEQ ID NO: 19360 - DNA, 507 bp, Artificial Sequence
  chemically treated genomic DNA (Homo sapiens) CpG-island No: 19360
cgcgtaaaatacaaacgacgccaaaaacgcgtacacctataaacgcgaaacgcgaaaacccctcccgacgcgaacgaacgcaattccccgacgacgccgctaaaaatctctctcgaataccgaacgaaataaaccgaatcaactaactcgcctaactctaaaccccgccgccgcgctcgaactccgtcaatttcctcgacaacgataaacgaaaacacgcgaaaaaacgtacgcgaaaaccccgaaaaacgacgacgataacgacgcgaacaaaacaaaaacgcgacgaatcccactcgcacaacaacgcactcgataccccgcgcaaaatcgcgatactacccgatttaacactactcctactaaccgcctaaacgactcgaacgctaaaaataaataccgcgcctcgaaaaacgaaaaaaaactacacgataaaaacgcgataccccccaaaaccttaacccaaatctttaatacaaaaaaaccgaaaatccgtcaataaaaccc

SEQ ID NO: 19361 - DNA, 753 bp, Artificial Sequence
  chemically treated genomic DNA (Homo sapiens) CpG-island No: 19361
gcgtcggatgttttttggaaggcgtttggatttacgttaggttttttagtttaattttttatgatttagcgttttagttcgcgtatcgattagcgttttagttttttatagacgtcggcgggttcgggagtttcgcggacgtgacgtcgcgggcggaagtgacgttttttcgcggttggacgcggcgtttagttgtcgggcgggggagggcgcgttcggttttttttaggggacgttgaaattatttttgtaacgggagtcgggagaggacggggcgtgtttcgacgtgcgcgcgcgtcgtttttttcggcgtttttttatagttcgttggttttcgtcgcggaaaggcgttatgtcgtttaaaatttttcgaaaaacggtcgttatcgtcgtcgttgtcgtcgcggaattttcggtatcgtcgtcgtcgtttttttttgaggaggatttagagtaggatagcggttcggaggatttgtttttcgttaggtgagcgagtagagtcgtcgtcgttttacgcgggaagggcgtttcgggtgtgcgtagggcgggcgtaaggcggttcggcggggattcgttttcgttaggggtcgggtttcggcgggaggaggcgttttttttgtttttcgttacggcggagcgtttgtagaatggtgataggattttgggtttttgggcgaggggtttcggttttaatttgataggtgtcgggcgggtggggttagggttttgagcgaagtgataggtgtagtt

SEQ ID NO: 19362 - DNA, 753 bp, Artificial Sequence
  chemically treated genomic DNA (Homo sapiens) CpG-island No: 19362
aactacacctatcacttcgctcaaaaccctaaccccacccgcccgacacctatcaaattaaaaccgaaacccctcgcccaaaaacccaaaatcctatcaccattctacaaacgctccgccgtaacgaaaaacaaaaaaaacgcctcctcccgccgaaacccgacccctaacgaaaacgaatccccgccgaaccgccttacgcccgccctacgcacacccgaaacgcccttcccgcgtaaaacgacgacgactctactcgctcacctaacgaaaaacaaatcctccgaaccgctatcctactctaaatcctcctcaaaaaaaaacgacgacgacgataccgaaaattccgcgacgacaacgacgacgataacgaccgtttttcgaaaaattttaaacgacataacgcctttccgcgacgaaaaccaacgaactataaaaaaacgccgaaaaaaacgacgcgcgcgcacgtcgaaacacgccccgtcctctcccgactcccgttacaaaaataatttcaacgtcccctaaaaaaaaccgaacgcgccctcccccgcccgacaactaaacgccgcgtccaaccgcgaaaaaacgtcacttccgcccgcgacgtcacgtccgcgaaactcccgaacccgccgacgtctataaaaaactaaaacgctaatcgatacgcgaactaaaacgctaaatcataaaaaattaaactaaaaaacctaacgtaaatccaaacgccttccaaaaaacatccgacgc

SEQ ID NO: 19363 - DNA, 753 bp, Artificial Sequence
  chemically treated genomic DNA (Homo sapiens) CpG-island No: 19363
aattgtatttgttatttcgtttaggattttagttttattcgttcgatatttgttaagttgaagtcgagatttttcgtttaagaatttagaattttgttattattttgtagacgtttcgtcgtggcggggggtagggagggcgttttttttcgtcgggattcggtttttggcgaggacgggttttcgtcgagtcgttttgcgttcgttttacgtatattcggggcgtttttttcgcgtgaggcgacggcggttttgttcgtttatttgacgagaggtaggtttttcgggtcgttgttttgttttgggttttttttaggagggggcggcggcggcggtgtcgggggtttcgcggcggtagcggcggcggtggcggtcgtttttcggggggttttgggcggtatgacgttttttcgcggcgggagttagcgagttgtggaggagcgtcggggaggacgacgcgcgcgtacgtcggggtacgtttcgttttttttcgattttcgttataaaaataattttaacgttttttgagaaaaatcggacgcgttttttttcgttcggtaattgagcgtcgcgtttaatcgcgggaaaacgttattttcgttcgcggcgttacgttcgcgaggttttcgggttcgtcggcgtttgtggggaattggggcgttggtcggtgcgcgggttgggacgttaagttatgaggaattaaattgggaaatttggcgtgggtttaggcgttttttaggaggtattcggcgt

SEQ ID NO: 19364 - DNA, 753 bp, Artificial Sequence
  chemically treated genomic DNA (Homo sapiens) CpG-island No: 19364
acgccgaatacctcctaaaaaacgcctaaacccacgccaaatttcccaatttaattcctcataacttaacgtcccaacccgcgcaccgaccaacgccccaattccccacaaacgccgacgaacccgaaaacctcgcgaacgtaacgccgcgaacgaaaataacgttttcccgcgattaaacgcgacgctcaattaccgaacgaaaaaaaacgcgtccgatttttctcaaaaaacgttaaaattatttttataacgaaaatcgaaaaaaaacgaaacgtaccccgacgtacgcgcgcgtcgtcctccccgacgctcctccacaactcgctaactcccgccgcgaaaaaacgtcataccgcccaaaaccccccgaaaaacgaccgccaccgccgccgctaccgccgcgaaacccccgacaccgccgccgccgccccctcctaaaaaaaacccaaaacaaaacaacgacccgaaaaacctacctctcgtcaaataaacgaacaaaaccgccgtcgcctcacgcgaaaaaaacgccccgaatatacgtaaaacgaacgcaaaacgactcgacgaaaacccgtcctcgccaaaaaccgaatcccgacgaaaaaaaacgccctccctaccccccgccacgacgaaacgtctacaaaataataacaaaattctaaattcttaaacgaaaaatctcgacttcaacttaacaaatatcgaacgaataaaactaaaatcctaaacgaaataacaaatacaatt

SEQ ID NO: 19365 - DNA, 595 bp, Artificial Sequence
  chemically treated genomic DNA (Homo sapiens) CpG-island No: 19365
gcgcggcgtttttgtttaaaatttcgtcgtcggttttgaatttcggcggacgcgtttcgacgtttttggaagattttgcgttttgtcggttcgtcggcgttcgggagttcgggaggcgggtgtgtacgcggggtgtttagggcgttttcgatcgaggttttttcgtcgtgtttcggggtagggggacggttgtaatttaggcgcgcgttttttttcggggtttttagtggtcgcgagggggcgcgtacggtttcgggaattcgcgcggcgtcgcgtttatttttattttagtttcgttaaaaatagttgtcgcgtttcgagtcgagttcgaaatagcggtttttagataaggtaggacgatttagcgttttcggggagcggaagggggagcgcgcggggggagcggtgttgggcgtagttcggtcgagtaggcgtcgttgtttttagcgtatttttattttgttttggcggttatattcgttttcgattgcgatttcgtttcgtcgttagtttggttgtttttttacgttttttatattgtatttttattttttgttttttatttttagttttatttttattttttattataatt

SEQ ID NO: 19366 - DNA, 595 bp, Artificial Sequence
  chemically treated genomic DNA (Homo sapiens) CpG-island No: 19366
aattataataaaaaataaaaataaaactaaaaataaaaaacaaaaaataaaaatacaatataaaaaacgtaaaaaaacaaccaaactaacgacgaaacgaaatcgcaatcgaaaacgaatataaccgccaaaacaaaataaaaatacgctaaaaacaacgacgcctactcgaccgaactacgcccaacaccgctccccccgcgcgctcccccttccgctccccgaaaacgctaaatcgtcctaccttatctaaaaaccgctatttcgaactcgactcgaaacgcgacaactatttttaacgaaactaaaataaaaataaacgcgacgccgcgcgaattcccgaaaccgtacgcgccccctcgcgaccactaaaaaccccgaaaaaaaacgcgcgcctaaattacaaccgtccccctaccccgaaacacgacgaaaaaacctcgatcgaaaacgccctaaacaccccgcgtacacacccgcctcccgaactcccgaacgccgacgaaccgacaaaacgcaaaatcttccaaaaacgtcgaaacgcgtccgccgaaattcaaaaccgacgacgaaattttaaacaaaaacgccgcgc

SEQ ID NO: 19367 - DNA, 595 bp, Artificial Sequence
  chemically treated genomic DNA (Homo sapiens) CpG-island No: 19367
agttatgatgaggaatggaggtgaagttgaggatgggggataggggatgaggatataatgtgggggacgtaggaaggtagttaggttagcggcggggcggggtcgtagtcgggggcgagtgtgatcgttagggtagagtgggggtgcgttggggatagcggcgtttgttcggtcgggttgcgtttagtatcgtttttttcgcgcgttttttttttcgtttttcggaagcgttgagtcgttttgttttatttgggggtcgttatttcgggttcggttcggagcgcggtaattatttttagcggagttggggtaaaaatggacgcggcgtcgcgcgggttttcgaggtcgtgcgcgttttttcgcgattattgagggtttcggggaggagcgcgcgtttgagttatagtcgtttttttatttcgaggtacggcgagggggtttcgatcgggggcgttttggatatttcgcgtgtatattcgtttttcgggttttcgggcgtcggcgagtcggtagggcgtagaattttttaggggcgtcgggacgcgttcgtcggggtttagagtcgacggcggagttttgggtaggggcgtcgcgt

SEQ ID NO: 19368 - DNA, 595 bp, Artificial Sequence
  chemically treated genomic DNA (Homo sapiens) CpG-island No: 19368
acgcgacgcccctacccaaaactccgccgtcgactctaaaccccgacgaacgcgtcccgacgcccctaaaaaattctacgccctaccgactcgccgacgcccgaaaacccgaaaaacgaatatacacgcgaaatatccaaaacgcccccgatcgaaaccccctcgccgtacctcgaaataaaaaaacgactataactcaaacgcgcgctcctccccgaaaccctcaataatcgcgaaaaaacgcgcacgacctcgaaaacccgcgcgacgccgcgtccatttttaccccaactccgctaaaaataattaccgcgctccgaaccgaacccgaaataacgacccccaaataaaacaaaacgactcaacgcttccgaaaaacgaaaaaaaaaacgcgcgaaaaaaacgatactaaacgcaacccgaccgaacaaacgccgctatccccaacgcacccccactctaccctaacgatcacactcgcccccgactacgaccccgccccgccgctaacctaactaccttcctacgtcccccacattatatcctcatcccctatcccccatcctcaacttcacctccattcctcatcataact

SEQ ID NO: 19369 - DNA, 676 bp, Artificial Sequence
  chemically treated genomic DNA (Homo sapiens) CpG-island No: 19369
  misc_feature (385)..(385): n is either a, c, g or t
  misc_feature (513)..(513): n is either a, c, g or t
ttgatagcgtcgcgtcgcgtttagcggtcgtacgggggtgtcgaggcgtttgggggtttgcgtttcggggcgagcgtagcgtaaggttggcgcgcgcgtatggaggatgtttattgtatttggttttcgttatttggtttgttttcgggttgggttttgtttgtcgttttcgacggttacggtggggttcgagttgttcgtttcggtgtacgttatttgttaggttatgtgttttaggagttgggttcggagtttagcgagttcgagggcgtgcgcgaggcgttgcgtcgagtttttttgagcgtcgacgagcgttttcgttttttttggtttcgcgtggaaacgggcggttttacggtcgtagtgttgttggttttttcgcggnttttgtatttggcgtattgcggtgattttcgcgcggtgttgagtcgcgttggcgtcgtggtttttagtatagaggattatcggttttttcgatttcgggaacgcgagcgtatttacgtcgttggcggnattattcgtcgtcgtcgcgtcgagggttttttggtcgtgtcgcgagcgttgggcgattttatttataaggaggtttcggggaggtttttcgagttatagttcgtttttgcggagttagaggtggtcgtattggtacgttaggttgaggacgagtttatgtttt

SEQ ID NO: 19370 - DNA, 676 bp, Artificial Sequence
  chemically treated genomic DNA (Homo sapiens) CpG-island No: 19370
  misc_feature (164)..(164): n is either a, c, g or t
  misc_feature (292)..(292): n is either a, c, g or t
aaaacataaactcgtcctcaacctaacgtaccaatacgaccacctctaactccgcaaaaacgaactataactcgaaaaacctccccgaaacctccttataaataaaatcgcccaacgctcgcgacacgaccaaaaaaccctcgacgcgacgacgacgaataatnccgccaacgacgtaaatacgctcgcgttcccgaaatcgaaaaaaccgataatcctctatactaaaaaccacgacgccaacgcgactcaacaccgcgcgaaaatcaccgcaatacgccaaatacaaaanccgcgaaaaaaccaacaacactacgaccgtaaaaccgcccgtttccacgcgaaaccaaaaaaaacgaaaacgctcgtcgacgctcaaaaaaactcgacgcaacgcctcgcgcacgccctcgaactcgctaaactccgaacccaactcctaaaacacataacctaacaaataacgtacaccgaaacgaacaactcgaaccccaccgtaaccgtcgaaaacgacaaacaaaacccaacccgaaaacaaaccaaataacgaaaaccaaatacaataaacatcctccatacgcgcgcgccaaccttacgctacgctcgccccgaaacgcaaacccccaaacgcctcgacacccccgtacgaccgctaaacgcgacgcgacgctatcaa

SEQ ID NO: 19371 - DNA, 676 bp, Artificial Sequence
  chemically treated genomic DNA (Homo sapiens) CpG-island No: 19371
  misc_feature (164)..(164): n is either a, c, g or t
  misc_feature (292)..(292): n is either a, c, g or t
ggagtatgaattcgtttttagtttggcgtgttagtgcggttatttttggtttcgtagaaacgagttgtagttcggggggttttttcggagtttttttgtaggtaaagtcgtttaacgttcgcgatacggttagagagttttcgacgcggcggcggcggatggtntcgttagcggcgtggatgcgttcgcgttttcggggtcgaaggggtcggtggttttttgtgttgaaggttacggcgttagcgcggtttagtatcgcgcgggagttatcgtagtgcgttaggtatagaantcgcggggagattagtaatattacggtcgtgaagtcgttcgtttttacgcggggttagagggagcgaaggcgttcgtcggcgtttaagaaggttcggcgtagcgtttcgcgtacgttttcgggttcgttaggtttcgggtttagtttttggagtatatggtttggtaaatggcgtgtatcgaagcgggtagttcgagttttatcgtggtcgtcgaggacggtaaataaggtttagttcgggggtagattaggtaacgaaagttaagtgtagtgagtattttttatgcgcgcgcgttagttttgcgttgcgttcgtttcgaagcgtaggtttttagacgtttcggtattttcgtgcggtcgttgggcgcggcgcggcgttgttaa

SEQ ID NO: 19372 - DNA, 676 bp, Artificial Sequence
  chemically treated genomic DNA (Homo sapiens) CpG-island No: 19372
  misc_feature (385)..(385): n is either a, c, g or t
  misc_feature (513)..(513): n is either a, c, g or t
ttaacaacgccgcgccgcgcccaacgaccgcacgaaaataccgaaacgtctaaaaacctacgcttcgaaacgaacgcaacgcaaaactaacgcgcgcgcataaaaaatactcactacacttaactttcgttacctaatctacccccgaactaaaccttatttaccgtcctcgacgaccacgataaaactcgaactacccgcttcgatacacgccatttaccaaaccatatactccaaaaactaaacccgaaacctaacgaacccgaaaacgtacgcgaaacgctacgccgaaccttcttaaacgccgacgaacgccttcgctccctctaaccccgcgtaaaaacgaacgacttcacgaccgtaatattactaatctccccgcganttctatacctaacgcactacgataactcccgcgcgatactaaaccgcgctaacgccgtaaccttcaacacaaaaaaccaccgaccccttcgaccccgaaaacgcgaacgcatccacgccgctaacganaccatccgccgccgccgcgtcgaaaactctctaaccgtatcgcgaacgttaaacgactttacctacaaaaaaactccgaaaaaaccccccgaactacaactcgtttctacgaaaccaaaaataaccgcactaacacgccaaactaaaaacgaattcatactcc

SEQ ID NO: 19373 - DNA, 1362 bp, Artificial Sequence
  chemically treated genomic DNA (Homo sapiens) CpG-island No: 19373
tcgttattcgcgtcgcggttattttttttcggtttttttttttttgcggcgtagagtgcgggtcgggcgggagtgcggcgagagtcggttggttgagtttagcgttcgaggaggcggcggcggcggcggcggtacggcggcggcggggttgtggggcggtgcggaagcgagaggcgaggagcgcgcgggtcgtggttagagtttggcggcggtttggcggagcggagagtagcgttcgcgtttcgtcgtgcggaggagtttcgtatataatagcggcgcgcgtagttcgcgttttttttttcggcgcgtttcgtttcgcgcgtcgagcgtttcgtttcgttttatttgttattagggagtgggcgggtattgttcgtcgtcgtcgtcgtcgcgcgggttatgggggtcgttcggcgttcggggtcgggttggcgaggcgtcgcgtcgtcgttgagacgggtttcgcgcgtagttcggcggcgtaggtaaggtcggtcgcgttatggtggattcggtgggtttcgcggaggcgtggaaggcgtagttttcggatttagagttttcgcgtatggagttgcgtttagtgggcgatatcgagtaggagttggagcgttgtaaggtttttattcggcgtttggagtaggaggtgaattaggagcgttttcgtatgatttatttgtagacgttgttggttaaggaaaagaagagttatgatcggtagcgatggggttttcggcgcgcggcgtaggttttcgacggcgttttcgagtttcgagcgttcgcgtcgcgttcgtagttagcgttcgtcgacggagtcgattcgtcgttcgtcgaggagttcgaggttcggttcgacggcgagggtttttcgggtaaggttaggttcgggatcgttcgtaggttcggggtagtcgcgtcgggggaacgggacgatcggggatttttcgttagcgtggcggcgtttaggtttaatttcgagcggattcgtaagggttatggttagttcggggcggacgtcgagaagtttttttacgtgaacgtcgagttttattacgagcgcggtttggtgaaggttaacgataaagaggtgtcggatcgtattagttttttgggtagttaggttatgtagatggagcgtaaaaagttttagtacggcgcgggttcgagcgtgggggatgtatttaggtttttttatcggggacgtttttcggagagtagttgcggcgtcgacggcgattacgaggacgtcgagttgaattttcgttttttgaaggataatttgatcgacgttaatggcggtagtaggtttttttggtcgtttttggagtattagttttattagagtatttacgtcgggggtat

SEQ ID NO: 19374 - DNA, 1362 bp, Artificial Sequence
  chemically treated genomic DNA (Homo sapiens) CpG-island No: 19374
atacccccgacgtaaatactctaataaaactaatactccaaaaacgaccaaaaaaacctactaccgccattaacgtcgatcaaattatccttcaaaaaacgaaaattcaactcgacgtcctcgtaatcgccgtcgacgccgcaactactctccgaaaaacgtccccgataaaaaaacctaaatacatcccccacgctcgaacccgcgccgtactaaaactttttacgctccatctacataacctaactacccaaaaaactaatacgatccgacacctctttatcgttaaccttcaccaaaccgcgctcgtaataaaactcgacgttcacgtaaaaaaacttctcgacgtccgccccgaactaaccataacccttacgaatccgctcgaaattaaacctaaacgccgccacgctaacgaaaaatccccgatcgtcccgttcccccgacgcgactaccccgaacctacgaacgatcccgaacctaaccttacccgaaaaaccctcgccgtcgaaccgaacctcgaactcctcgacgaacgacgaatcgactccgtcgacgaacgctaactacgaacgcgacgcgaacgctcgaaactcgaaaacgccgtcgaaaacctacgccgcgcgccgaaaaccccatcgctaccgatcataactcttcttttccttaaccaacaacgtctacaaataaatcatacgaaaacgctcctaattcacctcctactccaaacgccgaataaaaaccttacaacgctccaactcctactcgatatcgcccactaaacgcaactccatacgcgaaaactctaaatccgaaaactacgccttccacgcctccgcgaaacccaccgaatccaccataacgcgaccgaccttacctacgccgccgaactacgcgcgaaacccgtctcaacgacgacgcgacgcctcgccaacccgaccccgaacgccgaacgacccccataacccgcgcgacgacgacgacgacgaacaatacccgcccactccctaataacaaataaaacgaaacgaaacgctcgacgcgcgaaacgaaacgcgccgaaaaaaaaaacgcgaactacgcgcgccgctattatatacgaaactcctccgcacgacgaaacgcgaacgctactctccgctccgccaaaccgccgccaaactctaaccacgacccgcgcgctcctcgcctctcgcttccgcaccgccccacaaccccgccgccgccgtaccgccgccgccgccgccgcctcctcgaacgctaaactcaaccaaccgactctcgccgcactcccgcccgacccgcactctacgccgcaaaaaaaaaaaaaccgaaaaaaaataaccgcgacgcgaataacga

SEQ ID NO: 19375 - DNA, 1362 bp, Artificial Sequence
  chemically treated genomic DNA (Homo sapiens) CpG-island No: 19375
atgttttcgacgtagatgttttggtagggttggtattttaggggcggttaagggggtttgttatcgttattggcgtcgattaggttgttttttaggaagcgggggtttaattcggcgttttcgtagtcgtcgtcgacgtcgtagttgtttttcgaggagcgttttcggtaagggggtttggatgtattttttacgttcgagttcgcgtcgtgttgggattttttgcgttttatttgtatggtttggttgtttagggagttgatgcggttcgatatttttttgtcgttgatttttattaggtcgcgttcgtggtgaaattcgacgtttacgtagaagggtttttcggcgttcgtttcgggttggttatggtttttgcggattcgttcgaagttggatttgagcgtcgttacgttggcggggggttttcggtcgtttcgttttttcgacgcggttgtttcgggtttgcgggcggtttcgggtttggttttattcggagaattttcgtcgtcgggtcgggtttcgggtttttcggcgggcggcgggtcggtttcgtcggcgggcgttggttgcgggcgcgacgcggacgttcggggttcggaggcgtcgtcgggggtttgcgtcgcgcgtcggaagttttatcgttgtcggttatagttttttttttttttggttagtaacgtttgtaggtagattatgcggaagcgtttttggtttattttttgttttaggcgtcgaatggaggttttgtagcgttttagtttttgttcgatgtcgtttattgagcgtagttttatgcgcgggggttttgagttcgggaattgcgttttttacgttttcgcgaagtttatcgggtttattatggcgcggtcggttttatttgcgtcgtcgggttgcgcgcggggttcgttttagcggcggcgcggcgtttcgttagttcggtttcgggcgtcgggcggtttttatggttcgcgcggcggcggcggcggcgaataatgttcgtttattttttggtggtaggtgaggcggagcggggcgttcggcgcgcggggcggggcgcgtcggggggaagggcgcgggttgcgcgcgtcgttattgtgtgcggggttttttcgtacggcgaggcgcgggcgttgtttttcgtttcgttaggtcgtcgttagattttggttacggttcgcgcgtttttcgtttttcgttttcgtatcgttttatagtttcgtcgtcgtcgtgtcgtcgtcgtcgtcgtcgttttttcggacgttaagtttagttagtcggttttcgtcgtattttcgttcggttcgtattttgcgtcgtaggaaggggagggtcggggggaggtggtcgcggcgcggatgacgg

SEQ ID NO: 19376 - DNA, 1362 bp, Artificial Sequence
  chemically treated genomic DNA (Homo sapiens) CpG-island No: 19376
ccgtcatccgcgccgcgaccacctccccccgaccctccccttcctacgacgcaaaatacgaaccgaacgaaaatacgacgaaaaccgactaactaaacttaacgtccgaaaaaacgacgacgacgacgacgacacgacgacgacgaaactataaaacgatacgaaaacgaaaaacgaaaaacgcgcgaaccgtaaccaaaatctaacgacgacctaacgaaacgaaaaacaacgcccgcgcctcgccgtacgaaaaaaccccgcacacaataacgacgcgcgcaacccgcgcccttccccccgacgcgccccgccccgcgcgccgaacgccccgctccgcctcacctaccaccaaaaaataaacgaacattattcgccgccgccgccgccgcgcgaaccataaaaaccgcccgacgcccgaaaccgaactaacgaaacgccgcgccgccgctaaaacgaaccccgcgcgcaacccgacgacgcaaataaaaccgaccgcgccataataaacccgataaacttcgcgaaaacgtaaaaaacgcaattcccgaactcaaaacccccgcgcataaaactacgctcaataaacgacatcgaacaaaaactaaaacgctacaaaacctccattcgacgcctaaaacaaaaaataaaccaaaaacgcttccgcataatctacctacaaacgttactaaccaaaaaaaaaaaaaactataaccgacaacgataaaacttccgacgcgcgacgcaaacccccgacgacgcctccgaaccccgaacgtccgcgtcgcgcccgcaaccaacgcccgccgacgaaaccgacccgccgcccgccgaaaaacccgaaacccgacccgacgacgaaaattctccgaataaaaccaaacccgaaaccgcccgcaaacccgaaacaaccgcgtcgaaaaaacgaaacgaccgaaaaccccccgccaacgtaacgacgctcaaatccaacttcgaacgaatccgcaaaaaccataaccaacccgaaacgaacgccgaaaaacccttctacgtaaacgtcgaatttcaccacgaacgcgacctaataaaaatcaacgacaaaaaaatatcgaaccgcatcaactccctaaacaaccaaaccatacaaataaaacgcaaaaaatcccaacacgacgcgaactcgaacgtaaaaaatacatccaaacccccttaccgaaaacgctcctcgaaaaacaactacgacgtcgacgacgactacgaaaacgccgaattaaacccccgcttcctaaaaaacaacctaatcgacgccaataacgataacaaacccccttaaccgcccctaaaataccaaccctaccaaaacatctacgtcgaaaacat

SEQ ID NO: 19377 - DNA, 1136 bp, Artificial Sequence
  chemically treated genomic DNA (Homo sapiens) CpG-island No: 19377
  misc_feature (521)..(521): n is either a, c, g or t
aggggcggaggcgcgagcggtcgggtttttgggttgcgtttcggcgacggtcgttcgagacgggtgtcgaggatagggatcgcggaggatgtggattttttttttggtttgtttaggcgcgcgcgttttttcgtttcggggtacgtagttcggtcgggcgtattcgtcgttttcgggtcggcggggtagttatcgggataagggttatagcgttttcgtcgttcggttaaggacgcgtagttcgcgttttcgtttcgtttcgtcggcgcgattcgtacgggcgcgtttttcgtagaggggcgtcggtataaagtcgttttatataatggttcggttcggcgtagttcgttttgtaattcggtttcgcgtagttgtatttatatttgggtaacgagggtttgtggtttacgggtatttagattttttgtattcggttttgcgttagttttaacggtattttcgcggttgcgcgacggttcgtttttcggggtcgagatttcgacgttggtaggagagcggtnagcgattttcggaataaaggaggagaggggggcgtgcgtcggcgcgcggtcgggcgtttttttgcgttgttaggggaaacgtgtttgggttaagtttcggattttcgtttgtgcggggttcgacgtgtgttgcgagggtagcgaggttggggatgtcggtacggtcggttcgttcgttcggaaagttttgggatgttcgggcgtagtgatagtcgcgttttcgttattaggttttgtcgttcgtttttttttcggtttggttgggatgtttcgcgtatcgtcggtttttaaagagttcgggttggtcgtagacgcgtacgttagtttcggggcgggtcgtattttttgggttttagtttttttttacgtggggaggagggtgggcgagtcgggaagtagtttgcgagttttttttgcggtcggcgacggcggtgtattagttttcgtcgttttgtttcgggtttggagcgcgtttagttttgttgaagggttttggttgttgttattttttcgtttcgttgttttttcgggacgtttggtatagttttttcgattaatttcggttttttattttaattgtgttggtcgggaggagagtagagacgtagttttgtt

SEQ ID NO: 19378 - DNA, 1136 bp, Artificial Sequence
  chemically treated genomic DNA (Homo sapiens) CpG-island No: 19378
  misc_feature (616)..(616): n is either a, c, g or t
aacaaaactacgtctctactctcctcccgaccaacacaattaaaataaaaaaccgaaattaatcgaaaaaactataccaaacgtcccgaaaaaacaacgaaacgaaaaaataacaacaaccaaaacccttcaacaaaactaaacgcgctccaaacccgaaacaaaacgacgaaaactaatacaccgccgtcgccgaccgcaaaaaaaactcgcaaactacttcccgactcgcccaccctcctccccacgtaaaaaaaaactaaaacccaaaaaatacgacccgccccgaaactaacgtacgcgtctacgaccaacccgaactctttaaaaaccgacgatacgcgaaacatcccaaccaaaccgaaaaaaaaacgaacgacaaaacctaataacgaaaacgcgactatcactacgcccgaacatcccaaaactttccgaacgaacgaaccgaccgtaccgacatccccaacctcgctaccctcgcaacacacgtcgaaccccgcacaaacgaaaatccgaaacttaacccaaacacgtttcccctaacaacgcaaaaaaacgcccgaccgcgcgccgacgcacgcccccctctcctcctttattccgaaaatcgctnaccgctctcctaccaacgtcgaaatctcgaccccgaaaaacgaaccgtcgcgcaaccgcgaaaataccgttaaaactaacgcaaaaccgaatacaaaaaatctaaatacccgtaaaccacaaaccctcgttacccaaatataaatacaactacgcgaaaccgaattacaaaacgaactacgccgaaccgaaccattatataaaacgactttataccgacgcccctctacgaaaaacgcgcccgtacgaatcgcgccgacgaaacgaaacgaaaacgcgaactacgcgtccttaaccgaacgacgaaaacgctataacccttatcccgataactaccccgccgacccgaaaacgacgaatacgcccgaccgaactacgtaccccgaaacgaaaaaacgcgcgcgcctaaacaaaccaaaaaaaaaatccacatcctccgcgatccctatcctcgacacccgtctcgaacgaccgtcgccgaaacgcaacccaaaaacccgaccgctcgcgcctccgcccct

SEQ ID NO: 19379 - DNA, 1136 bp, Artificial Sequence
  chemically treated genomic DNA (Homo sapiens) CpG-island No: 19379
  misc_feature (616)..(616): n is either a, c, g or t
ggtaggattgcgtttttgtttttttttcggttagtatagttgaggtgaggggtcggaattagtcggggaagttgtgttagacgtttcgaggggataacgggacgaggggataatagtagttaggattttttagtagggttgggcgcgttttaggttcggggtagggcggcgggagttggtgtatcgtcgtcgtcggtcgtagggggagttcgtaggttgtttttcggttcgtttatttttttttttacgtggaagggggttgggatttaaggaatgcggttcgtttcgaggttgacgtacgcgtttgcggttagttcggattttttaaaagtcggcggtgcgcggggtattttagttaagtcggagaggaggcgagcggtagggtttggtggcgagagcgcggttgttattgcgttcgagtattttagagtttttcgagcggacgagtcggtcgtgtcggtatttttagtttcgttattttcgtagtatacgtcgagtttcgtataggcgagggttcggaatttagtttaagtacgttttttttggtagcgtaaggaaacgttcggtcgcgcgtcggcgtacgtttttttttttttttttgtttcgggggtcgttngtcgtttttttgttagcgtcgggatttcggtttcgggaggcgggtcgtcgcgtagtcgcgaagatgtcgttggaattgacgtagagtcgagtgtagaagatttgggtgttcgtggattataggttttcgttgtttagatgtgagtgtagttgcgcggagtcgggttgtagggcgggttgcgtcgggtcgggttattgtgtggggcggttttgtgtcgacgtttttttgcggggggcgcgttcgtgcgggtcgcgtcggcggggcggggcggaggcgcgggttgcgcgtttttggtcgggcggcgggggcgttgtggtttttgtttcggtggttgtttcgtcggttcggaaacggcgagtgcgttcggtcgggttgcgtatttcgagacggagggacgcgcgcgtttgggtaggttagggaggggatttatatttttcgcgatttttgttttcgatattcgtttcgggcggtcgtcgtcggagcgtagtttagggattcggtcgttcgcgttttcgttttt

SEQ ID NO: 19380 - DNA, 1136 bp, Artificial Sequence
  chemically treated genomic DNA (Homo sapiens) CpG-island No: 19380
  misc_feature (521)..(521): n is either a, c, g or t
aaaaacgaaaacgcgaacgaccgaatccctaaactacgctccgacgacgaccgcccgaaacgaatatcgaaaacaaaaatcgcgaaaaatataaatcccctccctaacctacccaaacgcgcgcgtccctccgtctcgaaatacgcaacccgaccgaacgcactcgccgtttccgaaccgacgaaacaaccaccgaaacaaaaaccacaacgcccccgccgcccgaccaaaaacgcgcaacccgcgcctccgccccgccccgccgacgcgacccgcacgaacgcgccccccgcaaaaaaacgtcgacacaaaaccgccccacacaataacccgacccgacgcaacccgccctacaacccgactccgcgcaactacactcacatctaaacaacgaaaacctataatccacgaacacccaaatcttctacactcgactctacgtcaattccaacgacatcttcgcgactacgcgacgacccgcctcccgaaaccgaaatcccgacgctaacaaaaaaacgacnaacgacccccgaaacaaaaaaaaaaaaaaaaacgtacgccgacgcgcgaccgaacgtttccttacgctaccaaaaaaaacgtacttaaactaaattccgaaccctcgcctatacgaaactcgacgtatactacgaaaataacgaaactaaaaataccgacacgaccgactcgtccgctcgaaaaactctaaaatactcgaacgcaataacaaccgcgctctcgccaccaaaccctaccgctcgcctcctctccgacttaactaaaataccccgcgcaccgccgacttttaaaaaatccgaactaaccgcaaacgcgtacgtcaacctcgaaacgaaccgcattccttaaatcccaacccccttccacgtaaaaaaaaaaataaacgaaccgaaaaacaacctacgaactccccctacgaccgacgacgacgatacaccaactcccgccgccctaccccgaacctaaaacgcgcccaaccctactaaaaaatcctaactactattatcccctcgtcccgttatcccctcgaaacgtctaacacaacttccccgactaattccgacccctcacctcaactatactaaccgaaaaaaaaacaaaaacgcaatcctacc

SEQ ID NO: 19381 - DNA, 669 bp, Artificial Sequence
  chemically treated genomic DNA (Homo sapiens) CpG-island No: 19381
tcggttttcgtagtttgtattagttcgcgatttgtgatagtcgtgtagttaggttagaggcgtgcggggaagatttgggttgtttttggtggggaatcgtcgttcgcgtcgggacggatgtaatttttgtaaacgaagttttagtataggagcgttgcgtcgttttgtagagaggtgtatatttagcgttgaggttgggttgtgattggagggaaggcggcgttcgttgaaatttatatcgcggcggaaaagtttgcgtagaggttgttatacgtcgtttacgtttcgtatgttttatagggagggcgttcgcgtttaggcggcgatcggggttgttttcgtttcgcgcgttcgttttattcgggtttttatttttttcgattcgtcgtttgtcgaggggtttcggaacgcgtaatatcggttatttggtttgtgtttcgttatttttttttacgtttcgatttttattttttttttcgtttcgatttttatttcggtatttcgtttttcgcgtcgtttttttagagtttttgttttcgcgatagttttgttgacggtttggttttcgcgttttggcggttgtttagaaattcgatgcgttgtatttggatttgttttttgtagtgggagtatatgttagaggcgatattttaaacgtttaggggagag

SEQ ID NO: 19382 - DNA, 669 bp, Artificial Sequence
  chemically treated genomic DNA (Homo sapiens) CpG-island No: 19382
ctctcccctaaacgtttaaaatatcgcctctaacatatactcccactacaaaaaacaaatccaaatacaacgcatcgaatttctaaacaaccgccaaaacgcgaaaaccaaaccgtcaacaaaactatcgcgaaaacaaaaactctaaaaaaacgacgcgaaaaacgaaataccgaaataaaaatcgaaacgaaaaaaaaaataaaaatcgaaacgtaaaaaaaaataacgaaacacaaaccaaataaccgatattacgcgttccgaaacccctcgacaaacgacgaatcgaaaaaaataaaaacccgaataaaacgaacgcgcgaaacgaaaacaaccccgatcgccgcctaaacgcgaacgccctccctataaaacatacgaaacgtaaacgacgtataacaacctctacgcaaacttttccgccgcgatataaatttcaacgaacgccgccttccctccaatcacaacccaacctcaacgctaaatatacacctctctacaaaacgacgcaacgctcctatactaaaacttcgtttacaaaaattacatccgtcccgacgcgaacgacgattccccaccaaaaacaacccaaatcttccccgcacgcctctaacctaactacacgactatcacaaatcgcgaactaatacaaactacgaaaaccga

SEQ ID NO: 19383 - DNA, 669 bp, Artificial Sequence
  chemically treated genomic DNA (Homo sapiens) CpG-island No: 19383
tttttttttgggcgtttagggtgtcgtttttggtatgtgtttttattgtagaaaataagtttaaatgtaacgtatcgggtttttgaatagtcgttagagcgcggaaattagatcgttagtaaagttgtcgcgggaataggggttttgagagggcggcgcggggggcggggtgtcggagtgggggtcgaggcgggagggggagtgggggtcgaggcgtgggggagggtggcggggtataggttaggtggtcgatgttgcgcgtttcggggtttttcggtaggcggcgggtcgggaggagtggaggttcgggtggggcgggcgcgcggggcgggagtagtttcggtcgtcgtttgggcgcgggcgttttttttgtggagtatgcgggacgtgagcgacgtgtggtagtttttgcgtagattttttcgtcgcggtgtaggttttagcgagcgtcgttttttttttaattatagtttagttttagcgttaagtgtgtatttttttgtaaggcggcgtagcgtttttgtattgaggtttcgtttgtaaaagttatattcgtttcggcgcgggcggcggttttttattaaaagtaatttagatttttttcgtacgtttttgatttgattgtacgattgttataagtcgcgagttggtgtaaattgcgagggtcgg

SEQ ID NO: 19384 - DNA, 669 bp, Artificial Sequence
  chemically treated genomic DNA (Homo sapiens) CpG-island No: 19384
ccgaccctcgcaatttacaccaactcgcgacttataacaatcgtacaatcaaatcaaaaacgtacgaaaaaaatctaaattacttttaataaaaaaccgccgcccgcgccgaaacgaatataacttttacaaacgaaacctcaatacaaaaacgctacgccgccttacaaaaaaatacacacttaacgctaaaactaaactataattaaaaaaaaaacgacgctcgctaaaacctacaccgcgacgaaaaaatctacgcaaaaactaccacacgtcgctcacgtcccgcatactccacaaaaaaaacgcccgcgcccaaacgacgaccgaaactactcccgccccgcgcgcccgccccacccgaacctccactcctcccgacccgccgcctaccgaaaaaccccgaaacgcgcaacatcgaccacctaacctataccccgccaccctcccccacgcctcgacccccactccccctcccgcctcgacccccactccgacaccccgccccccgcgccgccctctcaaaacccctattcccgcgacaactttactaacgatctaatttccgcgctctaacgactattcaaaaacccgatacgttacatttaaacttattttctacaataaaaacacataccaaaaacgacaccctaaacgcccaaaaaaaaa

SEQ ID NO: 19385 - DNA, 1075 bp, Artificial Sequence
  chemically treated genomic DNA (Homo sapiens) CpG-island No: 19385
ggtgatttattttcggttttgtttggtagcgttgtattttttaatttaaatttcggtcggtcgttcgtcgggggtatagagtgtgcgtcgggtcgcgcggtaattggttttcgcgtcgattttcgttcgcgagcgtcgtcgtttttttttttcgtttcgcgtttttttttttcggtttcgcgcgtcgtttgtttttcgagttagtcgttgatagtcgcggcgtcgcgagttttttttttttttacgatcgaggtaggtaaacgttcggggtgggaggaacgcgggcgggggtaggggagtcgcgggggtcgagtgaggatttcgggtttcgggttttaggcgtaagggtgttcggtcgggcggggtcgggattttagtgaggaggggtcgggggttgtttcgcgggcgcgtgacggtttcgggtttgttcggttgcgttggttttcgttcgggtgaggcggtttggtttcgttttttaggttaggaaagttttttttattgcgcgttggggggttgggggagttggcggagttacgttagggaggtcggtggcgtcggggtgttttagcgttttttgtatttcgcgcgggttcggtttagcgggcgatcgttggcgtttagggaatttcgggagggtcgttagcgggtttcgtaggcgcggggcggggaggggcgtttgggggtcgcggggttcgcgtttttcgttcgttggtcgtttttcggaggtcgagatcggggtttagaacgttttttggtaaagtttggcgttttcgcgatgtttagagggtgtttggggggatggagagaggggcgttcgtcggggtagtttcgggagtttcggtgtttttcgtcgtagttgtagcgtttttttcgggaggcggtttagttttttattttcgtcgtttgagttttttcgaggggggttgtagttttgcggtcgttgttatcgtttggagaagcggtttacgcggattgacgggcgggggcggggtttcgggtttcggcgggggcggggttcggggaggttttattttttgttttttaggggcggggagagaggagttgtaggtttgcg

SEQ ID NO: 19386 - DNA, 1075 bp, Artificial Sequence
  chemically treated genomic DNA (Homo sapiens) CpG-island No: 19386
cgcaaacctacaactcctctctccccgcccctaaaaaacaaaaaataaaacctccccgaaccccgcccccgccgaaacccgaaaccccgcccccgcccgtcaatccgcgtaaaccgcttctccaaacgataacaacgaccgcaaaactacaacccccctcgaaaaaactcaaacgacgaaaataaaaaactaaaccgcctcccgaaaaaaacgctacaactacgacgaaaaacaccgaaactcccgaaactaccccgacgaacgcccctctctccatccccccaaacaccctctaaacatcgcgaaaacgccaaactttaccaaaaaacgttctaaaccccgatctcgacctccgaaaaacgaccaacgaacgaaaaacgcgaaccccgcgacccccaaacgcccctccccgccccgcgcctacgaaacccgctaacgaccctcccgaaattccctaaacgccaacgatcgcccgctaaaccgaacccgcgcgaaatacaaaaaacgctaaaacaccccgacgccaccgacctccctaacgtaactccgccaactcccccaaccccccaacgcgcaataaaaaaaactttcctaacctaaaaaacgaaaccaaaccgcctcacccgaacgaaaaccaacgcaaccgaacaaacccgaaaccgtcacgcgcccgcgaaacaacccccgacccctcctcactaaaatcccgaccccgcccgaccgaacacccttacgcctaaaacccgaaacccgaaatcctcactcgacccccgcgactcccctacccccgcccgcgttcctcccaccccgaacgtttacctacctcgatcgtaaaaaaaaaaaaaactcgcgacgccgcgactatcaacgactaactcgaaaaacaaacgacgcgcgaaaccgaaaaaaaaaaacgcgaaacgaaaaaaaaaaacgacgacgctcgcgaacgaaaatcgacgcgaaaaccaattaccgcgcgacccgacgcacactctatacccccgacgaacgaccgaccgaaatttaaattaaaaaatacaacgctaccaaacaaaaccgaaaataaatcacc

SEQ ID NO: 19387 - DNA, 1075 bp, Artificial Sequence
  chemically treated genomic DNA (Homo sapiens) CpG-island No: 19387
cgtagatttgtagttttttttttttcgtttttggagaatagagggtggggttttttcggatttcgttttcgtcgaggttcgaggtttcgttttcgttcgttagttcgcgtgggtcgtttttttaggcggtggtaacggtcgtaaggttgtagtttttttcggagaagtttaggcggcgaggatgaagggttgggtcgtttttcgggaggaacgttgtagttgcggcgggaggtatcgaggttttcggaattatttcggcgggcgtttttttttttatttttttaagtattttttgggtatcgcggaagcgttaggttttgttaaggggcgttttgggtttcgatttcggttttcgaggggcggttaacgggcggggagcgcgagtttcgcggtttttaggcgttttttttcgtttcgcgtttgcggagttcgttggcggttttttcggagttttttgggcgttagcgatcgttcgttgggtcggattcgcgcggggtgtagggggcgttgagatatttcggcgttatcgatttttttaacgtggtttcgttagtttttttagttttttaacgcgtagtaaagggagtttttttaatttgaaaagcgaagttaagtcgttttattcgagcggagattagcgtagtcgggtaggttcgagatcgttacgcgttcgcggggtagttttcggtttttttttattggggtttcgatttcgttcggtcgggtatttttgcgtttgggattcgaggttcggggtttttattcggttttcgcggtttttttgttttcgttcgcgttttttttatttcgggcgtttatttgtttcggtcgtgaggagaggagaagttcgcggcgtcgcggttgttagcgattggttcggaggataggcgacgcgcggggtcgagggggagggacgcggggcggggaagggaagcggcggcgttcgcgggcggaggtcggcgcggggattaattgtcgcgcggttcggcgtatattttgtgttttcggcgggcggtcggtcgaggtttaagttaaagggtgtagcgttgttaagtagggtcgggaatgagttatt

SEQ ID NO: 19388 - DNA, 1075 bp, Artificial Sequence
  chemically treated genomic DNA (Homo sapiens) CpG-island No: 19388
aataactcattcccgaccctacttaacaacgctacaccctttaacttaaacctcgaccgaccgcccgccgaaaacacaaaatatacgccgaaccgcgcgacaattaatccccgcgccgacctccgcccgcgaacgccgccgcttcccttccccgccccgcgtccctccccctcgaccccgcgcgtcgcctatcctccgaaccaatcgctaacaaccgcgacgccgcgaacttctcctctcctcacgaccgaaacaaataaacgcccgaaataaaaaaaacgcgaacgaaaacaaaaaaaccgcgaaaaccgaataaaaaccccgaacctcgaatcccaaacgcaaaaatacccgaccgaacgaaatcgaaaccccaataaaaaaaaaccgaaaactaccccgcgaacgcgtaacgatctcgaacctacccgactacgctaatctccgctcgaataaaacgacttaacttcgcttttcaaattaaaaaaactccctttactacgcgttaaaaaactaaaaaaactaacgaaaccacgttaaaaaaatcgataacgccgaaatatctcaacgccccctacaccccgcgcgaatccgacccaacgaacgatcgctaacgcccaaaaaactccgaaaaaaccgccaacgaactccgcaaacgcgaaacgaaaaaaaacgcctaaaaaccgcgaaactcgcgctccccgcccgttaaccgcccctcgaaaaccgaaatcgaaacccaaaacgccccttaacaaaacctaacgcttccgcgatacccaaaaaatacttaaaaaaataaaaaaaaaaacgcccgccgaaataattccgaaaacctcgatacctcccgccgcaactacaacgttcctcccgaaaaacgacccaacccttcatcctcgccgcctaaacttctccgaaaaaaactacaaccttacgaccgttaccaccgcctaaaaaaacgacccacgcgaactaacgaacgaaaacgaaacctcgaacctcgacgaaaacgaaatccgaaaaaaccccaccctctattctccaaaaacgaaaaaaaaaaaactacaaatctacg

SEQ ID NO: 19389 - DNA, 706 bp, Artificial Sequence
  chemically treated genomic DNA (Homo sapiens) CpG-island No: 19389
agtcggggttatacgttttttatcgcgtgcggttacgagacgtttttaagggagtattttggtattcggaagtcgcgatttttggttttgagttcgggtttagttttcgggtttacgtggtcggagtcggtagttgattggacgcgggtcgttttattttttggtcgtcgcgggattcgtaggattgagattatggaggcggtggcggtggtcgcggcggtgggggttttttttttggtcggggtcgggggcgcggtaggcgacgaggttcgggaggcggcggtcgtgcgggcgttcgtggttcggttgttggggttaggtttcgcggtcgattttttcgtgtcggtggagcgcgttttggttgttaagtcgggtttggatatttatagtttgggcggcggcggcgcggcgcgcgtgcgggtgcgcggttttacgggcgtggcggtcgtcgcggggttgtatcgttatttgcgcgatttttgtggttgttacgtggtttggttcggtttttagttgcgtttgtcgcggttattgttagtcgtgtcgggggagttgatcgaggttacgtttaataggtatcgtttcgaagttttttcgcgttcgttcgaggcgtttattttttttcggagtcgttgttatttaaatcgggaggttgagcggggagcgttggtcggaaggtttagttgcgtcgtttttagtagttgtg

SEQ ID NO: 19390 - DNA, 706 bp, Artificial Sequence
  chemically treated genomic DNA (Homo sapiens) CpG-island No: 19390
cacaactactaaaaacgacgcaactaaaccttccgaccaacgctccccgctcaacctcccgatttaaataacaacgactccgaaaaaaaataaacgcctcgaacgaacgcgaaaaaacttcgaaacgatacctattaaacgtaacctcgatcaactcccccgacacgactaacaataaccgcgacaaacgcaactaaaaaccgaaccaaaccacgtaacaaccacaaaaatcgcgcaaataacgatacaaccccgcgacgaccgccacgcccgtaaaaccgcgcacccgcacgcgcgccgcgccgccgccgcccaaactataaatatccaaacccgacttaacaaccaaaacgcgctccaccgacacgaaaaaatcgaccgcgaaacctaaccccaacaaccgaaccacgaacgcccgcacgaccgccgcctcccgaacctcgtcgcctaccgcgcccccgaccccgaccaaaaaaaaaacccccaccgccgcgaccaccgccaccgcctccataatctcaatcctacgaatcccgcgacgaccaaaaaataaaacgacccgcgtccaatcaactaccgactccgaccacgtaaacccgaaaactaaacccgaactcaaaaccaaaaatcgcgacttccgaataccaaaatactcccttaaaaacgtctcgtaaccgcacgcgataaaaaacgtataaccccgact

SEQ ID NO: 19391 - DNA, 706 bp, Artificial Sequence
  chemically treated genomic DNA (Homo sapiens) CpG-island No: 19391
tatagttgttggaggcggcgtagttgggtttttcggttagcgtttttcgtttagtttttcgatttgggtggtagcggtttcgggagggggtaagcgtttcgggcggacgcggggaagtttcggggcggtatttgttgggcgtggtttcggttagttttttcggtacggttggtagtggtcgcggtaggcgtagttgagagtcggattaggttacgtggtagttatagaagtcgcgtaggtagcggtgtagtttcgcggcggtcgttacgttcgtggagtcgcgtattcgtacgcgcgtcgcgtcgtcgtcgtttaggttgtaggtgtttaagttcggtttggtagttagagcgcgttttatcgatacggagaagtcggtcgcggggtttggttttagtagtcgggttacgagcgttcgtacggtcgtcgtttttcgggtttcgtcgtttgtcgcgttttcggtttcggttaggagaaggatttttatcgtcgcggttatcgttatcgtttttatggttttagttttgcgggtttcgcgacggttagggggtggggcggttcgcgtttaattagttgtcggtttcggttacgtggattcgaaggttaagttcgggtttagggttaggagtcgcggttttcgggtattaggatatttttttgggggcgtttcgtgatcgtacgcggtggggagcgtgtgatttcggtt

SEQ ID NO: 19392 - DNA, 706 bp, Artificial Sequence
  chemically treated genomic DNA (Homo sapiens) CpG-island No: 19392
aaccgaaatcacacgctccccaccgcgtacgatcacgaaacgcccccaaaaaaatatcctaatacccgaaaaccgcgactcctaaccctaaacccgaacttaaccttcgaatccacgtaaccgaaaccgacaactaattaaacgcgaaccgccccaccccctaaccgtcgcgaaacccgcaaaactaaaaccataaaaacgataacgataaccgcgacgataaaaatccttctcctaaccgaaaccgaaaacgcgacaaacgacgaaacccgaaaaacgacgaccgtacgaacgctcgtaacccgactactaaaaccaaaccccgcgaccgacttctccgtatcgataaaacgcgctctaactaccaaaccgaacttaaacacctacaacctaaacgacgacgacgcgacgcgcgtacgaatacgcgactccacgaacgtaacgaccgccgcgaaactacaccgctacctacgcgacttctataactaccacgtaacctaatccgactctcaactacgcctaccgcgaccactaccaaccgtaccgaaaaaactaaccgaaaccacgcccaacaaataccgccccgaaacttccccgcgtccgcccgaaacgcttaccccctcccgaaaccgctaccacccaaatcgaaaaactaaacgaaaaacgctaaccgaaaaacccaactacgccgcctccaacaactata

SEQ ID NO: 19393 - DNA, 684 bp, Artificial Sequence
  chemically treated genomic DNA (Homo sapiens) CpG-island No: 19393
ggacgtagcggtgttgttttgggtcgtggttagggtcggggtcggggtcggtgttggggtaggagatgggatttggcgtttgggtcgttttcgtttttgtttatttgcggttttcgggttagtagcgtgagtttgatcgagtgcggttttgtggatatcgtttttatgtagaaggtgttgggcggtttcgattaggtgatggatcgtacgaatattcggatttttcgttttttgtattaatatttttattatagtaaggagatttatcgcgaggaggcgtagtattttgaggaggtggtgaaggtgagcggggggcgggatttcgggagcgggggcggtgcgtcgttttgcgcgtagtcggggttagagtttttttttcgtcgtcgtaggttttttttatcgttatgcgcgtttcgaagtcgattttgcgttattttataattaggcgttttttgtattagttgttgatgcgtttggacgatttttttggtttcgattacgtcgtcgttatgtatcgggacgtgttcgtcgacgatttcgtagaggtcgaggttggggtcggggttggggtcgaggtcgggggcggggtcggtgggatgggagattttgagtttagcgattttttggtcgtttcgtaagaaaggtttcgttagttattgtttttcgcgtttttttttgtttttt

SEQ ID NO: 19394 - DNA, 684 bp, Artificial Sequence
  chemically treated genomic DNA (Homo sapiens) CpG-island No: 19394
aaaaaacaaaaaaaaacgcgaaaaacaataactaacgaaacctttcttacgaaacgaccaaaaaatcgctaaactcaaaatctcccatcccaccgaccccgcccccgacctcgaccccaaccccgaccccaacctcgacctctacgaaatcgtcgacgaacacgtcccgatacataacgacgacgtaatcgaaaccaaaaaaatcgtccaaacgcatcaacaactaatacaaaaaacgcctaattataaaataacgcaaaatcgacttcgaaacgcgcataacgataaaaaaaacctacgacgacgaaaaaaaaactctaaccccgactacgcgcaaaacgacgcaccgcccccgctcccgaaatcccgccccccgctcaccttcaccacctcctcaaaatactacgcctcctcgcgataaatctccttactataataaaaatattaatacaaaaaacgaaaaatccgaatattcgtacgatccatcacctaatcgaaaccgcccaacaccttctacataaaaacgatatccacaaaaccgcactcgatcaaactcacgctactaacccgaaaaccgcaaataaacaaaaacgaaaacgacccaaacgccaaatcccatctcctaccccaacaccgaccccgaccccgaccctaaccacgacccaaaacaacaccgctacgtcc

SEQ ID NO: 19395 - DNA, 684 bp, Artificial Sequence
  chemically treated genomic DNA (Homo sapiens) CpG-island No: 19395
aggagataaaggagggcgcgggagatagtggttgacggagttttttttgcggggcggttagaggatcgttgagtttagggttttttattttatcggtttcgttttcggtttcggttttagtttcggttttagtttcggtttttgcgggatcgtcggcgaatacgtttcggtgtatggcggcggcgtagtcgaagttaaaggggtcgtttaggcgtattagtagttggtgtaggaagcgtttggttgtgaagtagcgtagggtcggtttcggggcgcgtatagcggtgaggaagatttgcggcggcgggagaggagttttggtttcggttgcgcgtaggacgacgtatcgttttcgttttcggagtttcgtttttcgtttatttttattatttttttagggtgttgcgttttttcgcggtagatttttttgttgtggtggaggtattagtgtaagaggcggaaggttcgggtgttcgtgcggtttattatttggtcgggatcgtttaatattttttgtatgaaggcggtgtttatagggtcgtattcgattaggtttacgttgttggttcgagagtcgtaagtgggtagggacggaggcgatttaggcgttaagttttattttttgttttagtatcggtttcgatttcggttttggttacgatttagaatagtatcgttgcgttt

SEQ ID NO: 19396 - DNA, 684 bp, Artificial Sequence
  chemically treated genomic DNA (Homo sapiens) CpG-island No: 19396
aaacgcaacgatactattctaaatcgtaaccaaaaccgaaatcgaaaccgatactaaaacaaaaaataaaacttaacgcctaaatcgcctccgtccctacccacttacgactctcgaaccaacaacgtaaacctaatcgaatacgaccctataaacaccgccttcatacaaaaaatattaaacgatcccgaccaaataataaaccgcacgaacacccgaaccttccgcctcttacactaatacctccaccacaacaaaaaaatctaccgcgaaaaaacgcaacaccctaaaaaaataataaaaataaacgaaaaacgaaactccgaaaacgaaaacgatacgtcgtcctacgcgcaaccgaaaccaaaactcctctcccgccgccgcaaatcttcctcaccgctatacgcgccccgaaaccgaccctacgctacttcacaaccaaacgcttcctacaccaactactaatacgcctaaacgacccctttaacttcgactacgccgccgccatacaccgaaacgtattcgccgacgatcccgcaaaaaccgaaactaaaaccgaaactaaaaccgaaaccgaaaacgaaaccgataaaataaaaaaccctaaactcaacgatcctctaaccgccccgcaaaaaaaactccgtcaaccactatctcccgcgccctcctttatctcct

SEQ ID NO: 19397 - DNA, 571 bp, Artificial Sequence
  chemically treated genomic DNA (Homo sapiens) CpG-island No: 19397
gcgcggggaggtcgtttttagggtaacgtggggagtcggtcggtcggatagtgcgcgtgtatatattatttgcggcggtgtgttgataagttaattgaggggattttattttataaaacgcgttttatgtcgtcgttattttattgtttaattcggggagggtaggtacggcggggagtagtttcgaaggaggttggcgttaggttaagcgtcgggttttgacggttggaatcgtggagtaaagtttttgggttgcgtatgcgcgatgtttcgttttgttttatttttcggtcgcggattggcgggcgcgggttacgtgggtacgttattcgttttttcgtcgtagggggttcgttcgttggttcgttttcggttcggtgggtataagatgacggagtcgggcgtttttttcgaggatttttgggttaaggtaagtttcgtgggcgcgtacgtcggcgaggggagggcgggtcgggttcgtgtacgtaggggggtcggaagacgaggggttttttttttgtttttaaagttttttacgtttttcgtgtttcggggttgtagagaagatagt

SEQ ID NO: 19398 - DNA, 571 bp, Artificial Sequence
  chemically treated genomic DNA (Homo sapiens) CpG-island No: 19398
actatcttctctacaaccccgaaacacgaaaaacgtaaaaaactttaaaaacaaaaaaaaaacccctcgtcttccgacccccctacgtacacgaacccgacccgccctcccctcgccgacgtacgcgcccacgaaacttaccttaacccaaaaatcctcgaaaaaaacgcccgactccgtcatcttatacccaccgaaccgaaaacgaaccaacgaacgaaccccctacgacgaaaaaacgaataacgtacccacgtaacccgcgcccgccaatccgcgaccgaaaaataaaacaaaacgaaacatcgcgcatacgcaacccaaaaactttactccacgattccaaccgtcaaaacccgacgcttaacctaacgccaacctccttcgaaactactccccgccgtacctaccctccccgaattaaacaataaaataacgacgacataaaacgcgttttataaaataaaatcccctcaattaacttatcaacacaccgccgcaaataatatatacacgcgcactatccgaccgaccgactccccacgttaccctaaaaacgacctccccgcgc

SEQ ID NO: 19399 - DNA, 571 bp, Artificial Sequence
  chemically treated genomic DNA (Homo sapiens) CpG-island No: 19399
gttgttttttttgtagtttcggggtacggagagcgtgggggattttggggataggagggaagtttttcgtttttcggtttttttacgtgtacgagttcgattcgtttttttttcgtcggcgtgcgcgtttacggggtttgttttgatttaagggttttcgggagaggcgttcggtttcgttattttgtatttatcggatcggaaacgggttagcgggcgggttttttgcggcgaggaagcgggtggcgtgtttacgtgattcgcgttcgttaattcgcgatcgagaggtggggtagggcgaagtatcgcgtatgcgtagtttaaagattttattttacggttttagtcgttaaggttcggcgtttggtttggcgttagtttttttcgagattgtttttcgtcgtgtttgtttttttcgggttaggtagtggaatggcggcgatatgaagcgcgttttgtaagatggagtttttttaattggtttgttagtatatcgtcgtagatagtgtgtgtacgcgtattgttcggtcggtcggttttttacgttattttgagggcggttttttcgcgt

SEQ ID NO: 19400 - DNA, 571 bp, Artificial Sequence
  chemically treated genomic DNA (Homo sapiens) CpG-island No: 19400
acgcgaaaaaaccgccctcaaaataacgtaaaaaaccgaccgaccgaacaatacgcgtacacacactatctacgacgatatactaacaaaccaattaaaaaaactccatcttacaaaacgcgcttcatatcgccgccattccactacctaacccgaaaaaaacaaacacgacgaaaaacaatctcgaaaaaaactaacgccaaaccaaacgccgaaccttaacgactaaaaccgtaaaataaaatctttaaactacgcatacgcgatacttcgccctaccccacctctcgatcgcgaattaacgaacgcgaatcacgtaaacacgccacccgcttcctcgccgcaaaaaacccgcccgctaacccgtttccgatccgataaatacaaaataacgaaaccgaacgcctctcccgaaaacccttaaatcaaaacaaaccccgtaaacgcgcacgccgacgaaaaaaaaacgaatcgaactcgtacacgtaaaaaaaccgaaaaacgaaaaacttccctcctatccccaaaatcccccacgctctccgtaccccgaaactacaaaaaaaacaac

SEQ ID NO: 19401 - DNA, 729 bp, Artificial Sequence
  chemically treated genomic DNA (Homo sapiens) CpG-island No: 19401
tattttgaatcggattaaattaaattaaattaaattaaattaaattagattagatattttttttcgcggaattttagagaggtcgaattgggataatcggatgtatttgattttttacgttattgagtgtatttttgtagaaatgggcgttttggttttcgcgaggtagtgcgatttgttatcgttttttagttttttcgttttttattaagttcgcgtacgttcggttcgcgcgtttgtttttcgattcggtatttcggtcggtttttagtagcgcgtatgcgcgcgtttttaggttatttgaagagagagggcggggtcgaggggttgagttcgcggggggagggaatagcgttgattacgtgacgtggttttagtgtttatattcgtagcgggtcgggggttcggttttagttaggcgtttagtttcgtttcggttttattttcggtggagggtcgtttttgagcgggcggcgggtcgacggcgagcgcgggcggcggcggtgacggaggcgtcgttgttagggggcgtgcggtagcgcggcggcggcggcggcggcggcggcggcggaggcggcggcggcggcggcggcggcggcggttgggtttcgagcgttcgtagtttatttttcgggggcgggttttcggcgttagtagggttgaagagaagatggaggagttggtggtggaagtgcggggttttaatggcgttttttataaggtatttgg

SEQ ID NO: 19402 - DNA, 729 bp, Artificial Sequence
  chemically treated genomic DNA (Homo sapiens) CpG-island No: 19402
ccaaataccttataaaaaacgccattaaaaccccgcacttccaccaccaactcctccatcttctcttcaaccctactaacgccgaaaacccgcccccgaaaaataaactacgaacgctcgaaacccaaccgccgccgccgccgccgccgccgccgcctccgccgccgccgccgccgccgccgccgccgcgctaccgcacgccccctaacaacgacgcctccgtcaccgccgccgcccgcgctcgccgtcgacccgccgcccgctcaaaaacgaccctccaccgaaaataaaaccgaaacgaaactaaacgcctaactaaaaccgaacccccgacccgctacgaatataaacactaaaaccacgtcacgtaatcaacgctattccctccccccgcgaactcaacccctcgaccccgccctctctcttcaaataacctaaaaacgcgcgcatacgcgctactaaaaaccgaccgaaataccgaatcgaaaaacaaacgcgcgaaccgaacgtacgcgaacttaataaaaaacgaaaaaactaaaaaacgataacaaatcgcactacctcgcgaaaaccaaaacgcccatttctacaaaaatacactcaataacgtaaaaaatcaaatacatccgattatcccaattcgacctctctaaaattccgcgaaaaaaaatatctaatctaatttaatttaatttaatttaatttaatttaatccgattcaaaata

SEQ ID NO: 19403 - DNA, 729 bp, Artificial Sequence
  chemically treated genomic DNA (Homo sapiens) CpG-island No: 19403
ttaagtattttgtagaaagcgttattggagtttcgtatttttattattagtttttttattttttttttagttttgttagcgtcgggagttcgttttcgagaggtgggttgcgggcgttcgaggtttagtcgtcgtcgtcgtcgtcgtcgtcgtcgttttcgtcgtcgtcgtcgtcgtcgtcgtcgtcgcgttgtcgtacgttttttggtagcggcgttttcgttatcgtcgtcgttcgcgttcgtcgtcggttcgtcgttcgtttagaggcggttttttatcggaagtgaaatcgaaacggagttgagcgtttgattgaggtcgaattttcggttcgttgcgggtgtaaatattgaaattacgttacgtgattaacgttgtttttttttttcgcgggtttagtttttcggtttcgttttttttttttaagtggtttgggagcgcgcgtatgcgcgttgttgggaatcggtcggggtgtcgggtcgaaagatagacgcgcgggtcgggcgtgcgcgggtttggtggagggcgggaaggttgaagggcggtgataggtcgtattgtttcgcgagggttagaacgtttatttttgtagaggtgtatttagtggcgtgggaaattaaatgtattcggttattttagttcggtttttttgggatttcgcgggagggggtgtttggtttggtttggtttggtttggtttggtttggtttggttcggtttaaagta

SEQ ID NO: 19404 - DNA, 729 bp, Artificial Sequence
  chemically treated genomic DNA (Homo sapiens) CpG-island No: 19404
tactttaaaccgaaccaaaccaaaccaaaccaaaccaaaccaaaccaaaccaaacaccccctcccgcgaaatcccaaaaaaaccgaactaaaataaccgaatacatttaatttcccacgccactaaatacacctctacaaaaataaacgttctaaccctcgcgaaacaatacgacctatcaccgcccttcaaccttcccgccctccaccaaacccgcgcacgcccgacccgcgcgtctatctttcgacccgacaccccgaccgattcccaacaacgcgcatacgcgcgctcccaaaccacttaaaaaaaaaaaacgaaaccgaaaaactaaacccgcgaaaaaaaaaaacaacgttaatcacgtaacgtaatttcaatatttacacccgcaacgaaccgaaaattcgacctcaatcaaacgctcaactccgtttcgatttcacttccgataaaaaaccgcctctaaacgaacgacgaaccgacgacgaacgcgaacgacgacgataacgaaaacgccgctaccaaaaaacgtacgacaacgcgacgacgacgacgacgacgacgacgacgaaaacgacgacgacgacgacgacgacgacgactaaacctcgaacgcccgcaacccacctctcgaaaacgaactcccgacgctaacaaaactaaaaaaaaaataaaaaaactaataataaaaatacgaaactccaataacgctttctacaaaatacttaa

SEQ ID NO: 19405 - DNA, 804 bp, Artificial Sequence
  chemically treated genomic DNA (Homo sapiens) CpG-island No: 19405
tcgtagttttcgttttgttattcgtttttattgattcgtattttttgcgtaggagtcgcgttgtgtttttggagtttacgcgttatagttcggtcgtggggttgtacgtcgtcgttacgttgcgtttcgagttttcggcggtcggtcgcgttttggtcgtttttagcgttcgtttttttgcgttgcgtcgttttagcgcgggtttttcgttgtttttgtttatttcggtacgttcgttttcggttagatttcgcgttttttatcggtagcgtttcgttttttcgcggggtttcgttcggtagcgttttatttttcgtagcgtttcgttttttcgtagcgtttcgttttttcgtagggtttcgtttcggtagcgtttcgttttttcgtagggtttcgtttcggtagcgtttcgttttttcgtagggtttcgtttcggtagcgtttttttcgtttttttgatcgcgttttttataggtgtgtttgttgttgttcgtcgtgtatttcgtcgtggtcgaggttcgtatttggtatagggaagggcgttggcgcgtgttgcggttcggagtttgggcgcggtggttgttggtggcgttgacggcggttacggtattggtacgtttcgtttagttgggtgtcgttgatcgttagtggattcgtttcgtgcgcggtcgttcgcgtcgttttattagtttcgattaggtggcgtagttgagtttcgtagttcgtggtttggcggtttcgttgttttttttgtttttggttaaggtgagggttgggtcggtgggcgcggggttgggcgtatat

SEQ ID NO: 19406 - DNA, 804 bp, Artificial Sequence
  chemically treated genomic DNA (Homo sapiens) CpG-island No: 19406
atatacgcccaaccccgcgcccaccgacccaaccctcaccttaaccaaaaacaaaaaaaacaacgaaaccgccaaaccacgaactacgaaactcaactacgccacctaatcgaaactaataaaacgacgcgaacgaccgcgcacgaaacgaatccactaacgatcaacgacacccaactaaacgaaacgtaccaataccgtaaccgccgtcaacgccaccaacaaccaccgcgcccaaactccgaaccgcaacacgcgccaacgcccttccctataccaaatacgaacctcgaccacgacgaaatacacgacgaacaacaacaaacacacctataaaaaacgcgatcaaaaaaacgaaaaaaacgctaccgaaacgaaaccctacgaaaaaacgaaacgctaccgaaacgaaaccctacgaaaaaacgaaacgctaccgaaacgaaaccctacgaaaaaacgaaacgctacgaaaaaacgaaacgctacgaaaaataaaacgctaccgaacgaaaccccgcgaaaaaacgaaacgctaccgataaaaaacgcgaaatctaaccgaaaacgaacgtaccgaaataaacaaaaacaacgaaaaacccgcgctaaaacgacgcaacgcaaaaaaacgaacgctaaaaacgaccaaaacgcgaccgaccgccgaaaactcgaaacgcaacgtaacgacgacgtacaaccccacgaccgaactataacgcgtaaactccaaaaacacaacgcgactcctacgcaaaaaatacgaatcaataaaaacgaataacaaaacgaaaactacga

SEQ ID NO: 19407 - DNA, 804 bp, Artificial Sequence
  chemically treated genomic DNA (Homo sapiens) CpG-island No: 19407
gtgtgcgtttagtttcgcgtttatcggtttagtttttattttgattaaaagtaggaagagtagcgaggtcgttaggttacgggttgcggagtttagttgcgttatttggtcgaagttagtgaagcggcgcgggcggtcgcgtacgaaacgggtttattggcggttagcggtatttagttgggcgaggcgtattagtgtcgtggtcgtcgttagcgttattagtagttatcgcgtttaggtttcgagtcgtagtacgcgttagcgtttttttttgtgttaagtacgggtttcggttacggcgaagtgtacggcgaatagtagtaggtatatttgtggggggcgcggttaggagggcgggagggacgttgtcggggcggggttttgcgagggggcgggacgttgtcggggcggggttttacgagggggcgggacgttgtcggggcggggttttgcgagggggcgggacgttgcgagggggcggggcgttgcgaggggtgagacgttgtcgggcggggtttcgcgagggggcgggacgttgtcggtgggaggcgcggggtttggtcggggacgggcgtatcgaggtgagtagaggtagcgagaggttcgcgttgaggcggcgtagcgtaaaggggcggacgttgagggcggttagggcgcggtcggtcgtcgggaattcgaggcgtagcgtgacggcggcgtgtagttttacggtcgggttgtagcgcgtgagttttaggaatatagcgcggtttttgcgtagagggtgcgggttagtaggagcgggtggtagggcgggagttgcgg

SEQ ID NO: 19408 - DNA, 804 bp, Artificial Sequence
  chemically treated genomic DNA (Homo sapiens) CpG-island No: 19408
ccgcaactcccgccctaccacccgctcctactaacccgcaccctctacgcaaaaaccgcgctatattcctaaaactcacgcgctacaacccgaccgtaaaactacacgccgccgtcacgctacgcctcgaattcccgacgaccgaccgcgccctaaccgccctcaacgtccgcccctttacgctacgccgcctcaacgcgaacctctcgctacctctactcacctcgatacgcccgtccccgaccaaaccccgcgcctcccaccgacaacgtcccgccccctcgcgaaaccccgcccgacaacgtctcacccctcgcaacgccccgccccctcgcaacgtcccgccccctcgcaaaaccccgccccgacaacgtcccgccccctcgtaaaaccccgccccgacaacgtcccgccccctcgcaaaaccccgccccgacaacgtccctcccgccctcctaaccgcgccccccacaaatatacctactactattcgccgtacacttcgccgtaaccgaaacccgtacttaacacaaaaaaaaacgctaacgcgtactacgactcgaaacctaaacgcgataactactaataacgctaacgacgaccacgacactaatacgcctcgcccaactaaataccgctaaccgccaataaacccgtttcgtacgcgaccgcccgcgccgcttcactaacttcgaccaaataacgcaactaaactccgcaacccgtaacctaacgacctcgctactcttcctacttttaatcaaaataaaaactaaaccgataaacgcgaaactaaacgcacac

SEQ ID NO: 19409 - DNA, 1264 bp, Artificial Sequence
  chemically treated genomic DNA (Homo sapiens) CpG-island No: 19409
gagggatgcgggagggggagggggaggggggtcggtcggtcgtgggggtggggcgatagtgatattatttcggagtcggtttttaagcggcggtcggtcggggacggggaagagagggatagtcggagcgaggtggcgagtcgttgagttcgtcgcggtttcgagagcggttgtagtcgtcgtcgtcgggaaggagagggcgaggcgcgttcgagtcgtcgtcgtcgtcgttatcgtcgtcgtcgttattatcgttatcggagtcgcgggttagtcgggtagttttcgcgggtttcggtcggggcggggggcgcgggttataggtttttgtttcggtcgtcgtttgtagatcgcgggcgtcgatgtcgttcgcgtttcgttaggatgagtttcgggtcgggcgaggagtcgtcgtagtcgtcgtcgttcgagtcgcgggtaggagtttcgggagtcgtcgtcgtcgtcgtcgtcgttcggtcgggtttcgacgtcgttcgcgcgttttcgggttttcgatatatatgagattttttaggtttatttttaagtgtttcgtggattgtttttgattgcgtcgttcgcgtttcgtatttcgtcgttcgttcgtcgtttcgtttttcggttcggtcgtttttcggttttcggtcggttcgcgttttcggggtttttttcggtgtcgtcggtgtttttcgtttgatcgtcgtttttcgtgaggcgtcgcgatttcggttcggtcgtgcggttcgtcggggttatggcgaagaagagcgtcgagaacggtatttatagcgtgttcggcgacgagaagaagggtttttttatcgcgttcgggttcgacggggtttcggttaagggcgacggtttcgtgggtttggggatattcggcggtcgtttggtcgtgtcgtcgcgcgagatttggacgcgttagatggattttattatgtcgtgcgtgggtttcgtcgtgggtttgggtaacgtgtggcgttttttttatttgtgttataagaacggcggaggtgagttttttcgttcgtcgcggtttttttttttagtaggtcgtcggttttcgttcgattttcggagtcgtcgcggaggggtgaagttcgggtaacgggtggttttcgggtacgcgggggtcggggtcgtttttcgttcgtcgttgtcgttcggtggtcgggtcgggcgtttttatttttttcgtagttatgtgtttggtatggtggggggagggggtcggcgatgttcgcgaggttgtttttta

SEQ ID NO: 19410 - DNA, 1264 bp, Artificial Sequence
  chemically treated genomic DNA (Homo sapiens) CpG-island No: 19410
taaaaaacaacctcgcgaacatcgccgaccccctccccccaccataccaaacacataactacgaaaaaaataaaaacgcccgacccgaccaccgaacgacaacgacgaacgaaaaacgaccccgacccccgcgtacccgaaaaccacccgttacccgaacttcacccctccgcgacgactccgaaaatcgaacgaaaaccgacgacctactaaaaaaaaaaaccgcgacgaacgaaaaaactcacctccgccgttcttataacacaaataaaaaaaacgccacacgttacccaaacccacgacgaaacccacgcacgacataataaaatccatctaacgcgtccaaatctcgcgcgacgacacgaccaaacgaccgccgaatatccccaaacccacgaaaccgtcgcccttaaccgaaaccccgtcgaacccgaacgcgataaaaaaacccttcttctcgtcgccgaacacgctataaataccgttctcgacgctcttcttcgccataaccccgacgaaccgcacgaccgaaccgaaatcgcgacgcctcacgaaaaacgacgatcaaacgaaaaacaccgacgacaccgaaaaaaaccccgaaaacgcgaaccgaccgaaaaccgaaaaacgaccgaaccgaaaaacgaaacgacgaacgaacgacgaaatacgaaacgcgaacgacgcaatcaaaaacaatccacgaaacacttaaaaataaacctaaaaaatctcatatatatcgaaaacccgaaaacgcgcgaacgacgtcgaaacccgaccgaacgacgacgacgacgacgacgactcccgaaactcctacccgcgactcgaacgacgacgactacgacgactcctcgcccgacccgaaactcatcctaacgaaacgcgaacgacatcgacgcccgcgatctacaaacgacgaccgaaacaaaaacctataacccgcgccccccgccccgaccgaaacccgcgaaaactacccgactaacccgcgactccgataacgataataacgacgacgacgataacgacgacgacgacgactcgaacgcgcctcgccctctccttcccgacgacgacgactacaaccgctctcgaaaccgcgacgaactcaacgactcgccacctcgctccgactatccctctcttccccgtccccgaccgaccgccgcttaaaaaccgactccgaaataatatcactatcgccccacccccacgaccgaccgacccccctccccctccccctcccgcatccctc

SEQ ID NO: 19411 - DNA, 1264 bp, Artificial Sequence
  chemically treated genomic DNA (Homo sapiens) CpG-island No: 19411
tggggggtagtttcgcgggtatcgtcggttttttttttttattatgttaggtatatgattgcgaggggggtggaggcgttcggttcggttatcgagcggtagcggcggacgaggggcggtttcgattttcgcgtgttcgggggttattcgttgttcggattttattttttcgcggcggtttcgggggtcgggcgggggtcggcggtttgttgggggaggaggtcgcggcgggcgggggaatttattttcgtcgtttttgtagtataggtaggggaagcgttatacgttgtttaagtttacggcgaagtttacgtacgatatgatgaagtttatttggcgcgtttaggtttcgcgcggcggtacggttaggcggtcgtcgggtgtttttaggtttacggggtcgtcgtttttggtcggggtttcgtcgggttcgggcgcgatgagggggttttttttttcgtcgtcggatacgttatagatgtcgttttcggcgttttttttcgttatggtttcggcgggtcgtacggtcgggtcggggtcgcggcgttttacggggggcggcggttaggcggggggtatcggcggtatcggggagggtttcgagggcgcgggtcggtcgggggtcggggggcggtcgggtcgggggacggggcggcgggcggacggcggggtgcggggcgcgggcggcgtagttagaagtagtttacgaagtatttgaaagtgagtttgaagaattttatgtgtgtcgggggttcgggggcgcgcgggcggcgtcggggttcggtcgggcggcggcggcggcggcggcggttttcgaggtttttgttcgcggttcgggcggcggcggttgcggcggtttttcgttcgattcgagatttattttaacggggcgcgggcgatatcggcgttcgcggtttgtaaacgacggtcggagtaggggtttgtggttcgcgtttttcgtttcggtcggggttcgcggaggttgttcggttggttcgcgatttcggtggcggtggtggcggcggcggcggtggcggcggcggcggcggttcgggcgcgtttcgttttttttttttcggcggcggcggttgtagtcgttttcggggtcgcggcgggtttagcgattcgttatttcgtttcgattatttttttttttttcgttttcggtcggtcgtcgtttaaaaatcgatttcggggtgatgttattatcgttttatttttacggtcggtcggtttttttttttttttttttttcgtatttttt

SEQ ID NO: 19412 - DNA, 1264 bp, Artificial Sequence
  chemically treated genomic DNA (Homo sapiens) CpG-island No: 19412
aaaaaatacgaaaaaaaaaaaaaaaaaaaaaccgaccgaccgtaaaaataaaacgataataacatcaccccgaaatcgatttttaaacgacgaccgaccgaaaacgaaaaaaaaaaaaataatcgaaacgaaataacgaatcgctaaacccgccgcgaccccgaaaacgactacaaccgccgccgccgaaaaaaaaaaaacgaaacgcgcccgaaccgccgccgccgccgccaccgccgccgccgccaccaccgccaccgaaatcgcgaaccaaccgaacaacctccgcgaaccccgaccgaaacgaaaaacgcgaaccacaaacccctactccgaccgtcgtttacaaaccgcgaacgccgatatcgcccgcgccccgttaaaataaatctcgaatcgaacgaaaaaccgccgcaaccgccgccgcccgaaccgcgaacaaaaacctcgaaaaccgccgccgccgccgccgccgcccgaccgaaccccgacgccgcccgcgcgcccccgaacccccgacacacataaaattcttcaaactcactttcaaatacttcgtaaactacttctaactacgccgcccgcgccccgcaccccgccgtccgcccgccgccccgtcccccgacccgaccgccccccgacccccgaccgacccgcgccctcgaaaccctccccgataccgccgataccccccgcctaaccgccgccccccgtaaaacgccgcgaccccgacccgaccgtacgacccgccgaaaccataacgaaaaaaaacgccgaaaacgacatctataacgtatccgacgacgaaaaaaaaaaccccctcatcgcgcccgaacccgacgaaaccccgaccaaaaacgacgaccccgtaaacctaaaaacacccgacgaccgcctaaccgtaccgccgcgcgaaacctaaacgcgccaaataaacttcatcatatcgtacgtaaacttcgccgtaaacttaaacaacgtataacgcttcccctacctatactacaaaaacgacgaaaataaattcccccgcccgccgcgacctcctcccccaacaaaccgccgacccccgcccgacccccgaaaccgccgcgaaaaaataaaatccgaacaacgaataacccccgaacacgcgaaaatcgaaaccgcccctcgtccgccgctaccgctcgataaccgaaccgaacgcctccacccccctcgcaatcatatacctaacataataaaaaaaaaaaaccgacgatacccgcgaaactacccccca

SEQ ID NO: 19413 - DNA, 963 bp, Artificial Sequence
  chemically treated genomic DNA (Homo sapiens) CpG-island No: 19413
cggttagtcgtgggggtggggcgatagtgatattatttcggagtcggtttttaagcggttgtcggtcgggaatcgggaagagaggaatagtcggaacgcggtggcgagtcgttgagttcgtcgcggtttcgagagcggttgtagtcgtcgtcgtttagaaggagagggcgaggcgcgtttgagtcgtcgtcgtcgttatcggagtttcgggtgagtcgggtagtcgtcgcgggtttcggtcggggtcgggggcgcgggttataggtttttgttttagtcgtcgtttgtagattgcgagcgtcgatatcgttcgtgtttcgttaggttgagtttcgggtcggtcgaggagtcgtggtagtcgttatcgttcgagtcgcgggtaagagttttcggaatcgttgtcgcggacgtttggtcgggtttcgtcgacgttcgcgcgttttcgggtttttgatatataggagattttttaggtttatttttaagtgtttcgtggattgtttttgattgcgtcgtttgtgattcgtatttcgtcgttttttcgtcgtttcgtttttcggttcggtcgtttttcggttttcggtcggttcgcgttttcggggtttttttcggtgtcgtcggtgtttcgcgtttgatcgtagtttttcgtagggtgtcgcgattttagttcggtcgtgaggttcgtaggggttatggcgaagaagagcgtcgagaacggtatttgtagcgtgttcggcgattagaagaagggtttttttatcgcgttcgggttcgacggggttcgggttaagggcgacggtttcgcgggtttggggatattcggcggcggtttggtcgtgtcgtcgcgcgcgatagatttggacgcgttagatggattttattatgtcgtgtgtgggttttatcgtgggtttgggtaacgtgtggcgttttttttatttgtgttataagaatggcggaggtgag

SEQ ID NO: 19414 - DNA, 963 bp, Artificial Sequence
  chemically treated genomic DNA (Homo sapiens) CpG-island No: 19414
ctcacctccgccattcttataacacaaataaaaaaaacgccacacgttacccaaacccacgataaaacccacacacgacataataaaatccatctaacgcgtccaaatctatcgcgcgcgacgacacgaccaaaccgccgccgaatatccccaaacccgcgaaaccgtcgcccttaacccgaaccccgtcgaacccgaacgcgataaaaaaacccttcttctaatcgccgaacacgctacaaataccgttctcgacgctcttcttcgccataacccctacgaacctcacgaccgaactaaaatcgcgacaccctacgaaaaactacgatcaaacgcgaaacaccgacgacaccgaaaaaaaccccgaaaacgcgaaccgaccgaaaaccgaaaaacgaccgaaccgaaaaacgaaacgacgaaaaaacgacgaaatacgaatcacaaacgacgcaatcaaaaacaatccacgaaacacttaaaaataaacctaaaaaatctcctatatatcaaaaacccgaaaacgcgcgaacgtcgacgaaacccgaccaaacgtccgcgacaacgattccgaaaactcttacccgcgactcgaacgataacgactaccacgactcctcgaccgacccgaaactcaacctaacgaaacacgaacgatatcgacgctcgcaatctacaaacgacgactaaaacaaaaacctataacccgcgcccccgaccccgaccgaaacccgcgacgactacccgactcacccgaaactccgataacgacgacgacgactcaaacgcgcctcgccctctccttctaaacgacgacgactacaaccgctctcgaaaccgcgacgaactcaacgactcgccaccgcgttccgactattcctctcttcccgattcccgaccgacaaccgcttaaaaaccgactccgaaataatatcactatcgccccacccccacgactaaccg

SEQ ID NO: 19415 - DNA, 963 bp, Artificial Sequence
  chemically treated genomic DNA (Homo sapiens) CpG-island No: 19415
tttattttcgttatttttgtagtataggtaggggaagcgttatacgttgtttaggtttacggtgaagtttatatacgatatgatgaagtttatttggcgcgtttaggtttatcgcgcgcggcggtacggttaggtcgtcgtcgggtgtttttaggttcgcggggtcgtcgtttttggttcgggtttcgtcgggttcgggcgcgatgaggggattttttttttggtcgtcggatacgttatagatgtcgttttcggcgttttttttcgttatggtttttgcgggttttacggtcgggttggggtcgcggtattttgcggggggttgcggttaggcgcggggtatcggcggtatcggggagggtttcgagggcgcggatcggtcgggggtcggggggcggtcgggtcgggggacggggcggcgggagagcggcggggtgcgggttataggcggcgtagttagaagtagtttacgaagtatttgaaagtgagtttgaagaattttttgtgtgttaggggttcgggggcgcgcgggcgtcggcggggttcggttaggcgttcgcggtagcggtttcggaggtttttgttcgcggttcgggcggtggcggttgttacggtttttcggtcgattcgaggtttagtttagcggggtacgggcgatatcggcgttcgtagtttgtaagcggcggttggagtaggggtttgtggttcgcgttttcggtttcggtcggggttcgcggcggttgttcggtttattcgagatttcggtggcggcggcggcggtttaggcgcgtttcgttttttttttttgggcggcggcggttgtagtcgttttcggggtcgcggcgggtttagcgattcgttatcgcgtttcgattgttttttttttttcggttttcggtcggtagtcgtttaaaaatcgatttcggggtgatgttattatcgttttatttttacggttggtcg

SEQ ID NO: 19416 - DNA, 963 bp, Artificial Sequence
  chemically treated genomic DNA (Homo sapiens) CpG-island No: 19416
cgaccaaccgtaaaaataaaacgataataacatcaccccgaaatcgatttttaaacgactaccgaccgaaaaccgaaaaaaaaaaaacaatcgaaacgcgataacgaatcgctaaacccgccgcgaccccgaaaacgactacaaccgccgccgcccaaaaaaaaaaaacgaaacgcgcctaaaccgccgccgccgccaccgaaatctcgaataaaccgaacaaccgccgcgaaccccgaccgaaaccgaaaacgcgaaccacaaacccctactccaaccgccgcttacaaactacgaacgccgatatcgcccgtaccccgctaaactaaacctcgaatcgaccgaaaaaccgtaacaaccgccaccgcccgaaccgcgaacaaaaacctccgaaaccgctaccgcgaacgcctaaccgaaccccgccgacgcccgcgcgcccccgaacccctaacacacaaaaaattcttcaaactcactttcaaatacttcgtaaactacttctaactacgccgcctataacccgcaccccgccgctctcccgccgccccgtcccccgacccgaccgccccccgacccccgaccgatccgcgccctcgaaaccctccccgataccgccgataccccgcgcctaaccgcaaccccccgcaaaataccgcgaccccaacccgaccgtaaaacccgcaaaaaccataacgaaaaaaaacgccgaaaacgacatctataacgtatccgacgaccaaaaaaaaaatcccctcatcgcgcccgaacccgacgaaacccgaaccaaaaacgacgaccccgcgaacctaaaaacacccgacgacgacctaaccgtaccgccgcgcgcgataaacctaaacgcgccaaataaacttcatcatatcgtatataaacttcaccgtaaacctaaacaacgtataacgcttcccctacctatactacaaaaataacgaaaataaa

SEQ ID NO: 19417 - DNA, 1413 bp, Artificial Sequence
  chemically treated genomic DNA (Homo sapiens) CpG-island No: 19417
cggtttcgcgagcgtggatcgtttcgtggttatgagcgggaagaattacgggttttcgttaggggttgggatggatttcgcgggcgggaggcggagggtattcggtttattttagcggaggatatcgcgtgggttcgttgagataacgtttcgcggtgatggattttatgattttcggagtagagttttggttgcgttgtatcgcgggagggaggggttgcgtttattgcggggttacgagagggaggggtcggggtcggggtcggggtcggggtcggggtcggggtcggggtcggggtcggggcgggataggaattcgcgtaagcgcggaaatgtttacggtcgcgttttttcgcgcgtatcgcggcgatattcgggtcgttttcggaaggtacggacgtcgcgtcgcgttttcggggcgttttatttgcgtttacggtcgacgtttcggtagcggcgggtaggtgttacgatttttggacgtttgtcgttttttttcgggaatggaacgtttagagaagcgtaggtttatatttaaaatataaggcggtattgttgcgtgtgtatcggcgattttgcggttagcgttttgggtttcgtttcgggaacgtttaggagtttgagagcgtcgcgttatattcggtagggtcgtagcggcgcgtacgcgacggggtgtcgtttattgggtagtaggagcgttagttaagggcgaggggcgggaatttcgtgtaatttgagtatggttattggcgaggataggcgaagaggaggacggataggcggggttgggcggggtttttcgtgggcgtttggagtttattaggagcgatcgaagcggaggcggggagcgaggtagttgtgggtttcggcgggcggagattagggttgtttttttacgtttcgttttcgtttcggtatcgtttttcgcgtttgtaagttttgggtcggttttgcggggtatgcgtcgagttttttttttttgtagatcggtggttattgttttttttcggggacgaggcggataggcgtcgtttgagattagggttcgggaagtttcgtgagtcgttttcgtttcggcgtcgtcgaggggtcgtttcgttttttttattttattgtgttgcgaaagtgtttcggggcgcgtttggggggtcgtggggaagtagggtcgcgtttattcggtagcgtttagggagaggtgggtagagcggggcgggcggtcgttttgggggaagtggcgtttggaggtgtttgtgtattatttcgcggtggcgcgcggtggggtaataaagtttttttcgttttttgatagcggcggtcgtcggggagggaattttgttttgttgcgggcggtcgtgggttggggcgttttttggtttgattgttttttgggggaggtaggaaaggcgagtttcg

SEQ ID NO: 19418 - DNA, 1413 bp, Artificial Sequence
  chemically treated genomic DNA (Homo sapiens) CpG-island No: 19418
cgaaactcgcctttcctacctcccccaaaaaacaatcaaaccaaaaaacgccccaacccacgaccgcccgcaacaaaacaaaattccctccccgacgaccgccgctatcaaaaaacgaaaaaaactttattaccccaccgcgcgccaccgcgaaataatacacaaacacctccaaacgccacttcccccaaaacgaccgcccgccccgctctacccacctctccctaaacgctaccgaataaacgcgaccctacttccccacgaccccccaaacgcgccccgaaacactttcgcaacacaataaaataaaaaaaacgaaacgacccctcgacgacgccgaaacgaaaacgactcacgaaacttcccgaaccctaatctcaaacgacgcctatccgcctcgtccccgaaaaaaaacaataaccaccgatctacaaaaaaaaaaaactcgacgcataccccgcaaaaccgacccaaaacttacaaacgcgaaaaacgataccgaaacgaaaacgaaacgtaaaaaaacaaccctaatctccgcccgccgaaacccacaactacctcgctccccgcctccgcttcgatcgctcctaataaactccaaacgcccacgaaaaaccccgcccaaccccgcctatccgtcctcctcttcgcctatcctcgccaataaccatactcaaattacacgaaattcccgcccctcgcccttaactaacgctcctactacccaataaacgacaccccgtcgcgtacgcgccgctacgaccctaccgaatataacgcgacgctctcaaactcctaaacgttcccgaaacgaaacccaaaacgctaaccgcaaaatcgccgatacacacgcaacaataccgccttatattttaaatataaacctacgcttctctaaacgttccattcccgaaaaaaaacgacaaacgtccaaaaatcgtaacacctacccgccgctaccgaaacgtcgaccgtaaacgcaaataaaacgccccgaaaacgcgacgcgacgtccgtaccttccgaaaacgacccgaatatcgccgcgatacgcgcgaaaaaacgcgaccgtaaacatttccgcgcttacgcgaattcctatcccgccccgaccccgaccccgaccccgaccccgaccccgaccccgaccccgaccccgacccctccctctcgtaaccccgcaataaacgcaacccctccctcccgcgatacaacgcaaccaaaactctactccgaaaatcataaaatccatcaccgcgaaacgttatctcaacgaacccacgcgatatcctccgctaaaataaaccgaataccctccgcctcccgcccgcgaaatccatcccaacccctaacgaaaacccgtaattcttcccgctcataaccacgaaacgatccacgctcgcgaaaccg

SEQ ID NO: 19419 - DNA, 1413 bp, Artificial Sequence
  chemically treated genomic DNA (Homo sapiens) CpG-island No: 19419
cggggttcgttttttttattttttttaggagatagttaggttaggaagcgttttagtttacgatcgttcgtagtagagtaggatttttttttcggcggtcgtcgttgttaagggacggggaagattttgttattttatcgcgcgttatcgcggaatggtgtatagatatttttagacgttattttttttaagacggtcgttcgtttcgttttgtttatttttttttggacgttgtcgggtgggcgcggttttgtttttttacgattttttagacgcgtttcgaggtattttcgtagtatagtggagtgggaagggcggggcggtttttcgacggcgtcgaggcgagagcggtttacggggtttttcgggttttgattttaggcgacgtttgttcgtttcgttttcgggggaagatagtgattatcggtttgtaaaggaaggggattcggcgtatgtttcgtagggtcggtttaggatttgtaggcgcggaaggcggtgtcgaggcgggggcggggcgtggagggatagttttagttttcgttcgtcggggtttatagttgtttcgtttttcgttttcgtttcggtcgtttttggtaagttttaggcgtttacgggaagtttcgtttagtttcgtttattcgttttttttttcgtttgttttcgttaatgattatgtttagattgtacggaattttcgtttttcgtttttgattgacgtttttgttgtttagtggacgatatttcgtcgcgtgcgcgtcgttgcggttttgtcgggtgtggcgcggcgtttttaggtttttaggcgttttcggggcgagatttagggcgttggtcgtagagtcgtcggtgtatacgtaatagtgtcgttttgtgttttgggtgtggatttgcgtttttttaagcgttttattttcgagaaggggcgataaacgtttagaggtcgtggtatttgttcgtcgttgtcggggcgtcggtcgtgggcgtaagtgaagcgtttcgggagcgcggcgcgacgttcgtgtttttcgagggcggttcgggtgtcgtcgcggtgcgcgcgggagggcgcggtcgtgggtattttcgcgtttgcgcgggtttttgtttcgtttcggtttcggtttcggtttcggtttcggtttcggtttcggtttcggtttcggtttttttttttcgtggtttcgtagtagacgtagtttttttttttcgcggtgtagcgtagttagggttttgtttcgggagttatggagtttattatcgcggagcgttattttagcggatttacgcggtgtttttcgttggggtgggtcgagtatttttcgtttttcgttcgcgagatttattttagtttttggcgggggttcgtggtttttttcgtttatggttacggaacggtttacgttcgcggagtcg

SEQ ID NO: 19420 - DNA, 1413 bp, Artificial Sequence
  chemically treated genomic DNA (Homo sapiens) CpG-island No: 19420
cgactccgcgaacgtaaaccgttccgtaaccataaacgaaaaaaaccacgaacccccgccaaaaactaaaataaatctcgcgaacgaaaaacgaaaaatactcgacccaccccaacgaaaaacaccgcgtaaatccgctaaaataacgctccgcgataataaactccataactcccgaaacaaaaccctaactacgctacaccgcgaaaaaaaaaaactacgtctactacgaaaccacgaaaaaaaaaaaccgaaaccgaaaccgaaaccgaaaccgaaaccgaaaccgaaaccgaaaccgaaacgaaacaaaaacccgcgcaaacgcgaaaatacccacgaccgcgccctcccgcgcgcaccgcgacgacacccgaaccgccctcgaaaaacacgaacgtcgcgccgcgctcccgaaacgcttcacttacgcccacgaccgacgccccgacaacgacgaacaaataccacgacctctaaacgtttatcgccccttctcgaaaataaaacgcttaaaaaaacgcaaatccacacccaaaacacaaaacgacactattacgtatacaccgacgactctacgaccaacgccctaaatctcgccccgaaaacgcctaaaaacctaaaaacgccgcgccacacccgacaaaaccgcaacgacgcgcacgcgacgaaatatcgtccactaaacaacaaaaacgtcaatcaaaaacgaaaaacgaaaattccgtacaatctaaacataatcattaacgaaaacaaacgaaaaaaaaaacgaataaacgaaactaaacgaaacttcccgtaaacgcctaaaacttaccaaaaacgaccgaaacgaaaacgaaaaacgaaacaactataaaccccgacgaacgaaaactaaaactatccctccacgccccgcccccgcctcgacaccgccttccgcgcctacaaatcctaaaccgaccctacgaaacatacgccgaatccccttcctttacaaaccgataatcactatcttcccccgaaaacgaaacgaacaaacgtcgcctaaaatcaaaacccgaaaaaccccgtaaaccgctctcgcctcgacgccgtcgaaaaaccgccccgcccttcccactccactatactacgaaaatacctcgaaacgcgtctaaaaaatcgtaaaaaaacaaaaccgcgcccacccgacaacgtccaaaaaaaaataaacaaaacgaaacgaacgaccgtcttaaaaaaaataacgtctaaaaatatctatacaccattccgcgataacgcgcgataaaataacaaaatcttccccgtcccttaacaacgacgaccgccgaaaaaaaaatcctactctactacgaacgatcgtaaactaaaacgcttcctaacctaactatctcctaaaaaaaataaaaaaaacgaaccccg

SEQ ID NO: 19421 - DNA, 894 bp, Artificial Sequence
  chemically treated genomic DNA (Homo sapiens) CpG-island No: 19421
cggaggcgcggttgcggaggatgtgagtttagtttgggcgtcggttagtcggggcgtagcgggcgggggcgcgtacggttcgtacgttcggtcggttagttagttagttcgcgcgtttttgttttgtaggttcgcgtggagtagagtagtcggaggtttcgggagttgcgttgcggttcggaagggggtggtttggaggggttcgttcggggagatggaaggacgtacggagttttcgttttcgttcgttcggcgtttcggggcgttttttatcgatggatattagtttgatgttttcgcggtttaggaattcgagcgttatcgatacgtttttaagttgtatttggcggaaagtgggtcgttggttgtgtttgcggtgtatttttttttggttgagtatttttaatagcgcgataagtcgtagttcgtcgtttaggttcgtttgtaggttggcgatgcgtttgtttacgtattttaggtgttcgttgtattagcgcgtgaaagtgttttgttggatttttttttacggcgcgtttttcgttaggtttttttcggtggtcggtatttcggcgtttcgcgtgtcgacgtcgtcgttcggagtcgcgtttgttgcgttttggttcgttcgagagtgggagttatttattttgaggcgcgagaagtcgggggggcggtgttgtagtttcggcgaggggacggttttttaattaaagtcgtaggtatttaggcgcgcgggaggcgaggtagggagtagaggttgcgttgcggagagagcgagttttttaaatgcgggaggagggcggggttagagggcgggttttttgcggggaggggtcgtggggtggggtttcgagggcgcgtttgttttatttcgtttcgttcgttggaatgttt

SEQ ID NO: 19422 - DNA, 894 bp, Artificial Sequence
  chemically treated genomic DNA (Homo sapiens) CpG-island No: 19422
aaacattccaacgaacgaaacgaaataaaacaaacgcgccctcgaaaccccaccccacgacccctccccgcaaaaaacccgccctctaaccccgccctcctcccgcatttaaaaaactcgctctctccgcaacgcaacctctactccctacctcgcctcccgcgcgcctaaatacctacgactttaattaaaaaaccgtcccctcgccgaaactacaacaccgcccccccgacttctcgcgcctcaaaataaataactcccactctcgaacgaaccaaaacgcaacaaacgcgactccgaacgacgacgtcgacacgcgaaacgccgaaataccgaccaccgaaaaaaacctaacgaaaaacgcgccgtaaaaaaaaatccaacaaaacactttcacgcgctaatacaacgaacacctaaaatacgtaaacaaacgcatcgccaacctacaaacgaacctaaacgacgaactacgacttatcgcgctattaaaaatactcaaccaaaaaaaaatacaccgcaaacacaaccaacgacccactttccgccaaatacaacttaaaaacgtatcgataacgctcgaattcctaaaccgcgaaaacatcaaactaatatccatcgataaaaaacgccccgaaacgccgaacgaacgaaaacgaaaactccgtacgtccttccatctccccgaacgaacccctccaaaccacccccttccgaaccgcaacgcaactcccgaaacctccgactactctactccacgcgaacctacaaaacaaaaacgcgcgaactaactaactaaccgaccgaacgtacgaaccgtacgcgcccccgcccgctacgccccgactaaccgacgcccaaactaaactcacatcctccgcaaccgcgcctccg

SEQ ID NO: 19423 - DNA, 894 bp, Artificial Sequence
  chemically treated genomic DNA (Homo sapiens) CpG-island No: 19423
gggtattttaacgggcggggcggggtggggtaggcgcgttttcgaagttttattttacggttttttttcgtaggaggttcgttttttggtttcgtttttttttcgtatttaaagggttcgtttttttcgtagcgtaatttttgttttttgtttcgtttttcgcgcgtttaggtgtttgcgattttaattaaagggtcgttttttcgtcgaggttgtagtatcgttttttcggtttttcgcgttttaaaatgagtagtttttattttcgggcgggttagagcgtagtaggcgcggtttcgggcggcggcgtcgatacgcgggacgtcgagatgtcggttatcgagaaggatttggcggaggacgcgtcgtggaagaagatttagtagaatatttttacgcgttggtgtaacgagtatttgaagtgcgtgagtaagcgtatcgttaatttgtagacggatttgagcgacgggttgcggtttatcgcgttgttggaggtgtttagttagaagaagatgtatcgtaagtataattagcggtttatttttcgttaaatgtagtttgagaacgtgtcggtggcgttcgagtttttggatcgcgagagtattaaattggtgtttatcggtgagggacgtttcgaagcgtcgggcgggcgggggcggggatttcgtgcgtttttttattttttcgggcggatttttttaaattattttttttcgggtcgtagcgtaattttcgaggttttcggttgttttgttttacgcgggtttgtagaataaaggcgcgcgggttggttggttggtcggtcgggcgtgcgaatcgtacgcgttttcgttcgttgcgtttcggttggtcggcgtttaggttgaatttatatttttcgtagtcgcgttttcg

SEQ ID NO: 19424 - DNA, 894 bp, Artificial Sequence
  chemically treated genomic DNA (Homo sapiens) CpG-island No: 19424
cgaaaacgcgactacgaaaaatataaattcaacctaaacgccgaccaaccgaaacgcaacgaacgaaaacgcgtacgattcgcacgcccgaccgaccaaccaaccaacccgcgcgcctttattctacaaacccgcgtaaaacaaaacaaccgaaaacctcgaaaattacgctacgacccgaaaaaaaataatttaaaaaaatccgcccgaaaaaataaaaaaacgcacgaaatccccgcccccgcccgcccgacgcttcgaaacgtccctcaccgataaacaccaatttaatactctcgcgatccaaaaactcgaacgccaccgacacgttctcaaactacatttaacgaaaaataaaccgctaattatacttacgatacatcttcttctaactaaacacctccaacaacgcgataaaccgcaacccgtcgctcaaatccgtctacaaattaacgatacgcttactcacgcacttcaaatactcgttacaccaacgcgtaaaaatattctactaaatcttcttccacgacgcgtcctccgccaaatccttctcgataaccgacatctcgacgtcccgcgtatcgacgccgccgcccgaaaccgcgcctactacgctctaacccgcccgaaaataaaaactactcattttaaaacgcgaaaaaccgaaaaaacgatactacaacctcgacgaaaaaacgaccctttaattaaaatcgcaaacacctaaacgcgcgaaaaacgaaacaaaaaacaaaaattacgctacgaaaaaaacgaaccctttaaatacgaaaaaaaaacgaaaccaaaaaacgaacctcctacgaaaaaaaaccgtaaaataaaacttcgaaaacgcgcctaccccaccccgccccgcccgttaaaataccc

SEQ ID NO: 19425 - DNA, 520 bp, Artificial Sequence
  chemically treated genomic DNA (Homo sapiens) CpG-island No: 19425
ttgcgtttttcggtttttttgttcgttttttttaatttcgttttcggtcgacgaggagcgcggcgattttacggcgcgaagtcgggtcgcggagattttatttgttgtttttgagagcgatcggtgatcgatgatcgcggggtggcgttcggatcgttttcgcgttcgcgttcgcgttaggcgtttcggggattttgtcggcgttcgttgcgcgcgacgcgtttttacgcgaatgggtcgtcgtcgttcgtttttttgttggtcgtattttcgtttcgcgttcgtttcgcgttcggttcggttcggcgagaaagttttaattggtaaaattgtttaggagttcgggacgggtgcgtggggggcgggggtgcgggggtacgtcgtgagttttagcgattcgtcgtcggcgacgtcgtttttcgagatgagtttatcgtcggcgagggtcgttaggttttgggggagggagggtttcgtgggggagtcgtttttagcgtttatagggattgtagggttcgtg

SEQ ID NO: 19426 - DNA, 520 bp, Artificial Sequence
  chemically treated genomic DNA (Homo sapiens) CpG-island No: 19426
cacgaaccctacaatccctataaacgctaaaaacgactcccccacgaaaccctccctcccccaaaacctaacgaccctcgccgacgataaactcatctcgaaaaacgacgtcgccgacgacgaatcgctaaaactcacgacgtacccccgcacccccgccccccacgcacccgtcccgaactcctaaacaattttaccaattaaaactttctcgccgaaccgaaccgaacgcgaaacgaacgcgaaacgaaaatacgaccaacaaaaaaacgaacgacgacgacccattcgcgtaaaaacgcgtcgcgcgcaacgaacgccgacaaaatccccgaaacgcctaacgcgaacgcgaacgcgaaaacgatccgaacgccaccccgcgatcatcgatcaccgatcgctctcaaaaacaacaaataaaatctccgcgacccgacttcgcgccgtaaaatcgccgcgctcctcgtcgaccgaaaacgaaattaaaaaaaacgaacaaaaaaaccgaaaaacgcaa

SEQ ID NO: 19427 - DNA, 520 bp, Artificial Sequence
  chemically treated genomic DNA (Homo sapiens) CpG-island No: 19427
tacgagttttgtagtttttgtgggcgttggaggcgatttttttacgaagtttttttttttttagggtttggcggttttcgtcggcggtgagtttatttcggggggcggcgtcgtcggcggcgggtcgttggagtttacggcgtgttttcgtattttcgttttttacgtattcgtttcgggtttttgggtaattttattaattaaggttttttcgtcgggtcgggtcgggcgcggggcgggcgcggggcgggggtgcggttaataagaaggcgggcggcggcggtttattcgcgtggaggcgcgtcgcgcgtagcggacgtcgatagaattttcgaggcgtttggcgcgggcgcgggcgcgaaggcgattcgggcgttatttcgcggttatcggttatcggtcgtttttaggaatagtaggtgaggttttcgcggttcggtttcgcgtcgtagggtcgtcgcgtttttcgtcggtcgggggcggggttggagaaggcgggtagagaggtcggaaaacgtag

SEQ ID NO: 19428 - DNA, 520 bp, Artificial Sequence
  chemically treated genomic DNA (Homo sapiens) CpG-island No: 19428
ctacgttttccgacctctctacccgccttctccaaccccgcccccgaccgacgaaaaacgcgacgaccctacgacgcgaaaccgaaccgcgaaaacctcacctactattcctaaaaacgaccgataaccgataaccgcgaaataacgcccgaatcgccttcgcgcccgcgcccgcgccaaacgcctcgaaaattctatcgacgtccgctacgcgcgacgcgcctccacgcgaataaaccgccgccgcccgccttcttattaaccgcacccccgccccgcgcccgccccgcgcccgacccgacccgacgaaaaaaccttaattaataaaattacccaaaaacccgaaacgaatacgtaaaaaacgaaaatacgaaaacacgccgtaaactccaacgacccgccgccgacgacgccgccccccgaaataaactcaccgccgacgaaaaccgccaaaccctaaaaaaaaaaaaacttcgtaaaaaaatcgcctccaacgcccacaaaaactacaaaactcgta

SEQ ID NO: 19429 - DNA, 1314 bp, Artificial Sequence
  chemically treated genomic DNA (Homo sapiens) CpG-island No: 19429
aagcgtcgatttcgttcgttcgtacgtttcgggtttttcgcgcgtaggtttcgttttttttatttcgtcgtacgttatagggtgacgtttgggtttttagtcgtatcgttttgattttcgcgcgggtttcgttttttgtcgttagttaatttgtgcgtttgtgatttttgggttcgtagtttcgtttgtttttatagcgatatcggtttgtattgttttgattttcgcgcgggtttcgttttttacgtcgttagttaatttatgtattagtggcgttcgggttcgtagtatcgttcgtttttatcgcgagattttttgtttcgcgttcgcgcgggtttttttttttttatcgttagttaattttcgttttgtgacgtatgggttcgcggtttcgttcgtttttatcgcgagattttttgtttcgcgttcgcgcgggtttcgttttttttattattagttaattttcgtgtttgtgatatatgggtttgcggtttcgttcgtttttatcgcgagatcggtttttatcgttttgattttcgggcgggtttcgtttttttcgtcgttagttaattttcgcgttgatgacgtttgggttcgcggttttagttttttagtttttagggtacggtcggtttgtgtcggttgttttcgcggttaggtttcgtttcgcgtagcgcgcgtagtttgcggagttagcggtcgtgacgcgataacgattcggttgtgacgcgataacgattcggttgtgacgcgagcgcggtcgttttcgatgcgttcgtgtcgttttcgtcgtgtttttcggtagtcgttgttcggtcggttttggtaggttcgggtcgtcgttaggttttcgtttgagttcgtattcgttatggataattacgtagatttttcggatatcgagttgattattttgttgcgtcggtataatatttcgtacgggtttgtagtaggtacgcggcggcgggcgggatttttttcgggtttttttttcgtgtttcgtttcgcgattttttcgttgtttttttcgcgcgtttttttcggttcgcggttttgatcgtttcgtgttcggttaggattaattcgtaggttttacgagaagaagattttcgagtacgagatttagaggcggcggttttcgttttttagttcgttcgtcgtttttttttatagtttttttggtgagagtttcgtttgtggggatagtttgggacgcggggaggatggggtcgcgagggtgtggtaggggggtcggtcgagagcggtattggagaaaggggagggaagtttgggggggtaaatagttttgttttt

SEQ ID NO: 19430 - DNA, 1314 bp, Artificial Sequence
  chemically treated genomic DNA (Homo sapiens) CpG-island No: 19430
aaaaacaaaactatttacccccccaaacttccctcccctttctccaataccgctctcgaccgacccccctaccacaccctcgcgaccccatcctccccgcgtcccaaactatccccacaaacgaaactctcaccaaaaaaactataaaaaaaaacgacgaacgaactaaaaaacgaaaaccgccgcctctaaatctcgtactcgaaaatcttcttctcgtaaaacctacgaattaatcctaaccgaacacgaaacgatcaaaaccgcgaaccgaaaaaaacgcgcgaaaaaaacaacgaaaaaatcgcgaaacgaaacacgaaaaaaaaacccgaaaaaaatcccgcccgccgccgcgtacctactacaaacccgtacgaaatattataccgacgcaacaaaataatcaactcgatatccgaaaaatctacgtaattatccataacgaatacgaactcaaacgaaaacctaacgacgacccgaacctaccaaaaccgaccgaacaacgactaccgaaaaacacgacgaaaacgacacgaacgcatcgaaaacgaccgcgctcgcgtcacaaccgaatcgttatcgcgtcacaaccgaatcgttatcgcgtcacgaccgctaactccgcaaactacgcgcgctacgcgaaacgaaacctaaccgcgaaaacaaccgacacaaaccgaccgtaccctaaaaactaaaaaactaaaaccgcgaacccaaacgtcatcaacgcgaaaattaactaacgacgaaaaaaacgaaacccgcccgaaaatcaaaacgataaaaaccgatctcgcgataaaaacgaacgaaaccgcaaacccatatatcacaaacacgaaaattaactaataataaaaaaaacgaaacccgcgcgaacgcgaaacaaaaaatctcgcgataaaaacgaacgaaaccgcgaacccatacgtcacaaaacgaaaattaactaacgataaaaaaaaaaaaacccgcgcgaacgcgaaacaaaaaatctcgcgataaaaacgaacgatactacgaacccgaacgccactaatacataaattaactaacgacgtaaaaaacgaaacccgcgcgaaaatcaaaacaatacaaaccgatatcgctataaaaacaaacgaaactacgaacccaaaaatcacaaacgcacaaattaactaacgacaaaaaacgaaacccgcgcgaaaatcaaaacgatacgactaaaaacccaaacgtcaccctataacgtacgacgaaataaaaaaaacgaaacctacgcgcgaaaaacccgaaacgtacgaacgaacgaaatcgacgctt

SEQ ID NO: 19431 - DNA, 1314 bp, Artificial Sequence
  chemically treated genomic DNA (Homo sapiens) CpG-island No: 19431
ggagatagaattgtttgtttttttagattttttttttttttttttagtgtcgttttcgatcggtttttttgttatattttcgcgattttatttttttcgcgttttaggttgtttttataggcgaggtttttattagagaagttataagaggaggcggcggacgagttggggggcgagagtcgtcgtttttgggtttcgtattcgaagatttttttttcgtaaagtttacgagttgattttggtcggatacggggcggttagggtcgcgggtcggggaaggcgcgcggggagggtagcggggaggtcgcgaggcggagtacgaggagggggttcggaaggggtttcgttcgtcgtcgcgtatttattataggttcgtgcgggatgttgtatcggcgtagtaaggtggttagttcggtattcgaaagatttgcgtagttgtttatggcgggtgcgggtttaggcggaggtttggcggcggttcgggtttattaaaatcggtcgagtaacggttgtcgaggagtacggcgggggcggtacgagcgtatcgggagcggtcgcgttcgcgttatagtcgaatcgttgtcgcgttatagtcgaatcgttgtcgcgttacggtcgttggtttcgtaggttgcgcgcgttgcgcggggcgggatttaatcgcgggagtagtcggtatagatcggtcgtgttttgagagttgggaggttggggtcgcgagtttaaacgttattaacgcgaggattggttagcggcggagagggcggggttcgttcgggagttagggcggtgggaatcggtttcgcgatgggagcgggcggggtcgtaagtttatatgttataagtacggggattggttagtgatggagggggcggggttcgcgcgggcgcggagtaaaaggtttcgcggtgggagcgagcggggtcgcgagtttatacgttataaaacggggattggttagcgatggagggggaggggttcgcgcgggcgcggagtagaaggtttcgcggtgggagcgagcggtattgcgagttcggacgttattaatgtatggattggttagcggcgtagggggcggggttcgcgcgggagttagggtaatgtaaatcggtatcgttgtgggagtaggcggggttgcgggtttaaaagttataaacgtatagattggttagcggtagggggcggggttcgcgcgggagttagggcgatgcggttgggagtttagacgttattttgtggcgtgcggcggggtgagaggggcggggtttgcgcgcgagggattcgggacgtgcgagcgggcgaagtcggcgttt

SEQ ID NO: 19432 - DNA, 1314 bp, Artificial Sequence
  chemically treated genomic DNA (Homo sapiens) CpG-island No: 19432
aaacgccgacttcgcccgctcgcacgtcccgaatccctcgcgcgcaaaccccgcccctctcaccccgccgcacgccacaaaataacgtctaaactcccaaccgcatcgccctaactcccgcgcgaaccccgccccctaccgctaaccaatctatacgtttataacttttaaacccgcaaccccgcctactcccacaacgataccgatttacattaccctaactcccgcgcgaaccccgccccctacgccgctaaccaatccatacattaataacgtccgaactcgcaataccgctcgctcccaccgcgaaaccttctactccgcgcccgcgcgaacccctccccctccatcgctaaccaatccccgttttataacgtataaactcgcgaccccgctcgctcccaccgcgaaaccttttactccgcgcccgcgcgaaccccgccccctccatcactaaccaatccccgtacttataacatataaacttacgaccccgcccgctcccatcgcgaaaccgattcccaccgccctaactcccgaacgaaccccgccctctccgccgctaaccaatcctcgcgttaataacgtttaaactcgcgaccccaacctcccaactctcaaaacacgaccgatctataccgactactcccgcgattaaatcccgccccgcgcaacgcgcgcaacctacgaaaccaacgaccgtaacgcgacaacgattcgactataacgcgacaacgattcgactataacgcgaacgcgaccgctcccgatacgctcgtaccgcccccgccgtactcctcgacaaccgttactcgaccgattttaataaacccgaaccgccgccaaacctccgcctaaacccgcacccgccataaacaactacgcaaatctttcgaataccgaactaaccaccttactacgccgatacaacatcccgcacgaacctataataaatacgcgacgacgaacgaaaccccttccgaaccccctcctcgtactccgcctcgcgacctccccgctaccctccccgcgcgccttccccgacccgcgaccctaaccgccccgtatccgaccaaaatcaactcgtaaactttacgaaaaaaaaatcttcgaatacgaaacccaaaaacgacgactctcgccccccaactcgtccgccgcctcctcttataacttctctaataaaaacctcgcctataaaaacaacctaaaacgcgaaaaaaataaaatcgcgaaaatataacaaaaaaaccgatcgaaaacgacactaaaaaaaaaaaaaaaaaatctaaaaaaacaaacaattctatctcc

SEQ ID NO: 19433 - DNA, 1418 bp, Artificial Sequence
  chemically treated genomic DNA (Homo sapiens) CpG-island No: 19433
tttttcggcggtcgtcgttgttaagggacggggaagattttgttattttatcgcgcgttatcgcggaatggtgtatagatatttttagacgttattttttttaagacggtcgttcgtttcgttttgtttatttttttttggacgttgtcgggtgggcgcggttttgtttttttacgattttttagacgcgtttcgaggtattttcgtagtatagtggagtgggaagggcggggcggtttttcgacggcgtcgaggcgagagcggtttacggggtttttcgggttttgattttaggcgacgtttgttcgtttcgttttcgggggaagatagtgattatcggtttgtaaaggaaggggattcggcgtatgtttcgtagggtcggtttaggattcgtaggcgcggaaggcggtgtcgaggcgggggcggggcgtggagggatagttttagttttcgttcgtcggggtttatagttgtttcgtttttcgttttcgtttcggtcgttttcggtaagttttaggcgtttacgggaagtttcgtttagtttcgtttattcgttttttttttcgtttgttttcgttaatgattatgtttagattgtacggaattttcgtttttcgtttttgattgacgtttttgttgtttagtggacgatatttcgtcgcgtgcgcgtcgttgcggttttgtcgggtgtggcgcggcgtttttaggtttttaggcgttttcggggcgagatttagggcgttggtcgtagagtcgtcggtgtatacgtaatagtgtcgttttgtgttttgggtgtggatttgcgtttttttaagcgttttattttcgagaaggggcgagaaacgtttagaggtcgtggtatttgttcgtcgttgtcggggcgtcggtcgtgggcgtaagtgaaagcgtttcgggagcgcggcgcgacgttcgtgtttttcgagggcggttcgggtgtcgtcgcggtgcgcgcgggagggcgcggtcgtgggtattttcgcgtttgcgcgggtttttgtttcgtttcggtttcggtttcggtttcggtttcggtttcggtttcggtttcggtttcggtttttttttttcgtggtttcgtagtagacgtagtttttttttttcgcggtgtagcgtagttagggttttgtttcgggagttatggagtttattatcgcggagcgttattttagcggatttacgcggtgtttttcgttggggtgggtcgagtatttttcgtttttcgttcgcgagatttattttagtttttggcgggggttcgtggtttttttcgtttatggttacggaacggtttacgttcgcggagtcgtaggttgagtttttgttggtgagggataaggtcgtggtttttcgtggttggtggtttttacggaggagtttgttgggagtacgttcgtgta

SEQ ID NO: 19434 - DNA, 1418 bp, Artificial Sequence
  chemically treated genomic DNA (Homo sapiens) CpG-island No: 19434
tacacgaacgtactcccaacaaactcctccgtaaaaaccaccaaccacgaaaaaccacgaccttatccctcaccaacaaaaactcaacctacgactccgcgaacgtaaaccgttccgtaaccataaacgaaaaaaaccacgaacccccgccaaaaactaaaataaatctcgcgaacgaaaaacgaaaaatactcgacccaccccaacgaaaaacaccgcgtaaatccgctaaaataacgctccgcgataataaactccataactcccgaaacaaaaccctaactacgctacaccgcgaaaaaaaaaaactacgtctactacgaaaccacgaaaaaaaaaaaccgaaaccgaaaccgaaaccgaaaccgaaaccgaaaccgaaaccgaaaccgaaacgaaacaaaaacccgcgcaaacgcgaaaatacccacgaccgcgccctcccgcgcgcaccgcgacgacacccgaaccgccctcgaaaaacacgaacgtcgcgccgcgctcccgaaacgctttcacttacgcccacgaccgacgccccgacaacgacgaacaaataccacgacctctaaacgtttctcgccccttctcgaaaataaaacgcttaaaaaaacgcaaatccacacccaaaacacaaaacgacactattacgtatacaccgacgactctacgaccaacgccctaaatctcgccccgaaaacgcctaaaaacctaaaaacgccgcgccacacccgacaaaaccgcaacgacgcgcacgcgacgaaatatcgtccactaaacaacaaaaacgtcaatcaaaaacgaaaaacgaaaattccgtacaatctaaacataatcattaacgaaaacaaacgaaaaaaaaaacgaataaacgaaactaaacgaaacttcccgtaaacgcctaaaacttaccgaaaacgaccgaaacgaaaacgaaaaacgaaacaactataaaccccgacgaacgaaaactaaaactatccctccacgccccgcccccgcctcgacaccgccttccgcgcctacgaatcctaaaccgaccctacgaaacatacgccgaatccccttcctttacaaaccgataatcactatcttcccccgaaaacgaaacgaacaaacgtcgcctaaaatcaaaacccgaaaaaccccgtaaaccgctctcgcctcgacgccgtcgaaaaaccgccccgcccttcccactccactatactacgaaaatacctcgaaacgcgtctaaaaaatcgtaaaaaaacaaaaccgcgcccacccgacaacgtccaaaaaaaaataaacaaaacgaaacgaacgaccgtcttaaaaaaaataacgtctaaaaatatctatacaccattccgcgataacgcgcgataaaataacaaaatcttccccgtcccttaacaacgacgaccgccgaaaaa

SEQ ID NO: 19435 - DNA, 1418 bp, Artificial Sequence
  chemically treated genomic DNA (Homo sapiens) CpG-island No: 19435
tatacgggcgtgtttttagtaggttttttcgtgagggttattagttacgggaaattacgattttgttttttattagtaaaagtttagtttgcggtttcgcgagcgtggatcgtttcgtggttatgagcgggaagaattacgggttttcgttaggggttgggatggatttcgcgggcgggaggcggagggtattcggtttattttagcggaggatatcgcgtgggttcgttgagataacgtttcgcggtgatggattttatgattttcggagtagagttttggttgcgttgtatcgcgggagggaggggttgcgtttattgcggggttacgagagggaggggtcggggtcggggtcggggtcggggtcggggtcggggtcggggtcggggtcggggcgggataggaattcgcgtaagcgcggaaatgtttacggtcgcgttttttcgcgcgtatcgcggcgatattcgggtcgttttcggaaggtacggacgtcgcgtcgcgttttcggggcgtttttatttgcgtttacggtcgacgtttcggtagcggcgggtaggtgttacgatttttggacgtttttcgttttttttcgggaatggaacgtttagagaagcgtaggtttatatttaaaatataaggcggtattgttgcgtgtgtatcggcgattttgcggttagcgttttgggtttcgtttcgggaacgtttaggagtttgagagcgtcgcgttatattcggtagggtcgtagcggcgcgtacgcgacggggtgtcgtttattgggtagtaggagcgttagttaagggcgaggggcgggaatttcgtgtaatttgagtatggttattggcgaggataggcgaagaggaggacggataggcggggttgggcggggtttttcgtgggcgtttggagtttatcgggagcgatcgaagcggaggcggggagcgaggtagttgtgggtttcggcgggcggagattagggttgtttttttacgtttcgttttcgtttcggtatcgtttttcgcgtttgcgagttttgggtcggttttgcggggtatgcgtcgagttttttttttttgtagatcggtggttattgttttttttcggggacgaggcggataggcgtcgtttgagattagggttcgggaagtttcgtgagtcgttttcgtttcggcgtcgtcgaggggtcgtttcgttttttttattttattgtgttgcgaaagtgtttcggggcgcgtttggggggtcgtggggaagtagggtcgcgtttattcggtagcgtttagggagaggtgggtagagcggggcgggcggtcgttttgggggaagtggcgtttggaggtgtttgtgtattatttcgcggtggcgcgcggtggggtaataaagtttttttcgttttttgatagcggcggtcgtcggggag

SEQ ID NO: 19436 - DNA, 1418 bp, Artificial Sequence
  chemically treated genomic DNA (Homo sapiens) CpG-island No: 19436
ctccccgacgaccgccgctatcaaaaaacgaaaaaaactttattaccccaccgcgcgccaccgcgaaataatacacaaacacctccaaacgccacttcccccaaaacgaccgcccgccccgctctacccacctctccctaaacgctaccgaataaacgcgaccctacttccccacgaccccccaaacgcgccccgaaacactttcgcaacacaataaaataaaaaaaacgaaacgacccctcgacgacgccgaaacgaaaacgactcacgaaacttcccgaaccctaatctcaaacgacgcctatccgcctcgtccccgaaaaaaaacaataaccaccgatctacaaaaaaaaaaaactcgacgcataccccgcaaaaccgacccaaaactcgcaaacgcgaaaaacgataccgaaacgaaaacgaaacgtaaaaaaacaaccctaatctccgcccgccgaaacccacaactacctcgctccccgcctccgcttcgatcgctcccgataaactccaaacgcccacgaaaaaccccgcccaaccccgcctatccgtcctcctcttcgcctatcctcgccaataaccatactcaaattacacgaaattcccgcccctcgcccttaactaacgctcctactacccaataaacgacaccccgtcgcgtacgcgccgctacgaccctaccgaatataacgcgacgctctcaaactcctaaacgttcccgaaacgaaacccaaaacgctaaccgcaaaatcgccgatacacacgcaacaataccgccttatattttaaatataaacctacgcttctctaaacgttccattcccgaaaaaaaacgaaaaacgtccaaaaatcgtaacacctacccgccgctaccgaaacgtcgaccgtaaacgcaaataaaaacgccccgaaaacgcgacgcgacgtccgtaccttccgaaaacgacccgaatatcgccgcgatacgcgcgaaaaaacgcgaccgtaaacatttccgcgcttacgcgaattcctatcccgccccgaccccgaccccgaccccgaccccgaccccgaccccgaccccgaccccgacccctccctctcgtaaccccgcaataaacgcaacccctccctcccgcgatacaacgcaaccaaaactctactccgaaaatcataaaatccatcaccgcgaaacgttatctcaacgaacccacgcgatatcctccgctaaaataaaccgaataccctccgcctcccgcccgcgaaatccatcccaacccctaacgaaaacccgtaattcttcccgctcataaccacgaaacgatccacgctcgcgaaaccgcaaactaaacttttactaataaaaaacaaaatcgtaatttcccgtaactaataaccctcacgaaaaaacctactaaaaacacgcccgtata

SEQ ID NO: 19437 - DNA, 539 bp, Artificial Sequence
  chemically treated genomic DNA (Homo sapiens) CpG-island No: 19437
cgggtttttcgcgattatgtggcgaagttttattcgttagttggtcgttcgcggttttggtattcggttatttttttgatttgcgtatgtgttgggttacgttcgggcgtaaggttaagagcggttgcgtttatggttatgacgtttgatagagcgtttattcgttttcgataggattttatggtttttacgcgcgtagatagatcgtttatataagttatgcgtaggcggaggagcgttttttttttttcggtgtggtgagtaagcgtagttgtcgttttttgcggtgtcgttgttggtttttatattttttaggtttgttttcgtttttcgtttcgattttttttttttcgttgtagttattgaagattttggtgtcgttatgggtcgtcgtttcgttcgttggtgagttttgaattcgtgtatttttattgttgggaaacgggcggggaaagaagtgtttatggttcgttgaaaataattgtggggtggagtttttttcgtgcggcggttttgttttgggaattgattttatgttt

SEQ ID NO: 19438 - DNA, 539 bp, Artificial Sequence
  chemically treated genomic DNA (Homo sapiens) CpG-island No: 19438
aaacataaaatcaattcccaaaacaaaaccgccgcacgaaaaaaactccaccccacaattattttcaacgaaccataaacacttctttccccgcccgtttcccaacaataaaaatacacgaattcaaaactcaccaacgaacgaaacgacgacccataacgacaccaaaatcttcaataactacaacgaaaaaaaaaaaatcgaaacgaaaaacgaaaacaaacctaaaaaatataaaaaccaacaacgacaccgcaaaaaacgacaactacgcttactcaccacaccgaaaaaaaaaaaacgctcctccgcctacgcataacttatataaacgatctatctacgcgcgtaaaaaccataaaatcctatcgaaaacgaataaacgctctatcaaacgtcataaccataaacgcaaccgctcttaaccttacgcccgaacgtaacccaacacatacgcaaatcaaaaaaataaccgaataccaaaaccgcgaacgaccaactaacgaataaaacttcgccacataatcgcgaaaaacccg

SEQ ID NO: 19439 - DNA, 539 bp, Artificial Sequence
  chemically treated genomic DNA (Homo sapiens) CpG-island No: 19439
aaatatagggttagtttttaagatagggtcgtcgtacgggggaggttttattttataattgtttttagcgggttataggtattttttttttcgttcgttttttagtagtgaaagtatacggatttaagatttattaacgggcggggcggcggtttatggcgatattaggatttttagtggttgtaacgaaaaagagagagtcggaacggaagacgagaatagatttaaaaggtgtgagaattagtaacggtatcgtaagagacgataattgcgtttatttattatatcgaagggaaagaggcgttttttcgtttgcgtatggtttatataggcggtttgtttgcgcgcgtaagaattatagagttttgtcgaagacgggtggacgttttgttagacgttatgattatagacgtagtcgtttttggttttgcgttcgggcgtagtttagtatatgcgtagattagagaggtgatcgggtattagggtcgcgggcggttagttgacgaatggggtttcgttatatggtcgcgagaagttcg

SEQ ID NO: 19440 - DNA, 539 bp, Artificial Sequence
  chemically treated genomic DNA (Homo sapiens) CpG-island No: 19440
cgaacttctcgcgaccatataacgaaaccccattcgtcaactaaccgcccgcgaccctaatacccgatcacctctctaatctacgcatatactaaactacgcccgaacgcaaaaccaaaaacgactacgtctataatcataacgtctaacaaaacgtccacccgtcttcgacaaaactctataattcttacgcgcgcaaacaaaccgcctatataaaccatacgcaaacgaaaaaacgcctctttcccttcgatataataaataaacgcaattatcgtctcttacgataccgttactaattctcacaccttttaaatctattctcgtcttccgttccgactctctctttttcgttacaaccactaaaaatcctaatatcgccataaaccgccgccccgcccgttaataaatcttaaatccgtatactttcactactaaaaaacgaacgaaaaaaaaaatacctataacccgctaaaaacaattataaaataaaacctcccccgtacgacgaccctatcttaaaaactaaccctatattt

SEQ ID NO: 19441 - DNA, 504 bp, Artificial Sequence
  chemically treated genomic DNA (Homo sapiens) CpG-island No: 19441
ttcgtcgtttcggggttggtttcgttgtcgttaagcggttcgtgcgcgttttcgatagtcggtcgggttgggtatcggcgtaggttcgtttttcggcggttgtatcgggtcggggtgttagcgttcgttttttcgttttttttcgtttcgtagcgcgtttacggtttgtgatttcggagatcgttttttagtgacgagagagcggggtcgggcgttgtttcggtttgatttgcgaagggatttcggtttagtattttgttgcgtcgcgttttcgttcgttcgtgcgcgggttagttaggggttagtgtgtcgaggcggtagaggtcgtagtttagaggcgttttataggtcggttcggggcgttgggagttcggtcggcggtcgggtggggtggtttttgtacgtgaaagtggtcgtttttcgcggtgtcgtcgtttatttggattttggttagtagcgtcgttatgggtttggtgggtatttatagttgtttttggattagtg

SEQ ID NO: 19442 - DNA, 504 bp, Artificial Sequence
  chemically treated genomic DNA (Homo sapiens) CpG-island No: 19442
cactaatccaaaaacaactataaatacccaccaaacccataacgacgctactaaccaaaatccaaataaacgacgacaccgcgaaaaacgaccactttcacgtacaaaaaccaccccacccgaccgccgaccgaactcccaacgccccgaaccgacctataaaacgcctctaaactacgacctctaccgcctcgacacactaacccctaactaacccgcgcacgaacgaacgaaaacgcgacgcaacaaaatactaaaccgaaatcccttcgcaaatcaaaccgaaacaacgcccgaccccgctctctcgtcactaaaaaacgatctccgaaatcacaaaccgtaaacgcgctacgaaacgaaaaaaaacgaaaaaacgaacgctaacaccccgacccgatacaaccgccgaaaaacgaacctacgccgatacccaacccgaccgactatcgaaaacgcgcacgaaccgcttaacgacaacgaaaccaaccccgaaacgacgaa

SEQ ID NO: 19443 - DNA, 504 bp, Artificial Sequence
  chemically treated genomic DNA (Homo sapiens) CpG-island No: 19443
tattggtttagaagtagttgtaggtgtttattaagtttatgacgacgttgttggttagggtttaggtgagcggcggtatcgcggggaacggttatttttacgtgtagaggttattttattcgatcgtcggtcgggtttttagcgtttcgggtcgatttgtggaacgtttttaggttgcgatttttatcgtttcgatatattggtttttgattggttcgcgtacggacggacgggggcgcggcgtaatagggtattggatcgaggttttttcgtaggttaggtcggagtagcgttcggtttcgttttttcgttattggggagcggttttcgaagttataggtcgtgggcgcgttgcggaacgggaggaaacgggaaagcgggcgttggtatttcggttcggtgtaatcgtcggaaagcgaatttgcgtcggtgtttagttcgatcgattgtcgaaagcgcgtacgggtcgtttgacggtagcgaggttagtttcggggcggcggg

SEQ ID NO: 19444 - DNA, 504 bp, Artificial Sequence
  chemically treated genomic DNA (Homo sapiens) CpG-island No: 19444
cccgccgccccgaaactaacctcgctaccgtcaaacgacccgtacgcgctttcgacaatcgatcgaactaaacaccgacgcaaattcgctttccgacgattacaccgaaccgaaataccaacgcccgctttcccgtttcctcccgttccgcaacgcgcccacgacctataacttcgaaaaccgctccccaataacgaaaaaacgaaaccgaacgctactccgacctaacctacgaaaaaacctcgatccaataccctattacgccgcgcccccgtccgtccgtacgcgaaccaatcaaaaaccaatatatcgaaacgataaaaatcgcaacctaaaaacgttccacaaatcgacccgaaacgctaaaaacccgaccgacgatcgaataaaataacctctacacgtaaaaataaccgttccccgcgataccgccgctcacctaaaccctaaccaacaacgtcgtcataaacttaataaacacctacaactacttctaaaccaata

SEQ ID NO: 19445 - DNA, 513 bp, Artificial Sequence
  chemically treated genomic DNA (Homo sapiens) CpG-island No: 19445
gtttaattatttgcggttttgtcggtcggttcgcgttggggttaatggaggtgcgaggcggggttcgggcgggggtaacggttatttgatttgcggttgtcgaggtcgttgaggtagtggaggttgaggttatgatggcggttatggcgacggttcgagtgcggatggggtcgcggtgcgtttaggcgttttggcgtatgtcgtggttgtcggtgtttttgtcgttggcggcggcggcggcggcggtagcggcggagtagtaggtttcgttggtgttgtggtcgagtgatcggtgagcgggtcggggtgggatgcgttgtggcggttgaggcgttttcgttcgatttcggcgttgttttaggcgaggggtggtgaggttcggaggtggattgttttttgttcgggggttcgtagcgaatttgtcggcgatagagttttagtttatatgcgttttcgtttgatagtattttttttgtgttttgttagggatttgtgggtttttgcggtcgatat

SEQ ID NO: 19446 - DNA, 513 bp, Artificial Sequence
  chemically treated genomic DNA (Homo sapiens) CpG-island No: 19446
atatcgaccgcaaaaacccacaaatccctaacaaaacacaaaaaaaatactatcaaacgaaaacgcatataaactaaaactctatcgccgacaaattcgctacgaacccccgaacaaaaaacaatccacctccgaacctcaccacccctcgcctaaaacaacgccgaaatcgaacgaaaacgcctcaaccgccacaacgcatcccaccccgacccgctcaccgatcactcgaccacaacaccaacgaaacctactactccgccgctaccgccgccgccgccgccgccaacgacaaaaacaccgacaaccacgacatacgccaaaacgcctaaacgcaccgcgaccccatccgcactcgaaccgtcgccataaccgccatcataacctcaacctccactacctcaacgacctcgacaaccgcaaatcaaataaccgttacccccgcccgaaccccgcctcgcacctccattaaccccaacgcgaaccgaccgacaaaaccgcaaataattaaac

SEQ ID NO: 19447 - DNA, 513 bp, Artificial Sequence
  chemically treated genomic DNA (Homo sapiens) CpG-island No: 19447
gtgtcggtcgtaggagtttataagtttttggtagggtatagaagaggtgttgttagacgggggcgtatgtggattggagttttgtcgtcggtagattcgttgcgagttttcgagtaaggaatagtttattttcgggttttattatttttcgtttaggatagcgtcggagtcgggcgagggcgttttagtcgttatagcgtattttatttcggttcgtttatcggttattcgattatagtattagcgggatttgttgtttcgtcgttgtcgtcgtcgtcgtcgtcgttaacgataaaaatatcggtagttacggtatgcgttagagcgtttgggcgtatcgcggttttattcgtattcgagtcgtcgttatggtcgttattatagttttagtttttattgttttagcggtttcgatagtcgtagattaggtgatcgttgttttcgttcgagtttcgtttcgtatttttattggttttagcgcgggtcgatcggtagggtcgtaggtaattggat

SEQ ID NO: 19448 - DNA, 513 bp, Artificial Sequence
  chemically treated genomic DNA (Homo sapiens) CpG-island No: 19448
atccaattacctacgaccctaccgatcgacccgcgctaaaaccaataaaaatacgaaacgaaactcgaacgaaaacaacgatcacctaatctacgactatcgaaaccgctaaaacaataaaaactaaaactataataacgaccataacgacgactcgaatacgaataaaaccgcgatacgcccaaacgctctaacgcataccgtaactaccgatatttttatcgttaacgacgacgacgacgacgacaacgacgaaacaacaaatcccgctaatactataatcgaataaccgataaacgaaccgaaataaaatacgctataacgactaaaacgccctcgcccgactccgacgctatcctaaacgaaaaataataaaacccgaaaataaactattccttactcgaaaactcgcaacgaatctaccgacgacaaaactccaatccacatacgcccccgtctaacaacacctcttctataccctaccaaaaacttataaactcctacgaccgacac

SEQ ID NO: 19449 - DNA, 1280 bp, Artificial Sequence
  chemically treated genomic DNA (Homo sapiens) CpG-island No: 19449
tggttgttttttttttaataaaataaacgcgggtcgttatgcgttgggttttttgtcgtttatttttgcgttgggttttaggcgcgtgttcgtcggagggatgcgggaggatggagtttggcgagggggaggcgaagaggtattcgcggagatcgggaggggttttagtaagttgggttttaatcgtttagggtagggaggggcggtcgggtcgagtttcggtgcgtttcggcgttttaggaggtcgtcgtgataatggtagttttcgcgtcgtgagggggtcgttttaggttgtcgtagcggcgcgcgttcggtcgcggggtcgcgtcgagattttcgggggggtgggcgggggtggggaggtgggcgggcgcgcgcggggcggggcggggcggggcgcggcgggtggggcggggcgcgcgcggttttcgcgacggattttttttgggtcgtagtatcggtcgtcggttcgtttcgttcgtttcgtttcgcgtttttttagattttcggcgagtagcgtcgttcgcggagtcgcgttggtgttgtggttcgggttttggtagttttttcgggaggcgagtcggggaggcggtggtttttgtcggttgcggcggggcgcgggaagaggcgggattttttgacgcggcggaggggtcgggcgacggtcgacgcgtcgttatttttggtttagtgcggtggcggcggcggcggtggcggcggcgattgttgcggtgaaggaggaggaggagtcgagcgggcgttggtatcgaggtttgattatggacgaggaatacgatgtgatcgtgttggggatcggttttatcgtaagtgcggtttcggcgtttttggttttgcgtcgtgttttcgttatttttcgcgatgatgcggtcgtcggtttattttttggttattgttattttttgcgtttcgtttttcgaaaagtcggcgtcgtgtttatttcgttgtttttttagcgacgtcgtttttgttcgttgttatgattttattttttcgaagaggttttttttttggtcgttttttgggttattcgggttcgattttcggcgtttttttattttttttatttttgttcgttggatcggaaaacgtatttttattcggttcgatgtttacgatttcgtttatttatcgtttttatttattacggtatttattcgtcgttcgtatttattgttcgtttagcgttgttttttagcgtttttttttattttgcgttaatttcggtggggatgaagtagaaggatttggggttagggggt

SEQ ID NO: 19450 - DNA, 1280 bp, Artificial Sequence
  chemically treated genomic DNA (Homo sapiens) CpG-island No: 19450
accccctaaccccaaatccttctacttcatccccaccgaaattaacgcaaaataaaaaaaaacgctaaaaaacaacgctaaacgaacaataaatacgaacgacgaataaataccgtaataaataaaaacgataaataaacgaaatcgtaaacatcgaaccgaataaaaatacgttttccgatccaacgaacaaaaataaaaaaaataaaaaaacgccgaaaatcgaacccgaataacccaaaaaacgaccaaaaaaaaaacctcttcgaaaaaataaaatcataacaacgaacaaaaacgacgtcgctaaaaaaacaacgaaataaacacgacgccgacttttcgaaaaacgaaacgcaaaaaataacaataaccaaaaaataaaccgacgaccgcatcatcgcgaaaaataacgaaaacacgacgcaaaaccaaaaacgccgaaaccgcacttacgataaaaccgatccccaacacgatcacatcgtattcctcgtccataatcaaacctcgataccaacgcccgctcgactcctcctcctccttcaccgcaacaatcgccgccgccaccgccgccgccgccaccgcactaaaccaaaaataacgacgcgtcgaccgtcgcccgacccctccgccgcgtcaaaaaatcccgcctcttcccgcgccccgccgcaaccgacaaaaaccaccgcctccccgactcgcctcccgaaaaaactaccaaaacccgaaccacaacaccaacgcgactccgcgaacgacgctactcgccgaaaatctaaaaaaacgcgaaacgaaacgaacgaaacgaaccgacgaccgatactacgacccaaaaaaaatccgtcgcgaaaaccgcgcgcgccccgccccacccgccgcgccccgccccgccccgccccgcgcgcgcccgcccacctccccacccccgcccacccccccgaaaatctcgacgcgaccccgcgaccgaacgcgcgccgctacgacaacctaaaacgaccccctcacgacgcgaaaactaccattatcacgacgacctcctaaaacgccgaaacgcaccgaaactcgacccgaccgcccctccctaccctaaacgattaaaacccaacttactaaaacccctcccgatctccgcgaatacctcttcgcctccccctcgccaaactccatcctcccgcatccctccgacgaacacgcgcctaaaacccaacgcaaaaataaacgacaaaaaacccaacgcataacgacccgcgtttattttattaaaaaaaaaacaacca

SEQ ID NO: 19451 - DNA, 1280 bp, Artificial Sequence
  chemically treated genomic DNA (Homo sapiens) CpG-island No: 19451
gttttttgattttaggtttttttattttatttttatcgggattagcgtaagatgggaagggacgttgagaggtaacgttaggcgggtaatgggtgcgggcgacgggtggatgtcgtgatgggtgggggcgatgggtgggcggggtcgtgggtatcgggtcgagtgggggtgcgtttttcggtttagcgggtaggggtagggaagatgggagggcgtcgggggtcggattcgggtagtttaggaggcggttaggaagggggttttttcggggagatggggttatggtaacgagtagaggcgacgtcgttgggggagtagcggggtgggtacggcgtcggtttttcggggagcggagcgtagaagatggtagtgattagaggatgggtcggcggtcgtattatcgcgggggatggcgagggtacgacgtagggttaggggcgtcggggtcgtatttacggtgagatcggtttttagtacgattatatcgtatttttcgtttatggttaggtttcggtgttagcgttcgttcggttttttttttttttttatcgtagtagtcgtcgtcgttatcgtcgtcgtcgttatcgtattggattaaagatggcggcgcgtcggtcgtcgttcgattttttcgtcgcgttaaagagtttcgttttttttcgcgtttcgtcgtaatcggtaggggttatcgttttttcggttcgtttttcgggagggttgttagggttcgggttatagtattagcgcggtttcgcgggcgacgttgttcgtcgagagtttagagaggcgcggggcggggcgggcggggcgggtcggcggtcggtgttgcggtttaggaagaattcgtcgcgggagtcgcgcgcgtttcgttttattcgtcgcgtttcgtttcgtttcgtttcgcgcgcgttcgtttatttttttattttcgtttattttttcgggagtttcggcgcggtttcgcggtcgggcgcgcgtcgttgcggtagtttggggcggtttttttacgacgcgaaggttgttattgttacgacggttttttgagacgtcgaagcgtatcgggattcggttcgatcgtttttttttattttgagcggttagggtttagtttgttaaagtttttttcggttttcgcggatgttttttcgtttttttttcgttaggttttattttttcgtattttttcggcgagtacgcgtttaaagtttagcgtagaaatgagcgataagaggtttaacgtatggcgattcgcgtttattttattaggaaggaaataatta

SEQ ID NO: 19452 - DNA, 1280 bp, Artificial Sequence
  chemically treated genomic DNA (Homo sapiens) CpG-island No: 19452
taattatttccttcctaataaaataaacgcgaatcgccatacgttaaacctcttatcgctcatttctacgctaaactttaaacgcgtactcgccgaaaaaatacgaaaaaataaaacctaacgaaaaaaaaacgaaaaaacatccgcgaaaaccgaaaaaaactttaacaaactaaaccctaaccgctcaaaataaaaaaaaacgatcgaaccgaatcccgatacgcttcgacgtctcaaaaaaccgtcgtaacaataacaaccttcgcgtcgtaaaaaaaccgccccaaactaccgcaacgacgcgcgcccgaccgcgaaaccgcgccgaaactcccgaaaaaataaacgaaaataaaaaaataaacgaacgcgcgcgaaacgaaacgaaacgaaacgcgacgaataaaacgaaacgcgcgcgactcccgcgacgaattcttcctaaaccgcaacaccgaccgccgacccgccccgcccgccccgccccgcgcctctctaaactctcgacgaacaacgtcgcccgcgaaaccgcgctaatactataacccgaaccctaacaaccctcccgaaaaacgaaccgaaaaaacgataacccctaccgattacgacgaaacgcgaaaaaaaacgaaactctttaacgcgacgaaaaaatcgaacgacgaccgacgcgccgccatctttaatccaatacgataacgacgacgacgataacgacgacgactactacgataaaaaaaaaaaaaaaaccgaacgaacgctaacaccgaaacctaaccataaacgaaaaatacgatataatcgtactaaaaaccgatctcaccgtaaatacgaccccgacgcccctaaccctacgtcgtaccctcgccatcccccgcgataatacgaccgccgacccatcctctaatcactaccatcttctacgctccgctccccgaaaaaccgacgccgtacccaccccgctactcccccaacgacgtcgcctctactcgttaccataaccccatctccccgaaaaaacccccttcctaaccgcctcctaaactacccgaatccgacccccgacgccctcccatcttccctacccctacccgctaaaccgaaaaacgcacccccactcgacccgatacccacgaccccgcccacccatcgcccccacccatcacgacatccacccgtcgcccgcacccattacccgcctaacgttacctctcaacgtcccttcccatcttacgctaatcccgataaaaataaaataaaaaaacctaaaatcaaaaaac

SEQ ID NO: 19453 - DNA, 617 bp, Artificial Sequence
  chemically treated genomic DNA (Homo sapiens) CpG-island No: 19453
taacgtcgaggtagcgcgaggggttggggaatttagttttcggggtttataggagtcggcggcgggggttggggcgggagtttacgtaggattaggggcggttttcggcggggcggggcgggcggtggttacgtttcgggttagttggcgcgcggcggggcggggtattcgtgcgttttttggtggttgacgttacggcgcgggcgttagtgattgttcggtcgttatcgtcgttgtcgttgtcgttgtcgttgtcgtcgtcgtcgtcgttcgtcgtcgtcgtcgtcgtcgtcgtcgttgttatggtttaatataagggcgtcgcgagcgaggtcggtcgcgttatgtatttgatgaagaagcgggagaagtagcgcgagtagatggagtagatgaagtagcgtatcgcggaggtgcgagtcggggagtttcggagtatgcgcgttgtttaggttttttggcggtttcgcgttacgtttcggttttggaagttttggggcggtggttacggagcgcgggcggcgcgtcggggtaggtttttggttcgttgatttttagtagggtatatagaagtaagttagcgatagttttatttgtgaaatgggtttggagtcggg

SEQ ID NO: 19454 - DNA, 617 bp, Artificial Sequence
  chemically treated genomic DNA (Homo sapiens) CpG-island No: 19454
cccgactccaaacccatttcacaaataaaactatcgctaacttacttctatataccctactaaaaatcaacgaaccaaaaacctaccccgacgcgccgcccgcgctccgtaaccaccgccccaaaacttccaaaaccgaaacgtaacgcgaaaccgccaaaaaacctaaacaacgcgcatactccgaaactccccgactcgcacctccgcgatacgctacttcatctactccatctactcgcgctacttctcccgcttcttcatcaaatacataacgcgaccgacctcgctcgcgacgcccttatattaaaccataacaacgacgacgacgacgacgacgacgacgaacgacgacgacgacgacaacgacaacgacaacgacaacgacgataacgaccgaacaatcactaacgcccgcgccgtaacgtcaaccaccaaaaaacgcacgaataccccgccccgccgcgcgccaactaacccgaaacgtaaccaccgcccgccccgccccgccgaaaaccgcccctaatcctacgtaaactcccgccccaacccccgccgccgactcctataaaccccgaaaactaaattccccaacccctcgcgctacctcgacgtta

SEQ ID NO: 19455 - DNA, 617 bp, Artificial Sequence
  chemically treated genomic DNA (Homo sapiens) CpG-island No: 19455
ttcggttttaggtttattttatagatgagattgtcgttggtttgtttttgtgtgttttgttggaagttagcgagttaggggtttgtttcggcgcgtcgttcgcgtttcgtggttatcgttttagggtttttagggtcggagcgtggcgcggggtcgttaggggatttgggtagcgcgtatgtttcgaggtttttcggttcgtattttcgcgatgcgttgttttatttgttttatttgttcgcgttgtttttttcgtttttttattaggtgtatggcgcggtcggtttcgttcgcggcgtttttgtattgagttatggtagcggcggcggcggcggcggcggcggcgggcggcggcggcggcgatagcgatagcggtagcggtagcggcggtggcggtcgaatagttattgacgttcgcgtcgtgacgttagttattaggagacgtacggatgtttcgtttcgtcgcgcgttagttggttcggagcgtgattatcgttcgtttcgtttcgtcggagatcgtttttggttttgcgtggattttcgttttagttttcgtcgtcggtttttgtggatttcggaggttgaattttttagtttttcgcgttgtttcgacgtta

SEQ ID NO: 19456 - DNA, 617 bp, Artificial Sequence
  chemically treated genomic DNA (Homo sapiens) CpG-island No: 19456
taacgtcgaaacaacgcgaaaaactaaaaaattcaacctccgaaatccacaaaaaccgacgacgaaaactaaaacgaaaatccacgcaaaaccaaaaacgatctccgacgaaacgaaacgaacgataatcacgctccgaaccaactaacgcgcgacgaaacgaaacatccgtacgtctcctaataactaacgtcacgacgcgaacgtcaataactattcgaccgccaccgccgctaccgctaccgctatcgctatcgccgccgccgccgcccgccgccgccgccgccgccgccgccgctaccataactcaatacaaaaacgccgcgaacgaaaccgaccgcgccatacacctaataaaaaaacgaaaaaaacaacgcgaacaaataaaacaaataaaacaacgcatcgcgaaaatacgaaccgaaaaacctcgaaacatacgcgctacccaaatcccctaacgaccccgcgccacgctccgaccctaaaaaccctaaaacgataaccacgaaacgcgaacgacgcgccgaaacaaacccctaactcgctaacttccaacaaaacacacaaaaacaaaccaacgacaatctcatctataaaataaacctaaaaccgaa

SEQ ID NO: 19457 - DNA, 802 bp, Artificial Sequence
  chemically treated genomic DNA (Homo sapiens) CpG-island No: 19457
agtttttcgggttagagatcgtcgggggcgtgttttgagttggggacgcgatttttcggcgggggtgtatttgagaggtcgggattagcgaggtcgcgtttcggtggtaggtgatttcgggcgcgttttcgagcgttagggtggggcgaggcggacgcgcgttttaggttcgagggggtgtggcgcgggcgcgcgcgggtttcggggtcgttcgaggcggcgggcggggagtcggggcgcgggggaggcgcgcgtcgcggaacgcgttatcgagcgaagggggtcggttggtcgggcgggtttttttttaggtcgcgggggttagggttgcgcgcgaggtttttggtttcggggagtagcggtttcgtttgcgttttttgtcgtcgcgtttttttcggtcgggcgttttcggacgttttcgtttcgcgcggtggtacggttcgggtttaaaaggtttcggcggttttcgggttagtttagtgtgtgggcggcggcggcggcggttgcgcgtttggggttcggggcgcggggcgaggtcgtggggacgtgcgagcggggtcgcggtggggttcgggggcgcgtttacgtggttagagggcggttattcggagttagcggagggataggtaggtggtcgttatcgtcgtcgttcgtgcggggttaaatagttcggggttcggggtttcggtagttcgggggttcggttcggtttgtgggggttaggttttatttttgttcgtcggcgtcggtttgttcgattttttgtgtttcgtatggtggggacgttaatttaagattaata

SEQ ID NO: 19458 - DNA, 802 bp, Artificial Sequence
  chemically treated genomic DNA (Homo sapiens) CpG-island No: 19458
tattaatcttaaattaacgtccccaccatacgaaacacaaaaaatcgaacaaaccgacgccgacgaacaaaaataaaacctaacccccacaaaccgaaccgaacccccgaactaccgaaaccccgaaccccgaactatttaaccccgcacgaacgacgacgataacgaccacctacctatccctccgctaactccgaataaccgccctctaaccacgtaaacgcgcccccgaaccccaccgcgaccccgctcgcacgtccccacgacctcgccccgcgccccgaaccccaaacgcgcaaccgccgccgccgccgcccacacactaaactaacccgaaaaccgccgaaaccttttaaacccgaaccgtaccaccgcgcgaaacgaaaacgtccgaaaacgcccgaccgaaaaaaacgcgacgacaaaaaacgcaaacgaaaccgctactccccgaaaccaaaaacctcgcgcgcaaccctaacccccgcgacctaaaaaaaaacccgcccgaccaaccgacccccttcgctcgataacgcgttccgcgacgcgcgcctcccccgcgccccgactccccgcccgccgcctcgaacgaccccgaaacccgcgcgcgcccgcgccacaccccctcgaacctaaaacgcgcgtccgcctcgccccaccctaacgctcgaaaacgcgcccgaaatcacctaccaccgaaacgcgacctcgctaatcccgacctctcaaatacacccccgccgaaaaatcgcgtccccaactcaaaacacgcccccgacgatctctaacccgaaaaact

SEQ ID NO: 19459 - DNA, 802 bp, Artificial Sequence
  chemically treated genomic DNA (Homo sapiens) CpG-island No: 19459
tgttggttttgggttggcgtttttattatgcggggtataaggagtcgggtaggtcggcgtcgacgggtagggatagggtttgatttttataggtcgagtcggattttcgggttgtcggagtttcgggtttcgagttgtttggtttcgtacggacggcgacgatgacggttatttatttgttttttcgttggtttcgggtggtcgttttttggttacgtggacgcgttttcgagttttatcgcggtttcgttcgtacgtttttacggtttcgtttcgcgtttcgggttttaagcgcgtagtcgtcgtcgtcgtcgtttatatattgggttggttcgggggtcgtcggagttttttaaattcggatcgtattatcgcgcggggcgggggcgttcggggacgttcggtcgagggggacgcggcggtaggggacgtaggcggggtcgttgtttttcggggttagggatttcgcgcgtagttttgattttcgcgatttgaagggggattcgttcggttagtcgatttttttcgttcgatggcgcgtttcgcggcgcgcgtttttttcgcgtttcggtttttcgttcgtcgtttcgggcgatttcggaattcgcgcgcgttcgcgttatattttttcgggtttggggcgcgcgttcgtttcgttttattttggcgttcggagacgcgttcggggttatttgttatcggggcgcggtttcgttggtttcggttttttaggtgtattttcgtcgaggagtcgcgtttttagtttaagatacgttttcgacggtttttaattcggagggtt

SEQ ID NO: 19460 - DNA, 802 bp, Artificial Sequence
  chemically treated genomic DNA (Homo sapiens) CpG-island No: 19460
aaccctccgaattaaaaaccgtcgaaaacgtatcttaaactaaaaacgcgactcctcgacgaaaatacacctaaaaaaccgaaaccaacgaaaccgcgccccgataacaaataaccccgaacgcgtctccgaacgccaaaataaaacgaaacgaacgcgcgccccaaacccgaaaaaatataacgcgaacgcgcgcgaattccgaaatcgcccgaaacgacgaacgaaaaaccgaaacgcgaaaaaaacgcgcgccgcgaaacgcgccatcgaacgaaaaaaatcgactaaccgaacgaatcccccttcaaatcgcgaaaatcaaaactacgcgcgaaatccctaaccccgaaaaacaacgaccccgcctacgtcccctaccgccgcgtccccctcgaccgaacgtccccgaacgcccccgccccgcgcgataatacgatccgaatttaaaaaactccgacgacccccgaaccaacccaatatataaacgacgacgacgacgactacgcgcttaaaacccgaaacgcgaaacgaaaccgtaaaaacgtacgaacgaaaccgcgataaaactcgaaaacgcgtccacgtaaccaaaaaacgaccacccgaaaccaacgaaaaaacaaataaataaccgtcatcgtcgccgtccgtacgaaaccaaacaactcgaaacccgaaactccgacaacccgaaaatccgactcgacctataaaaatcaaaccctatccctacccgtcgacgccgacctacccgactccttataccccgcataataaaaacgccaacccaaaaccaaca

SEQ ID NO: 19461 - DNA, 805 bp, Artificial Sequence
  chemically treated genomic DNA (Homo sapiens) CpG-island No: 19461
gatcgtatacgttagtttcggtttttttttgttatttttttcgtcggtttttcgttcgttttttttttttttttttcgagtttagttttcgttcgtcgtaagtagtttttagttcggaaaggatataatatgtgcggtcgtattcgtgattttttggcgtagacgcggcgtttttgttcggatttggcgcgtgcgttgggggagttttatcggtcggagttgcggttgtgtttacgttttcgcggtagttgtggttatttcggttattttcgtcgttagcgttttcgtttgcgtttgtattcgcgtttcgtatgatcgtcgtcgcgtcgtttcgattttattttcgaagcgtaggttttacgtttcgttttttttgtggttttttttcgaagtttcgttttttgcgtacgatttcgtttatacgcgtttgcgtaggtttttggagagtttgattggcgcgtggttagttttcgttaagcggttttgtcgggggttttttgagattcggttagcggttgagaggttgcggttttttttagaaattttgttttttcgcgcgtaattcgattttagagcgttggtgtaaattgatttatagtcggttcggttttaggaagttaattttgacggggtttttgaagatatcgtggtcgtttattttagaggcgtatttcgcgaggtttcgtttttaagcgcgttttgtgattttagcgcgtttgcgttggcggggtttttttttttgtttttggaggttttagtgaggttttgcggtgtttggacggtttttcgtttcgttttttatttg

SEQ ID NO: 19462 - DNA, 805 bp, Artificial Sequence
  chemically treated genomic DNA (Homo sapiens) CpG-island No: 19462
caaataaaaaacgaaacgaaaaaccgtccaaacaccgcaaaacctcactaaaacctccaaaaacaaaaaaaaaaaccccgccaacgcaaacgcgctaaaatcacaaaacgcgcttaaaaacgaaacctcgcgaaatacgcctctaaaataaacgaccacgatatcttcaaaaaccccgtcaaaattaacttcctaaaaccgaaccgactataaatcaatttacaccaacgctctaaaatcgaattacgcgcgaaaaaacaaaatttctaaaaaaaaccgcaacctctcaaccgctaaccgaatctcaaaaaacccccgacaaaaccgcttaacgaaaactaaccacgcgccaatcaaactctccaaaaacctacgcaaacgcgtataaacgaaatcgtacgcaaaaaacgaaacttcgaaaaaaaaccacaaaaaaaacgaaacgtaaaacctacgcttcgaaaataaaatcgaaacgacgcgacgacgatcatacgaaacgcgaatacaaacgcaaacgaaaacgctaacgacgaaaataaccgaaataaccacaactaccgcgaaaacgtaaacacaaccgcaactccgaccgataaaactcccccaacgcacgcgccaaatccgaacaaaaacgccgcgtctacgccaaaaaatcacgaatacgaccgcacatattatatcctttccgaactaaaaactacttacgacgaacgaaaactaaactcgaaaaaaaaaaaaaaaaaacgaacgaaaaaccgacgaaaaaaataacaaaaaaaaaccgaaactaacgtatacgatc

SEQ ID NO: 19463 - DNA, 805 bp, Artificial Sequence
  chemically treated genomic DNA (Homo sapiens) CpG-island No: 19463
taggtaagaaacggggcgggaagtcgtttaggtatcgtagggttttattggggtttttagggataagggggaaggtttcgttagcgtaggcgcgttaaggttataaggcgcgtttaggggcggagtttcgcggggtgcgtttttgggataggcgattacggtgtttttaaaagtttcgttagggttggttttttggggtcggatcgattgtgggttagtttgtattagcgttttggaatcgagttacgcgcgaaagggtagagtttttggaggaaatcgtagttttttaatcgttgatcgggttttagaaggttttcggtagggtcgtttggcgggaattgattacgcgttagttaggttttttagggatttgcgtaggcgcgtgtgggcggagtcgtgcgtagggggcggggtttcgggaaggagttatagagagggcggggcgtaggatttgcgtttcgggggtggagtcggagcggcgcggcggcggttatgcgggacgcggatgtagacgtaggcggaggcgttgacggcggggatggtcggggtggttatagttgtcgcgggggcgtggatatagtcgtagtttcggtcggtggagtttttttagcgtacgcgttaggttcgggtagagacgtcgcgtttgcgttagggggttacgaatgcggtcgtatatattgtatttttttcgagttgggggttgtttgcggcggacgagggttggattcggggagaaggaaaggagggcgggcggggggtcgacggaaagggtagtagggggggatcggggttggcgtatacggtt

SEQ ID NO: 19464 - DNA, 805 bp, Artificial Sequence
  chemically treated genomic DNA (Homo sapiens) CpG-island No: 19464
aaccgtatacgccaaccccgatccccccctactaccctttccgtcgaccccccgcccgccctcctttccttctccccgaatccaaccctcgtccgccgcaaacaacccccaactcgaaaaaaatacaatatatacgaccgcattcgtaaccccctaacgcaaacgcgacgtctctacccgaacctaacgcgtacgctaaaaaaactccaccgaccgaaactacgactatatccacgcccccgcgacaactataaccaccccgaccatccccgccgtcaacgcctccgcctacgtctacatccgcgtcccgcataaccgccgccgcgccgctccgactccacccccgaaacgcaaatcctacgccccgccctctctataactccttcccgaaaccccgccccctacgcacgactccgcccacacgcgcctacgcaaatccctaaaaaacctaactaacgcgtaatcaattcccgccaaacgaccctaccgaaaaccttctaaaacccgatcaacgattaaaaaactacgatttcctccaaaaactctaccctttcgcgcgtaactcgattccaaaacgctaatacaaactaacccacaatcgatccgaccccaaaaaaccaaccctaacgaaacttttaaaaacaccgtaatcgcctatcccaaaaacgcaccccgcgaaactccgcccctaaacgcgccttataaccttaacgcgcctacgctaacgaaaccttcccccttatccctaaaaaccccaataaaaccctacgatacctaaacgacttcccgccccgtttcttaccta

SEQ ID NO: 19465 - DNA, 600 bp, Artificial Sequence
  chemically treated genomic DNA (Homo sapiens) CpG-island No: 19465
tttggtcgcgcggagggtgggaggtaagggttgagttcgcggtttttagacggcgaagtttacgcgttcgttttcgagggtagttttttcggttttcggttttcggttcggttttttcgtgttcgttttcggttttgtcggtttttttgttaggagcgggcgagagagcgcgtcggattcggcggttcggttcggggattttatttgtaggttgtattcgcggttttgtagcgtttttatcgttagttgtatggcggtcgcgacggcgtttattcgggtcggcgcgtattttaattatttttcgtcgcgcgtcgtcgtttcgggcgcgcgttggaatcgttcgtcgtcgtcggaagtagcgagaggggcgcgttcgtcgttcgcgtttttcggtttcgtttttttgtttcgttcgcgtttcggtttcgtttttcggtttaattgcgtttcgggaggagttttttcggggtttcgtttagtacgcgcgtatcgatcgttttggtcggcggattttttttaaagtaacgacgcgggggagttgggagtaggaattagtcgggttaggttggcgttatttgggagttgggatatggagaaggg

SEQ ID NO: 19466 - DNA, 600 bp, Artificial Sequence
  chemically treated genomic DNA (Homo sapiens) CpG-island No: 19466
cccttctccatatcccaactcccaaataacgccaacctaacccgactaattcctactcccaactcccccgcgtcgttactttaaaaaaaatccgccgaccaaaacgatcgatacgcgcgtactaaacgaaaccccgaaaaaactcctcccgaaacgcaattaaaccgaaaaacgaaaccgaaacgcgaacgaaacaaaaaaacgaaaccgaaaaacgcgaacgacgaacgcgcccctctcgctacttccgacgacgacgaacgattccaacgcgcgcccgaaacgacgacgcgcgacgaaaaataattaaaatacgcgccgacccgaataaacgccgtcgcgaccgccatacaactaacgataaaaacgctacaaaaccgcgaatacaacctacaaataaaatccccgaaccgaaccgccgaatccgacgcgctctctcgcccgctcctaacaaaaaaaccgacaaaaccgaaaacgaacacgaaaaaaccgaaccgaaaaccgaaaaccgaaaaaactaccctcgaaaacgaacgcgtaaacttcgccgtctaaaaaccgcgaactcaacccttacctcccaccctccgcgcgaccaaa

SEQ ID NO: 19467 - DNA, 600 bp, Artificial Sequence
  chemically treated genomic DNA (Homo sapiens) CpG-island No: 19467
tttttttttatgttttagtttttagatgacgttaatttggttcgattggtttttgtttttaattttttcgcgtcgttgttttgggaggggttcgtcggttagggcggtcgatgcgcgcgtgttaggcgggatttcggggggatttttttcggggcgtaattgggtcggggggcggggtcggggcgcggacggggtaggagggcggggtcgggaagcgcgggcggcgggcgcgtttttttcgttgttttcggcggcggcgggcggttttagcgcgcgttcggggcggcggcgcgcggcggggggtggttggggtgcgcgtcggttcgagtggacgtcgtcgcgatcgttatgtagttgacggtgaaggcgttgtagggtcgcgagtgtagtttgtaggtagggttttcgggtcgggtcgtcgggttcggcgcgttttttcgttcgtttttggtagggggatcggtagggtcgagggcgggtacggggaggtcgggtcgagggtcgggagtcgggagagttgttttcgggggcggacgcgtgggtttcgtcgtttgggggtcgcgggtttaatttttgttttttatttttcgcgcggttagg

SEQ ID NO: 19468 - DNA, 600 bp, Artificial Sequence
  chemically treated genomic DNA (Homo sapiens) CpG-island No: 19468
cctaaccgcgcgaaaaataaaaaacaaaaattaaacccgcgacccccaaacgacgaaacccacgcgtccgcccccgaaaacaactctcccgactcccgaccctcgacccgacctccccgtacccgccctcgaccctaccgatccccctaccaaaaacgaacgaaaaaacgcgccgaacccgacgacccgacccgaaaaccctacctacaaactacactcgcgaccctacaacgccttcaccgtcaactacataacgatcgcgacgacgtccactcgaaccgacgcgcaccccaaccaccccccgccgcgcgccgccgccccgaacgcgcgctaaaaccgcccgccgccgccgaaaacaacgaaaaaaacgcgcccgccgcccgcgcttcccgaccccgccctcctaccccgtccgcgccccgaccccgccccccgacccaattacgccccgaaaaaaatccccccgaaatcccgcctaacacgcgcgcatcgaccgccctaaccgacgaacccctcccaaaacaacgacgcgaaaaaattaaaaacaaaaaccaatcgaaccaaattaacgtcatctaaaaactaaaacataaaaaaaaa

SEQ ID NO: 19469 - DNA, 648 bp, Artificial Sequence
  chemically treated genomic DNA (Homo sapiens) CpG-island No: 19469
agttcgggcgcgaatttgggagggaggaaaggaagggtacgtcgtcgttttatagtcggcgattcgttcgggtcgtttcggagtttgggggggttttttacgttatttttgggtttcgcggtttcgttaggtttcgtaaacgcgcggcggcggcggcggtttttttttgttaggttcggtcgggcgttcgagtgggcgatcgcggagtagggtcggggttagaggtcgtttttttttcggaggtttttatttgttatagttatcgcgtagtttagttgtagcgtttgtttggtaggtagtcgttcgcgagttcggtttgttagggtttcgttttatcgaagtttttttttttttcgtttcgcgcgttagggtttcgttttttttttagcgtttagtttaatttcggttgttcgttgggtttcgatcggttgtgacgtttttgggagtgacgcgtcggcgcgggcgcggtgcgggtgagttggtcggcgtttggcgttgtttggattaatcgtttggtagcgtatttgaagttgttgtgatcgttggggcgattcgttttgggagggagttttaggtattttcgattacgttgcgatttttaaaggtaatgggatagagggttagacgttagtagggttgggtgttcgg

SEQ ID NO: 19470 - DNA, 648 bp, Artificial Sequence
  chemically treated genomic DNA (Homo sapiens) CpG-island No: 19470
ccgaacacccaaccctactaacgtctaaccctctatcccattacctttaaaaatcgcaacgtaatcgaaaatacctaaaactccctcccaaaacgaatcgccccaacgatcacaacaacttcaaatacgctaccaaacgattaatccaaacaacgccaaacgccgaccaactcacccgcaccgcgcccgcgccgacgcgtcactcccaaaaacgtcacaaccgatcgaaacccaacgaacaaccgaaattaaactaaacgctaaaaaaaaaacgaaaccctaacgcgcgaaacgaaaaaaaaaaaaacttcgataaaacgaaaccctaacaaaccgaactcgcgaacgactacctaccaaacaaacgctacaactaaactacgcgataactataacaaataaaaacctccgaaaaaaaaacgacctctaaccccgaccctactccgcgatcgcccactcgaacgcccgaccgaacctaacaaaaaaaaaccgccgccgccgccgcgcgtttacgaaacctaacgaaaccgcgaaacccaaaaataacgtaaaaaacccccccaaactccgaaacgacccgaacgaatcgccgactataaaacgacgacgtacccttcctttcctccctcccaaattcgcgcccgaact

SEQ ID NO: 19471 - DNA, 648 bp, Artificial Sequence
  chemically treated genomic DNA (Homo sapiens) CpG-island No: 19471
tcgggtatttagttttgttaacgtttaattttttgttttattgtttttagaggtcgtagcgtaatcgggaatgtttggggtttttttttagagcgggtcgttttagcgattataatagttttagatgcgttgttaagcgattggtttaggtagcgttaagcgtcgattagtttattcgtatcgcgttcgcgtcggcgcgttatttttagagacgttataatcggtcggagtttagcgagtagtcggagttgagttggacgttgaggggggggcggggttttgacgcgcggggcggggaagggaggggtttcggtggggcggggttttgataggtcgagttcgcgggcgattgtttgttaggtagacgttgtagttaagttgcgcggtggttgtggtaggtgagagttttcggaagggaggcggtttttggtttcgattttgtttcgcgatcgtttattcgggcgttcggtcgggtttggtagggaagggtcgtcgtcgtcgtcgcgcgtttgcgaggtttggcggggtcgcggggtttaggaatggcgtaaggggtttttttagatttcgagacggttcgagcgggtcgtcggttgtgggacggcggcgtgttttttttttttttttttttaggttcgcgttcgagtt

SEQ ID NO: 19472 - DNA, 648 bp, Artificial Sequence
  chemically treated genomic DNA (Homo sapiens) CpG-island No: 19472
aactcgaacgcgaacctaaaaaaaaaaaaaaaaaaaacacgccgccgtcccacaaccgacgacccgctcgaaccgtctcgaaatctaaaaaaaccccttacgccattcctaaaccccgcgaccccgccaaacctcgcaaacgcgcgacgacgacgacgacccttccctaccaaacccgaccgaacgcccgaataaacgatcgcgaaacaaaatcgaaaccaaaaaccgcctcccttccgaaaactctcacctaccacaaccaccgcgcaacttaactacaacgtctacctaacaaacaatcgcccgcgaactcgacctatcaaaaccccgccccaccgaaacccctcccttccccgccccgcgcgtcaaaaccccgcccccccctcaacgtccaactcaactccgactactcgctaaactccgaccgattataacgtctctaaaaataacgcgccgacgcgaacgcgatacgaataaactaatcgacgcttaacgctacctaaaccaatcgcttaacaacgcatctaaaactattataatcgctaaaacgacccgctctaaaaaaaaaccccaaacattcccgattacgctacgacctctaaaaacaataaaacaaaaaattaaacgttaacaaaactaaatacccga

SEQ ID NO: 19473 - DNA, 1185 bp, Artificial Sequence
  chemically treated genomic DNA (Homo sapiens) CpG-island No: 19473
cgtcgcgcggcgtagcgcgggatagtacgttttttcgtttgcgcggcgttcgttcggtcggttatttgcgtttcgtcgtcgtcgtttttcgcgttcgtagtttcgaagtgtacgatcgttttcgggggttgagtttcgtcggtttatttaatcggcgggggcgggggcgggcgtttgggttgagcggattcgttttaggcgaggcgtgcggggcggggtttcggttattatttttcgtgcgggcggggcggggcgagggtaggtgcgcgcgtattttaggttagtttttgtttttcgggtatttgcgttggaggtcggttcgtcggttgtttgttatattcgttgtcgttgttttgtatttttaatttcggcgggtacgggtgtagtttcgcgtagtgttttcgtatttttatcgtcggttcggtttcgtttttattgttcggttttttcgtttgtttcggcggtttcgcgcgttcgcggagggttttattttcgtcggtagcgtggttacgttttttttgggttgtttttcggtttttgggcggggttttttgtcgcgttattttttcgggaattttcgtttgttcgcgggttaagtcggttttattgggtagtttttttttgatttttttttcggagagggcggggcggtcgagcgtttcgaggttagacgtcgtcgttcgagagacgagggggcgtgtaggcggtgacgttttgtaaagtggtcggcgtgtttattattatcgagttttcgcgggtttgtagagtttggcggatttagattttttttcggagcgggatgcggttttatcgcggttttatatttttcgtcggtttttcgagttttcgggggcggggtttgtgtttttattttcggattttatagttatgatatcggaagtcggaagcgtggtagggaagggcgatcgcgaaattgggattttttcggagcgtcggggttttattagcgtttatagttcgtcgtttttattttttttacgtttgacggattttgttgataggtgtggtttttttttttaaagatagggttttattcgtgggcgtttcgtcgttttcgaaatttttttcggacgtttaggttttttttttttttttgggttttagttcgtttttgtttcgcgtttttggagtattggttaaggcgggtcgatttaggatttaggt

SEQ ID NO: 19474 - DNA, 1185 bp, Artificial Sequence
  chemically treated genomic DNA (Homo sapiens) CpG-island No: 19474
acctaaatcctaaatcgacccgccttaaccaatactccaaaaacgcgaaacaaaaacgaactaaaacccaaaaaaaaaaaaaaaacctaaacgtccgaaaaaaatttcgaaaacgacgaaacgcccacgaataaaaccctatctttaaaaaaaaaaaccacacctatcaacaaaatccgtcaaacgtaaaaaaaataaaaacgacgaactataaacgctaataaaaccccgacgctccgaaaaaatcccaatttcgcgatcgcccttccctaccacgcttccgacttccgatatcataactataaaatccgaaaataaaaacacaaaccccgcccccgaaaactcgaaaaaccgacgaaaaatataaaaccgcgataaaaccgcatcccgctccgaaaaaaaatctaaatccgccaaactctacaaacccgcgaaaactcgataataataaacacgccgaccactttacaaaacgtcaccgcctacacgccccctcgtctctcgaacgacgacgtctaacctcgaaacgctcgaccgccccgccctctccgaaaaaaaaatcaaaaaaaaactacccaataaaaccgacttaacccgcgaacaaacgaaaattcccgaaaaaataacgcgacaaaaaaccccgcccaaaaaccgaaaaacaacccaaaaaaaacgtaaccacgctaccgacgaaaataaaaccctccgcgaacgcgcgaaaccgccgaaacaaacgaaaaaaccgaacaataaaaacgaaaccgaaccgacgataaaaatacgaaaacactacgcgaaactacacccgtacccgccgaaattaaaaatacaaaacaacgacaacgaatataacaaacaaccgacgaaccgacctccaacgcaaatacccgaaaaacaaaaactaacctaaaatacgcgcgcacctaccctcgccccgccccgcccgcacgaaaaataataaccgaaaccccgccccgcacgcctcgcctaaaacgaatccgctcaacccaaacgcccgcccccgcccccgccgattaaataaaccgacgaaactcaacccccgaaaacgatcgtacacttcgaaactacgaacgcgaaaaacgacgacgacgaaacgcaaataaccgaccgaacgaacgccgcgcaaacgaaaaaacgtactatcccgcgctacgccgcgcgacg

SEQ ID NO: 19475 - DNA, 1185 bp, Artificial Sequence
  chemically treated genomic DNA (Homo sapiens) CpG-island No: 19475
atttgggttttgaatcggttcgttttggttagtgttttagaagcgcggagtaggaacgggttggggtttaaaaaagaggggggagtttgaacgttcgggggaagtttcggaggcggcggaacgtttacggatggaattttgtttttggggaaaaggattatatttgttagtagagttcgttagacgtgagaagggtgggagcggcggattgtgaacgttggtagggtttcggcgtttcgagaaagttttagtttcgcggtcgtttttttttattacgttttcggttttcggtgttatagttgtgggattcggaagtaaaaatataagtttcgttttcgagaattcgggaagtcggcgagaagtgtgaggtcgcggtagggtcgtatttcgtttcggagagaagtttgagttcgttaggttttgtaggttcgcggaagttcggtaatgataagtacgtcggttattttgtagggcgttatcgtttatacgttttttcgtttttcggacggcggcgtttagtttcggggcgttcggtcgtttcgtttttttcgggggaggaattaagaagagattgtttaatagggtcggtttgattcgcgaataggcgagggttttcgggggagtggcgcggtagaaggtttcgtttaggagtcgagggatagtttagaggaggcgtggttacgttgtcggcggaagtggagtttttcgcgagcgcgcgaggtcgtcggggtaggcggggaaatcggatagtaggggcggggtcgggtcggcgatggggatgcgggagtattacgcggagttgtattcgtgttcgtcggaattggggatgtagagtagcggtagcgggtatggtaggtagtcggcgggtcggtttttagcgtaggtgttcgagaggtaggggttggtttgggatgcgcgcgtatttgttttcgtttcgtttcgttcgtacgaggggtggtggtcgaggtttcgtttcgtacgtttcgtttgaggcgggttcgtttagtttaggcgttcgttttcgttttcgtcgattaaatgggtcggcggggtttagttttcggaaacggtcgtatatttcggggttgcgagcgcggagggcgacgacgacgaagcgtaggtaatcggtcgggcgggcgtcgcgtaggcggaggagcgtattgtttcgcgttgcgtcgcgcggcg

SEQ ID NO: 19476 - DNA, 1185 bp, Artificial Sequence
  chemically treated genomic DNA (Homo sapiens) CpG-island No: 19476
cgccgcgcgacgcaacgcgaaacaatacgctcctccgcctacgcgacgcccgcccgaccgattacctacgcttcgtcgtcgtcgccctccgcgctcgcaaccccgaaatatacgaccgtttccgaaaactaaaccccgccgacccatttaatcgacgaaaacgaaaacgaacgcctaaactaaacgaacccgcctcaaacgaaacgtacgaaacgaaacctcgaccaccacccctcgtacgaacgaaacgaaacgaaaacaaatacgcgcgcatcccaaaccaacccctacctctcgaacacctacgctaaaaaccgacccgccgactacctaccatacccgctaccgctactctacatccccaattccgacgaacacgaatacaactccgcgtaatactcccgcatccccatcgccgacccgaccccgcccctactatccgatttccccgcctaccccgacgacctcgcgcgctcgcgaaaaactccacttccgccgacaacgtaaccacgcctcctctaaactatccctcgactcctaaacgaaaccttctaccgcgccactcccccgaaaaccctcgcctattcgcgaatcaaaccgaccctattaaacaatctcttcttaattcctcccccgaaaaaaacgaaacgaccgaacgccccgaaactaaacgccgccgtccgaaaaacgaaaaaacgtataaacgataacgccctacaaaataaccgacgtacttatcattaccgaacttccgcgaacctacaaaacctaacgaactcaaacttctctccgaaacgaaatacgaccctaccgcgacctcacacttctcgccgacttcccgaattctcgaaaacgaaacttatatttttacttccgaatcccacaactataacaccgaaaaccgaaaacgtaataaaaaaaaacgaccgcgaaactaaaactttctcgaaacgccgaaaccctaccaacgttcacaatccgccgctcccacccttctcacgtctaacgaactctactaacaaatataatccttttccccaaaaacaaaattccatccgtaaacgttccgccgcctccgaaacttcccccgaacgttcaaactcccccctcttttttaaaccccaacccgttcctactccgcgcttctaaaacactaaccaaaacgaaccgattcaaaacccaaat

SEQ ID NO: 19477 - DNA, 721 bp, Artificial Sequence
  chemically treated genomic DNA (Homo sapiens) CpG-island No: 19477
ggtttcgcggtcgttatgtttatcgtttttatgttatgtttatcgtcgttatgtttatcgtcgttaaagtttattatcgttatgtttattcgttgttaatgtttatcgtcgttaatatttattgtcgtcgttttttttttattttttagttattttttacggatttttttcgcgtcgcgattattaatataatttttattattgttatatcgatttatttttttggtttattgttatagttttttcgtttcggttattgcgacgaattttttttttagtcgttttacgtattttgttttattacgtagtggttattattatatatttatttgcgtttaatattttttaaatatcgattattttacgtattttcgtttcgttataattattttaatatatttattttcgtttaaaatttttatgtattggtttttttacgtattttcgttatacggaattgtaattattttgatgtatttatttttatttatgttttttgtttattgcggttatttcgtatgtttttagttattatcgttttttttatcgtagatattcgtaataggatttgtcgcgatattatagttgggggcggatgggggacgcgttttaatgcgagcggataggatattatcggggtagaacggtataatagtaagtttttgaatatttcggatttggttttttagaataaaggattttagggtttaaatttcgttta

SEQ ID NO: 19478 - DNA, 721 bp, Artificial Sequence
  chemically treated genomic DNA (Homo sapiens) CpG-island No: 19478
taaacgaaatttaaaccctaaaatcctttattctaaaaaaccaaatccgaaatattcaaaaacttactattataccgttctaccccgataatatcctatccgctcgcattaaaacgcgtcccccatccgcccccaactataatatcgcgacaaatcctattacgaatatctacgataaaaaaaacgataataactaaaaacatacgaaataaccgcaataaacaaaaaacataaataaaaataaatacatcaaaataattacaattccgtataacgaaaatacgtaaaaaaaccaatacataaaaattttaaacgaaaataaatatattaaaataattataacgaaacgaaaatacgtaaaataatcgatatttaaaaaatattaaacgcaaataaatatataataataaccactacgtaataaaacaaaatacgtaaaacgactaaaaaaaaaattcgtcgcaataaccgaaacgaaaaaactataacaataaaccaaaaaaataaatcgatataacaataataaaaattatattaataatcgcgacgcgaaaaaaatccgtaaaaaataactaaaaaataaaaaaaaaacgacgacaataaatattaacgacgataaacattaacaacgaataaacataacgataataaactttaacgacgataaacataacgacgataaacataacataaaaacgataaacataacgaccgcgaaacc

SEQ ID NO: 19479 - DNA, 721 bp, Artificial Sequence
  chemically treated genomic DNA (Homo sapiens) CpG-island No: 19479
taaacggaatttgggttttaaagttttttgttttggagaattagattcggaatgtttagaggtttgttgttgtgtcgttttgtttcgatggtattttgttcgttcgtattggggcgcgttttttattcgtttttaattgtggtgtcgcgataggttttattgcgggtgtttgcggtgggaagggcggtggtgattgggagtatgcggggtaatcgtagtgggtaagggatatgggtggaggtgggtatattagggtgattgtagtttcgtgtggcgagggtacgtggggggattagtgtatagggattttaggcggaggtaggtatattggagtgattgtggcggggcgaaggtacgtgaagtgatcggtatttagggggtgttgagcgtaggtaggtgtataatagtgattattgcgtggtggagtagggtacgtggggcgattggggggggaattcgtcgtagtgatcgaggcgaggaggttatggtagtggattagggggatgagtcggtgtgatagtggtgggggttgtgttggtggtcgcggcgcggggagagttcgtaggaagtggttgggaggtagggggaaggcggcgatagtgggtattggcggcggtgggtattggtagcgggtaggtatggcggtggtggattttggcggcggtaggtatggcggcggtgggtatggtatggaggcggtgggtatggcggtcgcggggtt

SEQ ID NO: 19480 - DNA, 721 bp, Artificial Sequence
  chemically treated genomic DNA (Homo sapiens) CpG-island No: 19480
aaccccgcgaccgccatacccaccgcctccataccatacccaccgccgccatacctaccgccgccaaaatccaccaccgccatacctacccgctaccaatacccaccgccgccaatacccactatcgccgccttccccctacctcccaaccacttcctacgaactctccccgcgccgcgaccaccaacacaacccccaccactatcacaccgactcatccccctaatccactaccataacctcctcgcctcgatcactacgacgaattccccccccaatcgccccacgtaccctactccaccacgcaataatcactattatacacctacctacgctcaacaccccctaaataccgatcacttcacgtaccttcgccccgccacaatcactccaatatacctacctccgcctaaaatccctatacactaatccccccacgtaccctcgccacacgaaactacaatcaccctaatatacccacctccacccatatcccttacccactacgattaccccgcatactcccaatcaccaccgcccttcccaccgcaaacacccgcaataaaacctatcgcgacaccacaattaaaaacgaataaaaaacgcgccccaatacgaacgaacaaaataccatcgaaacaaaacgacacaacaacaaacctctaaacattccgaatctaattctccaaaacaaaaaactttaaaacccaaattccgttta

SEQ ID NO: 19481 - DNA, 708 bp, Artificial Sequence
  chemically treated genomic DNA (Homo sapiens) CpG-island No: 19481
cgagggtttttttgagcgtcggagtttataggtttcgttttgtttcgaaagtttcgtaatcgaggcggaggcgatcgagttttcgatttttttagaacgttgttataagaagggggaacgtcggaatagtgtattatcgggcggcggtcggggcggcggtaggagggcgggcggggggtagggtttcgggggattgggcgggttatggcggaggacggcgaggaggcggagttttatttcgcggcgttttatataagtgggtagtggtcgcgattgcgcgtagatattgatttttagcgtttcggttttagcgttatggcgttttttaggaagtttttcgttgggggaaattggaagatgaacgggcggaagtagagtttgggggagtttatcggtattttgaacgcggttaaggtgtcggtcgatatcggtaagttttcgtcgaggaggggtttggtcgggtcggggtcggggtcggggtaggagtggtagcgttttttttcgaggtttcgaggtttcgaggtcggtattcgcgcggatttgatgtagggttgtgggacgagggtcgttggggttcgggtaggggtttcgtagtcgtagtttcgtcggtgcgtcgagggggtagggcggagtatatgatgttttttggattatggggtaggtaaggacgttttgggttttttggaggaaggtggtttcggggcgcgt

SEQ ID NO: 19482 - DNA, 708 bp, Artificial Sequence
  chemically treated genomic DNA (Homo sapiens) CpG-island No: 19482
acgcgccccgaaaccaccttcctccaaaaaacccaaaacgtccttacctaccccataatccaaaaaacatcatatactccgccctaccccctcgacgcaccgacgaaactacgactacgaaacccctacccgaaccccaacgaccctcgtcccacaaccctacatcaaatccgcgcgaataccgacctcgaaacctcgaaacctcgaaaaaaaacgctaccactcctaccccgaccccgaccccgacccgaccaaacccctcctcgacgaaaacttaccgatatcgaccgacaccttaaccgcgttcaaaataccgataaactcccccaaactctacttccgcccgttcatcttccaatttcccccaacgaaaaacttcctaaaaaacgccataacgctaaaaccgaaacgctaaaaatcaatatctacgcgcaatcgcgaccactacccacttatataaaacgccgcgaaataaaactccgcctcctcgccgtcctccgccataacccgcccaatcccccgaaaccctaccccccgcccgccctcctaccgccgccccgaccgccgcccgataatacactattccgacgttcccccttcttataacaacgttctaaaaaaatcgaaaactcgatcgcctccgcctcgattacgaaactttcgaaacaaaacgaaacctataaactccgacgctcaaaaaaaccctcg

SEQ ID NO: 19483 - DNA, 708 bp, Artificial Sequence
  chemically treated genomic DNA (Homo sapiens) CpG-island No: 19483
gcgcgtttcggggttatttttttttaggagatttaaaacgtttttatttgttttatagtttaaggggtattatgtgtttcgttttgttttttcgacgtatcgacggggttgcggttgcgaggtttttgttcggattttagcggttttcgttttatagttttgtattaggttcgcgcggatatcggtttcggggtttcggggtttcgggagagggcgttgttatttttgtttcggtttcggtttcggttcggttagattttttttcggcgagggtttatcggtgtcggtcggtattttggtcgcgtttagagtgtcgatgagtttttttagattttgttttcgttcgtttattttttagttttttttaacgaagaattttttggagggcgttatggcgttggagtcgaggcgttgaaggttagtgtttgcgcgtagtcgcggttattgtttatttatatagagcgtcgcgaagtggaatttcgttttttcgtcgtttttcgttatggttcgtttagtttttcggagttttgtttttcgttcgtttttttgtcgtcgtttcggtcgtcgttcgatgatgtattgtttcgacgttttttttttttgtggtaacgttttaggagagtcgggggttcggtcgttttcgtttcgattgcggggttttcgggataaggcgagatttgtgagtttcggcgtttaggggaattttcg

SEQ ID NO: 19484 - DNA, 708 bp, Artificial Sequence
  chemically treated genomic DNA (Homo sapiens) CpG-island No: 19484
cgaaaattcccctaaacgccgaaactcacaaatctcgccttatcccgaaaaccccgcaatcgaaacgaaaacgaccgaacccccgactctcctaaaacgttaccacaaaaaaaaaaaacgtcgaaacaatacatcatcgaacgacgaccgaaacgacgacaaaaaaacgaacgaaaaacaaaactccgaaaaactaaacgaaccataacgaaaaacgacgaaaaaacgaaattccacttcgcgacgctctatataaataaacaataaccgcgactacgcgcaaacactaaccttcaacgcctcgactccaacgccataacgccctccaaaaaattcttcgttaaaaaaaactaaaaaataaacgaacgaaaacaaaatctaaaaaaactcatcgacactctaaacgcgaccaaaataccgaccgacaccgataaaccctcgccgaaaaaaaatctaaccgaaccgaaaccgaaaccgaaacaaaaataacaacgccctctcccgaaaccccgaaaccccgaaaccgatatccgcgcgaacctaatacaaaactataaaacgaaaaccgctaaaatccgaacaaaaacctcgcaaccgcaaccccgtcgatacgtcgaaaaaacaaaacgaaacacataataccccttaaactataaaacaaataaaaacgttttaaatctcctaaaaaaaaataaccccgaaacgcgc

SEQ ID NO: 19485 - DNA, 551 bp, Artificial Sequence
  chemically treated genomic DNA (Homo sapiens) CpG-island No: 19485
cgcgttcgtacgtgcgttttcgtcggtagtttttgatttatcgggggtttcgggttatatgcgttcgcgcggttttataggcgtttttttcgttcgtcgttcgggagtcgtagtcgtcgtcgttattgttattttcgtttttttagcgtcgtcgtcgttatcgttatcgttatcgttattattatcgtttgagtttgtagtttcgaggtgaagttttcgttaggtttagagtttttgtggtttttttttttcgtcgcggcgtttttgttttttttattcggtgtcgttgcgtattttttcgtatttttggttcggtgtagttgcgtatttgtttcgtcgttcgcgtttagggcgttttttttttttggtttttttcgttcgttgttttcgttttttggttttttgcgcgtttatttttaattgcgtttttttatttttgtttgtttttttttcggtgttcgtttttatttacggttttatttgtttttaagttgggagttttttcgggcggtgtatttttattttagagcgttttttttggtttgtatttg

SEQ ID NO: 19486 - DNA, 551 bp, Artificial Sequence
  chemically treated genomic DNA (Homo sapiens) CpG-island No: 19486
caaatacaaaccaaaaaaaacgctctaaaataaaaatacaccgcccgaaaaaactcccaacttaaaaacaaataaaaccgtaaataaaaacgaacaccgaaaaaaaaacaaacaaaaataaaaaaacgcaattaaaaataaacgcgcaaaaaaccaaaaaacgaaaacaacgaacgaaaaaaaccaaaaaaaaaaaacgccctaaacgcgaacgacgaaacaaatacgcaactacaccgaaccaaaaatacgaaaaaatacgcaacgacaccgaataaaaaaaacaaaaacgccgcgacgaaaaaaaaaaaccacaaaaactctaaacctaacgaaaacttcacctcgaaactacaaactcaaacgataataataacgataacgataacgataacgacgacgacgctaaaaaaacgaaaataacaataacgacgacgactacgactcccgaacgacgaacgaaaaaaacgcctataaaaccgcgcgaacgcatataacccgaaacccccgataaatcaaaaactaccgacgaaaacgcacgtacgaacgcg

SEQ ID NO: 19487 - DNA, 551 bp, Artificial Sequence
  chemically treated genomic DNA (Homo sapiens) CpG-island No: 19487
taaatgtaaattaaaagggacgttttaggataaaaatgtatcgttcggagaggtttttaatttagaaataaatagaatcgtagatgagggcgagtatcgggagagaggtaggtaagggtggagaggcgtagttagagataggcgcgtagagggttagaaagcgaaggtagcgggcggggaaggttagggagggaaggcgttttgggcgcgggcggcggagtaggtgcgtagttgtatcgggttagagatgcggagaggtgcgtagcggtatcgggtaaaggaggtaggggcgtcgcggcgaagggagggggttataggggttttgggtttggcgggggttttatttcgggattgtagatttagacggtggtagtggcggtggcggtggcggtggcgacggcggcgttgagagagcgggagtggtagtggcggcggcggttgcggttttcgggcggcgggcggaggaggcgtttatagggtcgcgcgggcgtatgtgattcggagttttcgatgagttaggagttgtcggcggaggcgtacgtacgagcgcg

SEQ ID NO: 19488 - DNA, 551 bp, Artificial Sequence
  chemically treated genomic DNA (Homo sapiens) CpG-island No: 19488
cgcgctcgtacgtacgcctccgccgacaactcctaactcatcgaaaactccgaatcacatacgcccgcgcgaccctataaacgcctcctccgcccgccgcccgaaaaccgcaaccgccgccgccactaccactcccgctctctcaacgccgccgtcgccaccgccaccgccaccgccactaccaccgtctaaatctacaatcccgaaataaaacccccgccaaacccaaaacccctataaccccctcccttcgccgcgacgcccctacctcctttacccgataccgctacgcacctctccgcatctctaacccgatacaactacgcacctactccgccgcccgcgcccaaaacgccttccctccctaaccttccccgcccgctaccttcgctttctaaccctctacgcgcctatctctaactacgcctctccacccttacctacctctctcccgatactcgccctcatctacgattctatttatttctaaattaaaaacctctccgaacgatacatttttatcctaaaacgtcccttttaatttacattta

SEQ ID NO: 19489 - DNA, 1014 bp, Artificial Sequence
  chemically treated genomic DNA (Homo sapiens) CpG-island No: 19489
tttcgcgtcgggttcgcgggttttttatatttcgttacggttagtttttttcgcgtttcggttttttcggtttcggtttcggttaattcgcgttgcgttttttttttttcggtttttttttttttttttttcgcggtttgtttcgcgttttttttttcgcgttttttttttggtttttttttttttcgttttttcgcgttttttttttttttttttttttttttttttttattttttttttttaggtttttttttttcgtcgttcgtttttttgtgcgagtcgtcggacgtatcgtttagttcgttcgtagtttcgcgtcgggtcggggtttcgggtcgggttatttcggagggatcgcggtttcggggaggggttaggaggggggagagggagtcgattgtcggggaaggggcgggggtcgcgggcgaggcggtcgaggggttcgggatcgcgcgggtgcgggttgcgttaggcgggcgcgggcggcggcgggtcggaatcgcgtcgagggtcgggcgggtcgcggggtcgggcggcgcggcgggggcgggcggcgcggttcggggtatttcgggcggttagggggaggcggcgagttcggggaggtggggagtagagcggggatcggggtttgtttcgggggtcggcgggcgattggggttaggcggggaaaaggggggatgggggtcgtttttcgggggggtcggggtcgtcgtcgtcgtcgtcgcggcggcgattgaggtcgagaagaggagaggggggcgggggagttgtcgtcgtcgttttttagaggcgtcggagttcggaatttcgttcggagttagttagtcgtttcgagttattagtaggtaaggtttgcggtcgtttgggtttcgggttcgcggggttttgtttcgttcgggtttcggtttgcggttttttatttttattttttttagtttttttttttgtcgtcgtcgtttttatttgttatttttttaatttcgtttttttattgcgggttttgtttggtt

SEQ ID NO: 19490 - DNA, 1014 bp, Artificial Sequence
  chemically treated genomic DNA (Homo sapiens) CpG-island No: 19490
aaccaaacaaaacccgcaataaaaaaacgaaattaaaaaaataacaaataaaaacgacgacgacaaaaaaaaaaactaaaaaaaataaaaataaaaaaccgcaaaccgaaacccgaacgaaacaaaaccccgcgaacccgaaacccaaacgaccgcaaaccttacctactaataactcgaaacgactaactaactccgaacgaaattccgaactccgacgcctctaaaaaacgacgacgacaactcccccgcccccctctcctcttctcgacctcaatcgccgccgcgacgacgacgacgacgaccccgacccccccgaaaaacgacccccatccccccttttccccgcctaaccccaatcgcccgccgacccccgaaacaaaccccgatccccgctctactccccacctccccgaactcgccgcctccccctaaccgcccgaaataccccgaaccgcgccgcccgcccccgccgcgccgcccgaccccgcgacccgcccgaccctcgacgcgattccgacccgccgccgcccgcgcccgcctaacgcaacccgcacccgcgcgatcccgaacccctcgaccgcctcgcccgcgacccccgccccttccccgacaatcgactccctctcccccctcctaacccctccccgaaaccgcgatccctccgaaataacccgacccgaaaccccgacccgacgcgaaactacgaacgaactaaacgatacgtccgacgactcgcacaaaaaaacgaacgacgaaaaaaaaaaacctaaaaaaaaaaaataaaaaaaaaaaaaaaaaaaaaaaaaaaaaaaacgcgaaaaaacgaaaaaaaaaaaaaccaaaaaaaaaacgcgaaaaaaaaaacgcgaaacaaaccgcgaaaaaaaaaaaaaaaaaaaccgaaaaaaaaaaaacgcaacgcgaattaaccgaaaccgaaaccgaaaaaaccgaaacgcgaaaaaaactaaccgtaacgaaatataaaaaacccgcgaacccgacgcgaaa

SEQ ID NO: 19491 - DNA, 1014 bp, Artificial Sequence
  chemically treated genomic DNA (Homo sapiens) CpG-island No: 19491
ggttaggtagagttcgtagtggggggacgggattgggaaaataataaatggaggcggcggcggtaggagggggaattgggaggggtgggggtggggagtcgtaggtcggagttcgggcgggatagaatttcgcgggttcggggtttaggcggtcgtagattttatttgttggtagttcgggacggttggttggtttcgagcgggatttcgggtttcggcgtttttggggggcggcggcggtagttttttcgtttttttttttttttttcggttttagtcgtcgtcgcgacgacggcggcggcggtttcgattttttcggagggcggtttttattttttttttttttcgtttggttttaatcgttcgtcggttttcggagtaaatttcgattttcgttttgttttttattttttcgggttcgtcgtttttttttggtcgttcggaatgtttcgggtcgcgtcgttcgttttcgtcgcgtcgttcggtttcgcggttcgttcggttttcggcgcggtttcgattcgtcgtcgttcgcgttcgtttagcgtagttcgtattcgcgcgatttcgggtttttcggtcgtttcgttcgcggttttcgtttttttttcggtagtcggttttttttttttttttttagttttttttcgaagtcgcggttttttcgaaatggttcggttcgaggtttcgattcggcgcggggttgcggacgggttgggcggtgcgttcggcgattcgtataggaaagcggacggcgaagggagggagtttgggagagggggatgggagaagggaggaagagggagaaggagggagcgcggaggaacggaggagagaggggttaggagggagacgcgagggagggagcgcgaggtaagtcgcgaggggggagagagggggagtcggagagggggaggcgtagcgcgagttggtcgaggtcgaggtcgagggggtcggggcgcggggagggttagtcgtggcggaatgtggggagttcgcgggttcggcgcggga

SEQ ID NO: 19492 - DNA, 1014 bp, Artificial Sequence
  chemically treated genomic DNA (Homo sapiens) CpG-island No: 19492
tcccgcgccgaacccgcgaactccccacattccgccacgactaaccctccccgcgccccgaccccctcgacctcgacctcgaccaactcgcgctacgcctccccctctccgactccccctctctcccccctcgcgacttacctcgcgctccctccctcgcgtctccctcctaacccctctctcctccgttcctccgcgctccctccttctccctcttcctcccttctcccatccccctctcccaaactccctcccttcgccgtccgctttcctatacgaatcgccgaacgcaccgcccaacccgtccgcaaccccgcgccgaatcgaaacctcgaaccgaaccatttcgaaaaaaccgcgacttcgaaaaaaaactaaaaaaaaaaaaaaaaaaccgactaccgaaaaaaaaacgaaaaccgcgaacgaaacgaccgaaaaacccgaaatcgcgcgaatacgaactacgctaaacgaacgcgaacgacgacgaatcgaaaccgcgccgaaaaccgaacgaaccgcgaaaccgaacgacgcgacgaaaacgaacgacgcgacccgaaacattccgaacgaccaaaaaaaaacgacgaacccgaaaaaataaaaaacaaaacgaaaatcgaaatttactccgaaaaccgacgaacgattaaaaccaaacgaaaaaaaaaaaaaataaaaaccgccctccgaaaaaatcgaaaccgccgccgccgtcgtcgcgacgacgactaaaaccgaaaaaaaaaaaaaaaaacgaaaaaactaccgccgccgccccccaaaaacgccgaaacccgaaatcccgctcgaaaccaaccaaccgtcccgaactaccaacaaataaaatctacgaccgcctaaaccccgaacccgcgaaattctatcccgcccgaactccgacctacgactccccacccccacccctcccaattccccctcctaccgccgccgcctccatttattattttcccaatcccgtccccccactacgaactctacctaacc

SEQ ID NO: 19493 - DNA, 645 bp, Artificial Sequence
  chemically treated genomic DNA (Homo sapiens) CpG-island No: 19493
cgcgtaaggttcgtcgcgcgcgttttaattttttggtgttttttttggacgcggcgttgatcggggagttggaggtggtgtagtaggcggtgaaggaggtgagcgttgttgagcgggaggtgggtacggcgggggtatcgtagatgttagtcgcgggattgagttttttttttttttcggtgtatttagatgaacgattcgagttagtttaacgaggagggtattattgttttgtataacgttatttgcggcgttaattattttatcgtggatttttttattatcgcgggtgttaatgttaattttttcgatagttacggttggtgagtttcgattcgcgcggtgggttgggtttttcgtgggcggacgcgtagttttttacgtatcgtttttcgtaattttttatttttacgtttaggatatttttgtattgcgcggcgtcgtgtaacgatatagttatttgtatggcgttggtgtagtacggcgttgtaattttcgttattacgtttagcgacggcgttatcgttttcgagaagtgcgatttttatcgcgagggttatgttgattgcgttatttatttggtaggtgcgaggtagggttgttggcgtttgggtatttggcgggtgcgtaggagcggggagggga

SEQ ID NO: 19494 - DNA, 645 bp, Artificial Sequence
  chemically treated genomic DNA (Homo sapiens) CpG-island No: 19494
tcccctccccgctcctacgcacccgccaaatacccaaacgccaacaaccctacctcgcacctaccaaataaataacgcaatcaacataaccctcgcgataaaaatcgcacttctcgaaaacgataacgccgtcgctaaacgtaataacgaaaattacaacgccgtactacaccaacgccatacaaataactatatcgttacacgacgccgcgcaatacaaaaatatcctaaacgtaaaaataaaaaattacgaaaaacgatacgtaaaaaactacgcgtccgcccacgaaaaacccaacccaccgcgcgaatcgaaactcaccaaccgtaactatcgaaaaaattaacattaacacccgcgataataaaaaaatccacgataaaataattaacgccgcaaataacgttatacaaaacaataataccctcctcgttaaactaactcgaatcgttcatctaaatacaccgaaaaaaaaaaaaaactcaatcccgcgactaacatctacgatacccccgccgtacccacctcccgctcaacaacgctcacctccttcaccgcctactacaccacctccaactccccgatcaacgccgcgtccaaaaaaaacaccaaaaaattaaaacgcgcgcgacgaaccttacgcg

SEQ ID NO: 19495 - DNA, 645 bp, Artificial Sequence
  chemically treated genomic DNA (Homo sapiens) CpG-island No: 19495
tttttttttcgtttttgcgtattcgttaggtatttaggcgttagtagttttgtttcgtatttgttaggtaggtggcgtagttagtataattttcgcggtaagggtcgtatttttcgaaggcggtggcgtcgtcgttgagcgtggtggcgaagattgtagcgtcgtgttgtattagcgttatgtagatgattgtgtcgttgtacgacgtcgcgtagtgtaagggtgttttaggcgtgggggtggggggttgcggggaacgatgcgtgagaggttgcgcgttcgtttacgggggatttagtttatcgcgcgggtcggggtttattagtcgtggttgtcgggggagttgatattggtattcgcggtgatgaggaaatttacgatagagtagttggcgtcgtagatggcgttgtgtaaggtagtgatgtttttttcgttgggttggttcgggtcgtttatttgagtgtatcgggggagggggaagatttagtttcgcggttggtatttgcgatgttttcgtcgtgtttatttttcgtttagtagcgtttattttttttatcgtttgttgtattatttttagtttttcggttagcgtcgcgtttaggaggagtattagagggttgaggcgcgcgcggcgggttttgcgcg

SEQ ID NO: 19496 - DNA, 645 bp, Artificial Sequence
  chemically treated genomic DNA (Homo sapiens) CpG-island No: 19496
cgcgcaaaacccgccgcgcgcgcctcaaccctctaatactcctcctaaacgcgacgctaaccgaaaaactaaaaataatacaacaaacgataaaaaaaataaacgctactaaacgaaaaataaacacgacgaaaacatcgcaaataccaaccgcgaaactaaatcttccccctcccccgatacactcaaataaacgacccgaaccaacccaacgaaaaaaacatcactaccttacacaacgccatctacgacgccaactactctatcgtaaatttcctcatcaccgcgaataccaatatcaactcccccgacaaccacgactaataaaccccgacccgcgcgataaactaaatcccccgtaaacgaacgcgcaacctctcacgcatcgttccccgcaaccccccacccccacgcctaaaacacccttacactacgcgacgtcgtacaacgacacaatcatctacataacgctaatacaacacgacgctacaatcttcgccaccacgctcaacgacgacgccaccgccttcgaaaaatacgacccttaccgcgaaaattatactaactacgccacctacctaacaaatacgaaacaaaactactaacgcctaaatacctaacgaatacgcaaaaacgaaaaaaaaa

SEQ ID NO: 19497 - DNA, 737 bp, Artificial Sequence
  chemically treated genomic DNA (Homo sapiens) CpG-island No: 19497
ttatttcggtcgtttttttaggtggggttttatcgtttttcgtttcgttttcgagattagtttttagaggcgtcgttcggttttttttcgtttttgttttttatacgtaggtaggttgcgggtttcgagatttttcggttttcgggttttttcgcgtcgttcgtttttttttttcgtcgatgggtcggggagttttcgcggtttcggagtttagttcggcgcgcggagttcgtttatcgagttttttatagttaacgtgtaggtttcgtcgtagtaatagaatttttttatagtagtttcggtttcgttttttatatcgcggtcggaaatcggaagcgttcgtcgggtatcgtttattagttttcgcgaggtttcggaggtttcgtttattttcgttttttatttcgtttcggagcggagggtcggcgtttcgagcgggagaggaagaggcgtttcgggtttcgggcgagtagggcggggtggagcgagtacgcgggcggggcggggcggggttttgtcgggtcggcgagggtcgtttttttagttcgcgcggtcgttttacgtttttgtggtgcgggaggggtttcgtcgaggggcgagaacgggaggtgggggtgtgggcgggtttcgtcgaggggcgagaatagggtggggttttcgcgttcggatttcgtttttcgtttttttttcgttttttttttttttttcgattcgtttttggggaagagtgggtgggg

SEQ ID NO: 19498 - DNA, 737 bp, Artificial Sequence
  chemically treated genomic DNA (Homo sapiens) CpG-island No: 19498
ccccacccactcttccccaaaaacgaatcgaaaaaaaaaaaaaaaacgaaaaaaaaacgaaaaacgaaatccgaacgcgaaaaccccaccctattctcgcccctcgacgaaacccgcccacacccccacctcccgttctcgcccctcgacgaaacccctcccgcaccacaaaaacgtaaaacgaccgcgcgaactaaaaaaacgaccctcgccgacccgacaaaaccccgccccgccccgcccgcgtactcgctccaccccgccctactcgcccgaaacccgaaacgcctcttcctctcccgctcgaaacgccgaccctccgctccgaaacgaaataaaaaacgaaaataaacgaaacctccgaaacctcgcgaaaactaataaacgatacccgacgaacgcttccgatttccgaccgcgatataaaaaacgaaaccgaaactactataaaaaaattctattactacgacgaaacctacacgttaactataaaaaactcgataaacgaactccgcgcgccgaactaaactccgaaaccgcgaaaactccccgacccatcgacgaaaaaaaaaaacgaacgacgcgaaaaaacccgaaaaccgaaaaatctcgaaacccgcaacctacctacgtataaaaaacaaaaacgaaaaaaaaccgaacgacgcctctaaaaactaatctcgaaaacgaaacgaaaaacgataaaaccccacctaaaaaaacgaccgaaataa

SEQ ID NO: 19499 - DNA, 737 bp, Artificial Sequence
  chemically treated genomic DNA (Homo sapiens) CpG-island No: 19499
ttttatttatttttttttaggggcgagtcgggggaaggggaggaggcggaggaggggcgaggggcggagttcgggcgcgggagttttattttgttttcgtttttcggcggggttcgtttatatttttatttttcgttttcgtttttcggcggggtttttttcgtattatagagacgtgggacggtcgcgcggattagagaagcggttttcgtcggttcgataaagtttcgtttcgtttcgttcgcgtgttcgttttatttcgttttgttcgttcggagttcgaggcgtttttttttttttcgttcggagcgtcggtttttcgtttcggggcggggtgggaagcggaggtgggcggagttttcggggtttcgcgagggttggtgggcggtgttcggcgggcgttttcggttttcggtcgcggtatgaggggcggggtcggggttgttgtgggagagttttgttgttgcggcggggtttgtacgttgattgtgggaaattcggtgagcgggtttcgcgcgtcgggttgggtttcgggatcgcggaggtttttcggtttatcgacgagggagagaggcgagcggcgcggggaggttcgggggtcggggaatttcggggttcgtagtttatttgcgtgtgagaggtaggggcgaggggaaatcgggcggcgtttttagaagttggtttcgggggcggggcggggggcggtgaagttttatttggaggagcggtcgggatgg

SEQ ID NO: 19500 - DNA, 737 bp, Artificial Sequence
  chemically treated genomic DNA (Homo sapiens) CpG-island No: 19500
ccatcccgaccgctcctccaaataaaacttcaccgccccccgccccgcccccgaaaccaacttctaaaaacgccgcccgatttcccctcgcccctacctctcacacgcaaataaactacgaaccccgaaattccccgacccccgaacctccccgcgccgctcgcctctctccctcgtcgataaaccgaaaaacctccgcgatcccgaaacccaacccgacgcgcgaaacccgctcaccgaatttcccacaatcaacgtacaaaccccgccgcaacaacaaaactctcccacaacaaccccgaccccgcccctcataccgcgaccgaaaaccgaaaacgcccgccgaacaccgcccaccaaccctcgcgaaaccccgaaaactccgcccacctccgcttcccaccccgccccgaaacgaaaaaccgacgctccgaacgaaaaaaaaaaaaacgcctcgaactccgaacgaacaaaacgaaataaaacgaacacgcgaacgaaacgaaacgaaactttatcgaaccgacgaaaaccgcttctctaatccgcgcgaccgtcccacgtctctataatacgaaaaaaaccccgccgaaaaacgaaaacgaaaaataaaaatataaacgaaccccgccgaaaaacgaaaacaaaataaaactcccgcgcccgaactccgcccctcgcccctcctccgcctcctccccttcccccgactcgcccctaaaaaaaaataaataaaa

SEQ ID NO: 19501 - DNA, 588 bp, Artificial Sequence
  chemically treated genomic DNA (Homo sapiens) CpG-island No: 19501
agacggggtataggaacgtatttacgtagttacgttacgtataggtaagaagtttcgtttcgggtcgcggggttgggttttaggttcgagtttcgggtttcgcgttttttttttttttcgcggggttttgttggtttacgtttcgtaaagttcggttaggtattgttattcgtagagagtttaattcgttgatttcggcggcgtttatttattcgagacgtttaaggttcgggagtttatcgttcgggtagggttaggcgggagtgggtgtcggggtgggtatttagttttcggacggatttggatcgcgttcggggacgtttacgtatttttacgttttaggttcgtcgggatttagattcggcgtttttcgtacggcgggagtttggttttttttttcgttttgggttttgcggggagagcgtgtgcggggaattgcgttcgttgttatgtaatttttatttcgcgttcgtcgtatcgcgtttttcgggacggaagcgcgttttattcgggttaattttaattttttattttattcgtggttggtttttacggagcgttaatatttaatagttttaggatgggagg

SEQ ID NO: 19502 - DNA, 588 bp, Artificial Sequence
  chemically treated genomic DNA (Homo sapiens) CpG-island No: 19502
cctcccatcctaaaactattaaatattaacgctccgtaaaaaccaaccacgaataaaataaaaaattaaaattaacccgaataaaacgcgcttccgtcccgaaaaacgcgatacgacgaacgcgaaataaaaattacataacaacgaacgcaattccccgcacacgctctccccgcaaaacccaaaacgaaaaaaaaaaccaaactcccgccgtacgaaaaacgccgaatctaaatcccgacgaacctaaaacgtaaaaatacgtaaacgtccccgaacgcgatccaaatccgtccgaaaactaaatacccaccccgacacccactcccgcctaaccctacccgaacgataaactcccgaaccttaaacgtctcgaataaataaacgccgccgaaatcaacgaattaaactctctacgaataacaatacctaaccgaactttacgaaacgtaaaccaacaaaaccccgcgaaaaaaaaaaaaaacgcgaaacccgaaactcgaacctaaaacccaaccccgcgacccgaaacgaaacttcttacctatacgtaacgtaactacgtaaatacgttcctataccccgtct

SEQ ID NO: 19503 - DNA, 588 bp, Artificial Sequence
  chemically treated genomic DNA (Homo sapiens) CpG-island No: 19503
ttttttattttggggttgttgggtgttggcgtttcgtgggaattagttacgggtggggtgggaagttggggttggttcgggtggggcgcgttttcgtttcgggaggcgcggtgcggcgggcgcgggatggaggttgtatagtaacgagcgtagtttttcgtatacgtttttttcgtaggatttagggcgggggagggagttaggttttcgtcgtgcggggggcgtcgaatttagatttcggcgggtttggagcgtgggagtgcgtgggcgttttcgggcgcggtttaagttcgttcgggggttgggtgtttatttcgatatttattttcgtttggttttgttcgaacgatgggttttcgggttttaggcgtttcgggtgagtgggcgtcgtcgggattagcgggttgggttttttgcgggtggtagtgtttggtcgggttttgcggggcgtggattagtagggtttcgcggggagggaaggagacgcggggttcggagttcggatttggagtttagtttcgcggttcggaacggggttttttgtttgtgcgtggcgtgattacgtgagtgcgtttttgtgtttcgttt

SEQ ID NO: 19504 - DNA, 588 bp, Artificial Sequence
  chemically treated genomic DNA (Homo sapiens) CpG-island No: 19504
aaacgaaacacaaaaacgcactcacgtaatcacgccacgcacaaacaaaaaaccccgttccgaaccgcgaaactaaactccaaatccgaactccgaaccccgcgtctccttccctccccgcgaaaccctactaatccacgccccgcaaaacccgaccaaacactaccacccgcaaaaaacccaacccgctaatcccgacgacgcccactcacccgaaacgcctaaaacccgaaaacccatcgttcgaacaaaaccaaacgaaaataaatatcgaaataaacacccaacccccgaacgaacttaaaccgcgcccgaaaacgcccacgcactcccacgctccaaacccgccgaaatctaaattcgacgccccccgcacgacgaaaacctaactccctcccccgccctaaatcctacgaaaaaaacgtatacgaaaaactacgctcgttactatacaacctccatcccgcgcccgccgcaccgcgcctcccgaaacgaaaacgcgccccacccgaaccaaccccaacttcccaccccacccgtaactaattcccacgaaacgccaacacccaacaaccccaaaataaaaaa

SEQ ID NO: 19505 - DNA, 1046 bp, Artificial Sequence
  chemically treated genomic DNA (Homo sapiens) CpG-island No: 19505
gtttttttacgttcgtcgtttcgggtttttttattggttcgttttttttcgcggagggtcgcgttttcgtcgtagcgtcggcggttttatttgtagtattattttgtattgttttttcggtttttggattacgtatatattatattttatgttgttggtcggcgagaggaggcggagggcgggaacgggaagacgttttttattgattcgggcgcgggatttcgggtttcgggtcggggttaggggttatattttggcgcggggggcgggtcgtttagcgggggaggggggtacgttttcgaggtgggggtagcggttcgttttttaggttaatttttcgttggtcgaggttaggcgcgggtatgttttttcgtattcggttaggagaaaaagggtagcgggggatgggcgggcgcgtcgggcgttgttaggttacggttttttagggagcgcgggggcgcgtcgggtcgttaggggtcgttaggggtcgtgggtcgcgcgttttttcgttcgcggggttcgtcgttgtcgttgtcgttttcggtttttgtttatggtcgttagtttcgggagttcggttttcgcgttcggcgtcgcggttcggttcgcgataggggggtagcggcgcggcggcggttttcgttcgcggttaggttagcgttcgcgttttcgtttcgttcggtcgcgttttcggagttttcggcgttcgtttttcgtttagtagtcgttggtcgtttttagttttcgttcgggacgacgggtacgcgagcgcgtttacggcggcgggggaggggcgcgggtacggggcgtacgcgcgtcgggaggggcggggaggggagcggggtcggttgcgggagggagcggcgggggcgttggagtcggcgcgggaagtcgggggcgggcgttcgacggaagcgggcgggggttttaggtattttacgatattcggcgttcggttttgaggggcgggtattaggcgcgttgtttgcgcgatgtcgttttgggagagaggggttttgttaggaggagtagttttttgggttttt

SEQ ID NO: 19506 - DNA, 1046 bp, Artificial Sequence
  chemically treated genomic DNA (Homo sapiens) CpG-island No: 19506
aaaaacccaaaaaactactcctcctaacaaaacccctctctcccaaaacgacatcgcgcaaacaacgcgcctaatacccgcccctcaaaaccgaacgccgaatatcgtaaaatacctaaaacccccgcccgcttccgtcgaacgcccgcccccgacttcccgcgccgactccaacgcccccgccgctccctcccgcaaccgaccccgctcccctccccgcccctcccgacgcgcgtacgccccgtacccgcgcccctcccccgccgccgtaaacgcgctcgcgtacccgtcgtcccgaacgaaaactaaaaacgaccaacgactactaaacgaaaaacgaacgccgaaaactccgaaaacgcgaccgaacgaaacgaaaacgcgaacgctaacctaaccgcgaacgaaaaccgccgccgcgccgctacccccctatcgcgaaccgaaccgcgacgccgaacgcgaaaaccgaactcccgaaactaacgaccataaacaaaaaccgaaaacgacaacgacaacgacgaaccccgcgaacgaaaaaacgcgcgacccacgacccctaacgacccctaacgacccgacgcgcccccgcgctccctaaaaaaccgtaacctaacaacgcccgacgcgcccgcccatcccccgctaccctttttctcctaaccgaatacgaaaaaacatacccgcgcctaacctcgaccaacgaaaaattaacctaaaaaacgaaccgctacccccacctcgaaaacgtacccccctcccccgctaaacgacccgccccccgcgccaaaatataacccctaaccccgacccgaaacccgaaatcccgcgcccgaatcaataaaaaacgtcttcccgttcccgccctccgcctcctctcgccgaccaacaacataaaatataatatatacgtaatccaaaaaccgaaaaaacaatacaaaataatactacaaataaaaccgccgacgctacgacgaaaacgcgaccctccgcgaaaaaaaacgaaccaataaaaaaacccgaaacgacgaacgtaaaaaaac

SEQ ID NO: 19507 - DNA, 1046 bp, Artificial Sequence
  chemically treated genomic DNA (Homo sapiens) CpG-island No: 19507
ggggatttaggagattgttttttttggtaggattttttttttttagagcggtatcgcgtagataacgcgtttggtgttcgttttttaggatcggacgtcgggtgtcgtggggtgtttaggattttcgttcgttttcgtcgagcgttcgttttcggtttttcgcgtcggttttagcgttttcgtcgttttttttcgtagtcggtttcgttttttttttcgtttttttcggcgcgcgtgcgtttcgtgttcgcgtttttttttcgtcgtcgtgggcgcgttcgcgtgttcgtcgtttcgggcgggagttggagacggttagcggttgttggacgaagagcgggcgtcgggagtttcgagagcgcggtcgggcgaggcgggagcgcgggcgttggtttggtcgcgggcgggggtcgtcgtcgcgtcgttgtttttttgtcgcgggtcgggtcgcggcgtcgagcgcgagggtcgggttttcggggttggcggttatgggtaggagtcggaggcggtagcggtagcggcgggtttcgcgggcggggaggcgcgcggtttacggtttttgacggtttttggcggttcggcgcgttttcgcgttttttggggggtcgtagtttggtaacgttcggcgcgttcgtttatttttcgttgtttttttttttttggtcgggtgcgagggagtatgttcgcgtttggtttcggttagcgaagagttaatttgaggggcgagtcgttgtttttatttcgggggcgtgtttttttttttcgttaggcggttcgtttttcgcgttagggtatggtttttggtttcggttcgggattcgaggtttcgcgttcgggttagtgaaaggcgttttttcgttttcgtttttcgttttttttcgtcggttagtaatatgggatgtaatatgtgcgtggtttagaaatcggaggagtagtataaagtgatgttgtaggtagggtcgtcggcgttgcggcgggggcgcggtttttcgcggggaggagcgggttagtggggaggttcggagcggcgggcgtgggagagt

SEQ ID NO: 19508 - DNA, 1046 bp, Artificial Sequence
  chemically treated genomic DNA (Homo sapiens) CpG-island No: 19508
actctcccacgcccgccgctccgaacctccccactaacccgctcctccccgcgaaaaaccgcgcccccgccgcaacgccgacgaccctacctacaacatcactttatactactcctccgatttctaaaccacgcacatattacatcccatattactaaccgacgaaaaaaaacgaaaaacgaaaacgaaaaaacgcctttcactaacccgaacgcgaaacctcgaatcccgaaccgaaaccaaaaaccataccctaacgcgaaaaacgaaccgcctaacgaaaaaaaaaaacacgcccccgaaataaaaacaacgactcgcccctcaaattaactcttcgctaaccgaaaccaaacgcgaacatactccctcgcacccgaccaaaaaaaaaaaaacaacgaaaaataaacgaacgcgccgaacgttaccaaactacgaccccccaaaaaacgcgaaaacgcgccgaaccgccaaaaaccgtcaaaaaccgtaaaccgcgcgcctccccgcccgcgaaacccgccgctaccgctaccgcctccgactcctacccataaccgccaaccccgaaaacccgaccctcgcgctcgacgccgcgacccgacccgcgacaaaaaaacaacgacgcgacgacgacccccgcccgcgaccaaaccaacgcccgcgctcccgcctcgcccgaccgcgctctcgaaactcccgacgcccgctcttcgtccaacaaccgctaaccgtctccaactcccgcccgaaacgacgaacacgcgaacgcgcccacgacgacgaaaaaaaaacgcgaacacgaaacgcacgcgcgccgaaaaaaacgaaaaaaaaaacgaaaccgactacgaaaaaaaacgacgaaaacgctaaaaccgacgcgaaaaaccgaaaacgaacgctcgacgaaaacgaacgaaaatcctaaacaccccacgacacccgacgtccgatcctaaaaaacgaacaccaaacgcgttatctacgcgataccgctctaaaaaaaaaaaatcctaccaaaaaaaacaatctcctaaatcccc

SEQ ID NO: 19509 - DNA, 574 bp, Artificial Sequence
  chemically treated genomic DNA (Homo sapiens) CpG-island No: 19509
ttcggttttttttcggttgagttcggttaacgtttgtttttttaggttcggtttttttcggttttttgagagcgcgtttgtcgtggtttcggttttttttcggttgcgttcggtttacgattattttagttttagtttttttcggttacgttcggttggttgtcgttttttcggattcggtttttttcggttgagttcggtttattttttattaggagtcggtttttttcggttgcgttcggttgcgattcggaagagtttttatggagttagggtagtcggttcgacggattgttatggcgtcgttgttggagtacgagcgatagttggtgttggaattgttcgatattgacgggttagtagtgtgcgttcgcgggttcggcgcggatcggtttttttattattttttttagttgtattgttatttagtttgtttggtgttggtgtttaatacgtagtcggtcgaggaggtgcggtcgcgttggcgcgggagtgaggggatttcgagagtgttgagggttttttgagcggatgcgaggtttttgatagggatggaggggttttgagggggatt

SEQ ID NO: 19510 - DNA, 574 bp, Artificial Sequence
  chemically treated genomic DNA (Homo sapiens) CpG-island No: 19510
aatccccctcaaaacccctccatccctatcaaaaacctcgcatccgctcaaaaaaccctcaacactctcgaaatcccctcactcccgcgccaacgcgaccgcacctcctcgaccgactacgtattaaacaccaacaccaaacaaactaaataacaatacaactaaaaaaaataataaaaaaaccgatccgcgccgaacccgcgaacgcacactactaacccgtcaatatcgaacaattccaacaccaactatcgctcgtactccaacaacgacgccataacaatccgtcgaaccgactaccctaactccataaaaactcttccgaatcgcaaccgaacgcaaccgaaaaaaaccgactcctaataaaaaataaaccgaactcaaccgaaaaaaaccgaatccgaaaaaacgacaaccaaccgaacgtaaccgaaaaaaactaaaactaaaataatcgtaaaccgaacgcaaccgaaaaaaaaccgaaaccacgacaaacgcgctctcaaaaaaccgaaaaaaaccgaacctaaaaaaacaaacgttaaccgaactcaaccgaaaaaaaaccgaa

SEQ ID NO: 19511 - DNA, 574 bp, Artificial Sequence
  chemically treated genomic DNA (Homo sapiens) CpG-island No: 19511
aattttttttagagtttttttatttttgttagaggtttcgtattcgtttaggaggtttttaatattttcggagtttttttattttcgcgttagcgcggtcgtattttttcggtcggttgcgtgttgagtattagtattaggtaggttgggtggtagtgtagttggagaaagtggtagaggagtcggttcgcgtcgagttcgcgggcgtatattattagttcgttagtgtcgagtagttttagtattagttgtcgttcgtattttagtagcggcgttatggtaattcgtcgagtcggttgttttgattttatggaagttttttcgggtcgtagtcgaacgtagtcgaaggaagtcgatttttagtggagagtaggtcgaatttaatcgaagagagtcgagttcgagaggacggtagttagtcgaacgtagtcgaggagagttgagattgagatgatcgtgggtcgaacgtagtcgaagaggagtcgaggttacgataggcgcgtttttagaaagtcgaagagagtcgagtttgagaaggtaagcgttggtcgaatttagtcgaagaagagtcgag

SEQ ID NO: 19512 - DNA, 574 bp, Artificial Sequence
  chemically treated genomic DNA (Homo sapiens) CpG-island No: 19512
ctcgactcttcttcgactaaattcgaccaacgcttaccttctcaaactcgactctcttcgactttctaaaaacgcgcctatcgtaacctcgactcctcttcgactacgttcgacccacgatcatctcaatctcaactctcctcgactacgttcgactaactaccgtcctctcgaactcgactctcttcgattaaattcgacctactctccactaaaaatcgacttccttcgactacgttcgactacgacccgaaaaaacttccataaaatcaaaacaaccgactcgacgaattaccataacgccgctactaaaatacgaacgacaactaatactaaaactactcgacactaacgaactaataatatacgcccgcgaactcgacgcgaaccgactcctctaccactttctccaactacactaccacccaacctacctaatactaatactcaacacgcaaccgaccgaaaaaatacgaccgcgctaacgcgaaaataaaaaaactccgaaaatattaaaaacctcctaaacgaatacgaaacctctaacaaaaataaaaaaactctaaaaaaaatt

SEQ ID NO: 19513 - DNA, 505 bp, Artificial Sequence
  chemically treated genomic DNA (Homo sapiens) CpG-island No: 19513
ttttcgtttcgtttcgtttttatttcgtttttagaggtgattcgagcgtcgtcgtcgttagttttatacgttagtttaggagcgttttttagagtcggtattggagagcgcgcggcgtagggaggtaggcggagacgcggcggtagcggtcgcggttgcgcgggggcggacgtaaaaggtatacgcgtttttcggcgtcggttttcggttcggcgaggtttgagcgcgttcgcgggttgggaggtcgttggattcgggcgtatggtttttttcgggtagttatttttttgtcgcgattttgaggttttcggtaagaattggcgtttttttttttaacgtcggttttcggttttcgtttttgacgtttaggttcggggaggtcgttatttagaaattgttttattcgagttcgtcgtttcggagatgtcgagagtttggttttgttttttgttttcggtttttttttagatttattattttaggttattaaaggcgttttttatta

SEQ ID NO: 19514 - DNA, 505 bp, Artificial Sequence
  chemically treated genomic DNA (Homo sapiens) CpG-island No: 19514
taataaaaaacgcctttaataacctaaaataataaatctaaaaaaaaaccgaaaacaaaaaacaaaaccaaactctcgacatctccgaaacgacgaactcgaataaaacaatttctaaataacgacctccccgaacctaaacgtcaaaaacgaaaaccgaaaaccgacgttaaaaaaaaaaacgccaattcttaccgaaaacctcaaaatcgcgacaaaaaaataactacccgaaaaaaaccatacgcccgaatccaacgacctcccaacccgcgaacgcgctcaaacctcgccgaaccgaaaaccgacgccgaaaaacgcgtataccttttacgtccgcccccgcgcaaccgcgaccgctaccgccgcgtctccgcctacctccctacgccgcgcgctctccaataccgactctaaaaaacgctcctaaactaacgtataaaactaacgacgacgacgctcgaatcacctctaaaaacgaaataaaaacgaaacgaaacgaaaa

SEQ ID NO: 19515 - DNA, 505 bp, Artificial Sequence
  chemically treated genomic DNA (Homo sapiens) CpG-island No: 19515
tggtgggaggcgtttttagtgatttgaagtagtgagtttaggaaggggtcgggggtagagggtaggattaggttttcggtattttcgaggcggcggattcggatggagtagtttttgagtgacggttttttcgggtttgggcgttaagggcgaaggtcgaaagtcggcgttagaaagaggaacgttagtttttatcgaagattttaaggtcgcggtaaggagataattgttcgggggaggttatgcgttcgggtttagcggttttttagttcgcggacgcgtttaaatttcgtcgggtcggaagtcggcgtcgggaagcgcgtgtgttttttacgttcgttttcgcgtagtcgcggtcgttgtcgtcgcgttttcgtttgtttttttgcgtcgcgcgttttttagtgtcggttttagagggcgtttttgggttagcgtgtagggttggcggcggcggcgttcgggttatttttgggagcggagtgggggcggagcgagacggaag

SEQ ID NO: 19516 - DNA, 505 bp, Artificial Sequence
  chemically treated genomic DNA (Homo sapiens) CpG-island No: 19516
cttccgtctcgctccgcccccactccgctcccaaaaataacccgaacgccgccgccgccaaccctacacgctaacccaaaaacgccctctaaaaccgacactaaaaaacgcgcgacgcaaaaaaacaaacgaaaacgcgacgacaacgaccgcgactacgcgaaaacgaacgtaaaaaacacacgcgcttcccgacgccgacttccgacccgacgaaatttaaacgcgtccgcgaactaaaaaaccgctaaacccgaacgcataacctcccccgaacaattatctccttaccgcgaccttaaaatcttcgataaaaactaacgttcctctttctaacgccgactttcgaccttcgcccttaacgcccaaacccgaaaaaaccgtcactcaaaaactactccatccgaatccgccgcctcgaaaataccgaaaacctaatcctaccctctacccccgaccccttcctaaactcactacttcaaatcactaaaaacgcctcccacca

SEQ ID NO: 19517 - DNA, 742 bp, Artificial Sequence
  chemically treated genomic DNA (Homo sapiens) CpG-island No: 19517
gcgcgaggtttcgtttcgttcggcgtttcgtttttttcgttggatttcgtagtcgcggtttttttcgacgcgtttcgatttttttagttgtgtattttttatttagttgtgcgttttcgtcgggagttttagttatgttcgacgagagagaggtagtcgaggtagcgatcggggaagacgttttttcgtcgttttcgaaaatcgaggtagcgagcgatttttagtatttcgcggttttcgaaggggtcgtcgtcgtcgtcgtttcgtcgttattgttgcgttgtttagtgtttatcggttttggaggttacgataaggtgaagttgtagagtcggtcggtagcggtttcggtttttgggttcggttagttgacgttgcgtttgcgggtttgcgggtttaatttcgtagattttatggttaggtaggggttgtacgatcgtttttcgtttttgtttgttatttcgggtatggagggcgcgggtgttgtgatcgtagtgggcgagggagttagcgatcgtaaggtgagcgggttgcgtagggtagggtagggttgcgtaggttattgggtagtggggtacgagtgggcgagcgtcgggggtgtggtagggcgggagaaattggcgcggatttgggtgtacgagcgtggaaagcgtagttaaggaatttgtgtttgggggtttttggagagcggtatttatgtggggaggggagacgaaattatcgttttttttttaattatttt

SEQ ID NO: 19518 - DNA, 742 bp, Artificial Sequence
  chemically treated genomic DNA (Homo sapiens) CpG-island No: 19518
aaaataattaaaaaaaaaacgataatttcgtctcccctccccacataaataccgctctccaaaaacccccaaacacaaattccttaactacgctttccacgctcgtacacccaaatccgcgccaatttctcccgccctaccacacccccgacgctcgcccactcgtaccccactacccaataacctacgcaaccctaccctaccctacgcaacccgctcaccttacgatcgctaactccctcgcccactacgatcacaacacccgcgccctccatacccgaaataacaaacaaaaacgaaaaacgatcgtacaacccctacctaaccataaaatctacgaaattaaacccgcaaacccgcaaacgcaacgtcaactaaccgaacccaaaaaccgaaaccgctaccgaccgactctacaacttcaccttatcgtaacctccaaaaccgataaacactaaacaacgcaacaataacgacgaaacgacgacgacgacgaccccttcgaaaaccgcgaaatactaaaaatcgctcgctacctcgattttcgaaaacgacgaaaaaacgtcttccccgatcgctacctcgactacctctctctcgtcgaacataactaaaactcccgacgaaaacgcacaactaaataaaaaatacacaactaaaaaaatcgaaacgcgtcgaaaaaaaccgcgactacgaaatccaacgaaaaaaacgaaacgccgaacgaaacgaaacctcgcgc

SEQ ID NO: 19519 - DNA, 742 bp, Artificial Sequence
  chemically treated genomic DNA (Homo sapiens) CpG-island No: 19519
aaaatggttggggaaggggcgataatttcgttttttttttttatataaatgtcgttttttaggagtttttaaatataagttttttggttacgttttttacgttcgtgtatttaggttcgcgttagtttttttcgttttgttatattttcggcgttcgtttattcgtgttttattgtttagtggtttgcgtagttttgttttgttttacgtaattcgtttattttgcggtcgttgattttttcgtttattgcgattataatattcgcgttttttatgttcggagtgataggtagaggcgggagacggtcgtatagtttttgtttagttatgaggtttgcgaagttgagttcgtaggttcgtagacgtagcgttagttggtcgggtttaggggtcggggtcgttgtcggtcggttttgtagttttattttgtcgtagtttttaaagtcggtgagtattaggtagcgtagtagtggcggcgaggcggcggcggcggcggttttttcggaggtcgcgggatgttgggggtcgttcgttgtttcggttttcggaggcggcgaagaggcgtttttttcggtcgttgtttcggttatttttttttcgtcggatatggttgggattttcgacgagagcgtatagttggatggagagtgtatagttggggaagtcggaacgcgtcgggaagagtcgcggttgcgggatttagcgggaggggcggggcgtcgggcgaggcggggtttcgcgt

SEQ ID NO: 19520 - DNA, 742 bp, Artificial Sequence
  chemically treated genomic DNA (Homo sapiens) CpG-island No: 19520
acgcgaaaccccgcctcgcccgacgccccgcccctcccgctaaatcccgcaaccgcgactcttcccgacgcgttccgacttccccaactatacactctccatccaactatacgctctcgtcgaaaatcccaaccatatccgacgaaaaaaaaataaccgaaacaacgaccgaaaaaaacgcctcttcgccgcctccgaaaaccgaaacaacgaacgacccccaacatcccgcgacctccgaaaaaaccgccgccgccgccgcctcgccgccactactacgctacctaatactcaccgactttaaaaactacgacaaaataaaactacaaaaccgaccgacaacgaccccgacccctaaacccgaccaactaacgctacgtctacgaacctacgaactcaacttcgcaaacctcataactaaacaaaaactatacgaccgtctcccgcctctacctatcactccgaacataaaaaacgcgaatattataatcgcaataaacgaaaaaatcaacgaccgcaaaataaacgaattacgtaaaacaaaacaaaactacgcaaaccactaaacaataaaacacgaataaacgaacgccgaaaatataacaaaacgaaaaaaactaacgcgaacctaaatacacgaacgtaaaaaacgtaaccaaaaaacttatatttaaaaactcctaaaaaacgacatttatataaaaaaaaaaaacgaaattatcgccccttccccaaccatttt

SEQ ID NO: 19521 - DNA, 593 bp, Artificial Sequence
  chemically treated genomic DNA (Homo sapiens) CpG-island No: 19521
agaaggcgcggatttgttcgtatggggacggaggtttagcggtcgataggtatcgggttcgtcggggacggacggtagagggcgggtcgggttttatgggtttggtcggggcggaaggagggcgtcgtgggcgtcgtgggagtttgggatattttttttttatcggtgtcggggcgcggtcgacgtagtgcgtaagttcgtttttttttcgtattttgcgcgcgagtttagtgtcgtcggattaattagagtttgggaacgaatttcgtcgcgggtttgcgaatcggaagatattgtcgttaggcgcggggcgggataggatttcgttttcggtttatataaagggaagtttacgttttaagttaattaatatagtttcgttcgagtcgggaagcggagagttgtgggcgtgcgtagacgcgttttttcggtttcggtttcgttttgtcgcgttttgggtttcgtttttatagttgtcggttgtttgttggttacgtgcgaggcgttagttaaagagaatcgagttttaggtttgtgtggcgagtttttaattcggcggaggagtagtgtgttatttgtagtagtaggatata

SEQ ID NO: 19522 - DNA, 593 bp, Artificial Sequence
  chemically treated genomic DNA (Homo sapiens) CpG-island No: 19522
tatatcctactactacaaataacacactactcctccgccgaattaaaaactcgccacacaaacctaaaactcgattctctttaactaacgcctcgcacgtaaccaacaaacaaccgacaactataaaaacgaaacccaaaacgcgacaaaacgaaaccgaaaccgaaaaaacgcgtctacgcacgcccacaactctccgcttcccgactcgaacgaaactatattaattaacttaaaacgtaaacttccctttatataaaccgaaaacgaaatcctatcccgccccgcgcctaacgacaatatcttccgattcgcaaacccgcgacgaaattcgttcccaaactctaattaatccgacgacactaaactcgcgcgcaaaatacgaaaaaaaaacgaacttacgcactacgtcgaccgcgccccgacaccgataaaaaaaaaatatcccaaactcccacgacgcccacgacgccctccttccgccccgaccaaacccataaaacccgacccgccctctaccgtccgtccccgacgaacccgatacctatcgaccgctaaacctccgtccccatacgaacaaatccgcgccttct

SEQ ID NO: 19523 - DNA, 593 bp, Artificial Sequence
  chemically treated genomic DNA (Homo sapiens) CpG-island No: 19523
tgtgttttgttattgtaggtggtatattgttttttcgtcgggttgaaaattcgttatataggtttggagttcggttttttttggttggcgtttcgtacgtgattagtaggtagtcggtagttgtggaagcggagtttagagcgcggtagggcggggtcggggtcggaaaggcgcgtttgcgtacgtttatagtttttcgtttttcggttcgggcgaggttgtgttgattggtttaagacgtgggtttttttttgtatgggtcggaggcggagttttgtttcgtttcgcgtttggcggtagtgtttttcggttcgtaagttcgcggcgaggttcgtttttaggttttgattggttcggcggtattgggttcgcgcgtagggtgcgggggaagggcgggtttgcgtattgcgtcggtcgcgtttcggtatcggtggaagggaggtgttttaggtttttacggcgtttacggcgtttttttttcgtttcggttaggtttatgggattcggttcgttttttgtcgttcgttttcggcgggttcgatgtttgtcggtcgttgagttttcgtttttatgcgggtaggttcgcgtttttt

SEQ ID NO: 19524 - DNA, 593 bp, Artificial Sequence
  chemically treated genomic DNA (Homo sapiens) CpG-island No: 19524
aaaaaacgcgaacctacccgcataaaaacgaaaactcaacgaccgacaaacatcgaacccgccgaaaacgaacgacaaaaaacgaaccgaatcccataaacctaaccgaaacgaaaaaaaaacgccgtaaacgccgtaaaaacctaaaacacctcccttccaccgataccgaaacgcgaccgacgcaatacgcaaacccgcccttcccccgcaccctacgcgcgaacccaataccgccgaaccaatcaaaacctaaaaacgaacctcgccgcgaacttacgaaccgaaaaacactaccgccaaacgcgaaacgaaacaaaactccgcctccgacccatacaaaaaaaaacccacgtcttaaaccaatcaacacaacctcgcccgaaccgaaaaacgaaaaactataaacgtacgcaaacgcgcctttccgaccccgaccccgccctaccgcgctctaaactccgcttccacaactaccgactacctactaatcacgtacgaaacgccaaccaaaaaaaaccgaactccaaacctatataacgaattttcaacccgacgaaaaaacaatataccacctacaataacaaaacaca

SEQ ID NO: 19525 - DNA, 942 bp, Artificial Sequence
  chemically treated genomic DNA (Homo sapiens) CpG-island No: 19525
ttttcgtcggtttgttcggtttcgttttttcggggttgggtaggtattgtgacgatttgattttgtataacgttcggagtataggaataggagtgggcgtttcggaggttttcggagtttatttaacggaggttcgatattacgtaaataggagggaatcgtagtttcggtttcgcgtttcggttttttcggcgggttgggttagttttataggtttagcggtcgtaggtatatttagggttatcgggtcgggttcggtcggggttttcgggagtatgcgcggtagttattcggttcggcgtttacgcggcgcggatagtttttcgtttcgggcgtttattttcgtattgcggatgtttataacggcggcggggttcgcgggttttagcggatcgtgaaggcgtagttagttgtcgtcgcgtttcgaagcgacgtcgggacggtcggggttgggatcggagttgggttcgttgggcgacggcggaaggggcggtgcgcgtcgggtcggttatcggtcggaagtgtacggtcgtcgggttcgttttttcggtcgtttggttaatgcgcgggataggttagcgtacggggcgggttaatgcgcggagtcggttagcgcggggcgggtttgggggcggggcgggcgttgtttcggagttggagtcggtttttttttcggcgcgatagtttttttttcgcgagtttatagacgcgcgtatagtcgtaggtggagcggatttagtttttatttcgcgtttcggtaggcgggggtgggggcgggggagggggcgggggcggggcggtttagtagggcgtttagtattttttcgtatatggttaggtatcgcggtacgtggaagtagtttgcgggtagaggcgggtaggtagtgagggtcgggggtagtcgagaggcgtaatttttgcggtttcgtttttttttttatt

SEQ ID NO: 19526 - DNA, 942 bp, Artificial Sequence
  chemically treated genomic DNA (Homo sapiens) CpG-island No: 19526
aataaaaaaaaaaacgaaaccgcaaaaattacgcctctcgactacccccgaccctcactacctacccgcctctacccgcaaactacttccacgtaccgcgatacctaaccatatacgaaaaaatactaaacgccctactaaaccgccccgcccccgccccctcccccgcccccacccccgcctaccgaaacgcgaaataaaaactaaatccgctccacctacgactatacgcgcgtctataaactcgcgaaaaaaaaactatcgcgccgaaaaaaaaaccgactccaactccgaaacaacgcccgccccgcccccaaacccgccccgcgctaaccgactccgcgcattaacccgccccgtacgctaacctatcccgcgcattaaccaaacgaccgaaaaaacgaacccgacgaccgtacacttccgaccgataaccgacccgacgcgcaccgccccttccgccgtcgcccaacgaacccaactccgatcccaaccccgaccgtcccgacgtcgcttcgaaacgcgacgacaactaactacgccttcacgatccgctaaaacccgcgaaccccgccgccgttataaacatccgcaatacgaaaataaacgcccgaaacgaaaaactatccgcgccgcgtaaacgccgaaccgaataactaccgcgcatactcccgaaaaccccgaccgaacccgacccgataaccctaaatatacctacgaccgctaaacctataaaactaacccaacccgccgaaaaaaccgaaacgcgaaaccgaaactacgattccctcctatttacgtaatatcgaacctccgttaaataaactccgaaaacctccgaaacgcccactcctattcctatactccgaacgttatacaaaatcaaatcgtcacaatacctacccaaccccgaaaaaacgaaaccgaacaaaccgacgaaaa

SEQ ID NO: 19527 - DNA, 942 bp, Artificial Sequence
  chemically treated genomic DNA (Homo sapiens) CpG-island No: 19527
agtgggggagagggcggggtcgtaggggttgcgtttttcggttgttttcggtttttattatttgttcgtttttattcgtaggttgtttttacgtgtcgcggtgtttagttatgtgcgaggagatgttgggcgttttgttgagtcgtttcgttttcgttttttttttcgtttttattttcgtttgtcgaggcgcggaataaaggttgagttcgttttatttgcggttgtgcgcgcgtttgtgggttcgcgggaggggggttgtcgcgtcgagggaggggtcggttttagtttcggggtagcgttcgtttcgtttttaggttcgtttcgcgttgatcggtttcgcgtattggttcgtttcgtgcgttggtttgtttcgcgtattggttaagcggtcgggaggacgggttcggcggtcgtgtattttcggtcggtggtcggttcggcgcgtatcgtttttttcgtcgtcgtttagcgagtttagtttcggttttagtttcggtcgtttcggcgtcgtttcggagcgcggcggtagttgattgcgtttttacgattcgttgggattcgcgagtttcgtcgtcgttatgaatattcgtaatgcgagggtgagcgttcggggcgggaggttgttcgcgtcgcgtgggcgtcgggtcgggtggttgtcgcgtatgttttcgagggtttcggtcgagttcggttcggtggttttgagtgtgtttgcggtcgttggatttatggggttggtttagttcgtcgaagaggtcggggcgcggggtcggggttgcgatttttttttgtttgcgtgatgtcgggttttcgttgggtgggtttcggggattttcggggcgtttatttttgtttttgtgtttcgggcgttgtgtaaagttagatcgttatagtgtttgtttagtttcgagggagcggggtcgagtagatcgacgggga

SEQ ID NO: 19528 - DNA, 942 bp, Artificial Sequence
  chemically treated genomic DNA (Homo sapiens) CpG-island No: 19528
tccccgtcgatctactcgaccccgctccctcgaaactaaacaaacactataacgatctaactttacacaacgcccgaaacacaaaaacaaaaataaacgccccgaaaatccccgaaacccacccaacgaaaacccgacatcacgcaaacaaaaaaaaatcgcaaccccgaccccgcgccccgacctcttcgacgaactaaaccaaccccataaatccaacgaccgcaaacacactcaaaaccaccgaaccgaactcgaccgaaaccctcgaaaacatacgcgacaaccacccgacccgacgcccacgcgacgcgaacaacctcccgccccgaacgctcaccctcgcattacgaatattcataacgacgacgaaactcgcgaatcccaacgaatcgtaaaaacgcaatcaactaccgccgcgctccgaaacgacgccgaaacgaccgaaactaaaaccgaaactaaactcgctaaacgacgacgaaaaaaacgatacgcgccgaaccgaccaccgaccgaaaatacacgaccgccgaacccgtcctcccgaccgcttaaccaatacgcgaaacaaaccaacgcacgaaacgaaccaatacgcgaaaccgatcaacgcgaaacgaacctaaaaacgaaacgaacgctaccccgaaactaaaaccgacccctccctcgacgcgacaacccccctcccgcgaacccacaaacgcgcgcacaaccgcaaataaaacgaactcaacctttattccgcgcctcgacaaacgaaaataaaaacgaaaaaaaaaacgaaaacgaaacgactcaacaaaacgcccaacatctcctcgcacataactaaacaccgcgacacgtaaaaacaacctacgaataaaaacgaacaaataataaaaaccgaaaacaaccgaaaaacgcaacccctacgaccccgccctctcccccact

SEQ ID NO: 19529 - DNA, 688 bp, Artificial Sequence
  chemically treated genomic DNA (Homo sapiens) CpG-island No: 19529
tatagcggtagacgattttatggaggtcgttattttaattgttttttttttttttggttttttttttttttttcgtttatttcgttttcgtaagagtcgttcgaaattgtcgagcgtttaggtttaagaagttggaggtcgttgagtttcgtcgtttcgattatttgttcgggcgttttcgtttataagttcgggcgggaggttttgggagtcgttattttgagtcgtttttttttttttttttttttagtcgtagttttttttcgtcggaaatggcggagtttcggttcggtttttatatttttaagtttttagtattggtcggttttcggggcgggtggaaaggagttataagcgtcgcggtcgtcgtagtttcgtcggcgtttagattataattgtgggagtcgttattttgagatcgtttcgttttttcgtttagcgttttagtgtagtcgtcgttttcgaaatagtttcgatatatttaacgaatggaggcgggtcggaggtcggtggaattagttcgagttttcgagggtcgtttgggggttcgcgtcgtacggtttgtgaagtttcgcgtttttttttttagttcgtttttgttgtttaggttgcgtttgtcgtcgtgggagtcgttattttgagattagtttttcgtttttttttatttttttttttttaggttagtttt

SEQ ID NO: 19530 - DNA, 688 bp, Artificial Sequence
  chemically treated genomic DNA (Homo sapiens) CpG-island No: 19530
aaaactaacctaaaaaaaaaaaaataaaaaaaaacgaaaaactaatctcaaaataacgactcccacgacgacaaacgcaacctaaacaacaaaaacgaactaaaaaaaaaaacgcgaaacttcacaaaccgtacgacgcgaacccccaaacgaccctcgaaaactcgaactaattccaccgacctccgacccgcctccattcgttaaatatatcgaaactatttcgaaaacgacgactacactaaaacgctaaacgaaaaaacgaaacgatctcaaaataacgactcccacaattataatctaaacgccgacgaaactacgacgaccgcgacgcttataactcctttccacccgccccgaaaaccgaccaatactaaaaacttaaaaatataaaaaccgaaccgaaactccgccatttccgacgaaaaaaaactacgactaaaaaaaaaaaaaaaaaaaaacgactcaaaataacgactcccaaaacctcccgcccgaacttataaacgaaaacgcccgaacaaataatcgaaacgacgaaactcaacgacctccaacttcttaaacctaaacgctcgacaatttcgaacgactcttacgaaaacgaaataaacgaaaaaaaaaaaaaaaaccaaaaaaaaaaaaaacaattaaaataacgacctccataaaatcgtctaccgctata

SEQ ID NO: 19531 - DNA, 688 bp, Artificial Sequence
  chemically treated genomic DNA (Homo sapiens) CpG-island No: 19531
agaattgatttaggaggaagagaataggggggaacggggagttagttttaagatggcggtttttacggcggtaggcgtagtttgagtagtagaggcggattaaggggagaggcgcgagattttataagtcgtacggcgcgagtttttaaacggttttcgagagttcgagttggttttatcggttttcggttcgtttttattcgttaggtgtgtcgaggttgtttcgggagcggcggttgtattaaggcgttgggcggggaagcgggacggttttaagatggcggtttttataattgtggtttgagcgtcggcggggttgcgacgatcgcggcgtttgtggtttttttttattcgtttcggaagtcggttagtgttggggatttgggggtgtgggaatcgggtcggggtttcgttattttcggcgggggagggttacgattgaggaagggaggagagagaggcggtttaagatggcggtttttagggtttttcgttcgagtttgtaagcgggagcgttcggataagtagtcggggcgacgggatttagcggtttttagttttttgagtttaggcgttcgatagtttcgggcggtttttgcggagacggggtgagcgagaagaaagggaagagttaaagggaaggagggtagttaagatggcggtttttatggagtcgtttatcgttgtg

SEQ ID NO: 19532 - DNA, 688 bp, Artificial Sequence
  chemically treated genomic DNA (Homo sapiens) CpG-island No: 19532
cacaacgataaacgactccataaaaaccgccatcttaactaccctccttccctttaactcttccctttcttctcgctcaccccgtctccgcaaaaaccgcccgaaactatcgaacgcctaaactcaaaaaactaaaaaccgctaaatcccgtcgccccgactacttatccgaacgctcccgcttacaaactcgaacgaaaaaccctaaaaaccgccatcttaaaccgcctctctctcctcccttcctcaatcgtaaccctcccccgccgaaaataacgaaaccccgacccgattcccacacccccaaatccccaacactaaccgacttccgaaacgaataaaaaaaaaccacaaacgccgcgatcgtcgcaaccccgccgacgctcaaaccacaattataaaaaccgccatcttaaaaccgtcccgcttccccgcccaacgccttaatacaaccgccgctcccgaaacaacctcgacacacctaacgaataaaaacgaaccgaaaaccgataaaaccaactcgaactctcgaaaaccgtttaaaaactcgcgccgtacgacttataaaatctcgcgcctctccccttaatccgcctctactactcaaactacgcctaccgccgtaaaaaccgccatcttaaaactaactccccgttcccccctattctcttcctcctaaatcaattct

SEQ ID NO: 19533 - DNA, 1374 bp, Artificial Sequence
  chemically treated genomic DNA (Homo sapiens) CpG-island No: 19533
taggtttcgaagcggtaattgtacggtagaagaagcggtaacggtagggcgtttatgttttttttttgggagtcgttattttgtgtgaagaagtaataattaaatatggcggtagcggcgtcggcggtcgggcgaggaggcggagtcgggtgacgttatcgtttttttttattcgttttcgtatcgtttcgtttttgggtttaagttttttaaaggatttttgcgttgtttcgcggcgggggtgggggtcggcgttgtcgcgcgttgggttaaagttcgagtcgcgtttagattaggtgtaggcgtaggcgcgtttcgttttacggtttttttatcgggcgagtttttacgttttcgttttgggagtcgttattttgttattttttttcgttcggtcgttcgcgggcgttaatagcgatttttagtataaaataaagatggcggcggcggtatttcggaaatgttcggatgagattgttaattttttcgacgcgttcggtttcgtttttttgggaacggtttttcgggttgataagggacgtacgttcgaagaattgtttttaattagtattggggatagcggtacgtaggtggtcggggttggcgaatagttattgtagtcgcgtttgcggtcgggaagcgagtattttcgcgttttgtatatttagtagtcgtaggaggcggttcgaggcgcgtcgcgggggagtcgggggcggggcgatagtgggaggcgacgtagtcgagcgtcggcgttcgggggtggagttttcgttcgtttttaggtttttaggttgcggggttcgttttcgggcgttatcgttttcgttcgcgtcgtagtaaaatgagtcgggtcgcgcgttttagatcgtcgcgcgttcggtcgtttttattgtcgagaggttcgtagtcgggtcggtggcgtacgagtcgggcgggcgatcgcgggaggcgttcgcgttatttcgcgttatttcgtttcgttcgttttttaggtttcgagtttcgttttgcgcgtaggcgtatcggcgttgttcggatttttttttttcggagatttgaattttttttagcgaggcgagtgaggcgaaatattcgtatggtgatagttggttttttcgcgttaatattgtaagtgtttatcgtagttttgggaggtgggtttcggtttcgtttttacgtttcgttttttttaggaggtcgttcgggcgcggcggcggcggcggcggcggcggtattcgttttgttacgcgtaggtcgtagcgcggggatttaagttgttgttcgggagcggtagtcgttagtagaaatggatagatcggttttgttagagtttgtggtttttgttgtaaacgtttagaagtttagttaaattat

SEQ ID NO: 19534 - DNA, 1374 bp, Artificial Sequence
  chemically treated genomic DNA (Homo sapiens) CpG-island No: 19534
ataatttaactaaacttctaaacgtttacaacaaaaaccacaaactctaacaaaaccgatctatccatttctactaacgactaccgctcccgaacaacaacttaaatccccgcgctacgacctacgcgtaacaaaacgaataccgccgccgccgccgccgccgccgcgcccgaacgacctcctaaaaaaaacgaaacgtaaaaacgaaaccgaaacccacctcccaaaactacgataaacacttacaatattaacgcgaaaaaaccaactatcaccatacgaatatttcgcctcactcgcctcgctaaaaaaaattcaaatctccgaaaaaaaaaaatccgaacaacgccgatacgcctacgcgcaaaacgaaactcgaaacctaaaaaacgaacgaaacgaaataacgcgaaataacgcgaacgcctcccgcgatcgcccgcccgactcgtacgccaccgacccgactacgaacctctcgacaataaaaacgaccgaacgcgcgacgatctaaaacgcgcgacccgactcattttactacgacgcgaacgaaaacgataacgcccgaaaacgaaccccgcaacctaaaaacctaaaaacgaacgaaaactccacccccgaacgccgacgctcgactacgtcgcctcccactatcgccccgcccccgactcccccgcgacgcgcctcgaaccgcctcctacgactactaaatatacaaaacgcgaaaatactcgcttcccgaccgcaaacgcgactacaataactattcgccaaccccgaccacctacgtaccgctatccccaatactaattaaaaacaattcttcgaacgtacgtcccttatcaacccgaaaaaccgttcccaaaaaaacgaaaccgaacgcgtcgaaaaaattaacaatctcatccgaacatttccgaaataccgccgccgccatctttattttatactaaaaatcgctattaacgcccgcgaacgaccgaacgaaaaaaaataacaaaataacgactcccaaaacgaaaacgtaaaaactcgcccgataaaaaaaccgtaaaacgaaacgcgcctacgcctacacctaatctaaacgcgactcgaactttaacccaacgcgcgacaacgccgacccccacccccgccgcgaaacaacgcaaaaatcctttaaaaaacttaaacccaaaaacgaaacgatacgaaaacgaataaaaaaaaacgataacgtcacccgactccgcctcctcgcccgaccgccgacgccgctaccgccatatttaattattacttcttcacacaaaataacgactcccaaaaaaaaaacataaacgccctaccgttaccgcttcttctaccgtacaattaccgcttcgaaaccta

SEQ ID NO: 19535 - DNA, 1374 bp, Artificial Sequence
  chemically treated genomic DNA (Homo sapiens) CpG-island No: 19535
gtaatttaattgaatttttagacgtttataataaaagttataggttttgataggatcggtttgtttatttttattggcgattgtcgttttcgggtagtagtttgggttttcgcgttgcggtttgcgcgtggtagggcggatgtcgtcgtcgtcgtcgtcgtcgtcgcgttcgggcggttttttagaggaggcgaaacgtgggggcgaggtcgggatttattttttagggttgcggtgagtatttatagtattggcgcgaaaaggttagttattattatacgggtatttcgttttattcgtttcgttgggggaaatttaaattttcgaaaagggaggattcgagtagcgtcggtgcgtttgcgcgtagggcgggattcgaagtttgggaagcgggcggggcgaggtgacgcgagatgacgcggacgtttttcgcggtcgttcgttcggttcgtgcgttatcggttcgattgcgggtttttcggtagtgggggcggtcgagcgcgcggcggtttggggcgcgcggttcggtttattttgttgcggcgcgggcggaggcggtggcgttcgagggcgggtttcgtagtttgggagtttgggagcgggcggaggttttattttcgggcgtcggcgttcggttgcgtcgttttttattgtcgtttcgttttcggttttttcgcggcgcgtttcgggtcgttttttgcggttgttgggtgtgtagggcgcgaaaatgttcgtttttcggtcgtaggcgcggttgtagtggttgttcgttaatttcggttatttgcgtgtcgttgtttttagtgttggttaaaggtagtttttcgggcgtgcgttttttattaattcgagagatcgtttttaagggggcggggtcgagcgcgtcggaggggttagtagttttattcgggtattttcgagatgtcgtcgtcgttatttttgttttgtgttgaaagtcgttattgacgttcgcggacggtcgggcgaggggaagtggtaagatggcggtttttagggcggaggcgtggaggttcgttcggtgggggggtcgtggggcggggcgcgtttgcgtttgtatttgatttgagcgcgattcgagttttagtttagcgcgcggtagcgtcgatttttattttcgtcgcgaggtagcgtaggggttttttaagaggtttgggtttaggggcgaagcggtgcgagggcgagtggggggaagcggtgacgttattcggtttcgttttttcgttcgatcgtcggcgtcgttgtcgttatgtttagttgttatttttttatataagatggcggtttttagggaggaggtatgagcgttttgtcgttatcgttttttttgtcgtatagttgtcgtttcggggttta

SEQ ID NO: 19536 - DNA, 1374 bp, Artificial Sequence
  chemically treated genomic DNA (Homo sapiens) CpG-island No: 19536
taaaccccgaaacgacaactatacgacaaaaaaaacgataacgacaaaacgctcatacctcctccctaaaaaccgccatcttatataaaaaaataacaactaaacataacgacaacgacgccgacgatcgaacgaaaaaacgaaaccgaataacgtcaccgcttccccccactcgccctcgcaccgcttcgcccctaaacccaaacctcttaaaaaacccctacgctacctcgcgacgaaaataaaaatcgacgctaccgcgcgctaaactaaaactcgaatcgcgctcaaatcaaatacaaacgcaaacgcgccccgccccacgacccccccaccgaacgaacctccacgcctccgccctaaaaaccgccatcttaccacttcccctcgcccgaccgtccgcgaacgtcaataacgactttcaacacaaaacaaaaataacgacgacgacatctcgaaaatacccgaataaaactactaacccctccgacgcgctcgaccccgcccccttaaaaacgatctctcgaattaataaaaaacgcacgcccgaaaaactacctttaaccaacactaaaaacaacgacacgcaaataaccgaaattaacgaacaaccactacaaccgcgcctacgaccgaaaaacgaacattttcgcgccctacacacccaacaaccgcaaaaaacgacccgaaacgcgccgcgaaaaaaccgaaaacgaaacgacaataaaaaacgacgcaaccgaacgccgacgcccgaaaataaaacctccgcccgctcccaaactcccaaactacgaaacccgccctcgaacgccaccgcctccgcccgcgccgcaacaaaataaaccgaaccgcgcgccccaaaccgccgcgcgctcgaccgcccccactaccgaaaaacccgcaatcgaaccgataacgcacgaaccgaacgaacgaccgcgaaaaacgtccgcgtcatctcgcgtcacctcgccccgcccgcttcccaaacttcgaatcccgccctacgcgcaaacgcaccgacgctactcgaatcctcccttttcgaaaatttaaatttcccccaacgaaacgaataaaacgaaatacccgtataataataactaaccttttcgcgccaatactataaatactcaccgcaaccctaaaaaataaatcccgacctcgcccccacgtttcgcctcctctaaaaaaccgcccgaacgcgacgacgacgacgacgacgacgacatccgccctaccacgcgcaaaccgcaacgcgaaaacccaaactactacccgaaaacgacaatcgccaataaaaataaacaaaccgatcctatcaaaacctataacttttattataaacgtctaaaaattcaattaaattac

SEQ ID NO: 19537 - DNA, 549 bp, Artificial Sequence
  chemically treated genomic DNA (Homo sapiens) CpG-island No: 19537
gaggcggttggagcgcgcgtttataggtgggttcggtcgggcgtcgcggggtcgtagttttcgggtcggcgggcgaggacgtcgggtttagaattttaggaaatgcgcgatttaggtcggcgggcggggcgggggtttcggcgagagggcgggtttcgggaacggcggcgggcggggcgggaggcggggttcggttcgttaagaagagcgtggtcggtcgcggttatcgttggttttagggaaagtcgagcggttatcgagtcggtagagatttatcgagcggcggcggagggagtagcgtcggggcgtacgagggtattatggtttagacgttcgttttcgataagtttaaagtgagcgcgcgcgggggtttcggggacgggggttcggcgtttgggcggttcgaggggtttagcggggtttagttcggggcgtttaaattttgggaacgaacgggggtttttgtaggcgagtttttttttcggtttaggtcgtggtttgtttgcgggttaattagggataatggggtagagaaggtttagaattcgg

SEQ ID NO: 19538 - DNA, 549 bp, Artificial Sequence
  chemically treated genomic DNA (Homo sapiens) CpG-island No: 19538
ccgaattctaaaccttctctaccccattatccctaattaacccgcaaacaaaccacgacctaaaccgaaaaaaaaactcgcctacaaaaacccccgttcgttcccaaaatttaaacgccccgaactaaaccccgctaaacccctcgaaccgcccaaacgccgaacccccgtccccgaaacccccgcgcgcgctcactttaaacttatcgaaaacgaacgtctaaaccataataccctcgtacgccccgacgctactccctccgccgccgctcgataaatctctaccgactcgataaccgctcgactttccctaaaaccaacgataaccgcgaccgaccacgctcttcttaacgaaccgaaccccgcctcccgccccgcccgccgccgttcccgaaacccgccctctcgccgaaacccccgccccgcccgccgacctaaatcgcgcatttcctaaaattctaaacccgacgtcctcgcccgccgacccgaaaactacgaccccgcgacgcccgaccgaacccacctataaacgcgcgctccaaccgcctc

SEQ ID NO: 19539 - DNA, 549 bp, Artificial Sequence
  chemically treated genomic DNA (Homo sapiens) CpG-island No: 19539
tcgggttttggattttttttgttttattgtttttgattagttcgtaagtaagttacggtttaagtcgaaggaagaattcgtttgtaggagttttcgttcgtttttagggtttggacgtttcgggttgggtttcgttaagtttttcgggtcgtttaggcgtcggattttcgttttcggagttttcgcgcgcgtttattttgggtttgtcgaaggcgggcgtttgggttatggtgttttcgtgcgtttcggcgttgtttttttcgtcgtcgttcggtgggtttttgtcggttcggtggtcgttcggttttttttggggttagcggtggtcgcggtcggttacgttttttttaacgggtcgggtttcgtttttcgtttcgttcgtcgtcgttttcggggttcgttttttcgtcggagttttcgtttcgttcgtcggtttggatcgcgtattttttggaattttggattcggcgttttcgttcgtcgattcgaaaattacggtttcgcggcgttcgatcggatttatttgtgggcgcgcgttttagtcgtttt

SEQ ID NO: 19540 - DNA, 549 bp, Artificial Sequence
  chemically treated genomic DNA (Homo sapiens) CpG-island No: 19540
aaaacgactaaaacgcgcgcccacaaataaatccgatcgaacgccgcgaaaccgtaattttcgaatcgacgaacgaaaacgccgaatccaaaattccaaaaaatacgcgatccaaaccgacgaacgaaacgaaaactccgacgaaaaaacgaaccccgaaaacgacgacgaacgaaacgaaaaacgaaacccgacccgttaaaaaaaacgtaaccgaccgcgaccaccgctaaccccaaaaaaaaccgaacgaccaccgaaccgacaaaaacccaccgaacgacgacgaaaaaaacaacgccgaaacgcacgaaaacaccataacccaaacgcccgccttcgacaaacccaaaataaacgcgcgcgaaaactccgaaaacgaaaatccgacgcctaaacgacccgaaaaacttaacgaaacccaacccgaaacgtccaaaccctaaaaacgaacgaaaactcctacaaacgaattcttccttcgacttaaaccgtaacttacttacgaactaatcaaaaacaataaaacaaaaaaaatccaaaacccga

SEQ ID NO: 19541 - DNA, 702 bp, Artificial Sequence
  chemically treated genomic DNA (Homo sapiens) CpG-island No: 19541
cggcgtaggcgcgcgggcggggtcgggggcggggtttgcggggcgtggcggggcgggtagagggcggggtttgtttttttttagttttaggcggttgcgacgagtttttaggcgaatttttcggttttttcgcgcggcgtcgttttttgttgcgttttcgtttttttttttgtttcgttatcggttttttttttttgagtagttagttcgcgcgtcggtcggtttcgttatggcgattcgtagttttggcgtcgtggtgagtagttcggtttgtcggttttggtcggtttaggtttacgcggtaggtggcggtcgggttttgaggcgcgggattcgtagtgcgggttcgggcggtcgggtttagggaatttcgtaggcgggggcggttagtttttcgggttcggttttacgttacgcgagggcggtagggaggacggaatggcggggtttggggtgggttttttttcgggggagttttgggaaaagaggattgcgtgtgggaagagaaggtggaaatggcgttttggttgatatgtgtcgtttgcgagcgtgttgcggggaggggtcgagggtagattcgggaatgatggcgcggggtgggggcgtgggggttttttcgggagaggtttttttttggaagtttggggtgcgatggtgaggttttcggggtatttttggaggggtttcggtacggaaagcgat

SEQ ID NO: 19542 - DNA, 702 bp, Artificial Sequence
  chemically treated genomic DNA (Homo sapiens) CpG-island No: 19542
atcgctttccgtaccgaaacccctccaaaaataccccgaaaacctcaccatcgcaccccaaacttccaaaaaaaaacctctcccgaaaaaacccccacgcccccaccccgcgccatcattcccgaatctaccctcgacccctccccgcaacacgctcgcaaacgacacatatcaaccaaaacgccatttccaccttctcttcccacacgcaatcctcttttcccaaaactcccccgaaaaaaaacccaccccaaaccccgccattccgtcctccctaccgccctcgcgtaacgtaaaaccgaacccgaaaaactaaccgcccccgcctacgaaattccctaaacccgaccgcccgaacccgcactacgaatcccgcgcctcaaaacccgaccgccacctaccgcgtaaacctaaaccgaccaaaaccgacaaaccgaactactcaccacgacgccaaaactacgaatcgccataacgaaaccgaccgacgcgcgaactaactactcaaaaaaaaaaaaccgataacgaaacaaaaaaaaaaacgaaaacgcaacaaaaaacgacgccgcgcgaaaaaaccgaaaaattcgcctaaaaactcgtcgcaaccgcctaaaactaaaaaaaaacaaaccccgccctctacccgccccgccacgccccgcaaaccccgcccccgaccccgcccgcgcgcctacgccg

SEQ ID NO: 19543 - DNA, 702 bp, Artificial Sequence
  chemically treated genomic DNA (Homo sapiens) CpG-island No: 19543
gtcgtttttcgtgtcgaggtttttttagaggtgtttcgagaattttattatcgtattttaaatttttagggaagggtttttttcgagaaagtttttacgtttttatttcgcgttattattttcgaatttgttttcggttttttttcgtagtacgttcgtaggcggtatatgttaattaaaacgttatttttattttttttttttatacgtagttttttttttttagggttttttcgaggagggatttattttaaatttcgttatttcgttttttttgtcgttttcgcgtgacgtaaagtcgaattcgggaaattggtcgttttcgtttgcggggttttttgggttcggtcgttcgagttcgtattgcggatttcgcgttttagggttcggtcgttatttgtcgcgtgggtttgaatcggttagggtcggtaggtcgagttgtttattacgacgttagggttgcgggtcgttataacggagtcggtcggcgcgcgggttgattgtttaggaggaggaagtcggtggcggagtagaggaggaggcggaggcgtagtaagaggcggcgtcgcgcgggaaagtcgagaggttcgtttgagggttcgtcgtagtcgtttgaagttgaggagaagtaggtttcgttttttgttcgtttcgttacgtttcgtaggtttcgttttcggtttcgttcgcgcgtttacgtcg

SEQ ID NO: 19544 - DNA, 702 bp, Artificial Sequence
  chemically treated genomic DNA (Homo sapiens) CpG-island No: 19544
cgacgtaaacgcgcgaacgaaaccgaaaacgaaacctacgaaacgtaacgaaacgaacaaaaaacgaaacctacttctcctcaacttcaaacgactacgacgaaccctcaaacgaacctctcgactttcccgcgcgacgccgcctcttactacgcctccgcctcctcctctactccgccaccgacttcctcctcctaaacaatcaacccgcgcgccgaccgactccgttataacgacccgcaaccctaacgtcgtaataaacaactcgacctaccgaccctaaccgattcaaacccacgcgacaaataacgaccgaaccctaaaacgcgaaatccgcaatacgaactcgaacgaccgaacccaaaaaaccccgcaaacgaaaacgaccaatttcccgaattcgactttacgtcacgcgaaaacgacaaaaaaaacgaaataacgaaatttaaaataaatccctcctcgaaaaaaccctaaaaaaaaaaaactacgtataaaaaaaaaaaataaaaataacgttttaattaacatataccgcctacgaacgtactacgaaaaaaaaccgaaaacaaattcgaaaataataacgcgaaataaaaacgtaaaaactttctcgaaaaaaacccttccctaaaaatttaaaatacgataataaaattctcgaaacacctctaaaaaaacctcgacacgaaaaacgac

SEQ ID NO: 19545 - DNA, 609 bp, Artificial Sequence
  chemically treated genomic DNA (Homo sapiens) CpG-island No: 19545
gcggcggttttaggaggagtcgtgggggacgtttttcggggaaagcggcggtcggggcgggagggcgagggtcgagggcggggcggggcgggacggtttcgcgtttttaggattttagttttttcgcgtcgtgtagtcgtttttttatttgttcgttcgttcgttgtcgggttttgagttcgcgtcgtcgtcgttaggaaggaggggttcgcgtttgttttacgtcgggggttaagtttggttgttatcgtcgtcgcgtttttagtttttgatggtcgtcggcgcgtcggagttttaaacgtcgacggttgttttcgcgcggttaattagcgcgcggtcgggggtaggatcgtaggagggcgggcgtttaatgggaagttgtgtttcgtcgtttcgttttttttttttttttatttttcgttcgggcgtcgacggtttcgttttcggagtggagggtacgttagggtgtttgaagttgagatttcgggttcgtagtcgttttatgaatttcgagtttcgtaattgacgttattgggcggggttttatggttagggtttcgtttaggtttaagtttttttatttgtgtttaatgtataggtgcggtgtcg

SEQ ID NO: 19546 - DNA, 609 bp, Artificial Sequence
  chemically treated genomic DNA (Homo sapiens) CpG-island No: 19546
cgacaccgcacctatacattaaacacaaataaaaaaacttaaacctaaacgaaaccctaaccataaaaccccgcccaataacgtcaattacgaaactcgaaattcataaaacgactacgaacccgaaatctcaacttcaaacaccctaacgtaccctccactccgaaaacgaaaccgtcgacgcccgaacgaaaaataaaaaaaaaaaaaaaacgaaacgacgaaacacaacttcccattaaacgcccgccctcctacgatcctacccccgaccgcgcgctaattaaccgcgcgaaaacaaccgtcgacgtttaaaactccgacgcgccgacgaccatcaaaaactaaaaacgcgacgacgataacaaccaaacttaacccccgacgtaaaacaaacgcgaacccctccttcctaacgacgacgacgcgaactcaaaacccgacaacgaacgaacgaacaaataaaaaaacgactacacgacgcgaaaaaactaaaatcctaaaaacgcgaaaccgtcccgccccgccccgccctcgaccctcgccctcccgccccgaccgccgctttccccgaaaaacgtcccccacgactcctcctaaaaccgccgc

SEQ ID NO: 19547 - DNA, 609 bp, Artificial Sequence
  chemically treated genomic DNA (Homo sapiens) CpG-island No: 19547
cggtatcgtatttgtgtattgagtataggtggggaaatttaggtttgagcgaggttttggttatgaagtttcgtttagtagcgttagttgcggaattcgaaatttatggggcgattgcgagttcggggttttagttttagatattttggcgtgttttttatttcggaaacggaatcgtcggcgttcgagcggggggtggggggggagggagggcggagcggcgaggtatagttttttattggacgttcgtttttttgcggttttgttttcggtcgcgcgttgattggtcgcgcgaaggtaatcgtcggcgtttgaaatttcggcgcgtcggcggttattaagggttagaagcgcggcggcggtagtagttaggtttggttttcggcgtggagtagacgcggattttttttttttggcggcggcggcgcgggtttagagttcggtaacgggcgggcgggtaggtaggagagcggttatacggcgcggggaggttggggttttgggggcgcgaggtcgtttcgtttcgtttcgttttcggttttcgttttttcgtttcggtcgtcgtttttttcgggaagcgttttttacggttttttttggggtcgtcgt

SEQ ID NO: 19548 - DNA, 609 bp, Artificial Sequence
  chemically treated genomic DNA (Homo sapiens) CpG-island No: 19548
acgacgaccccaaaaaaaaccgtaaaaaacgcttcccgaaaaaaacgacgaccgaaacgaaaaaacgaaaaccgaaaacgaaacgaaacgaaacgacctcgcgcccccaaaaccccaacctccccgcgccgtataaccgctctcctacctacccgcccgcccgttaccgaactctaaacccgcgccgccgccgccaaaaaaaaaaaatccgcgtctactccacgccgaaaaccaaacctaactactaccgccgccgcgcttctaacccttaataaccgccgacgcgccgaaatttcaaacgccgacgattaccttcgcgcgaccaatcaacgcgcgaccgaaaacaaaaccgcaaaaaaacgaacgtccaataaaaaactatacctcgccgctccgccctccctccccccccaccccccgctcgaacgccgacgattccgtttccgaaataaaaaacacgccaaaatatctaaaactaaaaccccgaactcgcaatcgccccataaatttcgaattccgcaactaacgctactaaacgaaacttcataaccaaaacctcgctcaaacctaaatttccccacctatactcaatacacaaatacgataccg

SEQ ID NO: 19549 - DNA, 542 bp, Artificial Sequence
  chemically treated genomic DNA (Homo sapiens) CpG-island No: 19549
tcgtacggggattgtattttttagagcgtttcgcgagcggtcgagcggcgggattttatgttttagagtgtttcgcgggcggtcgggcggcgggattttatgttttagagtgtttcgcggcggtcggcggcggtcgtcgtaatcgataggttcgggattggcgttgcggtttcgttcgcgcgtcggggcgggggtttagttcgatagtttttcggcggttgcgcgatggatagtttcgaggtgatttttattttcgtttatttggtgttcgtcgtgtgtttcgtgtttacgtttaacgagttttacgcggcggggtttacggtgtagaatttgttgtcgggttggttgggtagcgaggacgtcgttttcgtgtttttttatttgcgtcgtacggtcgttacgttgttgtgttattcgttgttgtcgttcggtgaggttgttcgggtcggtcggtcgtatttttttttgcgtagggtttgttgggaggttaggaggaggttttcgttagtttttcgaggtttcgaaagcgtttgggcgtagtt

SEQ ID NO: 19550 - DNA, 542 bp, Artificial Sequence
  chemically treated genomic DNA (Homo sapiens) CpG-island No: 19550
aactacgcccaaacgctttcgaaacctcgaaaaactaacgaaaacctcctcctaacctcccaacaaaccctacgcaaaaaaaaatacgaccgaccgacccgaacaacctcaccgaacgacaacaacgaataacacaacaacgtaacgaccgtacgacgcaaataaaaaaacacgaaaacgacgtcctcgctacccaaccaacccgacaacaaattctacaccgtaaaccccgccgcgtaaaactcgttaaacgtaaacacgaaacacacgacgaacaccaaataaacgaaaataaaaatcacctcgaaactatccatcgcgcaaccgccgaaaaactatcgaactaaacccccgccccgacgcgcgaacgaaaccgcaacgccaatcccgaacctatcgattacgacgaccgccgccgaccgccgcgaaacactctaaaacataaaatcccgccgcccgaccgcccgcgaaacactctaaaacataaaatcccgccgctcgaccgctcgcgaaacgctctaaaaaatacaatccccgtacga

SEQ ID NO: 19551 - DNA, 542 bp, Artificial Sequence
  chemically treated genomic DNA (Homo sapiens) CpG-island No: 19551
agttgcgtttaggcgttttcggggtttcggggagttggcggaggtttttttttgattttttagtaagttttgcgtaggagaggatgcggtcggtcggttcgagtagttttatcgagcggtagtagcgagtggtataatagcgtggcggtcgtgcggcgtaagtggaagggtacgaaggcggcgttttcgttgtttagttagttcgatagtaggttttgtatcgtgagtttcgtcgcgtggaattcgttgggcgtgaatacgaagtatacggcgaatattagataggcgagagtgaaggttatttcggggttgtttatcgcgtagtcgtcgggaagttgtcgagttaggttttcgtttcggcgcgcggacgaggtcgtagcgttagtttcggatttgtcggttgcggcggtcgtcgtcggtcgtcgcggggtattttaggatatggagtttcgtcgttcggtcgttcgcggggtattttagggtatggagtttcgtcgttcggtcgttcgcggggcgttttgggagatgtagttttcgtgcgg

SEQ ID NO: 19552 - DNA, 542 bp, Artificial Sequence
  chemically treated genomic DNA (Homo sapiens) CpG-island No: 19552
ccgcacgaaaactacatctcccaaaacgccccgcgaacgaccgaacgacgaaactccataccctaaaataccccgcgaacgaccgaacgacgaaactccatatcctaaaataccccgcgacgaccgacgacgaccgccgcaaccgacaaatccgaaactaacgctacgacctcgtccgcgcgccgaaacgaaaacctaactcgacaacttcccgacgactacgcgataaacaaccccgaaataaccttcactctcgcctatctaatattcgccgtatacttcgtattcacgcccaacgaattccacgcgacgaaactcacgatacaaaacctactatcgaactaactaaacaacgaaaacgccgccttcgtacccttccacttacgccgcacgaccgccacgctattataccactcgctactaccgctcgataaaactactcgaaccgaccgaccgcatcctctcctacgcaaaacttactaaaaaatcaaaaaaaaacctccgccaactccccgaaaccccgaaaacgcctaaacgcaact

SEQ ID NO: 19553 - DNA, 1300 bp, Artificial Sequence
  chemically treated genomic DNA (Homo sapiens) CpG-island No: 19553
ggttacgggatcgtgggaagtagttagtattcgttataggtcgcgtttttcgggtttcgggtttcgggttttcgttagggaggagatacgtttttatttgggtaggaattaagtagagtcgcgttttatttaggtcggaattaatgggagatgcgttacgatttaggtcgagaaacgtgtcgtttattttttttttacgatttgcgtcgcgtcgcgcgcggtcgaatttttcgttaaagttgttttcgttcgttaaggcgcgatttattagcgtcgtagaggttcgcggcggttcggtcgttttaatttcgcgggtgggggtaattttttttttaggtttttttttagtttacggcgtttatttggttttcgagtcgagggtcgggtagtcgggtttcgcggttgttcgcggtttcgaggtttcgttttagttttagtcggttcgcgaggcgcgcgtagttgagtggatttttgcggcgtggttcgatggtttcgttcgattcggcgcgcgcgggaggtcgaggggcggggttcggcgtttatataaaggcggttgggggcggggcgcgtagagttcgtgagcgtcggcgcggggacgcgggtttttgttttaggttttgttttgttttattttgcgttttttgttcgcgtcgtcgtcgttttagtttcggttttgcgttgcgcgttcggttcgtgttgttatggtttgtcgttcgcgaagttcgtcgaggtattagagtcgttgcgacggtgacgttaggtgaggtcgggttgcgcggcgggcgagggagcgcgtgtttcgtggggcgggggttgtgcggggtcggggtgtgggagggcggaggttgtaaggcggtttcgaatttttcgtgtttagtcgatcgcgttttttttcgtagttcgtcgtttttcgcgcgatggagtttgggacggaagcgtagagtcgacggtaggcgttggaggttcgaagacgtcgaggaggtagagtatcgcggcgtcgagcgtagattcgagaggtgggcgcgggattcgggggtcggggcgcggtggggtttttgacgaggtcgcgggttttagggatttcgtcgcgttttcgcggtgtcgggatcggttaggtcggtattttgcgtttttttattttggttttcgcgcggttcgtggattggggcggtcgtagtaggtttgggaggcgttggaatatttcggaagttttttgttaggatgggagttagttgaatcggcgttagttcgagttagttagttcgagtttgtgttgtgttttcgggagaggttagggttt

SEQ ID NO: 19554 - DNA, 1300 bp, Artificial Sequence
  chemically treated genomic DNA (Homo sapiens) CpG-island No: 19554
aaaccctaacctctcccgaaaacacaacacaaactcgaactaactaactcgaactaacgccgattcaactaactcccatcctaacaaaaaacttccgaaatattccaacgcctcccaaacctactacgaccgccccaatccacgaaccgcgcgaaaaccaaaataaaaaaacgcaaaataccgacctaaccgatcccgacaccgcgaaaacgcgacgaaatccctaaaacccgcgacctcgtcaaaaaccccaccgcgccccgacccccgaatcccgcgcccacctctcgaatctacgctcgacgccgcgatactctacctcctcgacgtcttcgaacctccaacgcctaccgtcgactctacgcttccgtcccaaactccatcgcgcgaaaaacgacgaactacgaaaaaaaacgcgatcgactaaacacgaaaaattcgaaaccgccttacaacctccgccctcccacaccccgaccccgcacaacccccgccccacgaaacacgcgctccctcgcccgccgcgcaacccgacctcacctaacgtcaccgtcgcaacgactctaatacctcgacgaacttcgcgaacgacaaaccataacaacacgaaccgaacgcgcaacgcaaaaccgaaactaaaacgacgacgacgcgaacaaaaaacgcaaaataaaacaaaacaaaacctaaaacaaaaacccgcgtccccgcgccgacgctcacgaactctacgcgccccgcccccaaccgcctttatataaacgccgaaccccgcccctcgacctcccgcgcgcgccgaatcgaacgaaaccatcgaaccacgccgcaaaaatccactcaactacgcgcgcctcgcgaaccgactaaaactaaaacgaaacctcgaaaccgcgaacaaccgcgaaacccgactacccgaccctcgactcgaaaaccaaataaacgccgtaaactaaaaaaaaacctaaaaaaaaaattacccccacccgcgaaattaaaacgaccgaaccgccgcgaacctctacgacgctaataaatcgcgccttaacgaacgaaaacaactttaacgaaaaattcgaccgcgcgcgacgcgacgcaaatcgtaaaaaaaaaataaacgacacgtttctcgacctaaatcgtaacgcatctcccattaattccgacctaaataaaacgcgactctacttaattcctacccaaataaaaacgtatctcctccctaacgaaaacccgaaacccgaaacccgaaaaacgcgacctataacgaatactaactacttcccacgatcccgtaacc

SEQ ID NO: 19555 - DNA, 1300 bp, Artificial Sequence
  chemically treated genomic DNA (Homo sapiens) CpG-island No: 19555
agattttgatttttttcgggagtataatatagattcgaattggttaattcgggttgacgtcggtttagttgatttttattttggtaagaggttttcggagtgttttagcgttttttaggtttgttgcggtcgttttagtttacgggtcgcgcggagattaagataaaaggacgtagggtgtcgatttgatcgatttcggtatcgcgagagcgcgacgaggtttttggagttcgcggtttcgttaagggttttatcgcgtttcgattttcgggtttcgcgtttatttttcgggtttgcgttcggcgtcgcggtgttttgttttttcggcgttttcgggtttttagcgtttgtcgtcggttttgcgttttcgttttaggttttatcgcgcgggggacggcgggttgcggggagggacgcggtcggttgggtacgggaggttcgggatcgttttataattttcgtttttttatatttcggtttcgtataattttcgttttacggggtacgcgttttttcgttcgtcgcgtagttcggttttatttggcgttatcgtcgtagcggttttgatgtttcggcgggtttcgcgggcggtaggttatggtagtacgggtcgggcgcgtagcgtagggtcgaggttgaggcggcggcggcgcgggtagagagcgtagagtagagtagggtagggtttgaggtagaaattcgcgttttcgcgtcggcgtttacgagttttgcgcgtttcgtttttaatcgtttttatgtgggcgtcgggtttcgtttttcggtttttcgcgcgcgtcgggtcgggcgagattatcgggttacgtcgtaggggtttatttagttgcgcgcgtttcgcgagtcgattggggttagggcgaggtttcgggatcgcgggtagtcgcgaagttcgattgttcggttttcggttcgggagttagatggacgtcgtgggttgaggagaggtttgaggaaaaggttgtttttattcgcgggattgaggcggtcgggtcgtcgcgggtttttgcgacgttgataggtcgcgttttggcgggcgggggtagttttggcgggagattcggtcgcgcgcgacgcggcgtaggtcgtgggggaagggtaagcggtacgtttttcggtttgggtcgtggcgtattttttattggtttcggtttgggtggagcgcggttttgtttggtttttgtttaggtgggggcgtgttttttttttggcgggaattcggaattcggaattcggaaggcgcggtttgtggcgggtattgattgttttttacggtttcgtggtt

SEQ ID NO: 19556 - DNA, 1300 bp, Artificial Sequence
  chemically treated genomic DNA (Homo sapiens) CpG-island No: 19556
aaccacgaaaccgtaaaaaacaatcaatacccgccacaaaccgcgccttccgaattccgaattccgaattcccgccaaaaaaaaaacacgcccccacctaaacaaaaaccaaacaaaaccgcgctccacccaaaccgaaaccaataaaaaatacgccacgacccaaaccgaaaaacgtaccgcttacccttcccccacgacctacgccgcgtcgcgcgcgaccgaatctcccgccaaaactacccccgcccgccaaaacgcgacctatcaacgtcgcaaaaacccgcgacgacccgaccgcctcaatcccgcgaataaaaacaaccttttcctcaaacctctcctcaacccacgacgtccatctaactcccgaaccgaaaaccgaacaatcgaacttcgcgactacccgcgatcccgaaacctcgccctaaccccaatcgactcgcgaaacgcgcgcaactaaataaacccctacgacgtaacccgataatctcgcccgacccgacgcgcgcgaaaaaccgaaaaacgaaacccgacgcccacataaaaacgattaaaaacgaaacgcgcaaaactcgtaaacgccgacgcgaaaacgcgaatttctacctcaaaccctaccctactctactctacgctctctacccgcgccgccgccgcctcaacctcgaccctacgctacgcgcccgacccgtactaccataacctaccgcccgcgaaacccgccgaaacatcaaaaccgctacgacgataacgccaaataaaaccgaactacgcgacgaacgaaaaaacgcgtaccccgtaaaacgaaaattatacgaaaccgaaatataaaaaaacgaaaattataaaacgatcccgaacctcccgtacccaaccgaccgcgtccctccccgcaacccgccgtcccccgcgcgataaaacctaaaacgaaaacgcaaaaccgacgacaaacgctaaaaacccgaaaacgccgaaaaaacaaaacaccgcgacgccgaacgcaaacccgaaaaataaacgcgaaacccgaaaatcgaaacgcgataaaacccttaacgaaaccgcgaactccaaaaacctcgtcgcgctctcgcgataccgaaatcgatcaaatcgacaccctacgtccttttatcttaatctccgcgcgacccgtaaactaaaacgaccgcaacaaacctaaaaaacgctaaaacactccgaaaacctcttaccaaaataaaaatcaactaaaccgacgtcaacccgaattaaccaattcgaatctatattatactcccgaaaaaaatcaaaatct

SEQ ID NO: 19557 - DNA, 1220 bp, Artificial Sequence
  chemically treated genomic DNA (Homo sapiens) CpG-island No: 19557
cgttttcggcgattatgagcgagggtttaatttatattgtgtaggtgtagaagtgcgattcgagagggcgagcgatttgttaacggttatatagcgggtagacggtaggcgggaaggcggcggcggcgagtttcgggtttcgagatcgcgcgtttcgggttgggttatcgtttgagttacggttagtgtcgatcgggtttttttttgcgcgttttgtttcgtcgttttaggtcgtcgtcgttataggttttgttttttaggtttggaggacgtcgtcgagtgttaggtacgtacgcgcgtagggggcggggcgtcgattcgggggcggggttagattttcgtatagggcgcgttgcggattcggtgggcggtgcgagtttgggcgtttggaggtttcgtttttttcgtcggcgcggcgcggttgagggtcggcgtggagaaggcggcggttgacgggttcgcggcggcggcggggcgcgggcggttaatgagggcggtcggagggggcggggcggcggtcgcggttttgtttcgtcgcggttgaggcgcgtcgttttgagcgagcggggtttgggcggtcggtagttttttcgtttcgttttttcgcggtcgcgtttaggtatcgagttcgggcggagcgcgtcgtcgttttttttttttttgtttacgttgtttatttttcggcgtatcggtttcgagttttgttcgcggtacgtggagggcgcgggcggtcgtgggcgcggggttttgcgtttcgagttgggcgcgtgttacgtttttttgttttcgtcgtttgcgtcgttcgtcgaggcgattttttcgtacgaggcgaggttcgttttggtggtttcgcgtcgtggttcggtggcgcgagaggcggggagtcgtcgtggtaaacggggttttggggcgtttcgaaggggatttagacgcgggaggttagattttttcggcgattcgaggaggggatttgcggcggatttcgaagtcgttttttttgcgtagtttgggggtgtaaatcgtcgagatttttttgtgtggagaaggcgtcggtgttcgttcgttgttgtcggattttagaggggtgttttttttcgttaatttgagcgtagtcgcggagtttttgttttttacgtagtttgtgttaagtggtttcgtgagttttcgcgcggtatttttggtgttttttttttgaagttaagtttttataattttaaagt

SEQ ID NO: 19558 - DNA, 1220 bp, Artificial Sequence
  chemically treated genomic DNA (Homo sapiens) CpG-island No: 19558
actttaaaattataaaaacttaacttcaaaaaaaaaacaccaaaaataccgcgcgaaaactcacgaaaccacttaacacaaactacgtaaaaaacaaaaactccgcgactacgctcaaattaacgaaaaaaaacacccctctaaaatccgacaacaacgaacgaacaccgacgccttctccacacaaaaaaatctcgacgatttacacccccaaactacgcaaaaaaaacgacttcgaaatccgccgcaaatcccctcctcgaatcgccgaaaaaatctaacctcccgcgtctaaatccccttcgaaacgccccaaaaccccgtttaccacgacgactccccgcctctcgcgccaccgaaccacgacgcgaaaccaccaaaacgaacctcgcctcgtacgaaaaaatcgcctcgacgaacgacgcaaacgacgaaaacaaaaaaacgtaacacgcgcccaactcgaaacgcaaaaccccgcgcccacgaccgcccgcgccctccacgtaccgcgaacaaaactcgaaaccgatacgccgaaaaataaacaacgtaaacaaaaaaaaaaaaaacgacgacgcgctccgcccgaactcgatacctaaacgcgaccgcgaaaaaacgaaacgaaaaaactaccgaccgcccaaaccccgctcgctcaaaacgacgcgcctcaaccgcgacgaaacaaaaccgcgaccgccgccccgccccctccgaccgccctcattaaccgcccgcgccccgccgccgccgcgaacccgtcaaccgccgccttctccacgccgaccctcaaccgcgccgcgccgacgaaaaaaacgaaacctccaaacgcccaaactcgcaccgcccaccgaatccgcaacgcgccctatacgaaaatctaaccccgcccccgaatcgacgccccgccccctacgcgcgtacgtacctaacactcgacgacgtcctccaaacctaaaaaacaaaacctataacgacgacgacctaaaacgacgaaacaaaacgcgcaaaaaaaaacccgatcgacactaaccgtaactcaaacgataacccaacccgaaacgcgcgatctcgaaacccgaaactcgccgccgccgccttcccgcctaccgtctacccgctatataaccgttaacaaatcgctcgccctctcgaatcgcacttctacacctacacaatataaattaaaccctcgctcataatcgccgaaaacg

SEQ ID NO: 19559 - DNA, 1220 bp, Artificial Sequence
  chemically treated genomic DNA (Homo sapiens) CpG-island No: 19559
gttttagagttatggaaatttagttttaaagaagaggtattaaggatgtcgcgcgaaaatttacgaggttatttaatataggttgcgtgggaaataggggtttcgcgattgcgtttagattaacggaaaaagatatttttttagagttcggtagtagcgggcgggtatcggcgttttttttatataggagaatttcggcgatttatatttttaggttacgtagaaaaagcggtttcggaattcgtcgtaagtttttttttcgggtcgtcggggaagtttggtttttcgcgtttgggtttttttcgggacgttttaaggtttcgtttattacggcgatttttcgtttttcgcgttatcgaattacggcgcggggttattagggcgggtttcgtttcgtgcggaaaagtcgtttcgacgggcggcgtagacggcggaggtagggggacgtagtacgcgtttagttcggagcgtagggtttcgcgtttacgatcgttcgcgttttttacgtgtcgcgggtaaagttcggagtcggtgcgtcgaggaatgggtagcgtggataagagaggagggggcggcggcgcgtttcgttcgggttcggtatttgagcgcggtcgcgggggggcggagcgagaagattgtcggtcgtttaggtttcgttcgtttagggcgacgcgttttagtcgcggcggaataaaatcgcggtcgtcgtttcgtttttttcggtcgtttttattggtcgttcgcgtttcgtcgtcgtcgcgagttcgttagtcgtcgttttttttacgtcggtttttagtcgcgtcgcgtcgacggagggggcggggtttttaggcgtttaggttcgtatcgtttatcgagttcgtagcgcgttttgtgcgagggtttggtttcgttttcggatcgacgtttcgttttttgcgcgcgtgcgtgtttggtattcggcggcgttttttaggtttagaaggtaagatttgtggcggcggcgatttgaggcggcggggtaggacgcgtagaggagggttcggtcggtattagtcgtggtttaggcggtgatttagttcggggcgcgcggtttcggggttcgaggttcgtcgtcgtcgttttttcgtttgtcgtttgttcgttgtgtagtcgttggtaggtcgttcgttttttcgggtcgtatttttgtatttgtatagtgtgaattaggttttcgtttatggtcgtcgagggcg

SEQ ID NO: 19560 - DNA, 1220 bp, Artificial Sequence
  chemically treated genomic DNA (Homo sapiens) CpG-island No: 19560
cgccctcgacgaccataaacgaaaacctaattcacactatacaaatacaaaaatacgacccgaaaaaacgaacgacctaccaacgactacacaacgaacaaacgacaaacgaaaaaacgacgacgacgaacctcgaaccccgaaaccgcgcgccccgaactaaatcaccgcctaaaccacgactaataccgaccgaaccctcctctacgcgtcctaccccgccgcctcaaatcgccgccgccacaaatcttaccttctaaacctaaaaaacgccgccgaataccaaacacgcacgcgcgcaaaaaacgaaacgtcgatccgaaaacgaaaccaaaccctcgcacaaaacgcgctacgaactcgataaacgatacgaacctaaacgcctaaaaaccccgccccctccgtcgacgcgacgcgactaaaaaccgacgtaaaaaaaacgacgactaacgaactcgcgacgacgacgaaacgcgaacgaccaataaaaacgaccgaaaaaaacgaaacgacgaccgcgattttattccgccgcgactaaaacgcgtcgccctaaacgaacgaaacctaaacgaccgacaatcttctcgctccgcccccccgcgaccgcgctcaaataccgaacccgaacgaaacgcgccgccgccccctcctctcttatccacgctacccattcctcgacgcaccgactccgaactttacccgcgacacgtaaaaaacgcgaacgatcgtaaacgcgaaaccctacgctccgaactaaacgcgtactacgtccccctacctccgccgtctacgccgcccgtcgaaacgacttttccgcacgaaacgaaacccgccctaataaccccgcgccgtaattcgataacgcgaaaaacgaaaaatcgccgtaataaacgaaaccttaaaacgtcccgaaaaaaacccaaacgcgaaaaaccaaacttccccgacgacccgaaaaaaaaacttacgacgaattccgaaaccgctttttctacgtaacctaaaaatataaatcgccgaaattctcctatataaaaaaaacgccgatacccgcccgctactaccgaactctaaaaaaatatctttttccgttaatctaaacgcaatcgcgaaacccctatttcccacgcaacctatattaaataacctcgtaaattttcgcgcgacatccttaatacctcttctttaaaactaaatttccataactctaaaac

SEQ ID NO: 19561 - DNA, 706 bp, Artificial Sequence
  chemically treated genomic DNA (Homo sapiens) CpG-island No: 19561
cgttcgggtttcgcgtatttatttagcgttgttagttgcggcgagagggtagacggggcggcgtcgggggttgtagtgggttcggttcgggggatttacgcgtttgggcgggggtggtttttttacgtcggttgtcgcggcggttcggggtcgacgtcggggacgatatagtgttcggagtatttgcgcgataaggataagttcgggtcgggttcgtttttcggtttttttgttttgtttcgtagcgcggacgttttcgtcggtttcgcgttacgtttttttcgtcggcgcgcggttatcgtggaaaggcggtcgtttgtcgacgacgttcgcggatttcgagtttatttggcgagtagcgtttttaaatcgcgagatttagagttttcgtcggcggtaaggtcgttttcgtttttggcggggttttattaattatagcggcgttcgtacgtggtttcgttttcgggaggcgttattgcgtatcggtagggggggatagtgtcgttttttttagcgttcgtgcgtaaattagaagtaggtttcgttcggttttttttggtttagatggtttgattttttgcgcggtagcgttttcgcgggaaaattgggttttatagtattagttttcggggtgtgtttttttagcgttggttagggagcgtgtgtttttttattttttaggcgtttttggttaataaggatatta

SEQ ID NO: 19562 - DNA, 706 bp, Artificial Sequence
  chemically treated genomic DNA (Homo sapiens) CpG-island No: 19562
taatatccttattaaccaaaaacgcctaaaaaataaaaaaacacacgctccctaaccaacgctaaaaaaacacaccccgaaaactaatactataaaacccaattttcccgcgaaaacgctaccgcgcaaaaaatcaaaccatctaaaccaaaaaaaaccgaacgaaacctacttctaatttacgcacgaacgctaaaaaaaacgacactatccccccctaccgatacgcaataacgcctcccgaaaacgaaaccacgtacgaacgccgctataattaataaaaccccgccaaaaacgaaaacgaccttaccgccgacgaaaactctaaatctcgcgatttaaaaacgctactcgccaaataaactcgaaatccgcgaacgtcgtcgacaaacgaccgcctttccacgataaccgcgcgccgacgaaaaaaacgtaacgcgaaaccgacgaaaacgtccgcgctacgaaacaaaacaaaaaaaccgaaaaacgaacccgacccgaacttatccttatcgcgcaaatactccgaacactatatcgtccccgacgtcgaccccgaaccgccgcgacaaccgacgtaaaaaaaccacccccgcccaaacgcgtaaatcccccgaaccgaacccactacaacccccgacgccgccccgtctaccctctcgccgcaactaacaacgctaaataaatacgcgaaacccgaacg

SEQ ID NO: 19563 - DNA, 706 bp, Artificial Sequence
  chemically treated genomic DNA (Homo sapiens) CpG-island No: 19563
taatgtttttattaattaaaaacgtttaagggataaagaagtatacgttttttagttaacgttagaggaatatatttcgagagttggtgttgtaggatttagttttttcgcgaaaacgttgtcgcgtagggggttagattatttggattaaggggggtcgagcgaggtttatttttggtttacgtacgggcgttgaaagaagcggtattgtttttttttgtcgatgcgtagtggcgtttttcggaggcggagttacgtacgagcgtcgttgtgattggtgaggtttcgttaggggcggagacgattttgtcgtcggcgggaattttgggtttcgcggtttgggagcgttattcgttaggtggattcggagttcgcgagcgtcgtcggtaagcggtcgtttttttacggtaatcgcgcgtcggcggggagggcgtggcgcggagtcgacgggaacgttcgcgttgcggagtagggtagggaagtcgggaggcgggttcggttcgagtttgtttttgtcgcgtaggtatttcgagtattatgtcgttttcggcgtcgatttcgagtcgtcgcggtagtcggcgtggaagggttattttcgtttagacgcgtgagtttttcgagtcgggtttattatagttttcggcgtcgtttcgtttgttttttcgtcgtagttggtagcgttgggtgggtgcgcgggattcgggcg

SEQ ID NO: 19564 - DNA, 706 bp, Artificial Sequence
  chemically treated genomic DNA (Homo sapiens) CpG-island No: 19564
cgcccgaatcccgcgcacccacccaacgctaccaactacgacgaaaaaacaaacgaaacgacgccgaaaactataataaacccgactcgaaaaactcacgcgtctaaacgaaaataacccttccacgccgactaccgcgacgactcgaaatcgacgccgaaaacgacataatactcgaaatacctacgcgacaaaaacaaactcgaaccgaacccgcctcccgacttccctaccctactccgcaacgcgaacgttcccgtcgactccgcgccacgccctccccgccgacgcgcgattaccgtaaaaaaacgaccgcttaccgacgacgctcgcgaactccgaatccacctaacgaataacgctcccaaaccgcgaaacccaaaattcccgccgacgacaaaatcgtctccgcccctaacgaaacctcaccaatcacaacgacgctcgtacgtaactccgcctccgaaaaacgccactacgcatcgacaaaaaaaaacaataccgcttctttcaacgcccgtacgtaaaccaaaaataaacctcgctcgaccccccttaatccaaataatctaaccccctacgcgacaacgttttcgcgaaaaaactaaatcctacaacaccaactctcgaaatatattcctctaacgttaactaaaaaacgtatacttctttatcccttaaacgtttttaattaataaaaacatta

SEQ ID NO: 19565 - DNA, 554 bp, Artificial Sequence
  chemically treated genomic DNA (Homo sapiens) CpG-island No: 19565
aggggcggggaggggcggggcgcgtcgcgttagttcgcggcgtttttaggtcgggtcgtagcggggcgtggtttttagaggcgtggttttgggcgtgggggcggggttttttggtggggcggggtcgcgtagggtcgttttcgtcgtcggtcgttcgcgtttcgttttcgtgtcgtagtttataggtttcgtttcggttcgttttttcgttcgttttttaagtcgtcgcggcgtcgagtcggttttttcgtcggtgttcgagaggcgttttcggttcggttcggttcggttcgcgtttttcgttttcgttttttcgggtcggcggcggtgggcgagttcgcgggttcggtcgtttttagttttagtttcgtcgggtttcgtttttcgtcgagtgtatgaggttgacgttattttgttgtatttggagggaagaacgtatgggagaggaaggtgcgcgggtcgcggggtgtggggcgagggtttggagggggtgttcggggtagcgtggggtacgggagggggtcgggtttgttaggaggtcgcgtttttgtttt

SEQ ID NO: 19566 - DNA, 554 bp, Artificial Sequence
  chemically treated genomic DNA (Homo sapiens) CpG-island No: 19566
aaaacaaaaacgcgacctcctaacaaacccgaccccctcccgtaccccacgctaccccgaacaccccctccaaaccctcgccccacaccccgcgacccgcgcaccttcctctcccatacgttcttccctccaaatacaacaaaataacgtcaacctcatacactcgacgaaaaacgaaacccgacgaaactaaaactaaaaacgaccgaacccgcgaactcgcccaccgccgccgacccgaaaaaacgaaaacgaaaaacgcgaaccgaaccgaaccgaaccgaaaacgcctctcgaacaccgacgaaaaaaccgactcgacgccgcgacgacttaaaaaacgaacgaaaaaacgaaccgaaacgaaacctataaactacgacacgaaaacgaaacgcgaacgaccgacgacgaaaacgaccctacgcgaccccgccccaccaaaaaaccccgcccccacgcccaaaaccacgcctctaaaaaccacgccccgctacgacccgacctaaaaacgccgcgaactaacgcgacgcgccccgcccctccccgcccct

SEQ ID NO: 19567 - DNA, 554 bp, Artificial Sequence
  chemically treated genomic DNA (Homo sapiens) CpG-island No: 19567
gaggtaggggcgcggttttttggtagattcggttttttttcgtgttttacgttgtttcgggtattttttttaggttttcgttttatatttcgcggttcgcgtattttttttttttatacgtttttttttttaggtgtaataaagtagcgttaattttatgtattcgacggggggcggggttcggcggggttggggttgggggcggtcgggttcgcgagttcgtttatcgtcgtcggttcggggaggcgggggcggagggcgcgggtcgggtcgggtcgggtcgggggcgtttttcggatatcggcggggaaatcggttcggcgtcgcggcggtttggggagcgagcggaggggcggatcgaggcggggtttgtgagttgcggtacgggggcggggcgcgggcggtcggcggcgggaacggttttgcgcggtttcgttttattagaaaatttcgtttttacgtttaaggttacgtttttagaggttacgtttcgttgcggttcggtttgggggcgtcgcgagttggcgcggcgcgtttcgttttttttcgttttt

SEQ ID NO: 19568 - DNA, 554 bp, Artificial Sequence
  chemically treated genomic DNA (Homo sapiens) CpG-island No: 19568
aaaaacgaaaaaaaacgaaacgcgccgcgccaactcgcgacgcccccaaaccgaaccgcaacgaaacgtaacctctaaaaacgtaaccttaaacgtaaaaacgaaattttctaataaaacgaaaccgcgcaaaaccgttcccgccgccgaccgcccgcgccccgcccccgtaccgcaactcacaaaccccgcctcgatccgcccctccgctcgctccccaaaccgccgcgacgccgaaccgatttccccgccgatatccgaaaaacgcccccgacccgacccgacccgacccgcgccctccgcccccgcctccccgaaccgacgacgataaacgaactcgcgaacccgaccgcccccaaccccaaccccgccgaaccccgccccccgtcgaatacataaaattaacgctactttattacacctaaaaaaaaaaacgtataaaaaaaaaaaatacgcgaaccgcgaaatataaaacgaaaacctaaaaaaaatacccgaaacaacgtaaaacacgaaaaaaaaccgaatctaccaaaaaaccgcgcccctacctc

SEQ ID NO: 19569 - DNA, 959 bp, Artificial Sequence
  chemically treated genomic DNA (Homo sapiens) CpG-island No: 19569
ttttcggcgttttgtttcgtttatttgcgcgaggagattttagttgttggtggtgggggacgcgaattcggggtttttcgggaatggggatagtaagagggggttaggcgtgagcgaggttgtaggtttcgtgcgagtttggggtggtttttgtgtcgacgttgcgcggggggcggaggcggggggtttaggggtttgtatcgagcgtttttttttgtcgtgcgaggcgcggtcgtagtttttttttgttaaaagttgcgtgtgtgtgatcggcgttcgggaggatttgtttgtaggtttttcgtcgcgttgagggtaaagttagagagttttttttttgttttgcggttattgttttttaatcgtaggcgttttttgtgtttagagttggggatcgattcgttgtcgtttttgttcgcggcgttattcgtggagattaatcgaaggttgcggcgttttttcgttttcgggttaggtttttgcgttgggagtgcgcggcgtggggttgttgtggggtcggattttcgcgagtttggaggtggtggcgatagggataatttgggtagggcgtgtggaaagtagtcgttaggttgtagattttttgttttcgtatatttcgtgttcgtttttttttgtcgcggcgtcgttttatttttgtcgcgcgtttcggggcggttggaggttgtgtttgtcgtttgtttcgggaaggtaagggatagcgtgttgggattttgcgttttttgattttaatcgtttagtacgtcggttagagtgttcggtttgtttggcgggttttgaaagtttttagttttcggtgtttgcgatttgtattcgtaggttttgtttttttcggaaatttttgagattcgtgatcgttcgttttttcgttttcgggatttttatattttagggttgtttgggggtggggtgggagatggcgtggaattttttgtaaattt

SEQ ID NO: 19570 - DNA, 959 bp, Artificial Sequence
  chemically treated genomic DNA (Homo sapiens) CpG-island No: 19570
aaatttacaaaaaattccacgccatctcccaccccacccccaaacaaccctaaaatataaaaatcccgaaaacgaaaaaacgaacgatcacgaatctcaaaaatttccgaaaaaaacaaaacctacgaatacaaatcgcaaacaccgaaaactaaaaactttcaaaacccgccaaacaaaccgaacactctaaccgacgtactaaacgattaaaatcaaaaaacgcaaaatcccaacacgctatcccttaccttcccgaaacaaacgacaaacacaacctccaaccgccccgaaacgcgcgacaaaaataaaacgacgccgcgacaaaaaaaaacgaacacgaaatatacgaaaacaaaaaatctacaacctaacgactactttccacacgccctacccaaattatccctatcgccaccacctccaaactcgcgaaaatccgaccccacaacaaccccacgccgcgcactcccaacgcaaaaacctaacccgaaaacgaaaaaacgccgcaaccttcgattaatctccacgaataacgccgcgaacaaaaacgacaacgaatcgatccccaactctaaacacaaaaaacgcctacgattaaaaaacaataaccgcaaaacaaaaaaaaaactctctaactttaccctcaacgcgacgaaaaacctacaaacaaatcctcccgaacgccgatcacacacacgcaacttttaacaaaaaaaaactacgaccgcgcctcgcacgacaaaaaaaaacgctcgatacaaacccctaaaccccccgcctccgccccccgcgcaacgtcgacacaaaaaccaccccaaactcgcacgaaacctacaacctcgctcacgcctaaccccctcttactatccccattcccgaaaaaccccgaattcgcgtcccccaccaccaacaactaaaatctcctcgcgcaaataaacgaaacaaaacgccgaaaa

SEQ ID NO: 19571 - DNA, 959 bp, Artificial Sequence
  chemically treated genomic DNA (Homo sapiens) CpG-island No: 19571
ggatttgtagaaagttttacgttattttttattttatttttaggtagttttgaagtatagaagtttcgggggcggggaggcgggcggttacgaattttaaaaattttcgaagaaaataggatttgcgaatataggtcgtagatatcgggaattaggggtttttagaattcgttaggtaggtcgggtattttggtcggcgtgttaggcggttggagttagggaacgtagagttttagtacgttgttttttgttttttcggagtaggcggtaaatatagtttttagtcgtttcggggcgcgcggtaggaatgaaacggcgtcgcggtagaaaggggcgagtacgggatgtacgaaagtaaaaagtttgtaatttagcggttgttttttatacgttttgtttaagttgtttttgtcgttattatttttaggttcgcgggagttcggttttataatagttttacgtcgcgtatttttagcgtaaaagtttaattcggaggcggggaaacgtcgtagttttcgattggtttttacgggtggcgtcgcgagtagaggcggtagcgggtcggtttttagttttgggtataaagagcgtttgcggttggaaggtagtagtcgtagagtagagaaagggttttttaattttgtttttagcgcggcggagaatttgtaggtaggttttttcgggcgtcggttatatatacgtaatttttaataaaaggaagttgcggtcgcgtttcgtacggtaagagaaggcgttcggtgtaaatttttgagtttttcgttttcgtttttcgcgtaacgtcggtataaaagttattttaaattcgtacggagtttgtagtttcgtttacgtttaatttttttttgttgtttttattttcgaagaatttcggattcgcgttttttattattagtagttggggttttttcgcgtaggtgagcgaggtagggcgtcggaga

SEQ ID NO: 19572 - DNA, 959 bp, Artificial Sequence
  chemically treated genomic DNA (Homo sapiens) CpG-island No: 19572
tctccgacgccctacctcgctcacctacgcgaaaaaaccccaactactaataataaaaaacgcgaatccgaaattcttcgaaaataaaaacaacaaaaaaaaattaaacgtaaacgaaactacaaactccgtacgaatttaaaataacttttataccgacgttacgcgaaaaacgaaaacgaaaaactcaaaaatttacaccgaacgccttctcttaccgtacgaaacgcgaccgcaacttccttttattaaaaattacgtatatataaccgacgcccgaaaaaacctacctacaaattctccgccgcgctaaaaacaaaattaaaaaaccctttctctactctacgactactaccttccaaccgcaaacgctctttatacccaaaactaaaaaccgacccgctaccgcctctactcgcgacgccacccgtaaaaaccaatcgaaaactacgacgtttccccgcctccgaattaaacttttacgctaaaaatacgcgacgtaaaactattataaaaccgaactcccgcgaacctaaaaataataacgacaaaaacaacttaaacaaaacgtataaaaaacaaccgctaaattacaaactttttactttcgtacatcccgtactcgcccctttctaccgcgacgccgtttcattcctaccgcgcgccccgaaacgactaaaaactatatttaccgcctactccgaaaaaacaaaaaacaacgtactaaaactctacgttccctaactccaaccgcctaacacgccgaccaaaatacccgacctacctaacgaattctaaaaacccctaattcccgatatctacgacctatattcgcaaatcctattttcttcgaaaatttttaaaattcgtaaccgcccgcctccccgcccccgaaacttctatacttcaaaactacctaaaaataaaataaaaaataacgtaaaactttctacaaatcc

SEQ ID NO: 19573 - DNA, 604 bp, Artificial Sequence
  chemically treated genomic DNA (Homo sapiens) CpG-island No: 19573
tttagtcgcggtcggttttacggtttttggattttgagagtcgtgggcgtttagggtcgattttggtttttggttttagagtatagtttttcgttttttcgcgatttagcgaggttatcggagttagcgaggagacgtgggtcgcggtgagaagagagagtattcggttcgtgttagggttgtaaggtagttgtcgtttattttcggaaatcggtggttagtgatagatgttagcggtttataatttcggtttttatgtagttttcgtcgttttttttatgaggaacgtacgtgtgcgcgtaattacgtacgtacgtatattacgtacgtacgtaggaggttcgtatttagttacgtttatatatcgttaaatcgttaggaagttacgtatttacgaagttacgtagtgacgtcgttacgtacgtacgtacgtatttgttataaggagacgttgtttagtttatcggattttgtttcgcgttagttaattaggataaggtcggggagttcgagataggtagtttagattaagaatcggaaggaggaaaaggaatcggagggaggaagaggaggggcgggacgagattattaggtaggattttta

SEQ ID NO: 19574 - DNA, 604 bp, Artificial Sequence
  chemically treated genomic DNA (Homo sapiens) CpG-island No: 19574
taaaaatcctacctaataatctcgtcccgcccctcctcttcctccctccgattccttttcctccttccgattcttaatctaaactacctatctcgaactccccgaccttatcctaattaactaacgcgaaacaaaatccgataaactaaacaacgtctccttataacaaatacgtacgtacgtacgtaacgacgtcactacgtaacttcgtaaatacgtaacttcctaacgatttaacgatatataaacgtaactaaatacgaacctcctacgtacgtacgtaatatacgtacgtacgtaattacgcgcacacgtacgttcctcataaaaaaaacgacgaaaactacataaaaaccgaaattataaaccgctaacatctatcactaaccaccgatttccgaaaataaacgacaactaccttacaaccctaacacgaaccgaatactctctcttctcaccgcgacccacgtctcctcgctaactccgataacctcgctaaatcgcgaaaaaacgaaaaactatactctaaaaccaaaaaccaaaatcgaccctaaacgcccacgactctcaaaatccaaaaaccgtaaaaccgaccgcgactaaa

SEQ ID NO: 19575 - DNA, 604 bp, Artificial Sequence
  chemically treated genomic DNA (Homo sapiens) CpG-island No: 19575
taaaaattttgtttggtggtttcgtttcgtttttttttttttttttttcggttttttttttttttttcggtttttggtttaggttgtttgtttcgagtttttcggttttgttttggttggttggcgcgggataggattcggtaaattgaatagcgtttttttgtggtaagtgcgtgcgtacgtgcgtggcgacgttattgcgtggtttcgtgaatacgtggttttttagcgatttggcggtgtataggcgtggttgaatacgggttttttgcgtacgtgcgtggtgtacgtacgtgcgtgattacgcgtatacgtacgttttttatgaaagggacgacgggagttgtatgaaagtcgaagttatggatcgttagtatttgttattggttatcggttttcgggagtaagcggtagttattttatagttttgatacgagtcgggtgttttttttttttatcgcggtttacgttttttcgttggtttcggtggtttcgttgggtcgcgaggaggcggaggattgtattttgaggttaaaagttagagtcggttttgaacgtttacgatttttagggtttagaggtcgtgagatcggtcgcggttgaa

SEQ ID NO: 19576 - DNA, 604 bp, Artificial Sequence
  chemically treated genomic DNA (Homo sapiens) CpG-island No: 19576
ttcaaccgcgaccgatctcacgacctctaaaccctaaaaatcgtaaacgttcaaaaccgactctaacttttaacctcaaaatacaatcctccgcctcctcgcgacccaacgaaaccaccgaaaccaacgaaaaaacgtaaaccgcgataaaaaaaaaaaacacccgactcgtatcaaaactataaaataactaccgcttactcccgaaaaccgataaccaataacaaatactaacgatccataacttcgactttcatacaactcccgtcgtccctttcataaaaaacgtacgtatacgcgtaatcacgcacgtacgtacaccacgcacgtacgcaaaaaacccgtattcaaccacgcctatacaccgccaaatcgctaaaaaaccacgtattcacgaaaccacgcaataacgtcgccacgcacgtacgcacgcacttaccacaaaaaaacgctattcaatttaccgaatcctatcccgcgccaaccaaccaaaacaaaaccgaaaaactcgaaacaaacaacctaaaccaaaaaccgaaaaaaaaaaaaaaaaccgaaaaaaaaaaaaaaaaaaacgaaacgaaaccaccaaacaaaattttta

SEQ ID NO: 19577 - DNA, 812 bp, Artificial Sequence
  chemically treated genomic DNA (Homo sapiens) CpG-island No: 19577
ttttcgtcggtcgcgtgcggatataaggatggggattttttagcgaggagcgttttgggcggggtttcggacgtatgcgcggttttcgtacggaagttcggaaggaggggtagggggcggtggtttaggttttttcgggcggcggcggcggcggcggcggcgacggcgacggcgacggtagcggggacggtagtagtagcgggagtagtagcgtggacgcggttggcgttggcgttatgaattcgttgtaaggcgtaggttgtgtagtacggggtgcgggggaggaggaggaggacgtcgcggtgaagtttttcgttatgaatttgaggggttttttttaggattttaattcgaggtgaggcggcgtcgttggcgttttcgggagttcgcgttgcgggttcgggcgcgggttggtgttcggtttcggggaggtacggcgggcgagatgttgtagttcgaggattcgggcgtttgttcgagtttttttgcgggtgtaagcggtttttaggtaaaatagtcggtttcggcgttcgttcgtttttttttttcgtgttcggtgtttttagtttttgttcggttacggtcggaagggttcggtcgcgagtatcgttttgttttaagggaattttatttttttttgtttgttgttttttattggtgttttaattttttcgtttcggttttatttttttttgcgtcgttgcgggttttttatttttcgcgttagggtcgttttattcgatttaatatttttatttttattttagttgttttttttagtttttcgtagtttttggggttttttttgggtt

SEQ ID NO: 19578 - DNA, 812 bp, Artificial Sequence
  chemically treated genomic DNA (Homo sapiens) CpG-island No: 19578
aacccaaaaaaaaccccaaaaactacgaaaaactaaaaaaaacaactaaaataaaaataaaaatattaaatcgaataaaacgaccctaacgcgaaaaataaaaaacccgcaacgacgcaaaaaaaaataaaaccgaaacgaaaaaattaaaacaccaataaaaaacaacaaacaaaaaaaaataaaattcccttaaaacaaaacgatactcgcgaccgaacccttccgaccgtaaccgaacaaaaactaaaaacaccgaacacgaaaaaaaaaaacgaacgaacgccgaaaccgactattttacctaaaaaccgcttacacccgcaaaaaaactcgaacaaacgcccgaatcctcgaactacaacatctcgcccgccgtacctccccgaaaccgaacaccaacccgcgcccgaacccgcaacgcgaactcccgaaaacgccaacgacgccgcctcacctcgaattaaaatcctaaaaaaaacccctcaaattcataacgaaaaacttcaccgcgacgtcctcctcctcctcccccgcaccccgtactacacaacctacgccttacaacgaattcataacgccaacgccaaccgcgtccacgctactactcccgctactactaccgtccccgctaccgtcgccgtcgccgtcgccgccgccgccgccgccgccgcccgaaaaaacctaaaccaccgccccctacccctccttccgaacttccgtacgaaaaccgcgcatacgtccgaaaccccgcccaaaacgctcctcgctaaaaaatccccatccttatatccgcacgcgaccgacgaaaa

SEQ ID NO: 19579 - DNA, 812 bp, Artificial Sequence
  chemically treated genomic DNA (Homo sapiens) CpG-island No: 19579
aatttaaggaaaattttaaggattgcgaggaattggaggaaatagttggggtgggggtaggggtgttgggtcgagtgagacggttttgacgcggagaatggagggttcgtagcggcgtagaagaggatggaatcgagacgaagaagttgggatattaatgagggatagtaagtagaaaagaatggggtttttttggggtaggacggtgttcgcggtcgggttttttcggtcgtggtcgggtaggggttgaaagtatcgggtacgggaggaggaagcgggcgggcgtcgaggtcgattgttttgtttggggatcgtttgtattcgtagggaggttcgggtaggcgttcgggttttcgggttgtagtatttcgttcgtcgtgttttttcggagtcgaatattagttcgcgttcgagttcgtagcgcggattttcgggggcgttaacgacgtcgttttatttcgggttgaagttttggaagaggttttttaggtttatggcggagaattttatcgcggcgtttttttttttttttttcgtatttcgtgttgtatagtttgcgttttatagcgggtttatggcgttagcgttagtcgcgtttacgttgttgttttcgttattgttgtcgttttcgttgtcgtcgtcgtcgtcgtcgtcgtcgtcgtcgtcgtcgtcgttcggagaaatttgagttatcgttttttgttttttttttcgggttttcgtacgagggtcgcgtatgcgttcggagtttcgtttagagcgtttttcgttgggaggtttttatttttgtgttcgtacgcgatcggcggagg

SEQ ID NO: 19580 - DNA, 812 bp, Artificial Sequence
  chemically treated genomic DNA (Homo sapiens) CpG-island No: 19580
cctccgccgatcgcgtacgaacacaaaaataaaaacctcccaacgaaaaacgctctaaacgaaactccgaacgcatacgcgaccctcgtacgaaaacccgaaaaaaaaaacaaaaaacgataactcaaatttctccgaacgacgacgacgacgacgacgacgacgacgacgacgacgacaacgaaaacgacaacaataacgaaaacaacaacgtaaacgcgactaacgctaacgccataaacccgctataaaacgcaaactatacaacacgaaatacgaaaaaaaaaaaaaaaaacgccgcgataaaattctccgccataaacctaaaaaacctcttccaaaacttcaacccgaaataaaacgacgtcgttaacgcccccgaaaatccgcgctacgaactcgaacgcgaactaatattcgactccgaaaaaacacgacgaacgaaatactacaacccgaaaacccgaacgcctacccgaacctccctacgaatacaaacgatccccaaacaaaacaatcgacctcgacgcccgcccgcttcctcctcccgtacccgatactttcaacccctacccgaccacgaccgaaaaaacccgaccgcgaacaccgtcctaccccaaaaaaaccccattcttttctacttactatccctcattaatatcccaacttcttcgtctcgattccatcctcttctacgccgctacgaaccctccattctccgcgtcaaaaccgtctcactcgacccaacacccctacccccaccccaactatttcctccaattcctcgcaatccttaaaattttccttaaatt

SEQ ID NO: 19581 - DNA, 1105 bp, Artificial Sequence
  chemically treated genomic DNA (Homo sapiens) CpG-island No: 19581
cgggagcggtcgcgcgagttttggagtagggcgcggttattggtgacgtacgtcggggagtacggcgtttacgtttttattattagcgaggttttatattcggcgttttaagttcggggttggaggcgtttcggttttttttttttcggagcgggatcggtttcgttttcgcgtttcgggtcgttttcggcggttttttttattttttagttttggttttttcgggcgtagtatatttttagtcggtcgtagtttgatacgtcgcgcggttttttagtttttcgcggttgtttttttaggtatggtatagggtttcgttttattatggtagtagtacggtatagtacgttcgattttatgttcggcgttaaaggtgagggcgttcgtcgttatttgcgtggttattttcgtcgttttcgtcgtttggcgggttggggcgggggtcgggcgtggcgtgcgtcgcgggtcgaataatgcgggcggttcgcgcggcgtcgtattttttcggattgttacgtatagcgcgttgcggggtcgcgtgtatcggcggtcgggcggaggtcgcgtttttgttggtttcgcgtttcgtttcggtcgtagttcggggtttgtaggggtagtttcgggtgttcgtcggtcgcgtcgttttttcgggttttggtcgtttattcgcgtttttacgcgggttcgtcgttttcgcgttttcgttcggggagttttcgggttgtcgggcgcgggcggattttttatgggacgagggttgtagggattgcggcggagcgaggcgtgattcgcgcggcgagttcgggttgggggcgtgcgtcgagcggggttgttcgcgcgatttttttttgtttttgtaggcgggtaaattttttttttgggggcgggggttttttttcgtagggagttggggttggggaaaggtttgcggacgcgtagcgtttgtagaatttttagtcgattgcgtaggagacggatttttcggaaaggaattgggggacgggaaaaggaaacgattattattattgggggtggggaggtatgaggtttgggcgcgggaatcgtttatatttcgaatcggggagttattaaaagatagtcg

SEQ ID NO: 19582 - DNA, 1105 bp, Artificial Sequence
  chemically treated genomic DNA (Homo sapiens) CpG-island No: 19582
cgactatcttttaataactccccgattcgaaatataaacgattcccgcgcccaaacctcatacctccccacccccaataataataatcgtttccttttcccgtcccccaattcctttccgaaaaatccgtctcctacgcaatcgactaaaaattctacaaacgctacgcgtccgcaaacctttccccaaccccaactccctacgaaaaaaaacccccgcccccaaaaaaaaaatttacccgcctacaaaaacaaaaaaaaatcgcgcgaacaaccccgctcgacgcacgcccccaacccgaactcgccgcgcgaatcacgcctcgctccgccgcaatccctacaaccctcgtcccataaaaaatccgcccgcgcccgacaacccgaaaactccccgaacgaaaacgcgaaaacgacgaacccgcgtaaaaacgcgaataaacgaccaaaacccgaaaaaacgacgcgaccgacgaacacccgaaactacccctacaaaccccgaactacgaccgaaacgaaacgcgaaaccaacaaaaacgcgacctccgcccgaccgccgatacacgcgaccccgcaacgcgctatacgtaacaatccgaaaaaatacgacgccgcgcgaaccgcccgcattattcgacccgcgacgcacgccacgcccgacccccgccccaacccgccaaacgacgaaaacgacgaaaataaccacgcaaataacgacgaacgccctcacctttaacgccgaacataaaatcgaacgtactataccgtactactaccataataaaacgaaaccctataccatacctaaaaaaacaaccgcgaaaaactaaaaaaccgcgcgacgtatcaaactacgaccgactaaaaatatactacgcccgaaaaaaccaaaactaaaaaataaaaaaaaccgccgaaaacgacccgaaacgcgaaaacgaaaccgatcccgctccgaaaaaaaaaaaaccgaaacgcctccaaccccgaacttaaaacgccgaatataaaacctcgctaataataaaaacgtaaacgccgtactccccgacgtacgtcaccaataaccgcgccctactccaaaactcgcgcgaccgctcccg

SEQ ID NO: 19583 - DNA, 1105 bp, Artificial Sequence
  chemically treated genomic DNA (Homo sapiens) CpG-island No: 19583
cggttgttttttgatagtttttcgattcggggtgtaaacgattttcgcgtttagattttatgtttttttatttttaataataataatcgtttttttttttcgttttttagttttttttcgggggattcgttttttacgtagtcggttgagaattttgtaagcgttgcgcgttcgtagatttttttttagttttagttttttacgaggggaaattttcgtttttaagagggaaatttattcgtttgtaagaataggaaaaggtcgcgcgggtagtttcgttcggcgtacgtttttagttcgggttcgtcgcgcgggttacgtttcgtttcgtcgtagtttttgtaattttcgttttatggggggttcgttcgcgttcggtagttcggggatttttcgagcgggagcgcgaaggcggcgagttcgcgtgggagcgcgggtggacggttagggttcggaagggcggcgcggtcggcgggtattcgggattgtttttgtaggtttcgagttgcggtcgggacggagcgcggagttagtaggagcgcggttttcgttcgatcgtcggtgtacgcggtttcgtagcgcgttgtgcgtggtagttcgggagagtgcggcgtcgcgcgggtcgttcgtattgttcggttcgcggcgtacgttacgttcgattttcgttttagttcgttaggcggcgggagcggcggggatggttacgtaggtggcggcgggcgtttttatttttggcgtcgagtatgaagtcgagcgtgttgtgtcgtgttgttgttatagtgaggcgaggttttgtgttatgtttgggggagtagtcgcgggagattggggggtcgcgcggcgtgttaggttgcggtcggttgggagtgtgttgcgttcggggaggttaggattaggaggtgggaggggtcgtcgggagcgattcggggcgcgggggcggggtcggtttcgtttcgggagggaggaagtcgggacgtttttagtttcgaatttggagcgtcgggtgtgaggtttcgttaatggtggaaacgtgggcgtcgtgtttttcggcgtgcgttattaatggtcgcgttttgttttaaggttcgcgcggtcgttttcg

SEQ ID NO: 19584 - DNA, 1105 bp, Artificial Sequence
  chemically treated genomic DNA (Homo sapiens) CpG-island No: 19584
cgaaaacgaccgcgcgaaccttaaaacaaaacgcgaccattaataacgcacgccgaaaaacacgacgcccacgtttccaccattaacgaaacctcacacccgacgctccaaattcgaaactaaaaacgtcccgacttcctccctcccgaaacgaaaccgaccccgcccccgcgccccgaatcgctcccgacgacccctcccacctcctaatcctaacctccccgaacgcaacacactcccaaccgaccgcaacctaacacgccgcgcgaccccccaatctcccgcgactactcccccaaacataacacaaaacctcgcctcactataacaacaacacgacacaacacgctcgacttcatactcgacgccaaaaataaaaacgcccgccgccacctacgtaaccatccccgccgctcccgccgcctaacgaactaaaacgaaaatcgaacgtaacgtacgccgcgaaccgaacaatacgaacgacccgcgcgacgccgcactctcccgaactaccacgcacaacgcgctacgaaaccgcgtacaccgacgatcgaacgaaaaccgcgctcctactaactccgcgctccgtcccgaccgcaactcgaaacctacaaaaacaatcccgaatacccgccgaccgcgccgcccttccgaaccctaaccgtccacccgcgctcccacgcgaactcgccgccttcgcgctcccgctcgaaaaatccccgaactaccgaacgcgaacgaaccccccataaaacgaaaattacaaaaactacgacgaaacgaaacgtaacccgcgcgacgaacccgaactaaaaacgtacgccgaacgaaactacccgcgcgaccttttcctattcttacaaacgaataaatttccctcttaaaaacgaaaatttcccctcgtaaaaaactaaaactaaaaaaaaatctacgaacgcgcaacgcttacaaaattctcaaccgactacgtaaaaaacgaatcccccgaaaaaaaactaaaaaacgaaaaaaaaaaacgattattattattaaaaataaaaaaacataaaatctaaacgcgaaaatcgtttacaccccgaatcgaaaaactatcaaaaaacaaccg

SEQ ID NO: 19585 - DNA, 530 bp, Artificial Sequence
  chemically treated genomic DNA (Homo sapiens) CpG-island No: 19585
tttcgacgcggggttggggcgcgcgtagggtattgtgggtgtatagtttagttagcgcgtcgtcggttggtgggttttaggcgtggattattatttttatggtgttttacgcgtagttagtcgtcgtcgtttgcgcgtttaggtttttgggattagtagttttagtttcgtggatgtgggtttgaatcggatggtttggaattcgttttttcggcgatttgtttggtagggcggggcgtttcgcgaagatggtggcgcgcgtggcgtgtggttttcgtcgtttggttaagttttagcgtagcgtatcggtcggcgtttcgttggtttggagtttatatttatcgggtttttgatttcgcgtttttcgcgttcggttttcggtatgtttcgcgttcgtaagggtaatacgtttcggaagggtggttagcgtcgtggaggaggtgagtggggtggggggcgcgggatagttgtatgagcggcgggcgggggttttgttggatttttttggttgttttcgagggttttgggtg

SEQ ID NO: 19586 - DNA, 530 bp, Artificial Sequence
  chemically treated genomic DNA (Homo sapiens) CpG-island No: 19586
cacccaaaaccctcgaaaacaaccaaaaaaatccaacaaaacccccgcccgccgctcatacaactatcccgcgccccccaccccactcacctcctccacgacgctaaccacccttccgaaacgtattacccttacgaacgcgaaacataccgaaaaccgaacgcgaaaaacgcgaaatcaaaaacccgataaatataaactccaaaccaacgaaacgccgaccgatacgctacgctaaaacttaaccaaacgacgaaaaccacacgccacgcgcgccaccatcttcgcgaaacgccccgccctaccaaacaaatcgccgaaaaaacgaattccaaaccatccgattcaaacccacatccacgaaactaaaactactaatcccaaaaacctaaacgcgcaaacgacgacgactaactacgcgtaaaacaccataaaaataataatccacgcctaaaacccaccaaccgacgacgcgctaactaaactatacacccacaataccctacgcgcgccccaaccccgcgtcgaaa

SEQ ID NO: 19587 - DNA, 530 bp, Artificial Sequence
  chemically treated genomic DNA (Homo sapiens) CpG-island No: 19587
tatttagggttttcgagaataattaaggggatttagtaggattttcgttcgtcgtttatatagttgtttcgcgttttttattttatttattttttttacggcgttgattattttttcggagcgtgttgtttttacgggcgcgaggtatgtcgggaatcgggcgcggggggcgcggggttagggattcggtgggtgtgggttttaggttaacgagacgtcggtcggtgcgttgcgttgagatttggttagacgacgggagttatacgttacgcgcgttattattttcgcgaggcgtttcgttttgttaaataggtcgtcgggaaggcgagttttaggttattcgatttaggtttatatttacgaggttaaaattattaattttagaggtttgagcgcgtaggcgacggcggttagttgcgcgtagagtattatgggaatggtagtttacgtttggggtttattagtcgacgacgcgttggttgaattatgtatttataatgttttgcgcgcgttttagtttcgcgtcggga

SEQ ID NO: 19588 - DNA, 530 bp, Artificial Sequence
  chemically treated genomic DNA (Homo sapiens) CpG-island No: 19588
tcccgacgcgaaactaaaacgcgcgcaaaacattataaatacataattcaaccaacgcgtcgtcgactaataaaccccaaacgtaaactaccattcccataatactctacgcgcaactaaccgccgtcgcctacgcgctcaaacctctaaaattaataattttaacctcgtaaatataaacctaaatcgaataacctaaaactcgccttcccgacgacctatttaacaaaacgaaacgcctcgcgaaaataataacgcgcgtaacgtataactcccgtcgtctaaccaaatctcaacgcaacgcaccgaccgacgtctcgttaacctaaaacccacacccaccgaatccctaaccccgcgccccccgcgcccgattcccgacatacctcgcgcccgtaaaaacaacacgctccgaaaaaataatcaacgccgtaaaaaaaataaataaaataaaaaacgcgaaacaactatataaacgacgaacgaaaatcctactaaatccccttaattattctcgaaaaccctaaata

SEQ ID NO: 19589 - DNA, 664 bp, Artificial Sequence
  chemically treated genomic DNA (Homo sapiens) CpG-island No: 19589
gtttgtcgttttttgtttggttttcggcgtggggatagtttggttattagtgcgttgcgttgcgcggttttcgtttagcgcgaggtttaggggcgtgggtttttcggttacggtttttttttcgcgattttaggggtagtgattgtagcgtaggttgcgggcggtatatgcgtagggagttcgcgttgttattttcgttcggttttattagttgtagaaagtttcggtattagagtttggggttcggcggcgcggcgggcgtagttttttcggttcgcgttagtcgttcggtttgcgtagtatttaatacgtgtagcgataggcgacgtagcggttgcgtaaagttttgttcgacggcggcgtataagtatacgttcgagtttcggcgtcgtagtttgcgtagtagtagttttcgggcggtgcgttcggtgcgtttttttgttagtatttgcgggtagagggtagcgtgaggcgggggtgtcgggtcgggaatagggttttcgggttttagtacgcgacggaagaagtaaagagttattgggagtcgaggtggagcgggaaaggggtgttcgtaggcgtatattttaaggttgagtgtttgggagttggtggtttttaagggagaattcgaaagaggcggggtttatatgaatttggtgggggg

SEQ ID NO: 19590 - DNA, 664 bp, Artificial Sequence
  chemically treated genomic DNA (Homo sapiens) CpG-island No: 19590
ccccccaccaaattcatataaaccccgcctctttcgaattctcccttaaaaaccaccaactcccaaacactcaaccttaaaatatacgcctacgaacacccctttcccgctccacctcgactcccaataactctttacttcttccgtcgcgtactaaaacccgaaaaccctattcccgacccgacacccccgcctcacgctaccctctacccgcaaatactaacaaaaaaacgcaccgaacgcaccgcccgaaaactactactacgcaaactacgacgccgaaactcgaacgtatacttatacgccgccgtcgaacaaaactttacgcaaccgctacgtcgcctatcgctacacgtattaaatactacgcaaaccgaacgactaacgcgaaccgaaaaaactacgcccgccgcgccgccgaaccccaaactctaataccgaaactttctacaactaataaaaccgaacgaaaataacaacgcgaactccctacgcatataccgcccgcaacctacgctacaatcactacccctaaaatcgcgaaaaaaaaaccgtaaccgaaaaacccacgcccctaaacctcgcgctaaacgaaaaccgcgcaacgcaacgcactaataaccaaactatccccacgccgaaaaccaaacaaaaaacgacaaac

SEQ ID NO: 19591 - DNA, 664 bp, Artificial Sequence
  chemically treated genomic DNA (Homo sapiens) CpG-island No: 19591
ttttttattaagtttatgtaaatttcgtttttttcggatttttttttgaagattattagtttttaaatatttagttttaaaatgtgcgtttgcgggtatttttttttcgttttatttcggtttttaatgattttttgtttttttcgtcgcgtgttagggttcggaagttttgttttcggttcgatattttcgttttacgttgttttttgttcgtaggtgttggtagaggagcgtatcgagcgtatcgttcggggattattgttgcgtaggttgcggcgtcgggattcgggcgtgtatttgtgcgtcgtcgtcgagtagggttttacgtaatcgttgcgtcgtttgtcgttgtacgtgttgagtgttacgtaggtcgaacgattggcgcgggtcgaggaggttgcgttcgtcgcgtcgtcgggttttaaattttggtatcgggattttttgtagttggtggagtcgggcggaggtggtagcgcgaattttttgcgtatgtgtcgttcgtagtttgcgttgtagttattgtttttggagtcgcggagaaagggtcgtaatcggaggatttacgtttttgagtttcgcgttgagcgggggtcgcgtagcgtaacgtattggtgattagattgtttttacgtcgggaattaagtaggagacgataggt

SEQ ID NO: 19592 - DNA, 664 bp, Artificial Sequence
  chemically treated genomic DNA (Homo sapiens) CpG-island No: 19592
acctatcgtctcctacttaattcccgacgtaaaaacaatctaatcaccaatacgttacgctacgcgacccccgctcaacgcgaaactcaaaaacgtaaatcctccgattacgaccctttctccgcgactccaaaaacaataactacaacgcaaactacgaacgacacatacgcaaaaaattcgcgctaccacctccgcccgactccaccaactacaaaaaatcccgataccaaaatttaaaacccgacgacgcgacgaacgcaacctcctcgacccgcgccaatcgttcgacctacgtaacactcaacacgtacaacgacaaacgacgcaacgattacgtaaaaccctactcgacgacgacgcacaaatacacgcccgaatcccgacgccgcaacctacgcaacaataatccccgaacgatacgctcgatacgctcctctaccaacacctacgaacaaaaaacaacgtaaaacgaaaatatcgaaccgaaaacaaaacttccgaaccctaacacgcgacgaaaaaaacaaaaaatcattaaaaaccgaaataaaacgaaaaaaaaatacccgcaaacgcacattttaaaactaaatatttaaaaactaataatcttcaaaaaaaaatccgaaaaaaacgaaatttacataaacttaataaaaaa

SEQ ID NO: 19593 - DNA, 617 bp, Artificial Sequence
  chemically treated genomic DNA (Homo sapiens) CpG-island No: 19593
tcgcgtcgtttttttttcgttttttcgtaggtttttgtcgattattttagagcgttcggtcgtcgttttgttttcggcgtttacggtgtagtttatttcgtcgttcgtcggttcggtcgtcgttcggtttttatacggtttacggttcggttcggtttcgttcgatttatttcgtttttattattagttttttgcgggaagtattcgggtcggtagtttcgagcgattgcgggaggcgttttttttatcgtcgcgtatcgacggcggggcgggtcgggggtggggtttgggcgaattaagtttgtgattgggtcggggcgggtttgtaggcggggttagaggagattagaggttgttgattggttcgagggcggagcgaagggggaagttaggcgtagtttaggttcgggtttgggttgtaggcggggttacgcggagaaaaggtaataggggtggttttaaatttcgggattcggtattgggcgggttgtaggcgggatcgggttgtgattgggtgcggagcgtcgggagttttgttgttggatagtcgggagggcggatttgttaattcgagggtggggattcggtgttttcgagggtagagtaggaattagttt

SEQ ID NO: 19594 - DNA, 617 bp, Artificial Sequence
  chemically treated genomic DNA (Homo sapiens) CpG-island No: 19594
aaactaattcctactctaccctcgaaaacaccgaatccccaccctcgaattaacaaatccgccctcccgactatccaacaacaaaactcccgacgctccgcacccaatcacaacccgatcccgcctacaacccgcccaataccgaatcccgaaatttaaaaccacccctattaccttttctccgcgtaaccccgcctacaacccaaacccgaacctaaactacgcctaacttcccccttcgctccgccctcgaaccaatcaacaacctctaatctcctctaaccccgcctacaaacccgccccgacccaatcacaaacttaattcgcccaaaccccacccccgacccgccccgccgtcgatacgcgacgataaaaaaaacgcctcccgcaatcgctcgaaactaccgacccgaatacttcccgcaaaaaactaataataaaaacgaaataaatcgaacgaaaccgaaccgaaccgtaaaccgtataaaaaccgaacgacgaccgaaccgacgaacgacgaaataaactacaccgtaaacgccgaaaacaaaacgacgaccgaacgctctaaaataatcgacaaaaacctacgaaaaaacgaaaaaaaaacgacgcga

SEQ ID NO: 19595 - DNA, 617 bp, Artificial Sequence
  chemically treated genomic DNA (Homo sapiens) CpG-island No: 19595
gggttggtttttgttttgttttcgagggtatcggatttttattttcgggttaatagattcgttttttcggttgtttagtaatagagttttcggcgtttcgtatttaattatagttcggtttcgtttgtagttcgtttagtgtcgggtttcggggtttggaattatttttattgtttttttttcgcgtggtttcgtttgtagtttaggttcgagtttgggttgcgtttaattttttttttcgtttcgttttcgagttaattaatagtttttaattttttttggtttcgtttgtaagttcgtttcggtttagttataggtttggttcgtttaggttttattttcggttcgtttcgtcgtcggtgcgcggcggtagggaaggcgtttttcgtagtcgttcggaattgtcgattcgagtgtttttcgtagagggttggtggtgggagcggagtgggtcgggcggggtcgagtcgggtcgtgggtcgtgtgggggtcgggcggcggtcgggtcggcggacggcgggatgggttgtatcgtgagcgtcgaggataaggcggcggtcgagcgttttaagatgatcgataagaatttgcgggaggacggagagaaggcggcgcgg

SEQ ID NO: 19596 - DNA, 617 bp, Artificial Sequence
  chemically treated genomic DNA (Homo sapiens) CpG-island No: 19596
ccgcgccgccttctctccgtcctcccgcaaattcttatcgatcatcttaaaacgctcgaccgccgccttatcctcgacgctcacgatacaacccatcccgccgtccgccgacccgaccgccgcccgacccccacacgacccacgacccgactcgaccccgcccgacccactccgctcccaccaccaaccctctacgaaaaacactcgaatcgacaattccgaacgactacgaaaaacgccttccctaccgccgcgcaccgacgacgaaacgaaccgaaaataaaacctaaacgaaccaaacctataactaaaccgaaacgaacttacaaacgaaaccaaaaaaaattaaaaactattaattaactcgaaaacgaaacgaaaaaaaaaattaaacgcaacccaaactcgaacctaaactacaaacgaaaccacgcgaaaaaaaaacaataaaaataattccaaaccccgaaacccgacactaaacgaactacaaacgaaaccgaactataattaaatacgaaacgccgaaaactctattactaaacaaccgaaaaaacgaatctattaacccgaaaataaaaatccgataccctcgaaaacaaaacaaaaaccaaccc

SEQ ID NO: 19597 - DNA, 689 bp, Artificial Sequence
  chemically treated genomic DNA (Homo sapiens) CpG-island No: 19597
gtcgagcgcgtcggtgttcgtaggaagtttcgtttagcgcggatcgtattttttcgcgacgtttttggagaagtcgttagtttttgggtcgttagtagcgcgcgttttcggcgtgggaggagcgcggcgagtaggggcggggttagtgattttcgtagttaatcggggtggcggcgcgtttttggagggttcgtagttcgttcggcgcgtacggggcggggtttcgtttgatcgtggcggtcgtcgggtagtagagttcgggcgtagcgagcgtagcgtagcgtagggagcgtaggcggtggcggtattaggttttcggggttttagcgttcggcgtagcgaagtagttttcggcggtggtaattacggcggcggcgtcggggcgatgttgtgggtttcgttgggcgtcggtgttttggttttttttttaggtatttagtttcgtttgtttttcgtttcggggaatcgtagcgttcgggaggtatttttgtgaggttgtgggttcgttgtcggggagtgggtgggtggggtcgggcggggttgtgcggtttgggtcgttttttttcggaggaagagggtggggatcgagggaagcgggcgggggtgggagcgttgttttcgggtcgtcgttgatggtattttagggtttcgttttttttttgtttttatgtgggttgaaagaggttttg

SEQ ID NO: 19598 - DNA, 689 bp, Artificial Sequence
  chemically treated genomic DNA (Homo sapiens) CpG-island No: 19598
caaaacctctttcaacccacataaaaacaaaaaaaaaacgaaaccctaaaataccatcaacgacgacccgaaaacaacgctcccacccccgcccgcttccctcgatccccaccctcttcctccgaaaaaaaacgacccaaaccgcacaaccccgcccgaccccacccacccactccccgacaacgaacccacaacctcacaaaaatacctcccgaacgctacgattccccgaaacgaaaaacaaacgaaactaaatacctaaaaaaaaaaccaaaacaccgacgcccaacgaaacccacaacatcgccccgacgccgccgccgtaattaccaccgccgaaaactacttcgctacgccgaacgctaaaaccccgaaaacctaataccgccaccgcctacgctccctacgctacgctacgctcgctacgcccgaactctactacccgacgaccgccacgatcaaacgaaaccccgccccgtacgcgccgaacgaactacgaaccctccaaaaacgcgccgccaccccgattaactacgaaaatcactaaccccgcccctactcgccgcgctcctcccacgccgaaaacgcgcgctactaacgacccaaaaactaacgacttctccaaaaacgtcgcgaaaaaatacgatccgcgctaaacgaaacttcctacgaacaccgacgcgctcgac

SEQ ID NO: 19599 - DNA, 689 bp, Artificial Sequence
  chemically treated genomic DNA (Homo sapiens) CpG-island No: 19599
taaaattttttttaatttatatggaggtaggaggaggacggagttttgggatgttattagcggcggttcggagatagcgtttttattttcgttcgtttttttcggtttttatttttttttttcgagggaaggcggtttagatcgtatagtttcgttcggttttatttatttatttttcggtagcgagtttatagttttataaagatatttttcgggcgttgcggtttttcggggcgaggggtaagcggggttgggtatttgaggaagaggttaggatatcggcgtttaacgagatttatagtatcgtttcggcgtcgtcgtcgtagttgttatcgtcggaggttatttcgttgcgtcgagcgttggagtttcgggaatttggtgtcgttatcgtttgcgttttttgcgttgcgttgcgttcgttgcgttcgggttttgttgttcggcgatcgttacggttaagcggagtttcgtttcgtgcgcgtcgggcgagttgcggattttttaaggacgcgtcgttatttcgattggttgcgggagttattggtttcgtttttgttcgtcgcgttttttttacgtcgggggcgcgcgttgttggcggtttagagattggcggtttttttaggggcgtcgcgggagggtgcggttcgcgttgggcgaggttttttgcgggtatcggcgcgttcggt

SEQ ID NO: 19600 - DNA, 689 bp, Artificial Sequence
  chemically treated genomic DNA (Homo sapiens) CpG-island No: 19600
accgaacgcgccgatacccgcaaaaaacctcgcccaacgcgaaccgcaccctcccgcgacgcccctaaaaaaaccgccaatctctaaaccgccaacaacgcgcgcccccgacgtaaaaaaaacgcgacgaacaaaaacgaaaccaataactcccgcaaccaatcgaaataacgacgcgtccttaaaaaatccgcaactcgcccgacgcgcacgaaacgaaactccgcttaaccgtaacgatcgccgaacaacaaaacccgaacgcaacgaacgcaacgcaacgcaaaaaacgcaaacgataacgacaccaaattcccgaaactccaacgctcgacgcaacgaaataacctccgacgataacaactacgacgacgacgccgaaacgatactataaatctcgttaaacgccgatatcctaacctcttcctcaaatacccaaccccgcttacccctcgccccgaaaaaccgcaacgcccgaaaaatatctttataaaactataaactcgctaccgaaaaataaataaataaaaccgaacgaaactatacgatctaaaccgccttccctcgaaaaaaaaaaataaaaaccgaaaaaaacgaacgaaaataaaaacgctatctccgaaccgccgctaataacatcccaaaactccgtcctcctcctacctccatataaattaaaaaaaatttta

SEQ ID NO: 19601 - DNA, 1462 bp, Artificial Sequence
  chemically treated genomic DNA (Homo sapiens) CpG-island No: 19601
aggcgagcgtaaatagtgtacggatgcgtgtgtttatcgtgtgcgtaggcgagtgtaagtgtacgggtgtgtgtgttgtgcgtaggcgagtgtaaattgtacgggcgcgtgtgtttatcgtgtgcgtaggcgagtgtaaatagtgtacgggtgcgtgtgtttattgtgcgtaggcgtttgtaaatagtgtacgggcgtgtgtgtgtttattgcgtaggcgagtgtaaattgtacgggcgcgtgtgtgtttattgtgtgcgtaggcgagcgtaaattgtacgggtacgtgtgtttattgcgtaggcgagcgtaaatagtgtacgggcgcgtgtgtgtttattgtgtgcgtaggcgagtgtaaattgtacgggtacgtgtgtttattgtgtataggcgagtgtaaatagtgtacgggcgcgtgtgtttattgtgtgcgtaggcgagtgtaagtgtacgggcgtgtgtgtttattgcgtaggcgagtgtaaattgtataggcgcgtgtgtgtttattgtgcgtaggcgagtgtaaattgtacgggcgcgtgtgtgtttattgcgtaggcgagtttaaatagtgtacgggcgcgtgtgtgtttattgtgtgcgtaggcgagtgtaagtgtacgagcgcgtgtgtgtttattgcgtaggcgtttgtaaatagtgtatgggtatgtgtgttgtgtgtgtgtaggcgatcgtaaatagtgtacggacgcgtgtgtgtttatcgtgtgcgtaggcgagtgtaaatagtgtacgggtgtgtgtgtttattgtgtaggcgagtgtaaattgtataggcgcgtgtgtttatcgtgtgcgtaggcgagtgtaaatagtgtacgggcgcgtgtgtttatcgtgtgcgtaggcgtgtaaattgtacgggcgcgtgtgtttattgcgtaggcgagtgtaaatagtgtacgggcgcgtgtgtgtttattgtgcgtaggcgagtttaaatagcgtacgggcgcgtgtgtgtttattgcgtaggcgagtgtaaattgtacgggcgcgtgtgtttattgcgtaggcgagcgtaaatagtgtacgggcgcgcgtgtgtttatcgtgcgcgtaggcgagcgtaaatagtgtacgggcgcgcgtgtgtttatcgtgcgcgtaggcgagcgtaaatagtgtacgggcgcgcgtgtgtttatcgtgcgcgtaggcgagcgtaaatagtgtacgggcgcgcgtgtgtttatcgtgcgcgtaggcgagcgtaaatagtgtacgggcgcgcgtgtgtttatcgtgcgcgtaggcgagcgtaagtagtgtacgggcgcgcgtgtttatcgtgtgcgtaggcgagtgtaaatagtgtacgggcgtgtgtgtttatcgtgtgcgtaggcgagtgtaaatatagttggtgttttggtgcgtgtgtgttgtgagtataggtgtttgtaaatgatgtaaattttttttgacgtta

SEQ ID NO: 19602 - DNA, 1462 bp, Artificial Sequence
  chemically treated genomic DNA (Homo sapiens) CpG-island No: 19602
taacgtcaaaaaaaatttacatcatttacaaacacctatactcacaacacacacgcaccaaaacaccaactatatttacactcgcctacgcacacgataaacacacacgcccgtacactatttacactcgcctacgcacacgataaacacgcgcgcccgtacactacttacgctcgcctacgcgcacgataaacacacgcgcgcccgtacactatttacgctcgcctacgcgcacgataaacacacgcgcgcccgtacactatttacgctcgcctacgcgcacgataaacacacgcgcgcccgtacactatttacgctcgcctacgcgcacgataaacacacgcgcgcccgtacactatttacgctcgcctacgcgcacgataaacacacgcgcgcccgtacactatttacgctcgcctacgcaataaacacacgcgcccgtacaatttacactcgcctacgcaataaacacacacgcgcccgtacgctatttaaactcgcctacgcacaataaacacacacgcgcccgtacactatttacactcgcctacgcaataaacacacgcgcccgtacaatttacacgcctacgcacacgataaacacacgcgcccgtacactatttacactcgcctacgcacacgataaacacacgcgcctatacaatttacactcgcctacacaataaacacacacacccgtacactatttacactcgcctacgcacacgataaacacacacgcgtccgtacactatttacgatcgcctacacacacacaacacacatacccatacactatttacaaacgcctacgcaataaacacacacgcgctcgtacacttacactcgcctacgcacacaataaacacacacgcgcccgtacactatttaaactcgcctacgcaataaacacacacgcgcccgtacaatttacactcgcctacgcacaataaacacacacgcgcctatacaatttacactcgcctacgcaataaacacacacgcccgtacacttacactcgcctacgcacacaataaacacacgcgcccgtacactatttacactcgcctatacacaataaacacacgtacccgtacaatttacactcgcctacgcacacaataaacacacacgcgcccgtacactatttacgctcgcctacgcaataaacacacgtacccgtacaatttacgctcgcctacgcacacaataaacacacacgcgcccgtacaatttacactcgcctacgcaataaacacacacacgcccgtacactatttacaaacgcctacgcacaataaacacacgcacccgtacactatttacactcgcctacgcacacgataaacacacgcgcccgtacaatttacactcgcctacgcacaacacacacacccgtacacttacactcgcctacgcacacgataaacacacgcatccgtacactatttacgctcgcct

SEQ ID NO: 19603 - DNA, 1462 bp, Artificial Sequence
  chemically treated genomic DNA (Homo sapiens) CpG-island No: 19603
tgacgttaagggaggtttatattatttatagatatttgtgtttatagtatatacgtattagggtattagttgtgtttatattcgtttgcgtatacggtgaatatatacgttcgtgtattgtttatattcgtttgcgtatacggtgagtacgcgcgttcgtgtattgtttacgttcgtttgcgcgtacggtgagtatacgcgcgttcgtgtattgtttacgttcgtttgcgcgtacggtgagtatacgcgcgttcgtgtattgtttacgttcgtttgcgcgtacggtgagtatacgcgcgttcgtgtattgtttacgttcgtttgcgcgtacggtgagtatacgcgcgttcgtgtattgtttacgttcgtttgcgcgtacggtgagtatacgcgcgttcgtgtattgtttacgttcgtttgcgtagtgagtatacgcgttcgtgtagtttatattcgtttgcgtagtgagtatatacgcgttcgtgcgttgtttaaattcgtttgcgtatagtgagtatatacgcgttcgtgtattgtttatattcgtttgcgtagtgagtatacgcgttcgtgtagtttatacgtttgcgtatacggtgagtatacgcgttcgtgtattgtttatattcgtttgcgtatacggtgagtatacgcgtttgtgtagtttatattcgtttgtatagtgagtatatatattcgtgtattgtttatattcgtttgcgtatacggtgagtatatacgcgttcgtgtattgtttacggtcgtttgtatatatatagtatatatgtttatgtattgtttatagacgtttgcgtagtgagtatatacgcgttcgtgtatttatattcgtttgcgtatatagtgagtatatacgcgttcgtgtattgtttaaattcgtttgcgtagtgagtatatacgcgttcgtgtagtttatattcgtttgcgtatagtgagtatatacgcgtttgtgtagtttatattcgtttgcgtagtgagtatatacgttcgtgtatttatattcgtttgcgtatatagtgagtatacgcgttcgtgtattgtttatattcgtttgtgtatagtaagtatacgtgttcgtgtagtttatattcgtttgcgtatatagtgagtatatacgcgttcgtgtattgtttacgttcgtttgcgtagtgagtatacgtgttcgtgtagtttacgttcgtttgcgtatatagtgagtatatacgcgttcgtgtagtttatattcgtttgcgtagtgagtatatatacgttcgtgtattgtttatagacgtttgcgtatagtgagtatacgtattcgtgtattgtttatattcgtttgcgtatacggtgagtatacgcgttcgtgtagtttatattcgtttgcgtatagtatatatattcgtgtatttatattcgtttgcgtatacggtgagtatacgtattcgtgtattgtttacgttcgttt

SEQ ID NO: 19604 - DNA, 1462 bp, Artificial Sequence
  chemically treated genomic DNA (Homo sapiens) CpG-island No: 19604
aaacgaacgtaaacaatacacgaatacgtatactcaccgtatacgcaaacgaatataaatacacgaatatatatactatacgcaaacgaatataaactacacgaacgcgtatactcaccgtatacgcaaacgaatataaacaatacacgaatacgtatactcactatacgcaaacgtctataaacaatacacgaacgtatatatactcactacgcaaacgaatataaactacacgaacgcgtatatactcactatatacgcaaacgaacgtaaactacacgaacacgtatactcactacgcaaacgaacgtaaacaatacacgaacgcgtatatactcactatatacgcaaacgaatataaactacacgaacacgtatacttactatacacaaacgaatataaacaatacacgaacgcgtatactcactatatacgcaaacgaatataaatacacgaacgtatatactcactacgcaaacgaatataaactacacaaacgcgtatatactcactatacgcaaacgaatataaactacacgaacgcgtatatactcactacgcaaacgaatttaaacaatacacgaacgcgtatatactcactatatacgcaaacgaatataaatacacgaacgcgtatatactcactacgcaaacgtctataaacaatacataaacatatatactatatatatacaaacgaccgtaaacaatacacgaacgcgtatatactcaccgtatacgcaaacgaatataaacaatacacgaatatatatactcactatacaaacgaatataaactacacaaacgcgtatactcaccgtatacgcaaacgaatataaacaatacacgaacgcgtatactcaccgtatacgcaaacgtataaactacacgaacgcgtatactcactacgcaaacgaatataaacaatacacgaacgcgtatatactcactatacgcaaacgaatttaaacaacgcacgaacgcgtatatactcactacgcaaacgaatataaactacacgaacgcgtatactcactacgcaaacgaacgtaaacaatacacgaacgcgcgtatactcaccgtacgcgcaaacgaacgtaaacaatacacgaacgcgcgtatactcaccgtacgcgcaaacgaacgtaaacaatacacgaacgcgcgtatactcaccgtacgcgcaaacgaacgtaaacaatacacgaacgcgcgtatactcaccgtacgcgcaaacgaacgtaaacaatacacgaacgcgcgtatactcaccgtacgcgcaaacgaacgtaaacaatacacgaacgcgcgtactcaccgtatacgcaaacgaatataaacaatacacgaacgtatatattcaccgtatacgcaaacgaatataaacacaactaataccctaatacgtatatactataaacacaaatatctataaataatataaacctcccttaacgtca

SEQ ID NO: 19605 - DNA, 534 bp, Artificial Sequence
  chemically treated genomic DNA (Homo sapiens) CpG-island No: 19605
ttcgtgttttttttcgtttatgtgtttatatttatacggatattcgtgtttatttttgtttatgtgtttatatacggattttcgtgtttatttttacgtgtttatatacggatattcgtgtttatttttgtttatgtgtttatatattgattttcgtgtttatttttacgtgtttatatacggatattcgtgtttttatttatgtgtttatatatacgtgtttatttatgtgtttatatacggatattcgtgtttatttttgtttatgtgtttatatacggattttcgtgtttatttacgtgtttatacggatacgtgtttatttttatatgtttacggatatttatgtttatatttatatgtttatatacgtgtttatattcgttttatttatgtgtgtttatatatatacggatattcgtgtttatatagatattcgtgtattttcgtttttgtgtgtatatacgggtatatgattttttaaatgtgtatattcgtgttttttatatatttattagagtattcgtagtatag

SEQ ID NO: 19606 - DNA, 534 bp, Artificial Sequence
  chemically treated genomic DNA (Homo sapiens) CpG-island No: 19606
ctatactacgaatactctaataaatatataaaaaacacgaatatacacatttaaaaaatcatatacccgtatatacacacaaaaacgaaaatacacgaatatctatataaacacgaatatccgtatatatataaacacacataaataaaacgaatataaacacgtatataaacatataaatataaacataaatatccgtaaacatataaaaataaacacgtatccgtataaacacgtaaataaacacgaaaatccgtatataaacacataaacaaaaataaacacgaatatccgtatataaacacataaataaacacgtatatataaacacataaataaaaacacgaatatccgtatataaacacgtaaaaataaacacgaaaatcaatatataaacacataaacaaaaataaacacgaatatccgtatataaacacgtaaaaataaacacgaaaatccgtatataaacacataaacaaaaataaacacgaatatccgtataaatataaacacataaacgaaaaaaaacacgaa

SEQ ID NO: 19607 - DNA, 534 bp, Artificial Sequence
  chemically treated genomic DNA (Homo sapiens) CpG-island No: 19607
ttgtgttgcgggtgttttggtgagtgtgtgagggatacgagtatgtatatttgggagattatatgttcgtgtgtgtatataagggcgagagtgtacgagtatttgtgtgagtacgagtgttcgtgtgtatgtgagtatatatgggtgaggcgagtgtgagtacgtgtgtgagtatatgagtgtgagtatgggtgttcgtgagtatgtgagagtgagtacgtgttcgtgtgagtacgtgagtgagtacgagggttcgtgtgtgagtatatgggtaagaatgagtacgagtgttcgtgtgtgagtatatgggtgagtacgtgtgtgtgagtatatgggtgagagtacgagtgttcgtgtgtgagtacgtgagagtgagtacgagggttagtgtgtgagtatatgggtaagaatgagtacgagtgttcgtgtgtgagtacgtgagagtgagtacgagggttcgtgtgtgagtatatgggtaagaatgagtacgagtgttcgtgtgagtgtgagtatatgggcgagagggagtacgag

SEQ ID NO: 19608 - DNA, 534 bp, Artificial Sequence
  chemically treated genomic DNA (Homo sapiens) CpG-island No: 19608
ctcgtactccctctcgcccatatactcacactcacacgaacactcgtactcattcttacccatatactcacacacgaaccctcgtactcactctcacgtactcacacacgaacactcgtactcattcttacccatatactcacacactaaccctcgtactcactctcacgtactcacacacgaacactcgtactctcacccatatactcacacacacgtactcacccatatactcacacacgaacactcgtactcattcttacccatatactcacacacgaaccctcgtactcactcacgtactcacacgaacacgtactcactctcacatactcacgaacacccatactcacactcatatactcacacacgtactcacactcgcctcacccatatatactcacatacacacgaacactcgtactcacacaaatactcgtacactctcgcccttatatacacacacgaacatataatctcccaaatatacatactcgtatccctcacacactcaccaaaacacccgcaacacaa

SEQ ID NO: 19609 - DNA, 1651 bp, Artificial Sequence
  chemically treated genomic DNA (Homo sapiens) CpG-island No: 19609
gtaatacgacgtgtttggggttttttcgttattttcgttaatttcggtgataattttgatatcggtttttaagtgttattttagttatgttgttttttttttcgtagttttaggcggtagtttcgcggttcggcgttcggtttttcggtggtttcggagcgaagtttcgtaatggagagcggaggatttttttttttcgatttcgtacgattaagatcgtttattttttttttaacgttcggttgtgggagtcgttcgagtttttttcgttagggcgttttttttcgggaggtcgtttttttgggggaataaggttaaggattacgggatttggggaagtaagttcggttgggttaggattgtttgcgtagttcgttggaatttaaggtattagagggtttgacggttacgtgaggacgaattacgtaggcgtagtttcgcgtttcgggtaaggattttcggtaagttttaaaggggagcgtgtatcgcgatgacgtttttaaggcgcgttacgttcgttcggcggcgtagttgtttagcgtaatttcggtttcgtttcgatagtttcggatttttgtttcgttcgatttcgtttcgttacgggagcgcgttattcgttcgcgtagtaacggttttaatagcgttaggttcgcgtttataagaagttcgattaaggtcggcgtgggcgaggtttggttagacgttgacgtatcgttggagttattgatttcgggacgattggcggacggtcgcgggtttggagatttagagcgagacggtttatttcgttttcgagttagtagaacgggttgaacgtgtcgataattttattcgttagttagcggcgcgggcgtgttcgagtcggttcgtgggcgtggttaggtgcgtgggcggggattattgggcggggttcggcgcgggggcggggtttggcgggagtagtttcggggtcggggcggggttcggcgggcggggttcggttaagtatagttttggcgtagcggcggggtttggtggggcgtggttcggtgagggaggtttcgtttgggggcgtggttttttttagtaggcggggtttggtgtcgggggcggggtttggcgggcgcgggcgcgtgtgcgtgttgtgggtttcgtattggtacgtaagttttagtaatttttgagaattttcggaggaagaggtcggggttcggtgcggtagcgttttgggggcggaatcgtaggcgcgggtcgggttttgttggggcgcggggcgcggttttcggagaaagcggtcgtttcgggataggagggattcgggagaaatttttttggggcggtttcgtatgtcggggtcgcgattttaggcgattttggtagaggggttcgtttgcgtcgagttcgcgattttcgagggagttacggtttcgtgaattacgttgttcgttttggttattggttgtcgtttttgtttcgtgggattttagttcgtaaggtttgcggagcggcggtttcgtttcgagtgttttgagcgcggttcgagttgtttttggtttattttgttgtcgatattcgagcgtcgtttggagtttttggtattgaggggcgtaggtcgagttttagattagtttgggaaacgtaaagcgattttatttttataaaagtgggtttt

SEQ ID NO: 19610 - DNA, 1651 bp, Artificial Sequence
  chemically treated genomic DNA (Homo sapiens) CpG-island No: 19610
aaaacccacttttataaaaataaaatcgctttacgtttcccaaactaatctaaaactcgacctacgcccctcaataccaaaaactccaaacgacgctcgaatatcgacaacaaaataaaccaaaaacaactcgaaccgcgctcaaaacactcgaaacgaaaccgccgctccgcaaaccttacgaactaaaatcccacgaaacaaaaacgacaaccaataaccaaaacgaacaacgtaattcacgaaaccgtaactccctcgaaaatcgcgaactcgacgcaaacgaacccctctaccaaaatcgcctaaaatcgcgaccccgacatacgaaaccgccccaaaaaaatttctcccgaatccctcctatcccgaaacgaccgctttctccgaaaaccgcgccccgcgccccaacaaaacccgacccgcgcctacgattccgcccccaaaacgctaccgcaccgaaccccgacctcttcctccgaaaattctcaaaaattactaaaacttacgtaccaatacgaaacccacaacacgcacacgcgcccgcgcccgccaaaccccgcccccgacaccaaaccccgcctactaaaaaaaaccacgcccccaaacgaaacctccctcaccgaaccacgccccaccaaaccccgccgctacgccaaaactatacttaaccgaaccccgcccgccgaaccccgccccgaccccgaaactactcccgccaaaccccgcccccgcgccgaaccccgcccaataatccccgcccacgcacctaaccacgcccacgaaccgactcgaacacgcccgcgccgctaactaacgaataaaattatcgacacgttcaacccgttctactaactcgaaaacgaaataaaccgtctcgctctaaatctccaaacccgcgaccgtccgccaatcgtcccgaaatcaataactccaacgatacgtcaacgtctaaccaaacctcgcccacgccgaccttaatcgaacttcttataaacgcgaacctaacgctattaaaaccgttactacgcgaacgaataacgcgctcccgtaacgaaacgaaatcgaacgaaacaaaaatccgaaactatcgaaacgaaaccgaaattacgctaaacaactacgccgccgaacgaacgtaacgcgccttaaaaacgtcatcgcgatacacgctcccctttaaaacttaccgaaaatccttacccgaaacgcgaaactacgcctacgtaattcgtcctcacgtaaccgtcaaaccctctaataccttaaattccaacgaactacgcaaacaatcctaacccaaccgaacttacttccccaaatcccgtaatccttaaccttattcccccaaaaaaacgacctcccgaaaaaaaacgccctaacgaaaaaaactcgaacgactcccacaaccgaacgttaaaaaaaaaataaacgatcttaatcgtacgaaatcgaaaaaaaaaaatcctccgctctccattacgaaacttcgctccgaaaccaccgaaaaaccgaacgccgaaccgcgaaactaccgcctaaaactacgaaaaaaaaaacaacataactaaaataacacttaaaaaccgatatcaaaattatcaccgaaattaacgaaaataacgaaaaaaccccaaacacgtcgtattac

SEQ ID NO: 19611 - DNA, 1651 bp, Artificial Sequence
  chemically treated genomic DNA (Homo sapiens) CpG-island No: 19611
aaaatttatttttgtggaggtggggtcgttttgcgttttttaggttggtttggaattcggtttgcgttttttagtgttaggggttttaggcgacgttcgggtgtcggtagtagagtggattaggagtagttcggatcgcgtttagaatattcgggacgaggtcgtcgtttcgtaggttttgcgggttggggttttacgaaataaaggcggtagttagtggttaggacgggtagcgtggtttacggggtcgtggttttttcgggggtcgcgagttcggcgtaaacgagtttttttattaaggtcgtttagagtcgcgatttcgatatgcggagtcgttttaggggggtttttttcgggttttttttgtttcgaggcggtcgtttttttcgggggtcgcgtttcgcgttttagtaaggttcgattcgcgtttgcgatttcgtttttaaggcgttgtcgtatcgggtttcggttttttttttcgaggatttttaggaattgttgagatttgcgtgttagtgcgaggtttataatacgtatacgcgttcgcgttcgttagatttcgttttcggtattaagtttcgtttattgggggagattacgtttttaagcgagattttttttatcgagttacgttttattaggtttcgtcgttgcgttaagattgtgtttagtcgagtttcgttcgtcgggtttcgtttcgatttcgagattattttcgttaggtttcgttttcgcgtcgagtttcgtttagtagttttcgtttacgtatttgattacgtttacgagtcggttcgaatacgttcgcgtcgttgattggcgggtggggttgtcgatacgtttaattcgttttgttggttcgagaacgaagtaggtcgtttcgttttgggtttttaggttcgcgatcgttcgttagtcgtttcgaggttagtagttttagcggtgcgttagcgtttagttaggtttcgtttacgtcggttttggtcgggttttttgtagacgcgggtttggcgttattgaggtcgttgttgcgcgggcgagtggcgcgttttcgtggcggggcggggtcgggcggggtaggggttcggggttatcgaggcggggtcgaggttgcgttgggtagttgcgtcgtcgggcggacgtggcgcgttttgaggacgttatcgcggtgtacgtttttttttggggtttgtcggaagtttttgttcggggcgcggggttgcgtttgcgtggttcgtttttacgtggtcgttaagttttttagtgttttagattttagcgagttacgtaagtaattttggtttagtcgagtttgtttttttaaatttcgtaatttttgattttatttttttaaagaagcggtttttcgggaaggagcgttttggcggagaagattcgaacggtttttatagtcgggcgttgggggaaaggtgggcggttttggtcgtgcgaggtcggggagggagggtttttcgttttttattgcggagtttcgtttcgggattatcgggggatcggacgtcgggtcgcgaagttgtcgtttggggttgcggggaggagagtaatataattggaatggtatttaggggtcggtgttagggttgttatcggggttggcggaaatgacgaaggggttttaggtacgtcgtgttat

SEQ ID NO: 19612 - DNA, 1651 bp, Artificial Sequence
  chemically treated genomic DNA (Homo sapiens) CpG-island No: 19612
ataacacgacgtacctaaaaccccttcgtcatttccgccaaccccgataacaaccctaacaccgacccctaaataccattccaattatattactctcctccccgcaaccccaaacgacaacttcgcgacccgacgtccgatcccccgataatcccgaaacgaaactccgcaataaaaaacgaaaaaccctccctccccgacctcgcacgaccaaaaccgcccacctttcccccaacgcccgactataaaaaccgttcgaatcttctccgccaaaacgctccttcccgaaaaaccgcttctttaaaaaaataaaatcaaaaattacgaaatttaaaaaaacaaactcgactaaaccaaaattacttacgtaactcgctaaaatctaaaacactaaaaaacttaacgaccacgtaaaaacgaaccacgcaaacgcaaccccgcgccccgaacaaaaacttccgacaaaccccaaaaaaaaacgtacaccgcgataacgtcctcaaaacgcgccacgtccgcccgacgacgcaactacccaacgcaacctcgaccccgcctcgataaccccgaacccctaccccgcccgaccccgccccgccacgaaaacgcgccactcgcccgcgcaacaacgacctcaataacgccaaacccgcgtctacaaaaaacccgaccaaaaccgacgtaaacgaaacctaactaaacgctaacgcaccgctaaaactactaacctcgaaacgactaacgaacgatcgcgaacctaaaaacccaaaacgaaacgacctacttcgttctcgaaccaacaaaacgaattaaacgtatcgacaaccccacccgccaatcaacgacgcgaacgtattcgaaccgactcgtaaacgtaatcaaatacgtaaacgaaaactactaaacgaaactcgacgcgaaaacgaaacctaacgaaaataatctcgaaatcgaaacgaaacccgacgaacgaaactcgactaaacacaatcttaacgcaacgacgaaacctaataaaacgtaactcgataaaaaaaatctcgcttaaaaacgtaatctcccccaataaacgaaacttaataccgaaaacgaaatctaacgaacgcgaacgcgtatacgtattataaacctcgcactaacacgcaaatctcaacaattcctaaaaatcctcgaaaaaaaaaaccgaaacccgatacgacaacgccttaaaaacgaaatcgcaaacgcgaatcgaaccttactaaaacgcgaaacgcgacccccgaaaaaaacgaccgcctcgaaacaaaaaaaacccgaaaaaaacccccctaaaacgactccgcatatcgaaatcgcgactctaaacgaccttaataaaaaaactcgtttacgccgaactcgcgacccccgaaaaaaccacgaccccgtaaaccacgctacccgtcctaaccactaactaccgcctttatttcgtaaaaccccaacccgcaaaacctacgaaacgacgacctcgtcccgaatattctaaacgcgatccgaactactcctaatccactctactaccgacacccgaacgtcgcctaaaacccctaacactaaaaaacgcaaaccgaattccaaaccaacctaaaaaacgcaaaacgaccccacctccacaaaaataaatttt

SEQ ID NO: 19613 - DNA, 933 bp, Artificial Sequence
  chemically treated genomic DNA (Homo sapiens) CpG-island No: 19613
gttcgagcgttggatatggcgtcggtatttcgggggagggaatcgagaagtttggaggaagggagggaagggaaggcgcggagttcggtcgggcggggttttttatagtaggagtattcgtcgtatgggtttcggtcgggggtgcggggaggtcgggtagtcgtttacgttagttcggggatgcgtcgttcgggttaggtcgcgtcggtttcgagcggtttcggatcgtattttttcgattttcggttgggttgtgtcgtttttcggtcgggtcgcgtcgtttcgtttattttttgtcgtcgtagtcggtcgtttgtttcgttttttttttgtttttagcggtattgtttcgcgttcggtatataggtagtcgtcgtcggatttgttgtttttaatatggtcgttattatcgtcggttttcggtttttttcgtcggtagtagtcggaaatattcgaagcggttagaaacgggaggtggggcgcgtttttttttttcggttatagattacgggtgaatttcggaaatagtcgaagaaggtaaatttcggggacgcgttttttttttcgatttcgaagacgaagtttcggttttgtttacggaaatttacgaagcgatttcgggtgtttatttttcgttttcgtttacggttatttagttacgtttatcggttttttttcgtttattttaagggggttttcggtagttttcggaaatattcgaagttgtttcgcgtgttgagtcggttacgtttttttttatagttttgtcgagggcggtcgtcggttattttcggtaatattcgaggtttttcgagtattcggtcgttttttcgggtggttttcggagtttgattcgtttcgtgttttttcgttagttttcgggtatttttaaattttgaataggaagcgtgggttatttgtttgtgtttgtga

SEQ ID NO: 19614 - DNA, 933 bp, Artificial Sequence
  chemically treated genomic DNA (Homo sapiens) CpG-island No: 19614
tcacaaacacaaacaaataacccacgcttcctattcaaaatttaaaaatacccgaaaactaacgaaaaaacacgaaacgaatcaaactccgaaaaccacccgaaaaaacgaccgaatactcgaaaaacctcgaatattaccgaaaataaccgacgaccgccctcgacaaaactataaaaaaaaacgtaaccgactcaacacgcgaaacaacttcgaatatttccgaaaactaccgaaaacccccttaaaataaacgaaaaaaaaccgataaacgtaactaaataaccgtaaacgaaaacgaaaaataaacacccgaaatcgcttcgtaaatttccgtaaacaaaaccgaaacttcgtcttcgaaatcgaaaaaaaaaacgcgtccccgaaatttaccttcttcgactatttccgaaattcacccgtaatctataaccgaaaaaaaaaaacgcgccccacctcccgtttctaaccgcttcgaatatttccgactactaccgacgaaaaaaaccgaaaaccgacgataataacgaccatattaaaaacaacaaatccgacgacgactacctatataccgaacgcgaaacaataccgctaaaaacaaaaaaaaaacgaaacaaacgaccgactacgacgacaaaaaataaacgaaacgacgcgacccgaccgaaaaacgacacaacccaaccgaaaatcgaaaaaatacgatccgaaaccgctcgaaaccgacgcgacctaacccgaacgacgcatccccgaactaacgtaaacgactacccgacctccccgcacccccgaccgaaacccatacgacgaatactcctactataaaaaaccccgcccgaccgaactccgcgccttcccttccctcccttcctccaaacttctcgattccctcccccgaaataccgacgccatatccaacgctcgaac

SEQ ID NO: 19615 - DNA, 933 bp, Artificial Sequence
  chemically treated genomic DNA (Homo sapiens) CpG-island No: 19615
ttataagtatagataggtgatttacgttttttgtttaaggtttgaaaatgttcgaaaattgacggaaagatacgaagcgaattagatttcgagagttattcggggaaacgatcgggtgttcggagggtttcgggtgttgtcggaaatggtcgacgatcgttttcggtagggttgtgggagggggcgtggtcggtttagtacgcggagtagtttcgggtattttcggaaattgtcgaaagtttttttgaagtgggcggggaaaggtcggtgggcgtggttggatggtcgtggacgggggcggggggtaggtattcggggtcgtttcgtggattttcgtaaatagagtcgaagtttcgttttcggaatcgaggaggagagcgcgttttcggggtttatttttttcggttgttttcggaatttattcgtagtttgtggtcgggaggagaaggcgcgttttatttttcgtttttagtcgtttcggatgttttcggttgttgtcggcgaaaagagtcgagggtcggcggtggtggcggttatgttgggagtagtaggttcggcggcggttgtttgtgtgtcgggcgcggagtagtgtcgttgagggtaggggaggagcgaggtaggcggtcggttgcggcggtagagagtaggcggagcggcgcggttcggtcgaaaggcggtatagtttagtcgggggtcgggggggtgcggttcggagtcgttcggagtcggcgcggtttagttcgagcggcgtattttcgggttggcgtgagcggttgttcggttttttcgtattttcggtcggggtttatgcggcgggtgtttttgttgtgagaagtttcgttcggtcgggtttcgcgtttttttttttttttttttttttaagtttttcggttttttttttcgagatatcggcgttatgtttagcgttcggat

SEQ ID NO: 19616 - DNA, 933 bp, Artificial Sequence
  chemically treated genomic DNA (Homo sapiens) CpG-island No: 19616
atccgaacgctaaacataacgccgatatctcgaaaaaaaaaaccgaaaaacttaaaaaaaaaaaaaaaaaaaaaaacgcgaaacccgaccgaacgaaacttctcacaacaaaaacacccgccgcataaaccccgaccgaaaatacgaaaaaaccgaacaaccgctcacgccaacccgaaaatacgccgctcgaactaaaccgcgccgactccgaacgactccgaaccgcacccccccgacccccgactaaactataccgcctttcgaccgaaccgcgccgctccgcctactctctaccgccgcaaccgaccgcctacctcgctcctcccctaccctcaacgacactactccgcgcccgacacacaaacaaccgccgccgaacctactactcccaacataaccgccaccaccgccgaccctcgactcttttcgccgacaacaaccgaaaacatccgaaacgactaaaaacgaaaaataaaacgcgccttctcctcccgaccacaaactacgaataaattccgaaaacaaccgaaaaaaataaaccccgaaaacgcgctctcctcctcgattccgaaaacgaaacttcgactctatttacgaaaatccacgaaacgaccccgaatacctaccccccgcccccgtccacgaccatccaaccacgcccaccgacctttccccgcccacttcaaaaaaactttcgacaatttccgaaaatacccgaaactactccgcgtactaaaccgaccacgccccctcccacaaccctaccgaaaacgatcgtcgaccatttccgacaacacccgaaaccctccgaacacccgatcgtttccccgaataactctcgaaatctaattcgcttcgtatctttccgtcaattttcgaacattttcaaaccttaaacaaaaaacgtaaatcacctatctatacttataa

SEQ ID NO: 19617 - DNA, 565 bp, Artificial Sequence
  chemically treated genomic DNA (Homo sapiens) CpG-island No: 19617
tttcgattcgcgttgcgtttacgtgtagggttcgatttttttcgggaggcgcggcgtcggttggggttaggcggtcgaggatttcgcggtttttcgtttcgtttcgtttcgcgggttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggattcgggttcgggttgggggcggggaaggggttggatacgtttgcgtatacggcggttcgatttttaggagttttcgggaggggtagaaagggcggggtggaggaggggaaagggcgggggtgatgtcgcgcggtcgtaggtttgggatggtgttcgcgttttcgagattcggatagaggtaagtaggggcgtcgtgggtgttagagaggcggaagacgaggtttgatggggtgagtatagggttagggtag

SEQ ID NO: 19618 - DNA, 565 bp, Artificial Sequence
  chemically treated genomic DNA (Homo sapiens) CpG-island No: 19618
ctaccctaaccctatactcaccccatcaaacctcgtcttccgcctctctaacacccacgacgcccctacttacctctatccgaatctcgaaaacgcgaacaccatcccaaacctacgaccgcgcgacatcacccccgccctttcccctcctccaccccgccctttctacccctcccgaaaactcctaaaaatcgaaccgccgtatacgcaaacgtatccaaccccttccccgcccccaacccgaacccgaatccccgcctcccctacaaacgaactcgcccgctcccaaaccgaacccgcgcccgaaacaaaaacccgaccgaatcgaaccgtcgcgccaacgctacgccgccgatcgatacgcctaacgaatcgaaactacgcgcgaaaccgtactaccccgccccgctccacccgtaaaaataaatacgcgacgacgatacgcgaaaacccgcgaaacgaaacgaaacgaaaaaccgcgaaatcctcgaccgcctaaccccaaccgacgccgcgcctcccgaaaaaaatcgaaccctacacgtaaacgcaacgcgaatcgaaa

SEQ ID NO: 19619 - DNA, 565 bp, Artificial Sequence
  chemically treated genomic DNA (Homo sapiens) CpG-island No: 19619
ttgttttggttttgtgtttattttattaggtttcgtttttcgtttttttggtatttacggcgtttttgtttgtttttgttcgggtttcggaggcgcgaatattattttaagtttgcgatcgcgcggtattattttcgttttttttttttttttatttcgttttttttatttttttcgggagtttttgggagtcgggtcgtcgtgtgcgtaagcgtgtttagtttttttttcgtttttaattcgggttcgggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcgggggttcgcggggcggggcggggcggggagtcgcggggttttcggtcgtttgattttagtcggcgtcgcgtttttcggagggggtcgggttttgtacgtgggcgtagcgcgggtcgggg

SEQ ID NO: 19620 - DNA, 565 bp, Artificial Sequence
  chemically treated genomic DNA (Homo sapiens) CpG-island No: 19620
ccccgacccgcgctacgcccacgtacaaaacccgaccccctccgaaaaacgcgacgccgactaaaatcaaacgaccgaaaaccccgcgactccccgccccgccccgccccgcgaacccccgcgcaccgccgccgcgtactcaccctcacgaataaaacgaaacgaaacaacacgattccgcgcgcaactccgatccgctaaacgcaccgaccgacgacgcaacgctaacgcgacgactcgactcgaccgaatccctatcccgaacgcgaatccgacctaaaaacgaacgaatccgcctacaaaaaaaacgaaaacccgaacccgaattaaaaacgaaaaaaaaactaaacacgcttacgcacacgacgacccgactcccaaaaactcccgaaaaaaataaaaaaaacgaaataaaaaaaaaaaaaaaacgaaaataataccgcgcgatcgcaaacttaaaataatattcgcgcctccgaaacccgaacaaaaacaaacaaaaacgccgtaaataccaaaaaaacgaaaaacgaaacctaataaaataaacacaaaaccaaaacaa

SEQ ID NO: 19621 - DNA, 596 bp, Artificial Sequence
  chemically treated genomic DNA (Homo sapiens) CpG-island No: 19621
gtagattacgttggttaggcggtcgtagcgggttgagtaggtagacgacggcgggaaatatacggagaggatagagttaaagaaaagcgttatcgttatcgttatcgttattaggtgggtttcgtaggtggagaaggcgcggcgtcggtcgcggtaagtcgagtatcgcgattaggatgcgcgcgtaggaaaaggaatacgaggagtagcggggttaatattacggttaggttttcggagaagatggtcgttttcgcggcggacgtgttcgaggtcgttaagtttagtattatcgttatgtcgtaaaagaaggggcgtacgggggtggggtaggggtaggagagcgcggagaggagtagcgtgtgtagtagcgagtgtaggtgcgttacggtttacgacgtacgtattagcgaggcgtagcgtttatggcgttattagcgcgtcgtagcgtaggggtcggtacgtcgtcgtcgcgcggtcgtaggatatggtcgtcgggaggtagttttcggtgatgtttagagttacgaagaagtatatttcggtaaagtacgtttggaaggatatggtttggttcgggtggagtaggtcggtta

SEQ ID NO: 19622 - DNA, 596 bp, Artificial Sequence
  chemically treated genomic DNA (Homo sapiens) CpG-island No: 19622
taaccgacctactccacccgaaccaaaccatatccttccaaacgtactttaccgaaatatacttcttcgtaactctaaacatcaccgaaaactacctcccgacgaccatatcctacgaccgcgcgacgacgacgtaccgacccctacgctacgacgcgctaataacgccataaacgctacgcctcgctaatacgtacgtcgtaaaccgtaacgcacctacactcgctactacacacgctactcctctccgcgctctcctacccctaccccacccccgtacgccccttcttttacgacataacgataatactaaacttaacgacctcgaacacgtccgccgcgaaaacgaccatcttctccgaaaacctaaccgtaatattaaccccgctactcctcgtattccttttcctacgcgcgcatcctaatcgcgatactcgacttaccgcgaccgacgccgcgccttctccacctacgaaacccacctaataacgataacgataacgataacgcttttctttaactctatcctctccgtatatttcccgccgtcgtctacctactcaacccgctacgaccgcctaaccaacgtaatctac

SEQ ID NO: 19623 - DNA, 596 bp, Artificial Sequence
  chemically treated genomic DNA (Homo sapiens) CpG-island No: 19623
tggtcggtttgttttattcgggttaggttatatttttttaggcgtgttttgtcgagatgtattttttcgtggttttgggtattatcgagagttatttttcggcggttatgttttacgatcgcgcgacggcggcgtgtcggtttttgcgttacggcgcgttggtgacgttatgggcgttgcgtttcgttggtgcgtgcgtcgtgggtcgtgacgtatttgtattcgttgttgtatacgttgttttttttcgcgtttttttatttttattttattttcgtgcgtttttttttttgcgatatgacggtgatgttgagtttggcgatttcggatacgttcgtcgcggagacggttatttttttcgagggtttggtcgtggtgttggtttcgttgtttttcgtgtttttttttttacgcgcgtattttggtcgcggtgttcggtttgtcgcggtcggcgtcgcgttttttttatttgcggggtttatttagtggcggtggcggtggcggtggcgtttttttttggttttgtttttttcgtgtatttttcgtcgtcgtttgtttatttagttcgttacgatcgtttggttagcgtggtttat

SEQ ID NO: 19624 - DNA, 596 bp, Artificial Sequence
  chemically treated genomic DNA (Homo sapiens) CpG-island No: 19624
ataaaccacgctaaccaaacgatcgtaacgaactaaataaacaaacgacgacgaaaaatacacgaaaaaaacaaaaccaaaaaaaaacgccaccgccaccgccaccgccactaaataaaccccgcaaataaaaaaaacgcgacgccgaccgcgacaaaccgaacaccgcgaccaaaatacgcgcgtaaaaaaaaaaacacgaaaaacaacgaaaccaacaccacgaccaaaccctcgaaaaaaataaccgtctccgcgacgaacgtatccgaaatcgccaaactcaacatcaccgtcatatcgcaaaaaaaaaaacgcacgaaaataaaataaaaataaaaaaacgcgaaaaaaaacaacgtatacaacaacgaatacaaatacgtcacgacccacgacgcacgcaccaacgaaacgcaacgcccataacgtcaccaacgcgccgtaacgcaaaaaccgacacgccgccgtcgcgcgatcgtaaaacataaccgccgaaaaataactctcgataatacccaaaaccacgaaaaaatacatctcgacaaaacacgcctaaaaaaatataacctaacccgaataaaacaaaccgacca

SEQ ID NO: 19625 - DNA, 528 bp, Artificial Sequence
  chemically treated genomic DNA (Homo sapiens) CpG-island No: 19625
  misc_feature (56)..(57): n is either a, c, g or t
  misc_feature (490)..(491): n is either a, c, g or t
  misc_feature (498)..(498): n is either a, c, g or t
  misc_feature (500)..(500): n is either a, c, g or t
  misc_feature (509)..(509): n is either a, c, g or t
  misc_feature (512)..(514): n is either a, c, g or t
  misc_feature (516)..(516): n is either a, c, g or t
  misc_feature (520)..(520): n is either a, c, g or t
gtcgtcggtttttatttaggtcgaggtggttcggttttatgtatcgcgacgtaatnnggggaggtagataaggtatagggcggcgttataatttatgttaattcgttttatgtgttcgtcgaggcgtataaatcgtcgtgacgattagcggtttaatgatcgaagttaggttggtaagagtcgcgagcgatttttgaagttgtttttgatggtcgttatttatttgtttggatagtatggtttgtaacgcgggatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttnncgtcgangnaaatgattnagnnngngtgncggtattt

SEQ ID NO: 19626 - DNA, 528 bp, Artificial Sequence
  chemically treated genomic DNA (Homo sapiens) CpG-island No: 19626
  misc_feature (9)..(9): n is either a, c, g or t
  misc_feature (13)..(13): n is either a, c, g or t
  misc_feature (15)..(17): n is either a, c, g or t
  misc_feature (20)..(20): n is either a, c, g or t
  misc_feature (29)..(29): n is either a, c, g or t
  misc_feature (31)..(31): n is either a, c, g or t
  misc_feature (38)..(39): n is either a, c, g or t
  misc_feature (472)..(473): n is either a, c, g or t
aaataccgncacncnnnctnaatcatttncntcgacgnnaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatcccgcgttacaaaccatactatccaaacaaataaataacgaccatcaaaaacaacttcaaaaatcgctcgcgactcttaccaacctaacttcgatcattaaaccgctaatcgtcacgacgatttatacgcctcgacgaacacataaaacgaattaacataaattataacgccgccctataccttatctacctccccnnattacgtcgcgatacataaaaccgaaccacctcgacctaaataaaaaccgacgac

SEQ ID NO: 19627 - DNA, 528 bp, Artificial Sequence
  chemically treated genomic DNA (Homo sapiens) CpG-island No: 19627
  misc_feature (9)..(9): n is either a, c, g or t
  misc_feature (13)..(13): n is either a, c, g or t
  misc_feature (15)..(17): n is either a, c, g or t
  misc_feature (20)..(20): n is either a, c, g or t
  misc_feature (29)..(29): n is either a, c, g or t
  misc_feature (31)..(31): n is either a, c, g or t
  misc_feature (38)..(39): n is either a, c, g or t
  misc_feature (472)..(473): n is either a, c, g or t
aggtgtcgntatntnnnttnggttatttntntcgacgnnaatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatttcgcgttgtaggttatgttgtttaggtaggtagatgacgattattagggatagttttaaggatcgttcgcggtttttattagtttaatttcgattattggatcgttgatcgttacggcgatttatgcgtttcggcgagtatatggaacgggttggtatggattgtagcgtcgttttatattttgtttgtttttttnngttgcgtcgcggtgtatggagtcgggttatttcgatttgaatggaagtcggcggt

SEQ ID NO: 19628 - DNA, 528 bp, Artificial Sequence
  chemically treated genomic DNA (Homo sapiens) CpG-island No: 19628
  misc_feature (56)..(57): n is either a, c, g or t
  misc_feature (490)..(491): n is either a, c, g or t
  misc_feature (498)..(498): n is either a, c, g or t
  misc_feature (500)..(500): n is either a, c, g or t
  misc_feature (509)..(509): n is either a, c, g or t
  misc_feature (512)..(514): n is either a, c, g or t
  misc_feature (516)..(516): n is either a, c, g or t
  misc_feature (520)..(520): n is either a, c, g or t
accgccgacttccattcaaatcgaaataacccgactccatacaccgcgacgcaacnnaaaaaaacaaacaaaatataaaacgacgctacaatccataccaacccgttccatatactcgccgaaacgcataaatcgccgtaacgatcaacgatccaataatcgaaattaaactaataaaaaccgcgaacgatccttaaaactatccctaataatcgtcatctacctacctaaacaacataacctacaacgcgaaatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgattnncgtcgananaaataaccnaannnanatancgacacct

SEQ ID NO: 19629 - DNA, 665 bp, Artificial Sequence
  chemically treated genomic DNA (Homo sapiens) CpG-island No: 19629
tggatgcgcggatagtcgttgttggttttttggatgtcgacggatttgtattgtcggtagaatttcgcgaggtcgtttagttttaggtagtagttgaattaattcgcgaggggatcgagttcggggtgggcgaaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagagtttcgtttagaagaattcgttaagaaggcgatagaaggcgatgcgttgcgaatcgggagcggcgatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggttggcgcgagtttttgatgtttttcgtttagattattttgatggacgacgagatcggagtttattagagtaagaga

SEQ ID NO: 19630 - DNA, 665 bp, Artificial Sequence
  chemically treated genomic DNA (Homo sapiens) CpG-island No: 19630
tctcttactctaataaactccgatctcgtcgtccatcaaaataatctaaacgaaaaacatcaaaaactcgcgccaaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatatcgccgctcccgattcgcaacgcatcgccttctatcgccttcttaacgaattcttctaaacgaaactctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattctttcgcccaccccgaactcgatcccctcgcgaattaattcaactactacctaaaactaaacgacctcgcgaaattctaccgacaatacaaatccgtcgacatccaaaaaaccaacaacgactatccgcgcatcca

SEQ ID NO: 19631 - DNA, 665 bp, Artificial Sequence
  chemically treated genomic DNA (Homo sapiens) CpG-island No: 19631
ttttttattttgatggatttcggtttcgtcgtttattaggatgatttggacgaagagtattaggggttcgcgttagtcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatcgtcgttttcgattcgtagcgtatcgttttttatcgtttttttgacgagtttttttgagcgggattttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagttttttcgtttatttcgggttcgattttttcgcgagttggtttagttgttgtttgaggttggacgatttcgcggagttttatcggtagtgtaaattcgtcggtatttaggaaattagtagcggttattcgcgtattta

SEQ ID NO: 19632 - DNA, 665 bp, Artificial Sequence
  chemically treated genomic DNA (Homo sapiens) CpG-island No: 19632
taaatacgcgaataaccgctactaatttcctaaataccgacgaatttacactaccgataaaactccgcgaaatcgtccaacctcaaacaacaactaaaccaactcgcgaaaaaatcgaacccgaaataaacgaaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaaatcccgctcaaaaaaactcgtcaaaaaaacgataaaaaacgatacgctacgaatcgaaaacgacgataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgactaacgcgaacccctaatactcttcgtccaaatcatcctaataaacgacgaaaccgaaatccatcaaaataaaaaa

SEQ ID NO: 19633 - DNA, 607 bp, Artificial Sequence
  chemically treated genomic DNA (Homo sapiens) CpG-island No: 19633
gattttttcggtgcgttttttagcgcggtttttttcggtgcgttagttatcgtggtttttttcggcgcgtttttcggcgcggtttttttcggggttttttagcgcggcgtttttttgggggtttttcggcgtagtttttttcggggatttttcggcgtcgtttttttcggggtattcggggtttttcggcgcggtttttttcgggggtttttcggcgcggtttttttcgggggtttttcggcgcggtttttttcgggggtttttcggcgcggtttttttcgggggtttttcgtcgcggttttgtttttttcgggggttttttagtatggttttttttcgcgcggttttttttgggtttttttagcgcggtatttttttcgggggttttttagcgcggtattttttcggcggttttttagtgcggtttttttagattttttttagcgcggttttttttatttttttgggagggtttgaatacggttagtacggatttgggcggacggcgcgggacgggtgattattggcgttgttgaggtgagttgtgtgtttcgcggtcgttttagattataggcgttagtagtgtagtttggtttgggtagtgcgt

SEQ ID NO: 19634 - DNA, 607 bp, Artificial Sequence
  chemically treated genomic DNA (Homo sapiens) CpG-island No: 19634
acgcactacccaaaccaaactacactactaacgcctataatctaaaacgaccgcgaaacacacaactcacctcaacaacgccaataatcacccgtcccgcgccgtccgcccaaatccgtactaaccgtattcaaaccctcccaaaaaaataaaaaaaaccgcgctaaaaaaaatctaaaaaaaccgcactaaaaaaccgccgaaaaaataccgcgctaaaaaacccccgaaaaaaataccgcgctaaaaaaacccaaaaaaaaccgcgcgaaaaaaaaccatactaaaaaacccccgaaaaaaacaaaaccgcgacgaaaaacccccgaaaaaaaccgcgccgaaaaacccccgaaaaaaaccgcgccgaaaaacccccgaaaaaaaccgcgccgaaaaacccccgaaaaaaaccgcgccgaaaaaccccgaataccccgaaaaaaacgacgccgaaaaatccccgaaaaaaactacgccgaaaaacccccaaaaaaacgccgcgctaaaaaaccccgaaaaaaaccgcgccgaaaaacgcgccgaaaaaaaccacgataactaacgcaccgaaaaaaaccgcgctaaaaaacgcaccgaaaaaatc

SEQ ID NO: 19635 - DNA, 607 bp, Artificial Sequence
  chemically treated genomic DNA (Homo sapiens) CpG-island No: 19635
gcgtattgtttaggttaggttgtattgttgacgtttgtgatttgggacggtcgcggggtatatagtttattttagtaacgttagtgattattcgtttcgcgtcgttcgtttaggttcgtgttgatcgtgtttaaatttttttagagagatggggagggtcgcgttgaggagagtttgggagaatcgtattgaggagtcgtcgggagagtgtcgcgttgaggagttttcggggagagtgtcgcgttgaggaggtttagggaggatcgcgcggaggagaattatgttgaggagttttcggggagaatagaatcgcggcgagaggttttcggagagaatcgcgtcgaagaattttcggggagaatcgcgtcgaagaattttcggggagaatcgcgtcgaagaattttcggggagaatcgcgtcgaaaagtttcgggtgtttcgaggagaacggcgtcgaggagttttcggggagaattgcgtcgaggagtttttagaagagcgtcgcgttgaggagtttcgaggagaatcgcgtcgaggggcgcgtcggggagaattacgatgattgacgtatcgaggaggatcgcgttgaggggcgtatcgggagaatt

SEQ ID NO: 19636 - DNA, 607 bp, Artificial Sequence
  chemically treated genomic DNA (Homo sapiens) CpG-island No: 19636
aattctcccgatacgcccctcaacgcgatcctcctcgatacgtcaatcatcgtaattctccccgacgcgcccctcgacgcgattctcctcgaaactcctcaacgcgacgctcttctaaaaactcctcgacgcaattctccccgaaaactcctcgacgccgttctcctcgaaacacccgaaacttttcgacgcgattctccccgaaaattcttcgacgcgattctccccgaaaattcttcgacgcgattctccccgaaaattcttcgacgcgattctctccgaaaacctctcgccgcgattctattctccccgaaaactcctcaacataattctcctccgcgcgatcctccctaaacctcctcaacgcgacactctccccgaaaactcctcaacgcgacactctcccgacgactcctcaatacgattctcccaaactctcctcaacgcgaccctccccatctctctaaaaaaatttaaacacgatcaacacgaacctaaacgaacgacgcgaaacgaataatcactaacgttactaaaataaactatataccccgcgaccgtcccaaatcacaaacgtcaacaatacaacctaacctaaacaatacgc

SEQ ID NO: 19637 - DNA, 696 bp, Artificial Sequence
  chemically treated genomic DNA (Homo sapiens) CpG-island No: 19637
cgttagggtgatagcgcggcgttaagggaggaggtttcgcgtcggggttcgtcgggatttggcgcgggcggaaagaatatagatttttacgaatcggatttttcggggatttgggtttttttttgcgggcgttggagattcgggaggcggtttcggggattttcggttttcgtcgtcgtcgttttttaagcgttcgcgtttcggtttggggatattcggttttttttttttattttcggggattttttagtcgcgttttattttattaattttttatttaagggcgcgtcgttattaatttggagtttatttttttttaagatcgtgcgttttcggggcgttcgggttttttttttcgttattttaatttcggcgcgattcgggcgttttttggaaagatttaggcgtcgggttttgcgtttttttcgggagcgagggcggtcggacgattgggatttttttttttttagtcgtgaattttttgtttttttgtttttttttgtaggaaaattggagtttgtttttttttcggttacggagagaacgcgggtaatttgtgtggggggttcgggcgtttgcgttttttttttgcgcgcgcgtttttttttttaaaaatgggattttttttttttcgtattaaggtgtacggacgttaaatagtgatgaaatgagaagaaagttaattgtcggtttggg

SEQ ID NO: 19638 - DNA, 696 bp, Artificial Sequence
  chemically treated genomic DNA (Homo sapiens) CpG-island No: 19638
cccaaaccgacaattaactttcttctcatttcatcactatttaacgtccgtacaccttaatacgaaaaaaaaaaaatcccatttttaaaaaaaaaaacgcgcgcgcaaaaaaaaaacgcaaacgcccgaaccccccacacaaattacccgcgttctctccgtaaccgaaaaaaaaacaaactccaattttcctacaaaaaaaaacaaaaaaacaaaaaattcacgactaaaaaaaaaaaaatcccaatcgtccgaccgccctcgctcccgaaaaaaacgcaaaacccgacgcctaaatctttccaaaaaacgcccgaatcgcgccgaaattaaaataacgaaaaaaaaaacccgaacgccccgaaaacgcacgatcttaaaaaaaaataaactccaaattaataacgacgcgcccttaaataaaaaattaataaaataaaacgcgactaaaaaatccccgaaaataaaaaaaaaaaaccgaatatccccaaaccgaaacgcgaacgcttaaaaaacgacgacgacgaaaaccgaaaatccccgaaaccgcctcccgaatctccaacgcccgcaaaaaaaaacccaaatccccgaaaaatccgattcgtaaaaatctatattctttccgcccgcgccaaatcccgacgaaccccgacgcgaaacctcctcccttaacgccgcgctatcaccctaacg

SEQ ID NO: 19639 - DNA, 696 bp, Artificial Sequence
  chemically treated genomic DNA (Homo sapiens) CpG-island No: 19639
tttaggtcggtaattggttttttttttattttattattgtttggcgttcgtatattttggtgcgaagggggaaagattttatttttggaagggagagcgcgcgcgtaggaggggggcgtaggcgttcgagttttttatataggttattcgcgtttttttcgtggtcggaggaaaagtaaattttagtttttttgtagagagagatagagagataaggagtttacggttggagagaggagggttttagtcgttcggtcgttttcgttttcgggaggagcgtagagttcggcgtttggatttttttaggaagcgttcgggtcgcgtcggggttgagatggcgaggggggggattcgggcgtttcggggacgtacgattttgggagaagatgagttttaagttggtggcggcgcgtttttggatggagagttggtgagatggaacgcggttggagaattttcgaaagtgagaagaaggggtcgggtgtttttaaatcgggacgcgggcgtttgggaggcggcggcggcggaggtcgaggattttcggggtcgtttttcgggtttttagcgttcgtagaaagaagtttaggttttcgggagattcggttcgtaaagatttatatttttttcgttcgcgttagatttcggcggatttcggcgcgaggtttttttttttagcgtcgcgttgttattttggcg

SEQ ID NO: 19640 - DNA, 696 bp, Artificial Sequence
  chemically treated genomic DNA (Homo sapiens) CpG-island No: 19640
cgccaaaataacaacgcgacgctaaaaaaaaaaacctcgcgccgaaatccgccgaaatctaacgcgaacgaaaaaaatataaatctttacgaaccgaatctcccgaaaacctaaacttctttctacgaacgctaaaaacccgaaaaacgaccccgaaaatcctcgacctccgccgccgccgcctcccaaacgcccgcgtcccgatttaaaaacacccgaccccttcttctcactttcgaaaattctccaaccgcgttccatctcaccaactctccatccaaaaacgcgccgccaccaacttaaaactcatcttctcccaaaatcgtacgtccccgaaacgcccgaatcccccccctcgccatctcaaccccgacgcgacccgaacgcttcctaaaaaaatccaaacgccgaactctacgctcctcccgaaaacgaaaacgaccgaacgactaaaaccctcctctctccaaccgtaaactccttatctctctatctctctctacaaaaaaactaaaatttacttttcctccgaccacgaaaaaaacgcgaataacctatataaaaaactcgaacgcctacgcccccctcctacgcgcgcgctctcccttccaaaaataaaatctttcccccttcgcaccaaaatatacgaacgccaaacaataataaaataaaaaaaaaaccaattaccgacctaaa

SEQ ID NO: 19641 - DNA, 854 bp, Artificial Sequence
  chemically treated genomic DNA (Homo sapiens) CpG-island No: 19641
gcgtttttgcgtgcgttcgtcgcggagttcggagattagtaattgtattagataggtagcgtatggggggttgggcgaggtcgtcgcgtataaatagtgagatttttaatggaaaggcgtaaataatagcgttggtgatttattcgcgcgtacgggtcgtttttttcgcgcggggagacgcgcgtatttattagtttcggttgttcgttagtttcggttttagttatggaagagtttacggtttttgtatttaagttttttgattagaaaagtaaggacggtaacggcggaggcggaggcggcggaggtaagaaggattttattacgtatcgggaagttttggagagcggattggcgcgttttcgggagttggggacgtcggattttagtttttaggatattacggagggcggcggttattgttcggtgtatttgtttaaggattacgtagataatgataaggagaaattgaaagaattcggtatcgcgagagtggtagaaggtaagtttttttgcgcgtcggttttaggggggtttttttggggttcggcgttttttcgttacggagtcggtttcgcgcgtttttcgttgtgtatatttgtagttttcgtttcgttagggtaaggttcgggtcgttaggttttgtttaagaaaggaaggaaggtaggagtggattcgatcggagacgcgggtggtgggtagcggggtgcggggggatttagggagggtcgtagcgggggtcgcgcgcgtgggtatcgatacgggaaggtttcgggttggggtggattcgggtggttgtgtttgaagtcgtagggtttgagatgttttttttattttttttttttttttttttt

SEQ ID NO: 19642 - DNA, 854 bp, Artificial Sequence
  chemically treated genomic DNA (Homo sapiens) CpG-island No: 19642
aaaaaaaaaaaaaaaaaaaaataaaaaaaacatctcaaaccctacgacttcaaacacaaccacccgaatccaccccaacccgaaaccttcccgtatcgatacccacgcgcgcgacccccgctacgaccctccctaaatccccccgcaccccgctacccaccacccgcgtctccgatcgaatccactcctaccttccttcctttcttaaacaaaacctaacgacccgaaccttaccctaacgaaacgaaaactacaaatatacacaacgaaaaacgcgcgaaaccgactccgtaacgaaaaaacgccgaaccccaaaaaaacccccctaaaaccgacgcgcaaaaaaacttaccttctaccactctcgcgataccgaattctttcaatttctccttatcattatctacgtaatccttaaacaaatacaccgaacaataaccgccgccctccgtaatatcctaaaaactaaaatccgacgtccccaactcccgaaaacgcgccaatccgctctccaaaacttcccgatacgtaataaaatccttcttacctccgccgcctccgcctccgccgttaccgtccttacttttctaatcaaaaaacttaaatacaaaaaccgtaaactcttccataactaaaaccgaaactaacgaacaaccgaaactaataaatacgcgcgtctccccgcgcgaaaaaaacgacccgtacgcgcgaataaatcaccaacgctattatttacgcctttccattaaaaatctcactatttatacgcgacgacctcgcccaaccccccatacgctacctatctaatacaattactaatctccgaactccgcgacgaacgcacgcaaaaacgc

SEQ ID NO: 19643 - DNA, 854 bp, Artificial Sequence
  chemically treated genomic DNA (Homo sapiens) CpG-island No: 19643
ggaaaggaaagaaaaagaaaatgaaaaagatattttaggttttacggttttaggtatagttattcggatttattttagttcgggattttttcgtgtcggtgtttacgcgcgcggttttcgttgcgattttttttgggttttttcgtatttcgttatttattattcgcgttttcggtcgggtttatttttgttttttttttttttttaggtaaagtttgacggttcgggttttattttggcgagacgggagttgtaaatgtgtatagcgaggggcgcgcggggtcgatttcgtggcgaggaggcgtcgaattttaggagggtttttttggagtcggcgcgtaaaggaatttattttttgttattttcgcggtgtcgaatttttttagtttttttttgttattgtttacgtggtttttgaataaatgtatcgggtagtggtcgtcgtttttcgtgatgttttggaggttggaattcgacgtttttagttttcgggagcgcgttagttcgttttttaaaatttttcggtacgtaatggaattttttttattttcgtcgttttcgttttcgtcgttatcgtttttgtttttttggttaaaagatttggatataaaagtcgtgagtttttttatggttggggtcggggttggcgagtagtcggggttggtggatgcgcgcgttttttcgcgcggagaggacggttcgtgcgcgcgggtggattattagcgttgttatttacgtttttttattggaaattttattatttatacgcggcgatttcgtttagttttttatgcgttgtttgtttggtgtaattattggttttcgggtttcgcggcggacgtacgtagagacgt

SEQ ID NO: 19644 - DNA, 854 bp, Artificial Sequence
  chemically treated genomic DNA (Homo sapiens) CpG-island No: 19644
acgtctctacgtacgtccgccgcgaaacccgaaaaccaataattacaccaaacaaacaacgcataaaaaactaaacgaaatcgccgcgtataaataataaaatttccaataaaaaaacgtaaataacaacgctaataatccacccgcgcgcacgaaccgtcctctccgcgcgaaaaaacgcgcgcatccaccaaccccgactactcgccaaccccgaccccaaccataaaaaaactcacgacttttatatccaaatcttttaaccaaaaaaacaaaaacgataacgacgaaaacgaaaacgacgaaaataaaaaaaattccattacgtaccgaaaaattttaaaaaacgaactaacgcgctcccgaaaactaaaaacgtcgaattccaacctccaaaacatcacgaaaaacgacgaccactacccgatacatttattcaaaaaccacgtaaacaataacaaaaaaaaactaaaaaaattcgacaccgcgaaaataacaaaaaataaattcctttacgcgccgactccaaaaaaaccctcctaaaattcgacgcctcctcgccacgaaatcgaccccgcgcgcccctcgctatacacatttacaactcccgtctcgccaaaataaaacccgaaccgtcaaactttacctaaaaaaaaaaaaaaaacaaaaataaacccgaccgaaaacgcgaataataaataacgaaatacgaaaaaacccaaaaaaaatcgcaacgaaaaccgcgcgcgtaaacaccgacacgaaaaaatcccgaactaaaataaatccgaataactatacctaaaaccgtaaaacctaaaatatctttttcattttctttttctttcctttcc

SEQ ID NO: 19645 - DNA, 553 bp, Artificial Sequence
  chemically treated genomic DNA (Homo sapiens) CpG-island No: 19645
ggattttacgtagtttttgcgttaaagcgtattggttttcgagggttttttttttatcgcgggatgtacgaaggggttcgttacgttgcgtaaaattttttcggttttagttttgtgtttttcgttttttacgtagggatttatgaatgtaaagagaagcgcgaggacgtgaagtcggaggacgaggacgggtagattaagttgaaatagaggcgtagtcgtattaattttacgttggagtagttgaacgagttcgagcgatttttcgacgagatttattatttcgacgtttttatgcgcgaggagtttagttagcgtttggggtttttcgaggcgcgcgtgtaggtaggaattcgggggcgggggcggggggttcggagttatcgtttggttttcgggagcgtatagtacgcgtatagttatttgcgttcgggtcgtcgtcgtttttttttcggagcgcggggaggttgggtgagggacgggttggggtttttggatttttggagacgtttgaggtttgtaggatgggtttattgcgtttgttttttattaa

SEQ ID NO: 19646 - DNA, 553 bp, Artificial Sequence
  chemically treated genomic DNA (Homo sapiens) CpG-island No: 19646
ttaataaaaaacaaacgcaataaacccatcctacaaacctcaaacgtctccaaaaatccaaaaaccccaacccgtccctcacccaacctccccgcgctccgaaaaaaaaacgacgacgacccgaacgcaaataactatacgcgtactatacgctcccgaaaaccaaacgataactccgaaccccccgcccccgcccccgaattcctacctacacgcgcgcctcgaaaaaccccaaacgctaactaaactcctcgcgcataaaaacgtcgaaataataaatctcgtcgaaaaatcgctcgaactcgttcaactactccaacgtaaaattaatacgactacgcctctatttcaacttaatctacccgtcctcgtcctccgacttcacgtcctcgcgcttctctttacattcataaatccctacgtaaaaaacgaaaaacacaaaactaaaaccgaaaaaattttacgcaacgtaacgaaccccttcgtacatcccgcgataaaaaaaaaaccctcgaaaaccaatacgctttaacgcaaaaactacgtaaaatcc

SEQ ID NO: 19647 - DNA, 553 bp, Artificial Sequence
  chemically treated genomic DNA (Homo sapiens) CpG-island No: 19647
ttggtgaaaaataaacgtaatgaatttattttataggttttaggcgtttttaaaagtttaggaattttagttcgttttttatttaattttttcgcgtttcgggaaggggacggcggcggttcgggcgtaggtggttgtacgcgtgttgtgcgttttcgaggattaggcgatggtttcgggtttttcgttttcgttttcgggtttttatttgtacgcgcgtttcggagagttttaggcgttggttgagtttttcgcgtatgaaggcgtcggggtaatgggtttcgtcgaagagtcgttcgagttcgtttagttgttttagcgtgaagttggtgcggttgcgtttttgttttagtttggtttgttcgttttcgtttttcgattttacgttttcgcgtttttttttgtatttataaatttttgcgtggggagcggagggtatagggttgaggtcggggaggttttgcgtaacgtggcgaattttttcgtgtatttcgcggtggaaagggggttttcgaaaattaatgcgttttgacgtaaaaattgcgtggggttt

SEQ ID NO: 19648 - DNA, 553 bp, Artificial Sequence
  chemically treated genomic DNA (Homo sapiens) CpG-island No: 19648
aaaccccacgcaatttttacgtcaaaacgcattaattttcgaaaaccccctttccaccgcgaaatacacgaaaaaattcgccacgttacgcaaaacctccccgacctcaaccctataccctccgctccccacgcaaaaatttataaatacaaaaaaaaacgcgaaaacgtaaaatcgaaaaacgaaaacgaacaaaccaaactaaaacaaaaacgcaaccgcaccaacttcacgctaaaacaactaaacgaactcgaacgactcttcgacgaaacccattaccccgacgccttcatacgcgaaaaactcaaccaacgcctaaaactctccgaaacgcgcgtacaaataaaaacccgaaaacgaaaacgaaaaacccgaaaccatcgcctaatcctcgaaaacgcacaacacgcgtacaaccacctacgcccgaaccgccgccgtccccttcccgaaacgcgaaaaaattaaataaaaaacgaactaaaattcctaaacttttaaaaacgcctaaaacctataaaataaattcattacgtttatttttcaccaa

SEQ ID NO: 19649 - DNA, 538 bp, Artificial Sequence
  chemically treated genomic DNA (Homo sapiens) CpG-island No: 19649
tttacgcgtattcgtatttgtattcgtatttggcggcgtacgcgttttatttgatgtttttttcgtcgtttttcgggttgtttatcgcgtcgttggtcgagttcgtttcggtcgtcgtcgtggtcgtcgtcgtcgttaaaagtaatagtaagaattttagtatcgtcgatttgcggtttaaggcgcggaagtacgcggaggttttggggttttgattcgtcgcgtagtttttcgcgcgttcggattttcgggtttcgcgtatttcgtttgtatcgcgcgttttgtatttaatttcgtttggagtttttttcgcggttatcgtgtttcgggtatttcgggagtttttgtaagaggtttgaggagggaggttttcgggatcgtttacgtacgatttagttagattttcgcggagatggtgtagaaggcggagcgggtgagcggtcgtgcgtttagttcgggtttttttaaggttgttcgtgcgttttgggattttggagaagggtaaattttcgtttggttgcgtttttttttgttatat

SEQ ID NO: 19650 - DNA, 538 bp, Artificial Sequence
  chemically treated genomic DNA (Homo sapiens) CpG-island No: 19650
atataacaaaaaaaaacgcaaccaaacgaaaatttacccttctccaaaatcccaaaacgcacgaacaaccttaaaaaaacccgaactaaacgcacgaccgctcacccgctccgccttctacaccatctccgcgaaaatctaactaaatcgtacgtaaacgatcccgaaaacctccctcctcaaacctcttacaaaaactcccgaaatacccgaaacacgataaccgcgaaaaaaactccaaacgaaattaaatacaaaacgcgcgatacaaacgaaatacgcgaaacccgaaaatccgaacgcgcgaaaaactacgcgacgaatcaaaaccccaaaacctccgcgtacttccgcgccttaaaccgcaaatcgacgatactaaaattcttactattacttttaacgacgacgacgaccacgacgacgaccgaaacgaactcgaccaacgacgcgataaacaacccgaaaaacgacgaaaaaaacatcaaataaaacgcgtacgccgccaaatacgaatacaaatacgaatacgcgtaaa

SEQ ID NO: 19651 - DNA, 538 bp, Artificial Sequence
  chemically treated genomic DNA (Homo sapiens) CpG-island No: 19651
gtatagtagaggaagacgtagttaggcgggggtttatttttttttagggttttaggacgtacgggtagttttggagaggttcgggttggacgtacggtcgtttattcgtttcgttttttgtattattttcgcgagggtttggttgggtcgtgcgtggacggtttcgggagtttttttttttaggttttttgtaggagttttcggggtgttcggagtacggtggtcgcggaaggagttttaggcggggttgagtgtaggacgcgcggtgtaggcggggtgcgcggagttcgggagttcgggcgcgcggggggttgcgcggcgggttagagttttagggttttcgcgtgttttcgcgttttgagtcgtaggtcggcgatgttggaatttttgttgttgtttttggcggcggcggcgattacggcggcggtcgaggcggattcggttagcgacgcgatgggtagttcgaagggcggcggggggaatattaggtagggcgcgtgcgtcgttaggtgcgggtgtaggtgcgggtgcgcgtggg

SEQ ID NO: 19652 - DNA, 538 bp, Artificial Sequence
  chemically treated genomic DNA (Homo sapiens) CpG-island No: 19652
cccacgcgcacccgcacctacacccgcacctaacgacgcacgcgccctacctaatattccccccgccgcccttcgaactacccatcgcgtcgctaaccgaatccgcctcgaccgccgccgtaatcgccgccgccgccaaaaacaacaacaaaaattccaacatcgccgacctacgactcaaaacgcgaaaacacgcgaaaaccctaaaactctaacccgccgcgcaaccccccgcgcgcccgaactcccgaactccgcgcaccccgcctacaccgcgcgtcctacactcaaccccgcctaaaactccttccgcgaccaccgtactccgaacaccccgaaaactcctacaaaaaacctaaaaaaaaaaactcccgaaaccgtccacgcacgacccaaccaaaccctcgcgaaaataatacaaaaaacgaaacgaataaacgaccgtacgtccaacccgaacctctccaaaactacccgtacgtcctaaaaccctaaaaaaaaataaacccccgcctaactacgtcttcctctactatac

SEQ ID NO: 19653 - DNA, 543 bp, Artificial Sequence
  chemically treated genomic DNA (Homo sapiens) CpG-island No: 19653
tttttgtcgagtatgcgttttagtttttttttttggggttgtgatcgtggggtcgaagcgcgcgtgcgcggcggcggttggcggcggcggtggggcggggtttgggttgttagtcggtttaggaggaggaaggagtttgcggcgtgtagtgtgaggggcgggattcggttgtcggcggtgggtttagttgggggaggtcgggttatgttggtgggttagggcgcggggtcgttggggttcgcggtggttatcgtcgcggtggtgttgttgttgagcggcgtggggtcggcgtacggttcggaggatatcgtggtgggttgcggtggtttcgttaagtcggacgtggagattaattatttttttatcgaggtgagcgttcgtttcgtcgttcggcgtcgagtcgtcgggtcggtggtttagtttttttgggtcgcgttggtttcgtttttgatatcgggcggtgtggagtttttggagtttttatttttttcgaggttatgttgttcgcgggttttttgtagtttttttttagtcgcgttggag

SEQ ID NO: 19654 - DNA, 543 bp, Artificial Sequence
  chemically treated genomic DNA (Homo sapiens) CpG-island No: 19654
ctccaacgcgactaaaaaaaaactacaaaaaacccgcgaacaacataacctcgaaaaaaataaaaactccaaaaactccacaccgcccgatatcaaaaacgaaaccaacgcgacccaaaaaaactaaaccaccgacccgacgactcgacgccgaacgacgaaacgaacgctcacctcgataaaaaaataattaatctccacgtccgacttaacgaaaccaccgcaacccaccacgatatcctccgaaccgtacgccgaccccacgccgctcaacaacaacaccaccgcgacgataaccaccgcgaaccccaacgaccccgcgccctaacccaccaacataacccgacctcccccaactaaacccaccgccgacaaccgaatcccgcccctcacactacacgccgcaaactccttcctcctcctaaaccgactaacaacccaaaccccgccccaccgccgccgccaaccgccgccgcgcacgcgcgcttcgaccccacgatcacaaccccaaaaaaaaaaactaaaacgcatactcgacaaaaa

SEQ ID NO: 19655 - DNA, 543 bp, Artificial Sequence
  chemically treated genomic DNA (Homo sapiens) CpG-island No: 19655
ttttagcgcgattggggaggggttgtagggagttcgcggatagtatagtttcggaagaggtaagggttttaaggattttatatcgttcggtgttagagacgaggttagcgcggtttagagaggttgaattatcggttcggcgattcggcgtcgggcggcggggcgggcgtttatttcgatgagagagtagttgatttttacgttcgatttgacgaagttatcgtagtttattacgatgtttttcgagtcgtgcgtcggttttacgtcgtttagtagtagtattatcgcggcggtgattatcgcgggttttagcggtttcgcgttttggtttattagtatggttcgattttttttagttagatttatcgtcggtagtcgggtttcgttttttatattgtacgtcgtaggtttttttttttttttaggtcggttgatagtttaggtttcgttttatcgtcgtcgttagtcgtcgtcgcgtacgcgcgtttcgattttacggttatagttttagaagagagaattaaggcgtatgttcggtaagga

SEQ ID NO: 19656 - DNA, 543 bp, Artificial Sequence
  chemically treated genomic DNA (Homo sapiens) CpG-island No: 19656
tccttaccgaacatacgccttaattctctcttctaaaactataaccgtaaaatcgaaacgcgcgtacgcgacgacgactaacgacgacgataaaacgaaacctaaactatcaaccgacctaaaaaaaaaaaaaaacctacgacgtacaatataaaaaacgaaacccgactaccgacgataaatctaactaaaaaaaatcgaaccatactaataaaccaaaacgcgaaaccgctaaaacccgcgataatcaccgccgcgataatactactactaaacgacgtaaaaccgacgcacgactcgaaaaacatcgtaataaactacgataacttcgtcaaatcgaacgtaaaaatcaactactctctcatcgaaataaacgcccgccccgccgcccgacgccgaatcgccgaaccgataattcaacctctctaaaccgcgctaacctcgtctctaacaccgaacgatataaaatccttaaaacccttacctcttccgaaactatactatccgcgaactccctacaacccctccccaatcgcgctaaaa

SEQ ID NO: 19657 - DNA, 780 bp, Artificial Sequence
  chemically treated genomic DNA (Homo sapiens) CpG-island No: 19657
gttcgttcgtttatttatttattcgtacgtttattttatttttttttatttttatttaagcgtttagttcgcgcgcgtcgttttttcgtaggttgattagatttgtttgtttagttcgttttcgtttaaatttcgtttttttttcgttacgtttttttttcgggttaatcggggacgagattggggtcggggcggggtttcgtttttttagaattttcggcggcgtttacggtttcggaaacgcgtcgcggggttgttagttcggttgggtacgggcggtttcgtggcgttttttgttacgttaggtttgtttgggtcgcgttagcgtcgttttatcgagggtcgcgcgtcggtcgtcgtcgggtttgggtgagtgtgcgggtcgcgggaggatgtgcggggggcgttggaggggtcgtagggcggaggtgatcgtgggggcggtaggaggacgtgtggatttgagtgagcgtgtagggtcgcgagaggatgtgtagggggtgtaggattgtgtgcggggttggagcgagtgtgcgggtcgtagaagagtgtacggtggagggagggggcgtttttgggtagttggagagttgttcggttttgggcgggttagagtagggaacgggtttcggatgacgagtacgaagaggttcgaaggttttttcgaggcgggcggggggcggcgatttcgggtgggaatcgttaaagtgtagaggtttgttttgttttttgggggacgttaggagatgggaatcgtttaggggcggagagaaaggattt

SEQ ID NO: 19658 - DNA, 780 bp, Artificial Sequence
  chemically treated genomic DNA (Homo sapiens) CpG-island No: 19658
aaatcctttctctccgcccctaaacgattcccatctcctaacgtcccccaaaaaacaaaacaaacctctacactttaacgattcccacccgaaatcgccgccccccgcccgcctcgaaaaaaccttcgaacctcttcgtactcgtcatccgaaacccgttccctactctaacccgcccaaaaccgaacaactctccaactacccaaaaacgccccctccctccaccgtacactcttctacgacccgcacactcgctccaaccccgcacacaatcctacaccccctacacatcctctcgcgaccctacacgctcactcaaatccacacgtcctcctaccgcccccacgatcacctccgccctacgacccctccaacgccccccgcacatcctcccgcgacccgcacactcacccaaacccgacgacgaccgacgcgcgaccctcgataaaacgacgctaacgcgacccaaacaaacctaacgtaacaaaaaacgccacgaaaccgcccgtacccaaccgaactaacaaccccgcgacgcgtttccgaaaccgtaaacgccgccgaaaattctaaaaaaacgaaaccccgccccgaccccaatctcgtccccgattaacccgaaaaaaaaacgtaacgaaaaaaaaacgaaatttaaacgaaaacgaactaaacaaacaaatctaatcaacctacgaaaaaacgacgcgcgcgaactaaacgcttaaataaaaataaaaaaaaataaaataaacgtacgaataaataaataaacgaacgaac

SEQ ID NO: 19659 - DNA, 780 bp, Artificial Sequence
  chemically treated genomic DNA (Homo sapiens) CpG-island No: 19659
gggtttttttttttcgtttttgagcggtttttattttttagcgttttttaaagagtagagtaggtttttatattttagcgatttttattcgggatcgtcgtttttcgttcgtttcgggaaggttttcgggttttttcgtattcgttattcgggattcgttttttgttttggttcgtttaaggtcgagtagttttttaattgtttagagacgttttttttttttatcgtgtatttttttgcggttcgtatattcgttttagtttcgtatatagttttgtattttttgtatattttttcgcggttttgtacgtttatttaggtttatacgtttttttgtcgtttttacgattattttcgttttgcggtttttttagcgtttttcgtatattttttcgcggttcgtatatttatttaggttcggcggcggtcgacgcgcggttttcggtggagcggcgttggcgcggtttaggtaggtttggcgtggtaggaagcgttacggagtcgttcgtgtttagtcgagttaatagtttcgcggcgcgttttcggagtcgtgagcgtcgtcgggggttttgagggagcgaggtttcgtttcggttttagtttcgttttcgattggttcgggaagggggcgtggcgggaagggggcggggtttgggcgggggcggattgggtaggtaagtttgattagtttgcgggggagcggcgcgcgcgggttggacgtttgggtggaggtggggaggagtggaatgagcgtgcgaatgaatgaatgaacgagcgaat

SEQ ID NO: 19660 - DNA, 780 bp, Artificial Sequence
  chemically treated genomic DNA (Homo sapiens) CpG-island No: 19660
attcgctcgttcattcattcattcgcacgctcattccactcctccccacctccacccaaacgtccaacccgcgcgcgccgctcccccgcaaactaatcaaacttacctacccaatccgcccccgcccaaaccccgcccccttcccgccacgcccccttcccgaaccaatcgaaaacgaaactaaaaccgaaacgaaacctcgctccctcaaaacccccgacgacgctcacgactccgaaaacgcgccgcgaaactattaactcgactaaacacgaacgactccgtaacgcttcctaccacgccaaacctacctaaaccgcgccaacgccgctccaccgaaaaccgcgcgtcgaccgccgccgaacctaaataaatatacgaaccgcgaaaaaatatacgaaaaacgctaaaaaaaccgcaaaacgaaaataatcgtaaaaacgacaaaaaaacgtataaacctaaataaacgtacaaaaccgcgaaaaaatatacaaaaaatacaaaactatatacgaaactaaaacgaatatacgaaccgcaaaaaaatacacgataaaaaaaaaaaacgtctctaaacaattaaaaaactactcgaccttaaacgaaccaaaacaaaaaacgaatcccgaataacgaatacgaaaaaacccgaaaaccttcccgaaacgaacgaaaaacgacgatcccgaataaaaatcgctaaaatataaaaacctactctactctttaaaaaacgctaaaaaataaaaaccgctcaaaaacgaaaaaaaaaaaccc

SEQ ID NO: 19661 - DNA, 553 bp, Artificial Sequence
  chemically treated genomic DNA (Homo sapiens) CpG-island No: 19661
ttcgattgcgacgattgcggtaagttttttcgaggggttaacgggttggtcgagtattagcgtatttatagtggggttaagttatacgggtgtttttattgcggtaagttttttcgaaggagttcggagtttattaagtatcggcggatttatacgggcgagaagttttacgtttgcggttagtgcggtaaggtttttcgttagagttttagttttttggagtacgtacgtatttatagtggcgagcggttttacgtatgcggcgagtgtggtaaggtttttcgtgggttttttgattttattaagtatcggcgtatttatagcggattgaaattttatgagtgcgataaatgcggtaaggtttttcgtcggagtttcggttttagtcgttatcggcggatttatagtggggcgcggcgttgcgaatgtagttagtgtggtcgcgtgtttaagaggcgttcggtattgtagaagtattagttaatttattacgagtagaaacgttttgtggtttcgcgggatagggacggagtttttagaggggatggtagag

SEQ ID NO: 19662 - DNA, 553 bp, Artificial Sequence
  chemically treated genomic DNA (Homo sapiens) CpG-island No: 19662
ctctaccatcccctctaaaaactccgtccctatcccgcgaaaccacaaaacgtttctactcgtaataaattaactaatacttctacaataccgaacgcctcttaaacacgcgaccacactaactacattcgcaacgccgcgccccactataaatccgccgataacgactaaaaccgaaactccgacgaaaaaccttaccgcatttatcgcactcataaaatttcaatccgctataaatacgccgatacttaataaaatcaaaaaacccacgaaaaaccttaccacactcgccgcatacgtaaaaccgctcgccactataaatacgtacgtactccaaaaaactaaaactctaacgaaaaaccttaccgcactaaccgcaaacgtaaaacttctcgcccgtataaatccgccgatacttaataaactccgaactccttcgaaaaaacttaccgcaataaaaacacccgtataacttaaccccactataaatacgctaatactcgaccaacccgttaacccctcgaaaaaacttaccgcaatcgtcgcaatcgaa

SEQ ID NO: 19663 - DNA, 553 bp, Artificial Sequence
  chemically treated genomic DNA (Homo sapiens) CpG-island No: 19663
ttttgttattttttttggggatttcgtttttgtttcgcgggattatagggcgtttttattcgtggtgggttggttgatgtttttgtagtgtcgagcgttttttgaatacgcggttatattggttgtattcgtagcgtcgcgttttattgtggattcgtcggtggcgattgaggtcggagtttcggcggaaggttttgtcgtatttgtcgtatttatagggttttagttcgttgtggatgcgtcggtgtttgatgaggttagagggtttacggaaggttttgttatattcgtcgtatgcgtagggtcgttcgttattgtggatgcgtgcgtgttttaggaggttggagttttggcggaaggttttgtcgtattggtcgtaggcgtagggtttttcgttcgtgtggattcgtcggtgtttggtgagtttcgagttttttcggaagagtttgtcgtagtggggatattcgtatggtttggttttattgtggatgcgttggtgttcggttagttcgttgatttttcggaaggatttgtcgtagtcgtcgtagtcgaa

SEQ ID NO: 19664 - DNA, 553 bp, Artificial Sequence
  chemically treated genomic DNA (Homo sapiens) CpG-island No: 19664
ttcgactacgacgactacgacaaatccttccgaaaaatcaacgaactaaccgaacaccaacgcatccacaataaaaccaaaccatacgaatatccccactacgacaaactcttccgaaaaaactcgaaactcaccaaacaccgacgaatccacacgaacgaaaaaccctacgcctacgaccaatacgacaaaaccttccgccaaaactccaacctcctaaaacacgcacgcatccacaataacgaacgaccctacgcatacgacgaatataacaaaaccttccgtaaaccctctaacctcatcaaacaccgacgcatccacaacgaactaaaaccctataaatacgacaaatacgacaaaaccttccgccgaaactccgacctcaatcgccaccgacgaatccacaataaaacgcgacgctacgaatacaaccaatataaccgcgtattcaaaaaacgctcgacactacaaaaacatcaaccaacccaccacgaataaaaacgccctataatcccgcgaaacaaaaacgaaatccccaaaaaaaataacaaaa

SEQ ID NO: 19665 - DNA, 654 bp, Artificial Sequence
  chemically treated genomic DNA (Homo sapiens) CpG-island No: 19665
aacgcgggtttttttcgttttttttaggagtcgcggtgcgttgattatttcgattttagtttttagagtagtttagatagaaagcggaagtgtttcggggcgcgtggggagttaggttagacgtttttgtggggcgggcgcggggcgggtcgttatttttttgcgtcgcgtatgttttatgttttttttataacgcgtttcgtttttacgttgtcgtcgtttcggtttcgttcgttttcggttcgttcgtcggcgtattagattgagatttttttttaggacgtttttcgcgagcggtatttagaggcgaagtcgagataagtttaggagtttttatttttcgttcgcgttttttggggacgcggtttcggagggtttttaggaggaggcggcggttttggtttcgggtttgtcgggagtaggaagggaggtcgattttttcggttgttcgtcgagtttaggtaagagggtcgagttgggtcgtaggggtgcgggtaagcgggtaaggggttcgtttcggtagggtgtaggtgtcgagggggacgagggagttgcggcggcggcgataagtagggattttttgggaggcgggttagtattgagtggtcggattagttttcggggtcgtttcgtattaggggcgttaggggaaga

SEQ ID NO: 19666 - DNA, 654 bp, Artificial Sequence
  chemically treated genomic DNA (Homo sapiens) CpG-island No: 19666
tcttcccctaacgcccctaatacgaaacgaccccgaaaactaatccgaccactcaatactaacccgcctcccaaaaaatccctacttatcgccgccgccgcaactccctcgtccccctcgacacctacaccctaccgaaacgaaccccttacccgcttacccgcacccctacgacccaactcgaccctcttacctaaactcgacgaacaaccgaaaaaatcgacctcccttcctactcccgacaaacccgaaaccaaaaccgccgcctcctcctaaaaaccctccgaaaccgcgtccccaaaaaacgcgaacgaaaaataaaaactcctaaacttatctcgacttcgcctctaaataccgctcgcgaaaaacgtcctaaaaaaaaatctcaatctaatacgccgacgaacgaaccgaaaacgaacgaaaccgaaacgacgacaacgtaaaaacgaaacgcgttataaaaaaaacataaaacatacgcgacgcaaaaaaataacgacccgccccgcgcccgccccacaaaaacgtctaacctaactccccacgcgccccgaaacacttccgctttctatctaaactactctaaaaactaaaatcgaaataatcaacgcaccgcgactcctaaaaaaaacgaaaaaaacccgcgtt

SEQ ID NO: 19667 - DNA, 654 bp, Artificial Sequence
  chemically treated genomic DNA (Homo sapiens) CpG-island No: 19667
tttttttttggcgtttttggtacggggcggtttcgagggttggttcggttatttagtgttagttcgttttttagggagtttttgtttgtcgtcgtcgtcgtagttttttcgtttttttcgatatttgtattttgtcgagacgggttttttattcgtttattcgtatttttgcggtttagttcggtttttttatttgggttcggcgggtagtcgagggagtcggtttttttttttgttttcggtaggttcgaggttaaggtcgtcgtttttttttagaagtttttcgaggtcgcgtttttaggaaacgcgggcggggggtgggggtttttgggtttgtttcgatttcgtttttgggtatcgttcgcgaagagcgttttgaaggggagttttagtttggtgcgtcgacgagcgggtcgggagcgggcggggtcggggcggcggtagcgtgggaacggggcgcgttgtggggggggtatggagtatgcgcggcgtagagggatggcggttcgtttcgcgttcgttttataggggcgtttggtttggttttttacgcgtttcgaggtattttcgttttttgtttgggttgttttgaaggttggggtcgaagtggttagcgtatcgcggtttttgaaggggacgggagggattcgcgtt

SEQ ID NO: 19668 - DNA, 654 bp, Artificial Sequence
  chemically treated genomic DNA (Homo sapiens) CpG-island No: 19668
aacgcgaatccctcccgtccccttcaaaaaccgcgatacgctaaccacttcgaccccaaccttcaaaacaacccaaacaaaaaacgaaaatacctcgaaacgcgtaaaaaaccaaaccaaacgcccctataaaacgaacgcgaaacgaaccgccatccctctacgccgcgcatactccataccccccccacaacgcgccccgttcccacgctaccgccgccccgaccccgcccgctcccgacccgctcgtcgacgcaccaaactaaaactccccttcaaaacgctcttcgcgaacgatacccaaaaacgaaatcgaaacaaacccaaaaacccccaccccccgcccgcgtttcctaaaaacgcgacctcgaaaaacttctaaaaaaaaacgacgaccttaacctcgaacctaccgaaaacaaaaaaaaaaaccgactccctcgactacccgccgaacccaaataaaaaaaccgaactaaaccgcaaaaatacgaataaacgaataaaaaacccgtctcgacaaaatacaaatatcgaaaaaaacgaaaaaactacgacgacgacgacaaacaaaaactccctaaaaaacgaactaacactaaataaccgaaccaaccctcgaaaccgccccgtaccaaaaacgccaaaaaaaaa

SEQ ID NO: 19669 - DNA, 843 bp, Artificial Sequence
  chemically treated genomic DNA (Homo sapiens) CpG-island No: 19669
cgagaagttttacgcgtgtttcgagtgcggtaagttgtttcgtcgtagtttcgcgtttttggagtattagcgtatttatagcggcgagaagttttacgtttgtttcgagtgtagtaagatttttacgcgtagttttaattttattaagtattaggttatttatagcggcgagcggtttttcgtttgcggcgattgcggtaaattgtttcgtcgtagtttcgcgtttttggagtacgcgcgcgtgtatagcggcgagcggttttacgcgtgtttagagtgcggtaaggtttttagtcgtagttttaattttatcgagtattagcgtacgtatcgcggcgagaagttttacgtttgcggttagtgcgttaaggtttttaagggcgtttcgtagtttatttattattagcgtagttatagcggcgagcggtttttcgcgtgtcgcgagtgcggtaaggtttttcgtggtcgttcgggttttagttagtatcggcgcgtgtatagcggtgagaagttttacgagtgtagcgattgcggtaaggttttcggtcggcgcgttaatttatttaagtattaggtagtgtacggcgttaggcgttttgcgaaggcggagacggcgcggaggttagcgggttttgggagtatcggttttgggagcgcggtggcggttattagtttttcgcggtcgagtatagtcgttaggttttttaggtttagtcgtcgttgatttttcgttagcgtatttagggcgcggtcggtttgcgtggggggtttttttggggacgtcgaggtttagttttttttaggtgggaagatcgtttttttagggtttcgattgcggttata

SEQ ID NO: 19670 - DNA, 843 bp, Artificial Sequence
  chemically treated genomic DNA (Homo sapiens) CpG-island No: 19670
tataaccgcaatcgaaaccctaaaaaaacgatcttcccacctaaaaaaaactaaacctcgacgtccccaaaaaaaccccccacgcaaaccgaccgcgccctaaatacgctaacgaaaaatcaacgacgactaaacctaaaaaacctaacgactatactcgaccgcgaaaaactaataaccgccaccgcgctcccaaaaccgatactcccaaaacccgctaacctccgcgccgtctccgccttcgcaaaacgcctaacgccgtacactacctaatacttaaataaattaacgcgccgaccgaaaaccttaccgcaatcgctacactcgtaaaacttctcaccgctatacacgcgccgatactaactaaaacccgaacgaccacgaaaaaccttaccgcactcgcgacacgcgaaaaaccgctcgccgctataactacgctaataataaataaactacgaaacgcccttaaaaaccttaacgcactaaccgcaaacgtaaaacttctcgccgcgatacgtacgctaatactcgataaaattaaaactacgactaaaaaccttaccgcactctaaacacgcgtaaaaccgctcgccgctatacacgcgcgcgtactccaaaaacgcgaaactacgacgaaacaatttaccgcaatcgccgcaaacgaaaaaccgctcgccgctataaataacctaatacttaataaaattaaaactacgcgtaaaaatcttactacactcgaaacaaacgtaaaacttctcgccgctataaatacgctaatactccaaaaacgcgaaactacgacgaaacaacttaccgcactcgaaacacgcgtaaaacttctcg

SEQ ID NO: 19671 - DNA, 843 bp, Artificial Sequence
  chemically treated genomic DNA (Homo sapiens) CpG-island No: 19671
tgtggtcgtaatcgaggttttgggagggcggtttttttatttgaagggggttgagtttcgacgtttttaggaaggttttttacgtagatcggtcgcgttttgggtgcgttggcggggagttagcggcggttgggtttggaaggtttggcggttgtgttcggtcgcggggggttggtggtcgttatcgcgtttttagggtcggtgtttttagggttcgttagttttcgcgtcgttttcgttttcgtagggcgtttggcgtcgtgtattgtttggtgtttgaataggttggcgcgtcggtcgaaggttttgtcgtagtcgttgtattcgtagggttttttatcgttgtgtacgcgtcggtgttggttgaggttcgaacggttacggaaggttttgtcgtattcgcggtacgcgaagggtcgttcgtcgttgtggttgcgttggtggtggatgagttgcgagacgtttttgaaggttttggcgtattggtcgtaggcgtagggtttttcgtcgcggtgcgtgcgttggtgttcgatgaggttggagttgcggttgaaggttttgtcgtattttgggtacgcgtagggtcgttcgtcgttgtgtacgcgcgcgtgttttaggagcgcgaagttgcggcggaatagtttgtcgtagtcgtcgtaggcgaagggtcgttcgtcgttgtggatgatttggtgtttgatgaggttggagttgcgcgtgaaggttttgttgtattcggggtaggcgtagggtttttcgtcgttgtggatgcgttggtgttttaggagcgcgaagttgcggcgaaatagtttgtcgtattcggggtacgcgtaaggtttttcg

SEQ ID NO: 19672 - DNA, 843 bp, Artificial Sequence
  chemically treated genomic DNA (Homo sapiens) CpG-island No: 19672
cgaaaaaccttacgcgtaccccgaatacgacaaactatttcgccgcaacttcgcgctcctaaaacaccaacgcatccacaacgacgaaaaaccctacgcctaccccgaatacaacaaaaccttcacgcgcaactccaacctcatcaaacaccaaatcatccacaacgacgaacgacccttcgcctacgacgactacgacaaactattccgccgcaacttcgcgctcctaaaacacgcgcgcgtacacaacgacgaacgaccctacgcgtacccaaaatacgacaaaaccttcaaccgcaactccaacctcatcgaacaccaacgcacgcaccgcgacgaaaaaccctacgcctacgaccaatacgccaaaaccttcaaaaacgtctcgcaactcatccaccaccaacgcaaccacaacgacgaacgacccttcgcgtaccgcgaatacgacaaaaccttccgtaaccgttcgaacctcaaccaacaccgacgcgtacacaacgataaaaaaccctacgaatacaacgactacgacaaaaccttcgaccgacgcgccaacctattcaaacaccaaacaatacacgacgccaaacgccctacgaaaacgaaaacgacgcgaaaactaacgaaccctaaaaacaccgaccctaaaaacgcgataacgaccaccaaccccccgcgaccgaacacaaccgccaaaccttccaaacccaaccgccgctaactccccgccaacgcacccaaaacgcgaccgatctacgtaaaaaaccttcctaaaaacgtcgaaactcaacccccttcaaataaaaaaaccgccctcccaaaacctcgattacgaccaca

SEQ ID NO: 19673 - DNA, 945 bp, Artificial Sequence
  chemically treated genomic DNA (Homo sapiens) CpG-island No: 19673
tcgggcgcgtagtttttgagtttcgaggtttttgcgtcgcgtatcgtttttcgcgttcgttttttttttttttttttttttttatttagtttttttttttttttttttttttttttcgcgtttagagttgcggttggagtcgagcgcgtcgcgtcgttcgtcgcgggtgtagagcgtggggagtattcggtcgtagttttcgttcgtcgtagagggtcgcgtttcgcgtcgtcggttaggtcgtttcgtgtttaggtttttttatttttggagcggatcgttgttcgtttgacgttcgttcgtagcgatagcgttcgtcggagtcgaggtcgcggcggcggtcgtgtttatgttcgggtaagtggtgttttgggcgcgcgggcgtcgtcggggtgggcgcgggcgcggcgcgggtataaggcgcgggtggggatgggaggatgattcggtaggtggtgcggcggtaggtagggggatacgggttttcgttcgaggtatttgagtttcgcgtcgggtttgcgtgtttttgcggtattgcggtcgcgcgttatttcggggttttaggtcggcgggtagcgtttcgtattttgtattttgcgtttcgtatcgcgcgcgtacgcgtattcgtgtttgaggaataaggtttttgggggttgcgggtcggggtttagggtgggcgtagtcgggggcgcgggatttgggtcgggagttcgttagtgcgtacgtattttttcggagtttcgggtattttttttttttcgcgtttttatattgtattattttttttttttcgttttttcgtatcgtttttcgtacgtttacgcggttgtttagtagattttatcgcggttatgggtagtgtttacgagaagtcgttcggggtcgtatttaggtaatttttttatttttttaggaacggttgttttttttttttcgtttgtgtga

SEQ ID NO: 19674 - DNA, 945 bp, Artificial Sequence
  chemically treated genomic DNA (Homo sapiens) CpG-island No: 19674
tcacacaaacgaaaaaaaaaaaacaaccgttcctaaaaaaataaaaaaattacctaaatacgaccccgaacgacttctcgtaaacactacccataaccgcgataaaatctactaaacaaccgcgtaaacgtacgaaaaacgatacgaaaaaacgaaaaaaaaaaaataatacaatataaaaacgcgaaaaaaaaaaaatacccgaaactccgaaaaaatacgtacgcactaacgaactcccgacccaaatcccgcgcccccgactacgcccaccctaaaccccgacccgcaacccccaaaaaccttattcctcaaacacgaatacgcgtacgcgcgcgatacgaaacgcaaaatacaaaatacgaaacgctacccgccgacctaaaaccccgaaataacgcgcgaccgcaataccgcaaaaacacgcaaacccgacgcgaaactcaaatacctcgaacgaaaacccgtatccccctacctaccgccgcaccacctaccgaatcatcctcccatccccacccgcgccttatacccgcgccgcgcccgcgcccaccccgacgacgcccgcgcgcccaaaacaccacttacccgaacataaacacgaccgccgccgcgacctcgactccgacgaacgctatcgctacgaacgaacgtcaaacgaacaacgatccgctccaaaaataaaaaaacctaaacacgaaacgacctaaccgacgacgcgaaacgcgaccctctacgacgaacgaaaactacgaccgaatactccccacgctctacacccgcgacgaacgacgcgacgcgctcgactccaaccgcaactctaaacgcgaaaaaaaaaaaaaaaaaaaaaaaaaaactaaataaaaaaaaaaaaaaaaaaaaaaaacgaacgcgaaaaacgatacgcgacgcaaaaacctcgaaactcaaaaactacgcgcccga

SEQ ID NO: 19675 - DNA, 945 bp, Artificial Sequence
  chemically treated genomic DNA (Homo sapiens) CpG-island No: 19675
ttatataggcgaggagggggagatagtcgtttttggagggatggagaagttatttaagtgcggtttcgggcggtttttcgtgggtattgtttatgatcgcggtggggtttgttgggtagtcgcgtgggcgtgcggggaacggtgcgggaaggcgagaggggaaggatgatatagtgtgagggcgcgggggggagggggtgttcgaggtttcgggaaggtgcgtgcgtattggcgggttttcggtttagatttcgcgttttcggttgcgtttattttgagtttcggttcgtagtttttaagggttttgttttttagatacggatgcgcgtgcgcgcgcgatgcggggcgtagggtgtagggtgcggggcgttgttcgtcggtttggggtttcggggtgacgcgcggtcgtagtgtcgtaaggatacgtaggttcggcgcggggtttaggtgtttcgggcggggattcgtgtttttttatttgtcgtcgtattatttgtcgggttatttttttatttttattcgcgttttgtgttcgcgtcgcgttcgcgtttatttcggcggcgttcgcgcgtttagagtattatttattcgggtatgggtacggtcgtcgtcgcggtttcggtttcggcgggcgttgtcgttgcgggcgggcgttaggcgggtaacgattcgttttaaggatggaaaggtttgggtacggggcggtttggtcggcggcgcgggacgcgattttttgcggcgagcgagggttgcggtcgagtgttttttacgttttgtattcgcggcgggcgacgcggcgcgttcggttttaatcgtagttttgagcgcggagggagggaggggggaggggagggagttgggtgaggaggagggagggaggagggagcgggcgcggggggcggtgcgcggcgtaggggtttcggggtttaggagttacgcgttcgg

SEQ ID NO: 19676 - DNA, 945 bp, Artificial Sequence
  chemically treated genomic DNA (Homo sapiens) CpG-island No: 19676
ccgaacgcgtaactcctaaaccccgaaacccctacgccgcgcaccgccccccgcgcccgctccctcctccctccctcctcctcacccaactccctcccctcccccctccctccctccgcgctcaaaactacgattaaaaccgaacgcgccgcgtcgcccgccgcgaatacaaaacgtaaaaaacactcgaccgcaaccctcgctcgccgcaaaaaatcgcgtcccgcgccgccgaccaaaccgccccgtacccaaacctttccatccttaaaacgaatcgttacccgcctaacgcccgcccgcaacgacaacgcccgccgaaaccgaaaccgcgacgacgaccgtacccatacccgaataaataatactctaaacgcgcgaacgccgccgaaataaacgcgaacgcgacgcgaacacaaaacgcgaataaaaataaaaaaataacccgacaaataatacgacgacaaataaaaaaacacgaatccccgcccgaaacacctaaaccccgcgccgaacctacgtatccttacgacactacgaccgcgcgtcaccccgaaaccccaaaccgacgaacaacgccccgcaccctacaccctacgccccgcatcgcgcgcgcacgcgcatccgtatctaaaaaacaaaacccttaaaaactacgaaccgaaactcaaaataaacgcaaccgaaaacgcgaaatctaaaccgaaaacccgccaatacgcacgcaccttcccgaaacctcgaacaccccctcccccccgcgccctcacactatatcatccttcccctctcgccttcccgcaccgttccccgcacgcccacgcgactacccaacaaaccccaccgcgatcataaacaatacccacgaaaaaccgcccgaaaccgcacttaaataacttctccatccctccaaaaacgactatctccccctcctcgcctatataa

SEQ ID NO: 19677 - DNA, 789 bp, Artificial Sequence
  chemically treated genomic DNA (Homo sapiens) CpG-island No: 19677
  misc_feature (379)..(379): n is either a, c, g or t
ttatcgtttaagtttttgtagaggtttagggtcgagtttcggatatgcgtatgcgtacgcgtattcggtcggttaggtgagaaggaggcggtcgtttcgtatttgggttttaattttttttagttacgggagtgggcggagtgtacgtagggacggagtcgggggcgagtagcgagagaggtcgggtttgatttttgaggcggggtgggtagcgttcggggagcgcgtcgagtcgtttttagtttggggttcgcgcgcgtcgcggggaggagggggagtgtcgaggggagcgaagtttcgcgagatcgcgcggcggcggcgggagcggcggcggcggcggtcggggaggtgagcggcgggcggtggcggtcgttggggnttgaggtcgggtgagagcggtcgagatcgagggttgggtgggggagcgggtttggtgaatatttcgcgttttaggtagttatttttgttcgttttcgtagtagttgcggcgtcgtttggttcgtatcgttttcgggattcgcgcggggcggggcggtcggggtcgcgggtcggtgttttttttaatcggttttcgcgttcgggcgcgatttcggggtcgttttagtgtttatttcgattgtagagttggttttgttgatagtggtagcggcgtttatggagtttttgttgtgtgtcgggtatttaagttgcgcgtttgtacgtcggggttgtatagagaggtggagcgttcgggttagagttatattgcgaggaggcggtgggaggggatcgggatttttgcgttttttt

SEQ ID NO: 19678 - DNA, 789 bp, Artificial Sequence
  chemically treated genomic DNA (Homo sapiens) CpG-island No: 19678
  misc_feature (411)..(411): n is either a, c, g or t
aaaaaaacgcaaaaatcccgatcccctcccaccgcctcctcgcaatataactctaacccgaacgctccacctctctatacaaccccgacgtacaaacgcgcaacttaaatacccgacacacaacaaaaactccataaacgccgctaccactatcaacaaaaccaactctacaatcgaaataaacactaaaacgaccccgaaatcgcgcccgaacgcgaaaaccgattaaaaaaaacaccgacccgcgaccccgaccgccccgccccgcgcgaatcccgaaaacgatacgaaccaaacgacgccgcaactactacgaaaacgaacaaaaataactacctaaaacgcgaaatattcaccaaacccgctcccccacccaaccctcgatctcgaccgctctcacccgacctcaanccccaacgaccgccaccgcccgccgctcacctccccgaccgccgccgccgccgctcccgccgccgccgcgcgatctcgcgaaacttcgctcccctcgacactccccctcctccccgcgacgcgcgcgaaccccaaactaaaaacgactcgacgcgctccccgaacgctacccaccccgcctcaaaaatcaaacccgacctctctcgctactcgcccccgactccgtccctacgtacactccgcccactcccgtaactaaaaaaaattaaaacccaaatacgaaacgaccgcctccttctcacctaaccgaccgaatacgcgtacgcatacgcatatccgaaactcgaccctaaacctctacaaaaacttaaacgataa

SEQ ID NO: 19679 - DNA, 789 bp, Artificial Sequence
  chemically treated genomic DNA (Homo sapiens) CpG-island No: 19679
  misc_feature (411)..(411): n is either a, c, g or t
aagggggcgtaggggtttcggtttttttttatcgttttttcgtagtgtggttttggttcgggcgttttatttttttgtgtagtttcggcgtgtaagcgcgtaatttaagtgttcggtatatagtagaggttttataaacgtcgttgttattgttagtagggttaattttgtagtcgagatggatattgaggcggtttcggggtcgcgttcgggcgcgaggatcggttgaaggaggtatcggttcgcggtttcggtcgtttcgtttcgcgcgagtttcggggacggtgcggattaaacggcgtcgtagttgttgcggggacgaatagggatggttgtttgggacgcgggatgtttattaggttcgtttttttatttagttttcggtttcggtcgtttttattcggttttagnttttaacggtcgttatcgttcgtcgtttattttttcggtcgtcgtcgtcgtcgttttcgtcgtcgtcgcgcgatttcgcgagatttcgtttttttcggtattttttttttttttcgcggcgcgcgcggattttaggttagaagcggttcggcgcgtttttcggacgttgtttatttcgttttaagggttaagttcggtttttttcgttgttcgttttcgatttcgtttttgcgtgtatttcgtttattttcgtgattgggaagggttaaagtttaggtgcgaggcggtcgttttttttttatttggtcggtcgggtgcgcgtgcgtatgcgtatgttcggggttcggttttgagtttttgtaaaggtttggacggtgg

SEQ ID NO: 19680 - DNA, 789 bp, Artificial Sequence
  chemically treated genomic DNA (Homo sapiens) CpG-island No: 19680
  misc_feature (379)..(379): n is either a, c, g or t
ccaccgtccaaacctttacaaaaactcaaaaccgaaccccgaacatacgcatacgcacgcgcacccgaccgaccaaataaaaaaaaaacgaccgcctcgcacctaaactttaacccttcccaatcacgaaaataaacgaaatacacgcaaaaacgaaatcgaaaacgaacaacgaaaaaaaccgaacttaacccttaaaacgaaataaacaacgtccgaaaaacgcgccgaaccgcttctaacctaaaatccgcgcgcgccgcgaaaaaaaaaaaaaataccgaaaaaaacgaaatctcgcgaaatcgcgcgacgacgacgaaaacgacgacgacgacgaccgaaaaaataaacgacgaacgataacgaccgttaaaanctaaaaccgaataaaaacgaccgaaaccgaaaactaaataaaaaaacgaacctaataaacatcccgcgtcccaaacaaccatccctattcgtccccgcaacaactacgacgccgtttaatccgcaccgtccccgaaactcgcgcgaaacgaaacgaccgaaaccgcgaaccgatacctccttcaaccgatcctcgcgcccgaacgcgaccccgaaaccgcctcaatatccatctcgactacaaaattaaccctactaacaataacaacgacgtttataaaacctctactatataccgaacacttaaattacgcgcttacacgccgaaactacacaaaaaaataaaacgcccgaaccaaaaccacactacgaaaaaacgataaaaaaaaaccgaaacccctacgccccctt

SEQ ID NO: 19681 - DNA, 755 bp, Artificial Sequence
  chemically treated genomic DNA (Homo sapiens) CpG-island No: 19681
gggaattcgcgaattggagtttcgttttttttttggcgttttgttttttttttggagtttttttttaaggatttcgggagtttattttatagtgaggcgggtcgaggtcggcgcgtatcgaggggattcgggattcggttagttcgcggtagggtcggggtaaagcgggcgcggggttcgaggaacgcggggtcgttggggtttcgggagtcgtttttgttttcggggagagggagttgggcgcgaagggttttcgggtttcgggatggagatttatttcgattggaggattaataagatgtttaggaggattggaagaattttggataatattttcgcggagatcggcgcgattatttgcgcggaggtcgcggtttacgttttggtcgtattgagcgcggggcggaggtttttgttgggttttaatttttattttttttattcgtttcgtttcgtttcgcgtttttcgttttaggttcgtttcgatggaaattttcgacgacgtgacggttgttgcggtggggagtcggggaggttcgcgcgggcgcgggaaggaggcgggagttcggttgttgaggtttttcgtttttacgtcgttattgcggcgttgttagatagttaggggcgggggaggcggagggaggaggcggcgagttcgcggcgcggggtttgggcgggggaaattcgcgttttaggttgtggtcggtagggagttgttttagggataagatgtggggttggatgtgtttacgttt

SEQ ID NO: 19682 - DNA, 755 bp, Artificial Sequence
  chemically treated genomic DNA (Homo sapiens) CpG-island No: 19682
aaacgtaaacacatccaaccccacatcttatccctaaaacaactccctaccgaccacaacctaaaacgcgaatttcccccgcccaaaccccgcgccgcgaactcgccgcctcctccctccgcctcccccgcccctaactatctaacaacgccgcaataacgacgtaaaaacgaaaaacctcaacaaccgaactcccgcctccttcccgcgcccgcgcgaacctccccgactccccaccgcaacaaccgtcacgtcgtcgaaaatttccatcgaaacgaacctaaaacgaaaaacgcgaaacgaaacgaaacgaataaaaaaaataaaaattaaaacccaacaaaaacctccgccccgcgctcaatacgaccaaaacgtaaaccgcgacctccgcgcaaataatcgcgccgatctccgcgaaaatattatccaaaattcttccaatcctcctaaacatcttattaatcctccaatcgaaataaatctccatcccgaaacccgaaaacccttcgcgcccaactccctctccccgaaaacaaaaacgactcccgaaaccccaacgaccccgcgttcctcgaaccccgcgcccgctttaccccgaccctaccgcgaactaaccgaatcccgaatcccctcgatacgcgccgacctcgacccgcctcactataaaataaactcccgaaatccttaaaaaaaaactccaaaaaaaaaacaaaacgccaaaaaaaaaacgaaactccaattcgcgaattccc

SEQ ID NO: 19683 - DNA, 755 bp, Artificial Sequence
  chemically treated genomic DNA (Homo sapiens) CpG-island No: 19683
gggcgtgagtatatttagttttatattttgtttttgaagtagttttttgtcggttatagtttggggcgcgagtttttttcgtttaggtttcgcgtcgcgggttcgtcgtttttttttttcgtttttttcgtttttggttgtttggtagcgtcgtagtggcggcgtggggacggggggttttagtaatcgggttttcgtttttttttcgcgttcgcgcgagttttttcggttttttatcgtagtagtcgttacgtcgtcggagatttttatcggggcgggtttggggcggggagcgcgggacggggcggggcgagtgggaggagtgaaagttggagtttagtaaaagttttcgtttcgcgtttagtgcggttagagcgtgagtcgcgattttcgcgtaggtggtcgcgtcggttttcgcggaaatgttgtttaaagtttttttagtttttttaggtattttattgattttttagtcgaggtgagtttttatttcgggattcgggagtttttcgcgtttagtttttttttttcgggagtagggacggttttcgggattttagcggtttcgcgtttttcgagtttcgcgttcgttttgtttcggttttatcgcgggttggtcgagtttcgagttttttcgatgcgcgtcggtttcggttcgttttattgtaggatgggttttcggggtttttgagggggagttttaaaaggaagataggacgttagaaggaagacgggattttagttcgcggattttt

SEQ ID NO: 19684 - DNA, 755 bp, Artificial Sequence
  chemically treated genomic DNA (Homo sapiens) CpG-island No: 19684
aaaaatccgcgaactaaaatcccgtcttccttctaacgtcctatcttccttttaaaactccccctcaaaaaccccgaaaacccatcctacaataaaacgaaccgaaaccgacgcgcatcgaaaaaactcgaaactcgaccaacccgcgataaaaccgaaacaaaacgaacgcgaaactcgaaaaacgcgaaaccgctaaaatcccgaaaaccgtccctactcccgaaaaaaaaaaactaaacgcgaaaaactcccgaatcccgaaataaaaactcacctcgactaaaaaatcaataaaatacctaaaaaaactaaaaaaactttaaacaacatttccgcgaaaaccgacgcgaccacctacgcgaaaatcgcgactcacgctctaaccgcactaaacgcgaaacgaaaacttttactaaactccaactttcactcctcccactcgccccgccccgtcccgcgctccccgccccaaacccgccccgataaaaatctccgacgacgtaacgactactacgataaaaaaccgaaaaaactcgcgcgaacgcgaaaaaaaaacgaaaacccgattactaaaaccccccgtccccacgccgccactacgacgctaccaaacaaccaaaaacgaaaaaaacgaaaaaaaaaaacgacgaacccgcgacgcgaaacctaaacgaaaaaaactcgcgccccaaactataaccgacaaaaaactacttcaaaaacaaaatataaaactaaatatactcacgccc

SEQ ID NO: 19685 - DNA, 916 bp, Artificial Sequence
  chemically treated genomic DNA (Homo sapiens) CpG-island No: 19685
ttagcggggacgttgtaaggacgggcgttgcgtgtgtgatttcggttatattggcgaggattgtggtacgcggagttgtttttgggattgtggcgagggcgggcgttgcgtggacggtcgttgcgtgtgttggttcgggtatataggcgaggattgtagtacgcggatatgttcgagggattgtcggggtcgcgggcgttgcgaggacggcgaatgtatttgcgatacgggttatagcggggacgattgcggcgtgcgtagttgttttggcgattgtaattaaaggggtcgttgcgaggacggtcgttgcgtgtgttggtcggggtatattggaatcgattgcggttcgcgcgtttgtttacgcgattgtagaggtcgcgggcgttgcgagaacggcgtgtgtgtttgtaatgcgggttatagcggcgaggattgcggtgtgcgtagttgttttggggattgtcgtggtcggggtcgttgtgagagtggtcgttgtatgtgttggtcggggtatataggtcgggattgcggtacgcgcgtttgttttggcgattgtcgcgggcgcgggcgttgcgtggatggtcgttgcgtgtgtaattcgggttttatcggtgaggattgtgggagtcgtcgttgtttcggggattgtcgtgggtacggtttttgcgaggatggcgtgtgcgtgtgtgacgtaggttatttaggggaagattgtagtacgcgtagttgtttcgggggttgtcgaggtcgcggttagtgtttagatgggcggtgtgtgtgcgaggacggttattttggcgaggattgcggtgtgaggtagtgttcgaatgattgtagttagtacggcgtgtgttaggacggtgtgtgtatttgttgggaaggttacgtgagtgaggattgtagtattcgtatttgt

SEQ ID NO: 19686 - DNA, 916 bp, Artificial Sequence
  chemically treated genomic DNA (Homo sapiens) CpG-island No: 19686
acaaatacgaatactacaatcctcactcacgtaaccttcccaacaaatacacacaccgtcctaacacacgccgtactaactacaatcattcgaacactacctcacaccgcaatcctcgccaaaataaccgtcctcgcacacacaccgcccatctaaacactaaccgcgacctcgacaacccccgaaacaactacgcgtactacaatcttcccctaaataacctacgtcacacacgcacacgccatcctcgcaaaaaccgtacccacgacaatccccgaaacaacgacgactcccacaatcctcaccgataaaacccgaattacacacgcaacgaccatccacgcaacgcccgcgcccgcgacaatcgccaaaacaaacgcgcgtaccgcaatcccgacctatataccccgaccaacacatacaacgaccactctcacaacgaccccgaccacgacaatccccaaaacaactacgcacaccgcaatcctcgccgctataacccgcattacaaacacacacgccgttctcgcaacgcccgcgacctctacaatcgcgtaaacaaacgcgcgaaccgcaatcgattccaatataccccgaccaacacacgcaacgaccgtcctcgcaacgacccctttaattacaatcgccaaaacaactacgcacgccgcaatcgtccccgctataacccgtatcgcaaatacattcgccgtcctcgcaacgcccgcgaccccgacaatccctcgaacatatccgcgtactacaatcctcgcctatatacccgaaccaacacacgcaacgaccgtccacgcaacgcccgccctcgccacaatcccaaaaacaactccgcgtaccacaatcctcgccaatataaccgaaatcacacacgcaacgcccgtccttacaacgtccccgctaa

SEQ ID NO: 19687 - DNA, 916 bp, Artificial Sequence
  chemically treated genomic DNA (Homo sapiens) CpG-island No: 19687
gtaggtgcggatgttgtagtttttatttacgtagtttttttaatagatgtatatatcgttttggtatacgtcgtgttggttgtagttattcgggtattgttttatatcgtaattttcgttagagtagtcgttttcgtatatatatcgtttatttaggtattggtcgcggtttcggtagttttcggggtagttgcgcgtgttgtagtttttttttgagtagtttgcgttatatacgtatacgttattttcgtaaaggtcgtgtttacggtagttttcgggatagcgacggtttttatagtttttatcggtgaagttcgggttgtatacgtagcggttatttacgtagcgttcgcgttcgcgatagtcgttaggataggcgcgcgtgtcgtagtttcggtttgtgtatttcggttaatatatgtagcggttatttttatagcggtttcggttacgatagtttttaggatagttgcgtatatcgtagttttcgtcgttgtagttcgtattgtaaatatatacgtcgttttcgtagcgttcgcgatttttatagtcgcgtgggtaggcgcgcgagtcgtaatcggttttagtgtatttcggttagtatacgtagcggtcgttttcgtagcggtttttttggttgtagtcgttagggtagttgcgtacgtcgtagtcgttttcgttgtagttcgtgtcgtaaatgtattcgtcgttttcgtagcgttcgcggtttcggtagtttttcggatatgttcgcgtgttgtagttttcgtttgtgtattcgggttagtatacgtagcggtcgtttacgtagcgttcgttttcgttatagttttaggggtagtttcgcgtattatagttttcgttagtgtagtcggggttatatacgtagcgttcgtttttgtagcgttttcgttgg

SEQ ID NO: 19688 - DNA, 916 bp, Artificial Sequence
  chemically treated genomic DNA (Homo sapiens) CpG-island No: 19688
ccaacgaaaacgctacaaaaacgaacgctacgtatataaccccgactacactaacgaaaactataatacgcgaaactacccctaaaactataacgaaaacgaacgctacgtaaacgaccgctacgtatactaacccgaatacacaaacgaaaactacaacacgcgaacatatccgaaaaactaccgaaaccgcgaacgctacgaaaacgacgaatacatttacgacacgaactacaacgaaaacgactacgacgtacgcaactaccctaacgactacaaccaaaaaaaccgctacgaaaacgaccgctacgtatactaaccgaaatacactaaaaccgattacgactcgcgcgcctacccacgcgactataaaaatcgcgaacgctacgaaaacgacgtatatatttacaatacgaactacaacgacgaaaactacgatatacgcaactatcctaaaaactatcgtaaccgaaaccgctataaaaataaccgctacatatattaaccgaaatacacaaaccgaaactacgacacgcgcgcctatcctaacgactatcgcgaacgcgaacgctacgtaaataaccgctacgtatacaacccgaacttcaccgataaaaactataaaaaccgtcgctatcccgaaaactaccgtaaacacgacctttacgaaaataacgtatacgtatataacgcaaactactcaaaaaaaaactacaacacgcgcaactaccccgaaaactaccgaaaccgcgaccaatacctaaataaacgatatatatacgaaaacgactactctaacgaaaattacgatataaaacaatacccgaataactacaaccaacacgacgtataccaaaacgatatatacatctattaaaaaaactacgtaaataaaaactacaacatccgcacctac

SEQ ID NO: 19689 - DNA, 1282 bp, Artificial Sequence
  chemically treated genomic DNA (Homo sapiens) CpG-island No: 19689
ggagtcggagtcgttttcggttgcgttttgtttttgaatttcgattttcgtcggttttcgggaaaatcgtagcggggtagcgcgggcgttgtcggaatttgtagttttatttttcgtcgcgttaaatagtcggaaacgggggcggttagaatagagaattatcgaggcgaaggtacgggtggcggcgaggggttaattcgcgtcgggggtggggttggttgtgaggtcgtcggaggtggttgggtgggaggagattcgtttatatatacgaggaggagggttgagttgtcgtcgtcgtcgtttttgtcgtcgtcgcgagtgtggagtcgggattggagttgttgtcgcggcgacgtcggggatttttgtcgttagttttcggtttttttgtttcgtcgtttttttttagttagcgttgtttattttttttcggtcgggcgtttttgtttttatttttcgttttttgtttattatatatacggttttttcgattatggattcgggtagtggcggcggcggcggcggcggcggcggcggcgggagtagtagcggtagtagtagtagcgattcggcgtttgattgttgggattaggcggatatggaagttttcgggtcgggtttttgcggcggcggcggttttttggcggcggcggtcgaggtttagcgggagaattttagcgcggtttttagtcggtaatttaacgttaacgttaagtttttcgtgtttaacgtttacgtcgtcgagttcgtgtcgttttttttgcggggttcggtagcgtcgttatttttagttggcggcgtttttaataattacggagtcggtagcggcgcgggaggtcgtgcgggtaaaggttcgggacgcgggaggaagttcggtcgggcgtcggagtttatatggcgtaggggtgcggttcgggggcgcgcggttttggggttcggtcggtacgtggggcgttgatagtggcgtcgtttgtttgggtggggcgtttcgagttcgggagtcggttttcgcggggcggttcgcggcggtggtcgggcggggagcggatagcgggtagcgcgtttaaagattcggattcgagtgtcgttttttcgcgtttttgttttgttttggagttcgtagttatttatttgagatgggaatcgtatggaacggagtgggggtcgcggcggatttttgttacgaggcgtagaatgaggatagatggagttaggagttatttgggtgggcgtttagagattttaggagttggggaggacgaatggtcgagtttttttttta

SEQ ID NO: 19690 - DNA, 1282 bp, Artificial Sequence
  chemically treated genomic DNA (Homo sapiens) CpG-island No: 19690
taaaaaaaaaactcgaccattcgtcctccccaactcctaaaatctctaaacgcccacccaaataactcctaactccatctatcctcattctacgcctcgtaacaaaaatccgccgcgacccccactccgttccatacgattcccatctcaaataaataactacgaactccaaaacaaaacaaaaacgcgaaaaaacgacactcgaatccgaatctttaaacgcgctacccgctatccgctccccgcccgaccaccgccgcgaaccgccccgcgaaaaccgactcccgaactcgaaacgccccacccaaacaaacgacgccactatcaacgccccacgtaccgaccgaaccccaaaaccgcgcgcccccgaaccgcacccctacgccatataaactccgacgcccgaccgaacttcctcccgcgtcccgaacctttacccgcacgacctcccgcgccgctaccgactccgtaattattaaaaacgccgccaactaaaaataacgacgctaccgaaccccgcaaaaaaaacgacacgaactcgacgacgtaaacgttaaacacgaaaaacttaacgttaacgttaaattaccgactaaaaaccgcgctaaaattctcccgctaaacctcgaccgccgccgccaaaaaaccgccgccgccgcaaaaacccgacccgaaaacttccatatccgcctaatcccaacaatcaaacgccgaatcgctactactactaccgctactactcccgccgccgccgccgccgccgccgccgccgccactacccgaatccataatcgaaaaaaccgtatatataataaacaaaaaacgaaaaataaaaacaaaaacgcccgaccgaaaaaaaataaacaacgctaactaaaaaaaaacgacgaaacaaaaaaaccgaaaactaacgacaaaaatccccgacgtcgccgcgacaacaactccaatcccgactccacactcgcgacgacgacaaaaacgacgacgacgacaactcaaccctcctcctcgtatatataaacgaatctcctcccacccaaccacctccgacgacctcacaaccaaccccacccccgacgcgaattaacccctcgccgccacccgtaccttcgcctcgataattctctattctaaccgcccccgtttccgactatttaacgcgacgaaaaataaaactacaaattccgacaacgcccgcgctaccccgctacgattttcccgaaaaccgacgaaaatcgaaattcaaaaacaaaacgcaaccgaaaacgactccgactcc

SEQ ID NO: 19691 - DNA, 1282 bp, Artificial Sequence
  chemically treated genomic DNA (Homo sapiens) CpG-island No: 19691
tgaaaggaaaattcggttattcgttttttttaatttttgggatttttaaacgtttatttaaatgatttttggttttatttgtttttattttgcgtttcgtggtagggattcgtcgcggtttttatttcgttttatacggtttttattttaagtgggtaattgcggattttagagtagggtaggggcgcggaggggcggtattcgggttcgggtttttgggcgcgttgttcgttgttcgtttttcgttcggttatcgtcgcgggtcgtttcgcgaaggtcggttttcgggttcggggcgttttatttaggtagacggcgttattgttagcgttttacgtgtcgatcgggttttagggtcgcgcgttttcggatcgtatttttacgttatgtgggtttcggcgttcggtcggattttttttcgcgtttcgggtttttattcgtacggtttttcgcgtcgttgtcggtttcgtggttattgggggcgtcgttagttgggggtggcggcgttgtcgggtttcgtaggaaggacggtacgaattcggcggcgtggacgttgggtacgaagggtttggcgttgacgttgagttgtcggttgaaggtcgcgttgaggttttttcgttgggtttcggtcgtcgtcgttagggagtcgtcgtcgtcgtaagggttcggttcgggggtttttatgttcgtttggttttagtagttaggcgtcgagtcgttgttgttgttgtcgttgttgttttcgtcgtcgtcgtcgtcgtcgtcgtcgtcgttattgttcggatttatgatcgggggggtcgtgtgtgtggtggatagagagcgggaaatggaggtaggggcgttcggtcggagaggagtgggtaacgttgattgagggaaggcggcggggtagaagggtcgggagttagcgataaagattttcggcgtcgtcgcggtagtagttttagtttcgattttatattcgcgacgacgatagaggcggcggcggcggtagtttaattttttttttcgtgtgtgtgagcggatttttttttatttaattattttcgacggttttatagttaattttattttcggcgcggattgatttttcgtcgttattcgtattttcgtttcggtagttttttgttttggtcgttttcgttttcggttatttagcgcggcgggaggtggaattataagtttcggtagcgttcgcgttatttcgttgcggttttttcgggggtcgacgggagtcgaagtttagggatagggcgtaatcggaagcggtttcggtttt

SEQ ID NO: 19692 - DNA, 1282 bp, Artificial Sequence
  chemically treated genomic DNA (Homo sapiens) CpG-island No: 19692
aaaaccgaaaccgcttccgattacgccctatccctaaacttcgactcccgtcgacccccgaaaaaaccgcaacgaaataacgcgaacgctaccgaaacttataattccacctcccgccgcgctaaataaccgaaaacgaaaacgaccaaaacaaaaaactaccgaaacgaaaatacgaataacgacgaaaaatcaatccgcgccgaaaataaaattaactataaaaccgtcgaaaataattaaataaaaaaaaatccgctcacacacacgaaaaaaaaaattaaactaccgccgccgccgcctctatcgtcgtcgcgaatataaaatcgaaactaaaactactaccgcgacgacgccgaaaatctttatcgctaactcccgacccttctaccccgccgccttccctcaatcaacgttacccactcctctccgaccgaacgcccctacctccatttcccgctctctatccaccacacacacgacccccccgatcataaatccgaacaataacgacgacgacgacgacgacgacgacgacgaaaacaacaacgacaacaacaacaacgactcgacgcctaactactaaaaccaaacgaacataaaaacccccgaaccgaacccttacgacgacgacgactccctaacgacgacgaccgaaacccaacgaaaaaacctcaacgcgaccttcaaccgacaactcaacgtcaacgccaaacccttcgtacccaacgtccacgccgccgaattcgtaccgtccttcctacgaaacccgacaacgccgccacccccaactaacgacgcccccaataaccacgaaaccgacaacgacgcgaaaaaccgtacgaataaaaacccgaaacgcgaaaaaaaatccgaccgaacgccgaaacccacataacgtaaaaatacgatccgaaaacgcgcgaccctaaaacccgatcgacacgtaaaacgctaacaataacgccgtctacctaaataaaacgccccgaacccgaaaaccgaccttcgcgaaacgacccgcgacgataaccgaacgaaaaacgaacaacgaacaacgcgcccaaaaacccgaacccgaataccgcccctccgcgcccctaccctactctaaaatccgcaattacccacttaaaataaaaaccgtataaaacgaaataaaaaccgcgacgaatccctaccacgaaacgcaaaataaaaacaaataaaaccaaaaatcatttaaataaacgtttaaaaatcccaaaaattaaaaaaaacgaataaccgaattttcctttca

SEQ ID NO: 19693 - DNA, 800 bp, Artificial Sequence
  chemically treated genomic DNA (Homo sapiens) CpG-island No: 19693
gttcggaggttgtatgtttttcgtcgtcgggtagtagtagttttttcggggtacggcggattcggtttttttcgtcgcgtttttagcgttcggggttagtttcggtatttttttatgagttttttcgggcgcggttttcgtttttcgggtttacgcgcggttagtagttttatcggtttttagtttagggattcgtcgtcgtcgtcgtcgtcgtttgcgcgaaagtcggcgttttagaagtcgttttggttgtcggtcgttcgttttttaggtcgcgtttgattcgtcgttttttttgtcggtcggtagttattttcgataggcgattgcggaatttgtcgaagggcgtcgcgtcggaaatggtcgaagtcggcgttcgcgagcgggggcgcggacgcgggcgcgcgttcgttattttttcgatcgcgttcgaagatcgtcgaggtttttcgtagtttcgcggtgatattcgggttaggggcgcggggtcgggcgtcggggattgtgggaggcgcgggggggcgcgtcggtcgttttcggagttttttaattcgcgttttgtaaaggtcgtcgggttttgtcgagaagattcgatcgtagatggcggggaggatgttttcggcggcgtgggaatcgggtttgattttcgagttatcgtcgttttcgtaggggcgtcggtttcgggaaagttaagttataaatttttgaatttaaaattttatttttagagaaaaggtttttaaggacgggcgtcgtgcgcggtaattgtttgtagttttgaagttttttgattattttat

SEQ ID NO: 19694 - DNA, 800 bp, Artificial Sequence
  chemically treated genomic DNA (Homo sapiens) CpG-island No: 19694
ataaaataatcaaaaaacttcaaaactacaaacaattaccgcgcacgacgcccgtccttaaaaaccttttctctaaaaataaaattttaaattcaaaaatttataacttaactttcccgaaaccgacgcccctacgaaaacgacgataactcgaaaatcaaacccgattcccacgccgccgaaaacatcctccccgccatctacgatcgaatcttctcgacaaaacccgacgacctttacaaaacgcgaattaaaaaactccgaaaacgaccgacgcgcccccccgcgcctcccacaatccccgacgcccgaccccgcgcccctaacccgaatatcaccgcgaaactacgaaaaacctcgacgatcttcgaacgcgatcgaaaaaataacgaacgcgcgcccgcgtccgcgcccccgctcgcgaacgccgacttcgaccatttccgacgcgacgcccttcgacaaattccgcaatcgcctatcgaaaataactaccgaccgacaaaaaaaacgacgaatcaaacgcgacctaaaaaacgaacgaccgacaaccaaaacgacttctaaaacgccgactttcgcgcaaacgacgacgacgacgacgacgaatccctaaactaaaaaccgataaaactactaaccgcgcgtaaacccgaaaaacgaaaaccgcgcccgaaaaaactcataaaaaaataccgaaactaaccccgaacgctaaaaacgcgacgaaaaaaaccgaatccgccgtaccccgaaaaaactactactacccgacgacgaaaaacatacaacctccgaac

SEQ ID NO: 19695 - DNA, 800 bp, Artificial Sequence
  chemically treated genomic DNA (Homo sapiens) CpG-island No: 19695
atgaaatagttaaagggttttaaaattgtaggtagttgtcgcgtacggcgttcgtttttggaggttttttttttgagaatggagttttagatttagggatttatgatttgattttttcggggtcggcgtttttgcggaagcggcggtggttcgggagttagattcggtttttacgtcgtcgggagtatttttttcgttatttgcggtcgggttttttcgatagggttcggcggtttttgtaggacgcgagttggggggtttcgaaggcggtcggcgcgttttttcgcgttttttataattttcggcgttcggtttcgcgtttttgattcgggtgttatcgcggagttgcgggaggtttcggcggttttcggacgcggtcgggaaagtggcgagcgcgcgttcgcgttcgcgttttcgttcgcgaacgtcggtttcggttattttcggcgcggcgtttttcggtaagtttcgtagtcgtttgtcggaaatggttgtcggtcggtagggggagcggcggattaggcgcggtttggaaggcgggcggtcggtagttagaacggtttttgggacgtcgattttcgcgtaggcggcggcggcggcggcggcgggtttttgagttggaagtcggtaggattgttggtcgcgcgtgagttcgaggagcgggggtcgcgttcggaagggtttatgggagggtgtcggggttggtttcgagcgttggggacgcggcgggagggatcgggttcgtcgtgtttcggggaggttgttgttgttcggcggcgggaggtatgtagttttcgagt

SEQ ID NO: 19696 - DNA, 800 bp, Artificial Sequence
  chemically treated genomic DNA (Homo sapiens) CpG-island No: 19696
actcgaaaactacatacctcccgccgccgaacaacaacaacctccccgaaacacgacgaacccgatccctcccgccgcgtccccaacgctcgaaaccaaccccgacaccctcccataaacccttccgaacgcgacccccgctcctcgaactcacgcgcgaccaacaatcctaccgacttccaactcaaaaacccgccgccgccgccgccgccgcctacgcgaaaatcgacgtcccaaaaaccgttctaactaccgaccgcccgccttccaaaccgcgcctaatccgccgctccccctaccgaccgacaaccatttccgacaaacgactacgaaacttaccgaaaaacgccgcgccgaaaataaccgaaaccgacgttcgcgaacgaaaacgcgaacgcgaacgcgcgctcgccactttcccgaccgcgtccgaaaaccgccgaaacctcccgcaactccgcgataacacccgaatcaaaaacgcgaaaccgaacgccgaaaattataaaaaacgcgaaaaaacgcgccgaccgccttcgaaaccccccaactcgcgtcctacaaaaaccgccgaaccctatcgaaaaaacccgaccgcaaataacgaaaaaaatactcccgacgacgtaaaaaccgaatctaactcccgaaccaccgccgcttccgcaaaaacgccgaccccgaaaaaatcaaatcataaatccctaaatctaaaactccattctcaaaaaaaaaacctccaaaaacgaacgccgtacgcgacaactacctacaattttaaaaccctttaactatttcat

SEQ ID NO: 19697 - DNA, 1187 bp, Artificial Sequence
  chemically treated genomic DNA (Homo sapiens) CpG-island No: 19697
acgttcgggggaagtttcggaggcggcggaacgtttacggatggaattttgtttttggggaaaaggattatatttgttagtagagttcgttagacgtgagaagggtgggagcggcggattgtgaacgttggtagggtttcggcgtttcgagaaagttttagtttcgcggtcgtttttttttattacgttttcggttttcggtgttatagttgtgggattcggaagtaaaaatataagtttcgttttcgagaattcgggaagtcggcgagaagtgtgaggtcgcggtagggtcgtatttcgtttcggagagaagtttgagttcgttaggttttgtaggttcgcggaagttcggtaatgataagtacgtcggttattttgtagggcgttatcgtttatacgttttttcgtttttcggacggcggcgtttagtttcggggcgttcggtcgtttcgtttttttcgggggaggaattaagaagagattgtttaatagggtcggtttgattcgcgaataggcgagggttttcgggggagtggcgcggtagaaggtttcgtttaggagtcgagggatagtttagaggaggcgtggttacgttgtcggcggaagtggagtttttcgcgagcgcgcgaggtcgtcggggtaggcggggaaatcggatagtaggggcggggtcgggtcggcgatggggatgcgggagtattacgcggagttgtattcgtgttcgtcggaattggggatgtagagtagcggtagcgggtatggtaggtagtcggcgggtcggtttttagcgtaggtgttcgagaggtaggggttggtttgggatgcgcgcgtatttgttttcgtttcgtttcgttcgtacgaggggtggtggtcgaggtttcgtttcgtacgtttcgtttgaggcgggttcgtttagtttaggcgttcgttttcgttttcgtcgattaaatgggtcggcggggtttagttttcggaaacggtcgtatatttcggggttgcgagcgcggagggcgacgacgacgaagcgtaggtaatcggtcgggcgggcgtcgcgtaggcggaggagcgtattgtttcgcgttgcgtcgcgcggcggtaaaatatacgttgtttgttgtgtttgagaatcgagtagaatcgagagggttttaattaatttttttatatttcgtatttttttttttgag

SEQ ID NO: 19698 - DNA, 1187 bp, Artificial Sequence
  chemically treated genomic DNA (Homo sapiens) CpG-island No: 19698
ctcaaaaaaaaaaatacgaaatataaaaaaattaattaaaaccctctcgattctactcgattctcaaacacaacaaacaacgtatattttaccgccgcgcgacgcaacgcgaaacaatacgctcctccgcctacgcgacgcccgcccgaccgattacctacgcttcgtcgtcgtcgccctccgcgctcgcaaccccgaaatatacgaccgtttccgaaaactaaaccccgccgacccatttaatcgacgaaaacgaaaacgaacgcctaaactaaacgaacccgcctcaaacgaaacgtacgaaacgaaacctcgaccaccacccctcgtacgaacgaaacgaaacgaaaacaaatacgcgcgcatcccaaaccaacccctacctctcgaacacctacgctaaaaaccgacccgccgactacctaccatacccgctaccgctactctacatccccaattccgacgaacacgaatacaactccgcgtaatactcccgcatccccatcgccgacccgaccccgcccctactatccgatttccccgcctaccccgacgacctcgcgcgctcgcgaaaaactccacttccgccgacaacgtaaccacgcctcctctaaactatccctcgactcctaaacgaaaccttctaccgcgccactcccccgaaaaccctcgcctattcgcgaatcaaaccgaccctattaaacaatctcttcttaattcctcccccgaaaaaaacgaaacgaccgaacgccccgaaactaaacgccgccgtccgaaaaacgaaaaaacgtataaacgataacgccctacaaaataaccgacgtacttatcattaccgaacttccgcgaacctacaaaacctaacgaactcaaacttctctccgaaacgaaatacgaccctaccgcgacctcacacttctcgccgacttcccgaattctcgaaaacgaaacttatatttttacttccgaatcccacaactataacaccgaaaaccgaaaacgtaataaaaaaaaacgaccgcgaaactaaaactttctcgaaacgccgaaaccctaccaacgttcacaatccgccgctcccacccttctcacgtctaacgaactctactaacaaatataatccttttccccaaaaacaaaattccatccgtaaacgttccgccgcctccgaaacttcccccgaacgt

SEQ ID NO: 19699 - DNA, 1187 bp, Artificial Sequence
  chemically treated genomic DNA (Homo sapiens) CpG-island No: 19699
tttaagagaggaggtgcggggtataaagggattggttaagattttttcgattttgttcggtttttaagtataataaatagcgtgtattttatcgtcgcgcggcgtagcgcgggatagtacgttttttcgtttgcgcggcgttcgttcggtcggttatttgcgtttcgtcgtcgtcgtttttcgcgttcgtagtttcgaagtgtacgatcgttttcgggggttgagtttcgtcggtttatttaatcggcgggggcgggggcgggcgtttgggttgagcggattcgttttaggcgaggcgtgcggggcggggtttcggttattatttttcgtgcgggcggggcggggcgagggtaggtgcgcgcgtattttaggttagtttttgtttttcgggtatttgcgttggaggtcggttcgtcggttgtttgttatattcgttgtcgttgttttgtatttttaatttcggcgggtacgggtgtagtttcgcgtagtgttttcgtatttttatcgtcggttcggtttcgtttttattgttcggttttttcgtttgtttcggcggtttcgcgcgttcgcggagggttttattttcgtcggtagcgtggttacgttttttttgggttgtttttcggtttttgggcggggttttttgtcgcgttattttttcgggaattttcgtttgttcgcgggttaagtcggttttattgggtagtttttttttgatttttttttcggagagggcggggcggtcgagcgtttcgaggttagacgtcgtcgttcgagagacgagggggcgtgtaggcggtgacgttttgtaaagtggtcggcgtgtttattattatcgagttttcgcgggtttgtagagtttggcggatttagattttttttcggagcgggatgcggttttatcgcggttttatatttttcgtcggtttttcgagttttcgggggcggggtttgtgtttttattttcggattttatagttatgatatcggaagtcggaagcgtggtagggaagggcgatcgcgaaattgggattttttcggagcgtcggggttttattagcgtttatagttcgtcgtttttattttttttacgtttgacggattttgttgataggtgtggtttttttttttaaagatagggttttattcgtgggcgtttcgtcgttttcgaaatttttttcggacgt

SEQ ID NO: 19700 - DNA, 1187 bp, Artificial Sequence
  chemically treated genomic DNA (Homo sapiens) CpG-island No: 19700
acgtccgaaaaaaatttcgaaaacgacgaaacgcccacgaataaaaccctatctttaaaaaaaaaaaccacacctatcaacaaaatccgtcaaacgtaaaaaaaataaaaacgacgaactataaacgctaataaaaccccgacgctccgaaaaaatcccaatttcgcgatcgcccttccctaccacgcttccgacttccgatatcataactataaaatccgaaaataaaaacacaaaccccgcccccgaaaactcgaaaaaccgacgaaaaatataaaaccgcgataaaaccgcatcccgctccgaaaaaaaatctaaatccgccaaactctacaaacccgcgaaaactcgataataataaacacgccgaccactttacaaaacgtcaccgcctacacgccccctcgtctctcgaacgacgacgtctaacctcgaaacgctcgaccgccccgccctctccgaaaaaaaaatcaaaaaaaaactacccaataaaaccgacttaacccgcgaacaaacgaaaattcccgaaaaaataacgcgacaaaaaaccccgcccaaaaaccgaaaaacaacccaaaaaaaacgtaaccacgctaccgacgaaaataaaaccctccgcgaacgcgcgaaaccgccgaaacaaacgaaaaaaccgaacaataaaaacgaaaccgaaccgacgataaaaatacgaaaacactacgcgaaactacacccgtacccgccgaaattaaaaatacaaaacaacgacaacgaatataacaaacaaccgacgaaccgacctccaacgcaaatacccgaaaaacaaaaactaacctaaaatacgcgcgcacctaccctcgccccgccccgcccgcacgaaaaataataaccgaaaccccgccccgcacgcctcgcctaaaacgaatccgctcaacccaaacgcccgcccccgcccccgccgattaaataaaccgacgaaactcaacccccgaaaacgatcgtacacttcgaaactacgaacgcgaaaaacgacgacgacgaaacgcaaataaccgaccgaacgaacgccgcgcaaacgaaaaaacgtactatcccgcgctacgccgcgcgacgataaaatacacgctatttattatacttaaaaaccgaacaaaatcgaaaaaatcttaaccaatccctttataccccgcacctcctctcttaaa

SEQ ID NO: 19701 - DNA, 592 bp, Artificial Sequence
  chemically treated genomic DNA (Homo sapiens) CpG-island No: 19701
gatttttcggagattttttcgagattttcgagattcgtcgagatttgtcgggatttcgagattttttcgagattttcgagattcgtcgagaatttttagatagttaaggttcgtcgagttttttttagacgcggagatcgttttttcgcgagattttcgagattcgtcgagattcgtcgtcgaggtttattcgtcgagcgtttttttggttcgcgggttttgggtcgaggcggcggtttgattcggtcgttaggcgttttcgttcgcgggattcgtcgtcgtcgtagtttcgtttcgttcgcgttcgtttagttcgttttttttttggtttcgtttcggtttcgttttttttcggcgggtttcgtaattttggaggttcgagttgggcgtggggcggggtcggtattttagggtgggcggggaattgtacgtggttttcgcggtttcgggacgaggtttttggggggcgaagattggcgttgtcgcgggtttagacgtcgggtttatagtaggtgtttagttttcgttcgtgagtgaggtagcgtgtttgttttttttgcgtgttttttttagtgatattttagtgtttagt

SEQ ID NO: 19702 - DNA, 592 bp, Artificial Sequence
  chemically treated genomic DNA (Homo sapiens) CpG-island No: 19702
actaaacactaaaatatcactaaaaaaaacacgcaaaaaaaacaaacacgctacctcactcacgaacgaaaactaaacacctactataaacccgacgtctaaacccgcgacaacgccaatcttcgccccccaaaaacctcgtcccgaaaccgcgaaaaccacgtacaattccccgcccaccctaaaataccgaccccgccccacgcccaactcgaacctccaaaattacgaaacccgccgaaaaaaaacgaaaccgaaacgaaaccaaaaaaaaaacgaactaaacgaacgcgaacgaaacgaaactacgacgacgacgaatcccgcgaacgaaaacgcctaacgaccgaatcaaaccgccgcctcgacccaaaacccgcgaaccaaaaaaacgctcgacgaataaacctcgacgacgaatctcgacgaatctcgaaaatctcgcgaaaaaacgatctccgcgtctaaaaaaaactcgacgaaccttaactatctaaaaattctcgacgaatctcgaaaatctcgaaaaaatctcgaaatcccgacaaatctcgacgaatctcgaaaatctcgaaaaaatctccgaaaaatc

SEQ ID NO: 19703 - DNA, 592 bp, Artificial Sequence
  chemically treated genomic DNA (Homo sapiens) CpG-island No: 19703
gttgggtattggggtgttattgggagggatacgtaggagggatagatacgttattttatttacgggcgagaattaagtatttattgtggattcggcgtttaggttcgcgataacgttagttttcgttttttaggggtttcgtttcggggtcgcggaggttacgtgtagtttttcgtttattttgaggtatcggtttcgttttacgtttagttcggatttttaggattgcgggattcgtcggggaggggcggggtcggggcggggttaggaggagggcggattgggcgggcgcgggcgggacggagttgcggcggcggcgggtttcgcgggcgggagcgtttggcggtcgagttaagtcgtcgtttcgatttagggttcgcgggttaggagagcgttcggcgggtaagtttcggcggcgggtttcggcgggtttcgggggtttcgcgggggggcggttttcgcgtttggaaggggttcggcgggttttggttgtttgggggttttcggcgggtttcgggggtttcgggggagtttcggggtttcgataggtttcggcgggtttcgggggtttcgggggagttttcggggagtt

SEQ ID NO: 19704 - DNA, 592 bp, Artificial Sequence
  chemically treated genomic DNA (Homo sapiens) CpG-island No: 19704
aactccccgaaaactcccccgaaacccccgaaacccgccgaaacctatcgaaaccccgaaactcccccgaaacccccgaaacccgccgaaaacccccaaacaaccaaaacccgccgaaccccttccaaacgcgaaaaccgcccccccgcgaaacccccgaaacccgccgaaacccgccgccgaaacttacccgccgaacgctctcctaacccgcgaaccctaaatcgaaacgacgacttaactcgaccgccaaacgctcccgcccgcgaaacccgccgccgccgcaactccgtcccgcccgcgcccgcccaatccgccctcctcctaaccccgccccgaccccgcccctccccgacgaatcccgcaatcctaaaaatccgaactaaacgtaaaacgaaaccgatacctcaaaataaacgaaaaactacacgtaacctccgcgaccccgaaacgaaacccctaaaaaacgaaaactaacgttatcgcgaacctaaacgccgaatccacaataaatacttaattctcgcccgtaaataaaataacgtatctatccctcctacgtatccctcccaataacaccccaatacccaac

SEQ ID NO: 19705 - DNA, 816 bp, Artificial Sequence
  chemically treated genomic DNA (Homo sapiens) CpG-island No: 19705
tttcgggcgaagagtttcgtttttcggagttgttttttaggtcgattcggcgtattttttttgttttttgtttcgttacgtgatgtagtttcgttaatcggtacggggaggcgggtagcgggcggtggtcgggggcgggtaggtcgtggggggcggattttagagggggcggagtagggttcggtagtcgagtagtttggtaacggcggtggcgttcggagttcgaggtgggtgcgcgtttacggttggtttggttcggagtcgggtattgcggggattcgtggtgaggggatcgggaggaggaagttgggattttttgggttagcgggtcgcgcggggttttgtcgtatcgttagggttgggtgggggtttcgtttaagcgtcgtcgttgttttcgcggggtagggttgaggttagggagtagtaggtaggtattttcggttttttttcgtttttttcgtttaaggtggtcggtcggcggcgggcgaaggtcgggacgggggtaggggttggttggtcgtggagttgggggcggacgttttagttattgtttggattttgttttttcgtttcggggcggtgagtgggtcgggcgttcgttttgttttttcggcgacgtttcgcggttggttttcgttttggtttttcgtacggagcgggcgttcgtcgtattttcggtgggttttgcggagcggtcgtagttcggtattggtcgcgaagtttcgatggtcgttttcggttagtgtttttgtgttatatacgagaggtttatttgtttttgtaatagttgagggaagattttagagggaacggtta

SEQ ID NO: 19706 - DNA, 816 bp, Artificial Sequence
  chemically treated genomic DNA (Homo sapiens) CpG-island No: 19706
taaccgttccctctaaaatcttccctcaactattacaaaaacaaataaacctctcgtatataacacaaaaacactaaccgaaaacgaccatcgaaacttcgcgaccaataccgaactacgaccgctccgcaaaacccaccgaaaatacgacgaacgcccgctccgtacgaaaaaccaaaacgaaaaccaaccgcgaaacgtcgccgaaaaaacaaaacgaacgcccgacccactcaccgccccgaaacgaaaaaacaaaatccaaacaataactaaaacgtccgcccccaactccacgaccaaccaacccctacccccgtcccgaccttcgcccgccgccgaccgaccaccttaaacgaaaaaaacgaaaaaaaaccgaaaatacctacctactactccctaacctcaaccctaccccgcgaaaacaacgacgacgcttaaacgaaacccccacccaaccctaacgatacgacaaaaccccgcgcgacccgctaacccaaaaaatcccaacttcctcctcccgatcccctcaccacgaatccccgcaatacccgactccgaaccaaaccaaccgtaaacgcgcacccacctcgaactccgaacgccaccgccgttaccaaactactcgactaccgaaccctactccgccccctctaaaatccgccccccacgacctacccgcccccgaccaccgcccgctacccgcctccccgtaccgattaacgaaactacatcacgtaacgaaacaaaaaacaaaaaaaatacgccgaatcgacctaaaaaacaactccgaaaaacgaaactcttcgcccgaaa

SEQ ID NO: 19707 - DNA, 816 bp, Artificial Sequence
  chemically treated genomic DNA (Homo sapiens) CpG-island No: 19707
taatcgttttttttaagatttttttttaattgttgtaaaagtagataaatttttcgtgtatgatatagaaatattggtcgagagcggttatcgaggtttcgcggttagtgtcgggttgcggtcgtttcgtagggtttatcggggatgcgacggacgttcgtttcgtgcggagggttaaggcgaggattagtcgcggagcgtcgtcggggaggtagggcggacgttcggtttatttatcgtttcgggacggggaagtaaagtttaggtagtggttgagacgttcgtttttagttttacggttagttaatttttattttcgtttcgattttcgttcgtcgtcggtcggttattttgggcggggagaacgggaggaagtcggaggtatttgtttgttgttttttggttttagttttgtttcgcggggatagcgacggcgtttggacgaaatttttatttaattttgacggtgcggtaaggtttcgcgcgattcgttggtttaaggagttttaatttttttttttcgatttttttattacgggttttcgtagtgttcggtttcgagttaggttagtcgtgagcgcgtatttatttcgggtttcgggcgttatcgtcgttgttaggttgttcggttgtcgggttttgtttcgttttttttggggttcgttttttacggtttgttcgttttcggttatcgttcgttgttcgttttttcgtgtcggttggcgggattgtattacgtgacggggtagggggtaggaagagtgcgtcgggtcgatttggggagtagtttcgaagggcggggtttttcgttcgaga

SEQ ID NO: 19708 - DNA, 816 bp, Artificial Sequence
  chemically treated genomic DNA (Homo sapiens) CpG-island No: 19708
tctcgaacgaaaaaccccgcccttcgaaactactccccaaatcgacccgacgcactcttcctaccccctaccccgtcacgtaatacaatcccgccaaccgacacgaaaaaacgaacaacgaacgataaccgaaaacgaacaaaccgtaaaaaacgaaccccaaaaaaaacgaaacaaaacccgacaaccgaacaacctaacaacgacgataacgcccgaaacccgaaataaatacgcgctcacgactaacctaactcgaaaccgaacactacgaaaacccgtaataaaaaaatcgaaaaaaaaaaattaaaactccttaaaccaacgaatcgcgcgaaaccttaccgcaccgtcaaaattaaataaaaatttcgtccaaacgccgtcgctatccccgcgaaacaaaactaaaaccaaaaaacaacaaacaaatacctccgacttcctcccgttctccccgcccaaaataaccgaccgacgacgaacgaaaatcgaaacgaaaataaaaattaactaaccgtaaaactaaaaacgaacgtctcaaccactacctaaactttacttccccgtcccgaaacgataaataaaccgaacgtccgccctacctccccgacgacgctccgcgactaatcctcgccttaaccctccgcacgaaacgaacgtccgtcgcatccccgataaaccctacgaaacgaccgcaacccgacactaaccgcgaaacctcgataaccgctctcgaccaatatttctatatcatacacgaaaaatttatctacttttacaacaattaaaaaaaaatcttaaaaaaaacgatta

SEQ ID NO: 19709 - DNA, 991 bp, Artificial Sequence
  chemically treated genomic DNA (Homo sapiens) CpG-island No: 19709
tcgcggttgaggcgattttaggtcgttgtagtgcgtttggagttcgggtttcggaaggtagtttttgttttaataaagcggtcgttcgtggagttcgacgagggaatttttttagcgttttcgggcgtatttcgttcgcgggattttttgttcggcgtcgttttcgcgggtttcgttaagggttcgggcgggttttatagcgcggggttttaggaggtcgcgtattcgttcggtcggaggttttataggttcgcgtttcgcgtcgttcgatttcgttttcgtttcgtttcgtttcgcgtcgggttcgggattaggagtttgagttaggtcggcgaataaaaggtagggcgggcgggcggcgatttcgaggggacgggcgtcgcgtagggttggtcgggatcggtcgggaggcggagggcgcgggcgcgcgtttcggagacgaaagaaagagcggaggcggcgcgttttgttttcgtttcggttcggtttcgtatatttatcgggtcgcgtcgttcgttttcgtttcgggcgtttcggttcgcgttatcgttcgcgcgcgtaacggtcgtttcggtagttatcgtttttcggggtcgaggcgagggcggggtcgaggtcggaggaggggcggggacggagaggggcggggcgaatttggtgaggcggggttaagggggtggggttggggcggggcgatgcgggggcggggtacggggcggggcgagggttttcgcgtcgggatagcgtggtaacgggattgttagggaagtagggatgagaagaagcgagggacggggtttttacggtcgggggcgggattttcgttgggggcgcggcggcgttggtgcgtacggtgtgtattcgtattggttcggttttggtgttgggagcgattgcgttttcgtaagttggttttttttgttttcgttggttcgggatattttgcgaagggtaggtcggtgtggtcgggaggagtcgtttttgtttgggt

SEQ ID NO: 19710 - DNA, 991 bp, Artificial Sequence
  chemically treated genomic DNA (Homo sapiens) CpG-island No: 19710
acccaaacaaaaacgactcctcccgaccacaccgacctacccttcgcaaaatatcccgaaccaacgaaaacaaaaaaaaccaacttacgaaaacgcaatcgctcccaacaccaaaaccgaaccaatacgaatacacaccgtacgcaccaacgccgccgcgcccccaacgaaaatcccgcccccgaccgtaaaaaccccgtccctcgcttcttctcatccctacttccctaacaatcccgttaccacgctatcccgacgcgaaaaccctcgccccgccccgtaccccgcccccgcatcgccccgccccaaccccacccccttaaccccgcctcaccaaattcgccccgcccctctccgtccccgcccctcctccgacctcgaccccgccctcgcctcgaccccgaaaaacgataactaccgaaacgaccgttacgcgcgcgaacgataacgcgaaccgaaacgcccgaaacgaaaacgaacgacgcgacccgataaatatacgaaaccgaaccgaaacgaaaacaaaacgcgccgcctccgctctttctttcgtctccgaaacgcgcgcccgcgccctccgcctcccgaccgatcccgaccaaccctacgcgacgcccgtcccctcgaaatcgccgcccgcccgccctaccttttattcgccgacctaactcaaactcctaatcccgaacccgacgcgaaacgaaacgaaacgaaaacgaaatcgaacgacgcgaaacgcgaacctataaaacctccgaccgaacgaatacgcgacctcctaaaaccccgcgctataaaacccgcccgaacccttaacgaaacccgcgaaaacgacgccgaacaaaaaatcccgcgaacgaaatacgcccgaaaacgctaaaaaaattccctcgtcgaactccacgaacgaccgctttattaaaacaaaaactaccttccgaaacccgaactccaaacgcactacaacgacctaaaatcgcctcaaccgcga

SEQ ID NO: 19711 - DNA, 991 bp, Artificial Sequence
  chemically treated genomic DNA (Homo sapiens) CpG-island No: 19711
gtttaggtaggggcggtttttttcggttatatcgatttgtttttcgtagggtgtttcgggttagcggaggtagagaaaattagtttgcgggaacgtagtcgtttttagtattagggtcgggttagtgcgggtatatatcgtgcgtattagcgtcgtcgcgtttttaacggaagtttcgttttcggtcgtggaggtttcgtttttcgtttttttttatttttgtttttttggtagtttcgttattacgttgtttcgacgcgaaggttttcgtttcgtttcgtgtttcgttttcgtatcgtttcgttttaattttatttttttggtttcgttttattaggttcgtttcgttttttttcgttttcgtttttttttcggtttcggtttcgttttcgtttcgatttcggggggcggtggttgtcgaggcgatcgttgcgcgcgcgggcggtggcgcgggtcgaagcgttcggagcgggagcgagcggcgcggttcggtaggtgtgcggggtcgggtcggggcgggggtagggcgcgtcgttttcgttttttttttcgttttcggggcgcgcgttcgcgtttttcgtttttcggtcgatttcggttagttttgcgcggcgttcgttttttcggggtcgtcgttcgttcgttttgttttttgttcgtcggtttgatttaggtttttggtttcgggttcggcgcggggcggggcggggcgggggcggggtcgggcggcgcggggcgcgggtttgtggggttttcggtcgggcgggtgcgcggttttttggggtttcgcgttgtgaggttcgttcgggtttttggcgggattcgcgggggcggcgtcgggtagggggtttcgcgggcgagatgcgttcgggagcgttgggagggttttttcgtcggattttacgagcggtcgttttgttagggtagaagttgtttttcgagattcgaattttagacgtattgtagcgatttggggtcgttttagtcgcgg

SEQ ID NO: 19712 - DNA, 991 bp, Artificial Sequence
  chemically treated genomic DNA (Homo sapiens) CpG-island No: 19712
ccgcgactaaaacgaccccaaatcgctacaatacgtctaaaattcgaatctcgaaaaacaacttctaccctaacaaaacgaccgctcgtaaaatccgacgaaaaaaccctcccaacgctcccgaacgcatctcgcccgcgaaaccccctacccgacgccgcccccgcgaatcccgccaaaaacccgaacgaacctcacaacgcgaaaccccaaaaaaccgcgcacccgcccgaccgaaaaccccacaaacccgcgccccgcgccgcccgaccccgcccccgccccgccccgccccgcgccgaacccgaaaccaaaaacctaaatcaaaccgacgaacaaaaaacaaaacgaacgaacgacgaccccgaaaaaacgaacgccgcgcaaaactaaccgaaatcgaccgaaaaacgaaaaacgcgaacgcgcgccccgaaaacgaaaaaaaaaacgaaaacgacgcgccctacccccgccccgacccgaccccgcacacctaccgaaccgcgccgctcgctcccgctccgaacgcttcgacccgcgccaccgcccgcgcgcgcaacgatcgcctcgacaaccaccgccccccgaaatcgaaacgaaaacgaaaccgaaaccgaaaaaaaaacgaaaacgaaaaaaaacgaaacgaacctaataaaacgaaaccaaaaaaataaaattaaaacgaaacgatacgaaaacgaaacacgaaacgaaacgaaaaccttcgcgtcgaaacaacgtaataacgaaactaccaaaaaaacaaaaataaaaaaaaacgaaaaacgaaacctccacgaccgaaaacgaaacttccgttaaaaacgcgacgacgctaatacgcacgatatatacccgcactaacccgaccctaatactaaaaacgactacgttcccgcaaactaattttctctacctccgctaacccgaaacaccctacgaaaaacaaatcgatataaccgaaaaaaaccgcccctacctaaac

SEQ ID NO: 19713 - DNA, 512 bp, Artificial Sequence
  chemically treated genomic DNA (Homo sapiens) CpG-island No: 19713
tcgggggcggcgtgagttttcgcggcgaagttacggggatagttaggaaaggtcgtttttttcgggtttcgggacgttcgcgaaggcggcgcggtgattgcggcgtttagcgggtttgtttttttcggagcgcgggtagtagcgagggcgggatcggaggtatcgttggtacgagaggaggagttgttcggtttcggtttgcgtttttggttttgttttagtcgtcgtttttattttttaggtcggagtttttttttcgtttttttcgtgtttttttttttcggcgttgggtttttttgtttttttttttttgttttttttttattttttttcgtcgcgtttttttttcgagacgtattcgtcgttgttgtttacgttttagttttgtcgttcgtttagggattcggtttttttcgggtttgttttttttttgttatttgttttgatgggtttaaaacgtttttttttcgttttcgttatcgttttatggttttttggtagttttttattat

SEQ ID NO: 19714 - DNA, 512 bp, Artificial Sequence
  chemically treated genomic DNA (Homo sapiens) CpG-island No: 19714
ataataaaaaactaccaaaaaaccataaaacgataacgaaaacgaaaaaaaaacgttttaaacccatcaaaacaaataacaaaaaaaaaacaaacccgaaaaaaaccgaatccctaaacgaacgacaaaactaaaacgtaaacaacaacgacgaatacgtctcgaaaaaaaaacgcgacgaaaaaaaataaaaaaaaaacaaaaaaaaaaaaacaaaaaaacccaacgccgaaaaaaaaaaacacgaaaaaaacgaaaaaaaaactccgacctaaaaaataaaaacgacgactaaaacaaaaccaaaaacgcaaaccgaaaccgaacaactcctcctctcgtaccaacgatacctccgatcccgccctcgctactacccgcgctccgaaaaaaacaaacccgctaaacgccgcaatcaccgcgccgccttcgcgaacgtcccgaaacccgaaaaaaacgacctttcctaactatccccgtaacttcgccgcgaaaactcacgccgcccccga

SEQ ID NO: 19715 - DNA, 512 bp, Artificial Sequence
  chemically treated genomic DNA (Homo sapiens) CpG-island No: 19715
atgatggagagttgttaagaaattatggggcggtggcggggacggaggggaagcgttttgagtttattaaggtaggtgataggaaagaagtaaattcgagaggggtcgagtttttgggcgggcggtagggttggagcgtgaatagtagcgacggatgcgtttcgagggaaaaacgcggcgggagagaatgaggggaaggtaggaaggaaggggtagggagatttagcgtcggggaaggaagatacgaagagggcgaggaaggaatttcggtttaaagggtgaaggcggcggttgggatagggttagaggcgtaggtcggggtcgggtagttttttttttcgtgttagcggtgttttcggtttcgttttcgttgttgttcgcgtttcgggaggggtagattcgttggacgtcgtagttatcgcgtcgttttcgcgggcgtttcggggttcggagggaacggttttttttggttgttttcgtggtttcgtcgcgggaatttacgtcgttttcga

SEQ ID NO: 19716 - DNA, 512 bp, Artificial Sequence
  chemically treated genomic DNA (Homo sapiens) CpG-island No: 19716
tcgaaaacgacgtaaattcccgcgacgaaaccacgaaaacaaccaaaaaaaaccgttccctccgaaccccgaaacgcccgcgaaaacgacgcgataactacgacgtccaacgaatctacccctcccgaaacgcgaacaacaacgaaaacgaaaccgaaaacaccgctaacacgaaaaaaaaaactacccgaccccgacctacgcctctaaccctatcccaaccgccgccttcaccctttaaaccgaaattccttcctcgccctcttcgtatcttccttccccgacgctaaatctccctaccccttccttcctaccttcccctcattctctcccgccgcgtttttccctcgaaacgcatccgtcgctactattcacgctccaaccctaccgcccgcccaaaaactcgacccctctcgaatttacttctttcctatcacctaccttaataaactcaaaacgcttcccctccgtccccgccaccgccccataatttcttaacaactctccatcat

SEQ ID NO: 19717 - DNA, 548 bp, Artificial Sequence
  chemically treated genomic DNA (Homo sapiens) CpG-island No: 19717
ttcgcgtagagtacgcgagagttttggaaattaatttatatagagtacgcgagagtttcgtatattcgcgtagagtacgcgagagttttggaaatcgatttatagagtacgtgagagtttcggaaattcgcgtagagtacgcgagagtttcggaaattaatttatatagagtatgcgagagtttcgtatattcgcgtagagtacgcgagagttttggaaatcgatttacgtcgagtaagcgagagtttcggaaacggattaacgcggagtaagtgagagtttcggaaatcgattaacgtagagtacgcgggagttttaggaaatcgatttgcgtagagtacgttagagttttcgaaattcgcgtagagtacgcggtagttttggaaatcgattcgcgtagagtacgcgagagtttcggaaatcgattaacgcggagtacgcgagagtttcggaaatcgattcgtacgaagtacgcgggagttatcgttttattttacgtattatttatttgttgggcgtttttagagttttaaaaatttaagaaagaa

SEQ ID NO: 19718 - DNA, 548 bp, Artificial Sequence
  chemically treated genomic DNA (Homo sapiens) CpG-island No: 19718
ttctttcttaaatttttaaaactctaaaaacgcccaacaaataaataatacgtaaaataaaacgataactcccgcgtacttcgtacgaatcgatttccgaaactctcgcgtactccgcgttaatcgatttccgaaactctcgcgtactctacgcgaatcgatttccaaaactaccgcgtactctacgcgaatttcgaaaactctaacgtactctacgcaaatcgatttcctaaaactcccgcgtactctacgttaatcgatttccgaaactctcacttactccgcgttaatccgtttccgaaactctcgcttactcgacgtaaatcgatttccaaaactctcgcgtactctacgcgaatatacgaaactctcgcatactctatataaattaatttccgaaactctcgcgtactctacgcgaatttccgaaactctcacgtactctataaatcgatttccaaaactctcgcgtactctacgcgaatatacgaaactctcgcgtactctatataaattaatttccaaaactctcgcgtactctacgcgaa

SEQ ID NO: 19719 - DNA, 548 bp, Artificial Sequence
  chemically treated genomic DNA (Homo sapiens) CpG-island No: 19719
tttttttttgggtttttagaattttgaagacgtttagtaagtgggtggtgcgtggaatgaagcggtggttttcgcgtgtttcgtgcgggtcggttttcggggttttcgcgtgtttcgcgttggtcggttttcggggttttcgcgtgttttgcgcgggtcggtttttaggattatcgcgtgttttgcgcgggtttcggggattttggcgtgttttgcgtaggtcggttttttgggattttcgcgtgttttgcgttggtcgattttcggggtttttatttgtttcgcgttggttcgttttcggggttttcgtttgttcggcgtgggtcggtttttaggattttcgcgtgttttgcgcgggtgtgcggggttttcgtatgttttgtgtgggttggttttcgggattttcgcgtgttttgcgcgggttttcggggtttttacgtgttttgtgagtcggtttttaggattttcgcgtgttttgcgcgggtgtgcggggttttcgcgtgttttgtgtgggttggtttttaggattttcgcgtgttttgcgcggg

SEQ ID NO: 19720 - DNA, 548 bp, Artificial Sequence
  chemically treated genomic DNA (Homo sapiens) CpG-island No: 19720
cccgcgcaaaacacgcgaaaatcctaaaaaccaacccacacaaaacacgcgaaaaccccgcacacccgcgcaaaacacgcgaaaatcctaaaaaccgactcacaaaacacgtaaaaaccccgaaaacccgcgcaaaacacgcgaaaatcccgaaaaccaacccacacaaaacatacgaaaaccccgcacacccgcgcaaaacacgcgaaaatcctaaaaaccgacccacgccgaacaaacgaaaaccccgaaaacgaaccaacgcgaaacaaataaaaaccccgaaaatcgaccaacgcaaaacacgcgaaaatcccaaaaaaccgacctacgcaaaacacgccaaaatccccgaaacccgcgcaaaacacgcgataatcctaaaaaccgacccgcgcaaaacacgcgaaaaccccgaaaaccgaccaacgcgaaacacgcgaaaaccccgaaaaccgacccgcacgaaacacgcgaaaaccaccgcttcattccacgcaccacccacttactaaacgtcttcaaaattctaaaaacccaaaaaaaaa

SEQ ID NO: 19721 - DNA, 545 bp, Artificial Sequence
  chemically treated genomic DNA (Homo sapiens) CpG-island No: 19721
gttggtcggggtacgggttgcgggacggggaggggttgggcggggcgttcgcgttcgttttttgtttgaggtttggtttggggtcgcgggtttatatcgttttttcgtggatattcgtcgcgagggttcgcgtcgttcggaggttgggtttgagtttacgggaaatgaatacggattttataagattcgagtttttattattgggttattagacggttttgggcgcgtgttcggggtttattttgaatatgcgttgatggggtcgttgggtacggtggcggtgtggtcgtaagatttcgcggggtcgcgtttattcggagggttttatattagtttttttttcgcgtttaggttttggtttttttcgttgtattttcgttgttcgtagttttgagcgcgtttcgttttcgttggcgggatagtagcgttttgttaaggtcgcggcgtcgtatagttcgaatatttttttacgaaattttagagattttttttgtattcgttgtgtttttcggtttgttagtagtttatggttattttagggtttt

SEQ ID NO: 19722 - DNA, 545 bp, Artificial Sequence
  chemically treated genomic DNA (Homo sapiens) CpG-island No: 19722
aaaaccctaaaataaccataaactactaacaaaccgaaaaacacaacgaatacaaaaaaaatctctaaaatttcgtaaaaaaatattcgaactatacgacgccgcgaccttaacaaaacgctactatcccgccaacgaaaacgaaacgcgctcaaaactacgaacaacgaaaatacaacgaaaaaaaccaaaacctaaacgcgaaaaaaaaactaatataaaaccctccgaataaacgcgaccccgcgaaatcttacgaccacaccgccaccgtacccaacgaccccatcaacgcatattcaaaataaaccccgaacacgcgcccaaaaccgtctaataacccaataataaaaactcgaatcttataaaatccgtattcatttcccgtaaactcaaacccaacctccgaacgacgcgaaccctcgcgacgaatatccacgaaaaaacgatataaacccgcgaccccaaaccaaacctcaaacaaaaaacgaacgcgaacgccccgcccaacccctccccgtcccgcaacccgtaccccgaccaac

SEQ ID NO: 19723 - DNA, 545 bp, Artificial Sequence
  chemically treated genomic DNA (Homo sapiens) CpG-island No: 19723
gggattttgaggtaattatgagttattggtaggtcgggggatatagcgggtatagaaggggtttttggagtttcgtgaggaagtattcgggttgtgcggcgtcgcgattttggtaggacgttgttgtttcgttagcggaagcggggcgcgtttagggttgcgggtagcgggggtgtagcggggagagttagggtttgggcgcggaggaggggttggtatgggatttttcgggtgggcgcggtttcgcggggttttgcggttatatcgttatcgtgtttagcggttttattagcgtatatttaggatgaatttcggatacgcgtttagaatcgtttggtgatttagtgatgaaagttcgaattttataggattcgtatttatttttcgtgggtttaagtttagttttcgggcggcgcgggttttcgcggcgagtgtttacgaggaggcggtgtggattcgcggttttagattaggttttaggtagaaggcgagcgcgagcgtttcgtttagttttttttcgtttcgtaattcgtgtttcgattagt

SEQ ID NO: 19724 - DNA, 545 bp, Artificial Sequence
  chemically treated genomic DNA (Homo sapiens) CpG-island No: 19724
actaatcgaaacacgaattacgaaacgaaaaaaaactaaacgaaacgctcgcgctcgccttctacctaaaacctaatctaaaaccgcgaatccacaccgcctcctcgtaaacactcgccgcgaaaacccgcgccgcccgaaaactaaacttaaacccacgaaaaataaatacgaatcctataaaattcgaactttcatcactaaatcaccaaacgattctaaacgcgtatccgaaattcatcctaaatatacgctaataaaaccgctaaacacgataacgatataaccgcaaaaccccgcgaaaccgcgcccacccgaaaaatcccataccaacccctcctccgcgcccaaaccctaactctccccgctacacccccgctacccgcaaccctaaacgcgccccgcttccgctaacgaaacaacaacgtcctaccaaaatcgcgacgccgcacaacccgaatacttcctcacgaaactccaaaaaccccttctatacccgctatatcccccgacctaccaataactcataattacctcaaaatccc

SEQ ID NO: 19725 - DNA, 641 bp, Artificial Sequence
  chemically treated genomic DNA (Homo sapiens) CpG-island No: 19725
ggtggggtcgggcgagaaggggttgggcgggttgtcgtcgggcggggttgcgcggggaagggcggcgttgcgcggggggcggggttgcgtgggggagggcggggtcgggttgttgtgggtgggcggggcgtatcggggaaagtttcgggaagggcggtagtcggcggggttcgggcgcggaagttgtcggcggtcgcgcggtttttcgggcgggtttatagttatgtttcgggattcggggtcgggcggttgggaggaggtttcgcgcgtagttgtcgcgttttgtattttgtattacgaggtcggatagcggttgcgtcgtttgtaggattagttcgttgttcgcgacgtttttatcgttcgttttcgcgttcgtttggtcgcgttggagggggacgtcgcgtcgtttttagtggacgcgttgttggagtaggttgcgcgttttcgggagtagttgcgaaggtaggagggcggcgtcgtcgaggtttagatgcgttaggtacgagggcgggtattagaggagttgcgggagcgagagtgcgtgtggcggtcgtcgggttttgggtgggtgaacgagcgggtttcgggttttgaggggttgagggggtattgggttttggggttgagttggtttcgggttt

SEQ ID NO: 19726 - DNA, 641 bp, Artificial Sequence
  chemically treated genomic DNA (Homo sapiens) CpG-island No: 19726
aaacccgaaaccaactcaaccccaaaacccaataccccctcaacccctcaaaacccgaaacccgctcgttcacccacccaaaacccgacgaccgccacacgcactctcgctcccgcaactcctctaatacccgccctcgtacctaacgcatctaaacctcgacgacgccgccctcctaccttcgcaactactcccgaaaacgcgcaacctactccaacaacgcgtccactaaaaacgacgcgacgtccccctccaacgcgaccaaacgaacgcgaaaacgaacgataaaaacgtcgcgaacaacgaactaatcctacaaacgacgcaaccgctatccgacctcgtaatacaaaatacaaaacgcgacaactacgcgcgaaacctcctcccaaccgcccgaccccgaatcccgaaacataactataaacccgcccgaaaaaccgcgcgaccgccgacaacttccgcgcccgaaccccgccgactaccgcccttcccgaaactttccccgatacgccccgcccacccacaacaacccgaccccgccctcccccacgcaaccccgccccccgcgcaacgccgcccttccccgcgcaaccccgcccgacgacaacccgcccaaccccttctcgcccgaccccacc

SEQ ID NO: 19727 - DNA, 641 bp, Artificial Sequence
  chemically treated genomic DNA (Homo sapiens) CpG-island No: 19727
ggattcgaggttaatttaattttaggatttagtatttttttaattttttaggattcggggttcgttcgtttatttatttaggattcggcggtcgttatacgtattttcgttttcgtagtttttttggtattcgttttcgtatttggcgtatttgggtttcggcggcgtcgtttttttgttttcgtagttgttttcggaagcgcgtaatttgttttagtagcgcgtttattagggacggcgcggcgtttttttttagcgcggttaggcgggcgcggaggcgagcgatgagggcgtcgcgggtagcgagttggttttgtaggcggcgtagtcgttgttcggtttcgtggtatagggtgtagagcgcggtagttgcgcgcggggtttttttttagtcgttcgatttcgggtttcgggatatggttgtaggttcgttcgggaggtcgcgcggtcgtcggtaattttcgcgttcgggtttcgtcggttgtcgtttttttcggaatttttttcggtgcgtttcgtttatttataatagttcggtttcgtttttttttacgtagtttcgtttttcgcgtagcgtcgttttttttcgcgtagtttcgttcgacggtagttcgtttagttttttttcgttcggttttatt

SEQ ID NO: 19728 - DNA, 641 bp, Artificial Sequence
  chemically treated genomic DNA (Homo sapiens) CpG-island No: 19728
aataaaaccgaacgaaaaaaaactaaacgaactaccgtcgaacgaaactacgcgaaaaaaaacgacgctacgcgaaaaacgaaactacgtaaaaaaaaacgaaaccgaactattataaataaacgaaacgcaccgaaaaaaattccgaaaaaaacgacaaccgacgaaacccgaacgcgaaaattaccgacgaccgcgcgacctcccgaacgaacctacaaccatatcccgaaacccgaaatcgaacgactaaaaaaaaaccccgcgcgcaactaccgcgctctacaccctataccacgaaaccgaacaacgactacgccgcctacaaaaccaactcgctacccgcgacgccctcatcgctcgcctccgcgcccgcctaaccgcgctaaaaaaaaacgccgcgccgtccctaataaacgcgctactaaaacaaattacgcgcttccgaaaacaactacgaaaacaaaaaaacgacgccgccgaaacccaaatacgccaaatacgaaaacgaataccaaaaaaactacgaaaacgaaaatacgtataacgaccgccgaatcctaaataaataaacgaacgaaccccgaatcctaaaaaattaaaaaaatactaaatcctaaaattaaattaacctcgaatcc

SEQ ID NO: 19729 - DNA, 568 bp, Artificial Sequence
  chemically treated genomic DNA (Homo sapiens) CpG-island No: 19729
gggcggaggtcgtttttgtcgcggttcggcgtttcgggaaaggttcgaggtataggagagtatcgtttttgggatcggaatcgatgggtagggttatagggttaagcgtttgagatcgcgttttaaaatttagcgtaagttttcgatcgtcggggttcggttgtagtaggttatttcgggggattcggtgtttcgaggcgagaagaaagcgggacgggtaatagcggcggtttacggtgttcgggaagggggtagtggtgggaaacgagagcgcgtcgggtttcgcgtggttttttcgcgtgtttttttttttaaatttttaagattaatcgtgcgtattaggtattcgattatgtttaagtttgttcgtttcgtcgcggtatggattttttttaattttgaaatagggcggcgggtggggtggcggtttcgggtcggtagatagtaatttttgttcgggagggtggtttcgggagaggcgttgggttttcgggaattgcgtcgcggtagttattcgtttgttgttggtgtttacgttttcgcgggggttgtattcgtatacgtcgcg

SEQ ID NO: 19730 - DNA, 568 bp, Artificial Sequence
  chemically treated genomic DNA (Homo sapiens) CpG-island No: 19730
cgcgacgtatacgaatacaacccccgcgaaaacgtaaacaccaacaacaaacgaataactaccgcgacgcaattcccgaaaacccaacgcctctcccgaaaccaccctcccgaacaaaaattactatctaccgacccgaaaccgccaccccacccgccgccctatttcaaaattaaaaaaaatccataccgcgacgaaacgaacaaacttaaacataatcgaatacctaatacgcacgattaatcttaaaaatttaaaaaaaaaaacacgcgaaaaaaccacgcgaaacccgacgcgctctcgtttcccaccactacccccttcccgaacaccgtaaaccgccgctattacccgtcccgctttcttctcgcctcgaaacaccgaatcccccgaaataacctactacaaccgaaccccgacgatcgaaaacttacgctaaattttaaaacgcgatctcaaacgcttaaccctataaccctacccatcgattccgatcccaaaaacgatactctcctatacctcgaacctttcccgaaacgccgaaccgcgacaaaaacgacctccgccc

SEQ ID NO: 19731 - DNA, 568 bp, Artificial Sequence
  chemically treated genomic DNA (Homo sapiens) CpG-island No: 19731
cgcggcgtgtgcgagtgtagttttcgcggggacgtgggtattaatagtaggcgagtgattatcgcggcgtagttttcgaggatttagcgtttttttcgaggttattttttcgggtaggaattattgtttgtcggttcgaagtcgttattttattcgtcgttttgttttaaagttggggagagtttatgtcgcgacggagcgagtagatttggatatggtcgagtgtttggtgcgtacgattggttttaagagtttagggaaaaaagtacgcggggaaattacgcggggttcggcgcgttttcgttttttattattgtttttttttcgggtatcgtgggtcgtcgttgttgttcgtttcgtttttttttcgtttcggagtatcgggtttttcggagtgatttattgtagtcgagtttcggcggtcgggggtttgcgttgggttttgggacgcggttttagacgtttggttttgtggttttatttatcggtttcggttttaagaacggtgtttttttgtgtttcgggtttttttcggggcgtcgggtcgcggtaggagcgattttcgttt

SEQ ID NO: 19732 - DNA, 568 bp, Artificial Sequence
  chemically treated genomic DNA (Homo sapiens) CpG-island No: 19732
aaacgaaaatcgctcctaccgcgacccgacgccccgaaaaaaacccgaaacacaaaaaaacaccgttcttaaaaccgaaaccgataaataaaaccacaaaaccaaacgtctaaaaccgcgtcccaaaacccaacgcaaacccccgaccgccgaaactcgactacaataaatcactccgaaaaacccgatactccgaaacgaaaaaaaaacgaaacgaacaacaacgacgacccacgatacccgaaaaaaaaacaataataaaaaacgaaaacgcgccgaaccccgcgtaatttccccgcgtacttttttccctaaactcttaaaaccaatcgtacgcaccaaacactcgaccatatccaaatctactcgctccgtcgcgacataaactctccccaactttaaaacaaaacgacgaataaaataacgacttcgaaccgacaaacaataattcctacccgaaaaaataacctcgaaaaaaacgctaaatcctcgaaaactacgccgcgataatcactcgcctactattaatacccacgtccccgcgaaaactacactcgcacacgccgcg

SEQ ID NO: 19733 - DNA, 657 bp, Artificial Sequence
  chemically treated genomic DNA (Homo sapiens) CpG-island No: 19733
atcgcgttcggttcgaaggagtttcgtagtggggatggaggagggagtttcgtgtttagttcgttcgcggggagttgttcgtagatcgataagtttcgtgtcggtttgagttttttattcgttcgtcgggacggtttacgttcgtttttgtttttttaagaagcgcgtgggcgattagtagcgttcggggttcgcggtttggtttaggggttcggggtgcggggtttagagtcggaagttcgcggttcgggtttcggggttcgggggtcggggttcggtatttacggcgtttacgcggcgggtatggtcggttttttcggggcgatttacgttcgttttttttgcgagtatcggtacggtttcgggtcgcgtttttcggtcgtcgtcgtttcgtttcgggcgttcgtttttcgtcggttttagtttcgcggcgcggttcggagttcgttatgttcgtcggttttggtttggtagtcgtcggttttttttttttcggcgggggattgggcgggtaggtgaggatttcggcgcgtttttttcggtttcgttttttgtcgcgttatcgtgcgcgggaggtacgtgagttttttgcgggttttagtttttttacgttgtaaggaggttggtgggcgtttgggataggaggtttatatttgt

SEQ ID NO: 19734 - DNA, 657 bp, Artificial Sequence
  chemically treated genomic DNA (Homo sapiens) CpG-island No: 19734
acaaatataaacctcctatcccaaacgcccaccaacctccttacaacgtaaaaaaactaaaacccgcaaaaaactcacgtacctcccgcgcacgataacgcgacaaaaaacgaaaccgaaaaaaacgcgccgaaatcctcacctacccgcccaatcccccgccgaaaaaaaaaaaaccgacgactaccaaaccaaaaccgacgaacataacgaactccgaaccgcgccgcgaaactaaaaccgacgaaaaacgaacgcccgaaacgaaacgacgacgaccgaaaaacgcgacccgaaaccgtaccgatactcgcaaaaaaaacgaacgtaaatcgccccgaaaaaaccgaccatacccgccgcgtaaacgccgtaaataccgaaccccgacccccgaaccccgaaacccgaaccgcgaacttccgactctaaaccccgcaccccgaacccctaaaccaaaccgcgaaccccgaacgctactaatcgcccacgcgcttcttaaaaaaacaaaaacgaacgtaaaccgtcccgacgaacgaataaaaaactcaaaccgacacgaaacttatcgatctacgaacaactccccgcgaacgaactaaacacgaaactccctcctccatccccactacgaaactccttcgaaccgaacgcgat

SEQ ID NO: 19735 - DNA, 657 bp, Artificial Sequence
  chemically treated genomic DNA (Homo sapiens) CpG-island No: 19735
atagatgtgggttttttgttttaagcgtttattaatttttttgtagcgtggggaaattgaggttcgtagggggtttacgtgtttttcgcgtacggtgacgcggtagggggcggggtcgggaggggcgcgtcgggatttttatttgttcgtttagtttttcgtcgagaggggaggagtcggcggttgttaggttagggtcggcgggtatggcgggtttcgggtcgcgtcgcggagttggggtcggcgggaggcgggcgttcgggacgaggcggcggcggtcgggggacgcggttcggggtcgtgtcggtgttcgtaggggaggcgggcgtggatcgtttcggggaagtcggttatgttcgtcgcgtggacgtcgtgagtatcgagtttcggttttcgagtttcgggattcgggtcgcgagttttcggttttggatttcgtatttcgagtttttggattaggtcgcgagtttcgggcgttgttggtcgtttacgcgttttttgggggaataaaggcgggcgtggatcgtttcggcgggcggatgggggatttaggtcggtacggggtttgtcgatttgcgggtagtttttcgcgggcggattgggtacggggtttttttttttatttttattgcggggttttttcgggtcgggcgcggt

SEQ ID NO: 19736 - DNA, 657 bp, Artificial Sequence
  chemically treated genomic DNA (Homo sapiens) CpG-island No: 19736
accgcgcccgacccgaaaaaaccccgcaataaaaataaaaaaaaaaaccccgtacccaatccgcccgcgaaaaactacccgcaaatcgacaaaccccgtaccgacctaaatcccccatccgcccgccgaaacgatccacgcccgcctttattcccccaaaaaacgcgtaaacgaccaacaacgcccgaaactcgcgacctaatccaaaaactcgaaatacgaaatccaaaaccgaaaactcgcgacccgaatcccgaaactcgaaaaccgaaactcgatactcacgacgtccacgcgacgaacataaccgacttccccgaaacgatccacgcccgcctcccctacgaacaccgacacgaccccgaaccgcgtcccccgaccgccgccgcctcgtcccgaacgcccgcctcccgccgaccccaactccgcgacgcgacccgaaacccgccatacccgccgaccctaacctaacaaccgccgactcctcccctctcgacgaaaaactaaacgaacaaataaaaatcccgacgcgcccctcccgaccccgccccctaccgcgtcaccgtacgcgaaaaacacgtaaaccccctacgaacctcaatttccccacgctacaaaaaaattaataaacgcttaaaacaaaaaacccacatctat

SEQ ID NO: 19737 - DNA, 1426 bp, Artificial Sequence
  chemically treated genomic DNA (Homo sapiens) CpG-island No: 19737
attttgcgttcggcggggaggggagtcgtttacggttttacgtaagattttcgggtagagcgcgaggtttcgtttttttacgtagttattgttttcgtcgcgtttagattcggcggttcggttcggttcggcgtacgtttcggagcgttttgtttcgttttcgtagcggagacgtttttgcgttttaacgggtttttaggacggcgggcggttttcgcgcgttgcgttttttttcggtaacgcgttcggttgcggcgtttttattggtcgcgcgtttcgttatcggttattggttcgtagtgtttgttttatataggtcgttttggttaatcggcgcgcggcgtttatttaatatgtacggcggtcgttagttagttagcgcgggggtcgggttattacgtgttgttgttaagttcgggtttttaaattgttattagcgcggtcggtttattttagtttagttttgtatttgttaatattttcggttcggttcgaggcgttcgattcgtttttattggttttagttcggttcggcgttcgttttcggggcgcgaacgtcgttttttattggttttgcgggtcgtcgtttttttttatgtgttaatttgagggtttgaggcggagggtggcggtcgagcgtcggagttcgcggagtttggaagtgcggcggtcgggcgcgcggggtgggcggcgagcggagtcggtcggagcgggtcgggtagcggtcgtcgtcgtttcggggcggacgggcgcgggcgggaggatggagttgaattttttgttgattttgttggaggcggtcgagtatttggagcgtagggatcgaggtagcgttcgtattttattgtgcgttcgcggcggtgggcgggcggcggggcgtgtcgggcgggggtcgttgatcgcgtcgtgtgttcgtagaggtcgagtacggttacgtttcggtgttgtttttcgacggcgatttcgttagggagaaaataaaggcggtcggtttggtgcgtaaggtttcgaataataggtatcgtttttcgttttcgatttcgttcggttcggttcgaattttcgtcgtcgttcggagcgtgtttttcgggtttcgattttcggttcgcggtttttagcgtcgtcgtcgcgcgtttcggcggttagtttggaggaggaggcgcgtaggtcgcggtcgtagtttcgttcggtcggtttcgttttcgtcgtcgttattttttcgcggtcgcgtttttcgggtcgttcgcgtaaatagtgttacgcgtatagcgttcgtcgtcggggttcgttttcgcgttcgtttttcgttttcgagttgttttggatttttttaggcggtagaaaagttgttagcgggcgttggtcggtgtttcgtgggtttggggaaataggtttagttagggtttgcgggggttgtcggttttaa

SEQ ID NO: 19738 - DNA, 1426 bp, Artificial Sequence
  chemically treated genomic DNA (Homo sapiens) CpG-island No: 19738
ttaaaaccgacaacccccgcaaaccctaactaaacctatttccccaaacccacgaaacaccgaccaacgcccgctaacaacttttctaccgcctaaaaaaatccaaaacaactcgaaaacgaaaaacgaacgcgaaaacgaaccccgacgacgaacgctatacgcgtaacactatttacgcgaacgacccgaaaaacgcgaccgcgaaaaaataacgacgacgaaaacgaaaccgaccgaacgaaactacgaccgcgacctacgcgcctcctcctccaaactaaccgccgaaacgcgcgacgacgacgctaaaaaccgcgaaccgaaaatcgaaacccgaaaaacacgctccgaacgacgacgaaaattcgaaccgaaccgaacgaaatcgaaaacgaaaaacgatacctattattcgaaaccttacgcaccaaaccgaccgcctttattttctccctaacgaaatcgccgtcgaaaaacaacaccgaaacgtaaccgtactcgacctctacgaacacacgacgcgatcaacgacccccgcccgacacgccccgccgcccgcccaccgccgcgaacgcacaataaaatacgaacgctacctcgatccctacgctccaaatactcgaccgcctccaacaaaatcaacaaaaaattcaactccatcctcccgcccgcgcccgtccgccccgaaacgacgacgaccgctacccgacccgctccgaccgactccgctcgccgcccaccccgcgcgcccgaccgccgcacttccaaactccgcgaactccgacgctcgaccgccaccctccgcctcaaaccctcaaattaacacataaaaaaaaacgacgacccgcaaaaccaataaaaaacgacgttcgcgccccgaaaacgaacgccgaaccgaactaaaaccaataaaaacgaatcgaacgcctcgaaccgaaccgaaaatattaacaaatacaaaactaaactaaaataaaccgaccgcgctaataacaatttaaaaacccgaacttaacaacaacacgtaataacccgacccccgcgctaactaactaacgaccgccgtacatattaaataaacgccgcgcgccgattaaccaaaacgacctatataaaacaaacactacgaaccaataaccgataacgaaacgcgcgaccaataaaaacgccgcaaccgaacgcgttaccgaaaaaaaacgcaacgcgcgaaaaccgcccgccgtcctaaaaacccgttaaaacgcaaaaacgtctccgctacgaaaacgaaacaaaacgctccgaaacgtacgccgaaccgaaccgaaccgccgaatctaaacgcgacgaaaacaataactacgtaaaaaaacgaaacctcgcgctctacccgaaaatcttacgtaaaaccgtaaacgactcccctccccgccgaacgcaaaat

SEQ ID NO: 19739 - DNA, 1426 bp, Artificial Sequence
  chemically treated genomic DNA (Homo sapiens) CpG-island No: 19739
ttagggtcggtagttttcgtagattttggttgagtttgtttttttagatttacggggtatcggttagcgttcgttgataatttttttatcgtttggaaaagtttagaataattcgggggcggggagcgggcgcgggagcggatttcggcggcgggcgttgtacgcgtggtattgtttacgcgagcggttcgggaggcgcggtcgcgggaagatggcgacggcgagggcggggtcggtcgggcggggttgcggtcgcggtttgcgcgtttttttttttaggttggtcgtcggggcgcgcggcggcggcgttgagggtcgcgggtcgggaatcggggttcggagagtacgtttcgggcggcggcgggggttcggatcgggtcgggcggggtcgggagcggggggcggtatttgttgttcggggttttgcgtattaggtcggtcgtttttgttttttttttggcgaagtcgtcgtcgaagggtagtatcgaggcgtagtcgtgttcggtttttgcggatatacggcgcggttagcggttttcgttcggtacgtttcgtcgttcgtttatcgtcgcgggcgtataatggggtgcgagcgttatttcgatttttgcgttttaggtattcggtcgtttttagtaggattagtagggagtttagttttattttttcgttcgcgttcgttcgtttcgggacggcggcggtcgttgttcggttcgtttcggtcggtttcgttcgtcgtttatttcgcgcgttcggtcgtcgtatttttagatttcgcggatttcggcgttcggtcgttatttttcgttttaggtttttaaattgatatataagggagagcggcggttcgtagagttaatgggaggcggcgttcgcgtttcgggggcgggcgtcgggtcgggttggggttaatggggacgggtcgagcgtttcgggtcgggtcgagaatgttgatagatgtagagttgggttgggataggtcggtcgcgttagtaataatttagaagttcgagtttagtaatagtacgtggtggttcggttttcgcgttagttgattggcggtcgtcgtgtatgttaagtaggcgtcgcgcgtcgattggttagagcggtttatgtaaaataggtattgcgagttaatggtcggtggcggggcgcgcggttaatgagggcgtcgtagtcggacgcgttgtcgagaggaagcgtagcgcgcggggatcgttcgtcgttttgggggttcgttaggacgtaggagcgttttcgttacgagagcgaagtagggcgtttcggggcgtgcgtcgggtcgggtcgggtcgtcgggtttgagcgcgacgaaagtagtggttgcgtggggggacgaggtttcgcgttttgttcgggggttttgcgtggggtcgtgaacgattttttttttcgtcgggcgtagagt

SEQ ID NO: 19740 - DNA, 1426 bp, Artificial Sequence
  chemically treated genomic DNA (Homo sapiens) CpG-island No: 19740
actctacgcccgacgaaaaaaaaaatcgttcacgaccccacgcaaaacccccgaacaaaacgcgaaacctcgtccccccacgcaaccactactttcgtcgcgctcaaacccgacgacccgacccgacccgacgcacgccccgaaacgccctacttcgctctcgtaacgaaaacgctcctacgtcctaacgaacccccaaaacgacgaacgatccccgcgcgctacgcttcctctcgacaacgcgtccgactacgacgccctcattaaccgcgcgccccgccaccgaccattaactcgcaatacctattttacataaaccgctctaaccaatcgacgcgcgacgcctacttaacatacacgacgaccgccaatcaactaacgcgaaaaccgaaccaccacgtactattactaaactcgaacttctaaattattactaacgcgaccgacctatcccaacccaactctacatctatcaacattctcgacccgacccgaaacgctcgacccgtccccattaaccccaacccgacccgacgcccgcccccgaaacgcgaacgccgcctcccattaactctacgaaccgccgctctcccttatatatcaatttaaaaacctaaaacgaaaaataacgaccgaacgccgaaatccgcgaaatctaaaaatacgacgaccgaacgcgcgaaataaacgacgaacgaaaccgaccgaaacgaaccgaacaacgaccgccgccgtcccgaaacgaacgaacgcgaacgaaaaaataaaactaaactccctactaatcctactaaaaacgaccgaatacctaaaacgcaaaaatcgaaataacgctcgcaccccattatacgcccgcgacgataaacgaacgacgaaacgtaccgaacgaaaaccgctaaccgcgccgtatatccgcaaaaaccgaacacgactacgcctcgatactacccttcgacgacgacttcgccaaaaaaaaaacaaaaacgaccgacctaatacgcaaaaccccgaacaacaaataccgccccccgctcccgaccccgcccgacccgatccgaacccccgccgccgcccgaaacgtactctccgaaccccgattcccgacccgcgaccctcaacgccgccgccgcgcgccccgacgaccaacctaaaaaaaaaaacgcgcaaaccgcgaccgcaaccccgcccgaccgaccccgccctcgccgtcgccatcttcccgcgaccgcgcctcccgaaccgctcgcgtaaacaataccacgcgtacaacgcccgccgccgaaatccgctcccgcgcccgctccccgcccccgaattattctaaacttttccaaacgataaaaaaattatcaacgaacgctaaccgataccccgtaaatctaaaaaaacaaactcaaccaaaatctacgaaaactaccgaccctaa

SEQ ID NO: 19741 - DNA, 834 bp, Artificial Sequence
  chemically treated genomic DNA (Homo sapiens) CpG-island No: 19741
tgcggaggtaggggggtcggggtcgaggggggttcggttaaggaagaggaggcgcgtatcgcgggtcgtattttttattggggcggcgggtgtagggggtggttcgtaagcgggtggggcgcgttcggttcggtttaggcggtttttaggcggcgcgcgggttcgggttttgagtttttttgttgtagcgtttgtagtttgcgttcgcggtttcgttttagttttagttagtgttgcgtttttagttgcgtttgtaggtcggggaacgcgtcggcgcgggtagggacgtttttatcgtttttcgcgttcgtcgttgcgtatttttcggtcgcggatcggattcgattttttcgttattttcgtttcgggacgtcggtttttgcgcgtcgcgttcgttatttttattcggtttcggtttttagtcgttcgggttttttttattaattcggatttattcggggtttggggcgcgcggttcgcggcgtcgatacgtgtagtaaggtcgtttgtttgttgcgttcggtcgtttttttcgagattttgcgtcgtagttgttgtacgcgttcgttttgcgagggcgtcgtcggggtcgtcgtaagggtttttttttttttttatttggcgggcgacgcggcgggtttaggagtaggtcggcgggaggtttaggttagatttaggatgttattcgtgtttaagcgacgcgggggtaaggagttacgtagtcggagaggtttatcggaatgatttaggatagatagcgaggtttaggggtcgcggcgcgtttttagatagtattatcgtttaggggttggaggggttgggggagtttttagt
